United States Patent 11,332,783 (SAMPLE ANALYSIS, PRESENCE DETERMINATION OF A TARGET SEQUENCE) - sequence listing, part 23

SEQ ID NO: 437700 - DNA, 140 bp, Artificial Sequence
  Synthetic
caccgctgtcccaaaaggtcaagtaaagaataaagcctttgactcattactacctgttacattcttagtagtaggatcatacatgtcggaaataacaagatccacttgttggccgacacgcatatcagcagccagggcct

SEQ ID NO: 437701 - DNA, 140 bp, Artificial Sequence
  Synthetic
atacgccatgctgggtctccccctggattctggtgatgcgtcacctcaggtccttaaggctttacaaaaagctgttaacgtggctaaaaatgcttatgagaaagataagtctgtagcccgcgtacttgggagtcggccat

SEQ ID NO: 437702 - DNA, 140 bp, Artificial Sequence
  Synthetic
atggccgactcccaagtacgcgggctacagacttatctttctcataagcatttttagccacgttaacagctttttgtaaagccttaaggacctgaggtgacgcatcaccagaatccagggggagacccagcatggcgtat

SEQ ID NO: 437703 - DNA, 140 bp, Artificial Sequence
  Synthetic
aggccctggctgctgatatgattaaaataacagaacactcttggagcgttgaactttatgaacttatgggaaaatttgcttggtggactgttttctgcaccaatgcaaatgcatcctcatgaccttttgggacagcggtg

SEQ ID NO: 437704 - DNA, 140 bp, Artificial Sequence
  Synthetic
caccgctgtcccaaaaggtcatgaggatgcatttgcattggtgcagaaaacagtccaccaagcaaattttcccataagttcataaagttcaacgctccaagagtgttctgttattttaatcatatcagcagccagggcct

SEQ ID NO: 437705 - DNA, 140 bp, Artificial Sequence
  Synthetic
atacgccatgctgggtctccgggcgttcttattctaacatatcacttgcataccagggtctttttcccaagcagggagaccttgggcagcagtatgtctattctgtggcacatgctgatgcgtacttgggagtcggccat

SEQ ID NO: 437706 - DNA, 140 bp, Artificial Sequence
  Synthetic
atggccgactcccaagtacgcatcagcatgtgccacagaatagacatactgctgcccaaggtctccctgcttgggaaaaagaccctggtatgcaagtgatatgttagaataagaacgcccggagacccagcatggcgtat

SEQ ID NO: 437707 - DNA, 140 bp, Artificial Sequence
  Synthetic
atacgccatgctgggtctccctgaaggattcctcttaggtattaattacttgggtactattaaagaaaatatagatggtggtgctatgcacgccaactatatattttggagaaattccaccgtacttgggagtcggccat

SEQ ID NO: 437708 - DNA, 140 bp, Artificial Sequence
  Synthetic
atggccgactcccaagtacggtggaatttctccaaaatatatagttggcgtgcatagcaccaccatctatattttctttaatagtacccaagtaattaatacctaagaggaatccttcagggagacccagcatggcgtat

SEQ ID NO: 437709 - DNA, 140 bp, Artificial Sequence
  Synthetic
aggccctggctgctgatatgtatgaccatgcctaagacttgtttcggacccatagtccgaaagatctttgttgatggcgtgccatttgtagtatcttgtggttatcactacaaagaattagaccttttgggacagcggtg

SEQ ID NO: 437710 - DNA, 140 bp, Artificial Sequence
  Synthetic
caccgctgtcccaaaaggtctaattctttgtagtgataaccacaagatactacaaatggcacgccatcaacaaagatctttcggactatgggtccgaaacaagtcttaggcatggtcatacatatcagcagccagggcct

SEQ ID NO: 437711 - DNA, 140 bp, Artificial Sequence
  Synthetic
atacgccatgctgggtctcctcctatgaatctgagtacttactcactttttgatttatccaagtttcaattaaaattaaaaggaacaccagttcttcaattaaaggagagtcaaattaaccgtacttgggagtcggccat

SEQ ID NO: 437712 - DNA, 140 bp, Artificial Sequence
  Synthetic
atggccgactcccaagtacggttaatttgactctcctttaattgaagaactggtgttccttttaattttaattgaaacttggataaatcaaaaagtgagtaagtactcagattcataggaggagacccagcatggcgtat

SEQ ID NO: 437713 - DNA, 140 bp, Artificial Sequence
  Synthetic
aggccctggctgctgatatgtaaaattaaaaggaacaccagttcttcaattaaaggagagtcaaattaacgaactcgtaatatctctcctgtcgcagggtaagttacttatccgtgacaagaccttttgggacagcggtg

SEQ ID NO: 437714 - DNA, 140 bp, Artificial Sequence
  Synthetic
caccgctgtcccaaaaggtcttgtcacggataagtaacttaccctgcgacaggagagatattacgagttcgttaatttgactctcctttaattgaagaactggtgttccttttaattttacatatcagcagccagggcct

SEQ ID NO: 437715 - DNA, 140 bp, Artificial Sequence
  Synthetic
aggccctggctgctgatatgtgatacactcagtgtttctactgatgttcttgttaacacctacagaaagttacgttgatgtagggccagattctgttaagtctgcttgtattgaggttgagaccttttgggacagcggtg

SEQ ID NO: 437716 - DNA, 140 bp, Artificial Sequence
  Synthetic
caccgctgtcccaaaaggtctcaacctcaatacaagcagacttaacagaatctggccctacatcaacgtaactttctgtaggtgttaacaagaacatcagtagaaacactgagtgtatcacatatcagcagccagggcct

SEQ ID NO: 437717 - DNA, 140 bp, Artificial Sequence
  Synthetic
atacgccatgctgggtctcctgctacaatatggttacccatctcgtagcatgacagtatatgttttcaaaatgctagtactatggctactttggccagcttcaatggcgctctccattttcgtacttgggagtcggccat

SEQ ID NO: 437718 - DNA, 140 bp, Artificial Sequence
  Synthetic
atggccgactcccaagtacgaaaatggagagcgccattgaagctggccaaagtagccatagtactagcattttgaaaacatatactgtcatgctacgagatgggtaaccatattgtagcaggagacccagcatggcgtat

SEQ ID NO: 437719 - DNA, 140 bp, Artificial Sequence
  Synthetic
atacgccatgctgggtctcctgatctttatgagttgatgggaaaatttgcttggtggactgttttctgcaccaatgccaatgcatcctcttctgaaggatttctcatcggtgttaattaccgtacttgggagtcggccat

SEQ ID NO: 437720 - DNA, 140 bp, Artificial Sequence
  Synthetic
atggccgactcccaagtacggtaattaacaccgatgagaaatccttcagaagaggatgcattggcattggtgcagaaaacagtccaccaagcaaattttcccatcaactcataaagatcaggagacccagcatggcgtat

SEQ ID NO: 437721 - DNA, 140 bp, Artificial Sequence
  Synthetic
atacgccatgctgggtctccctaaggctgacggtattatataccctcaaggccgtacatattctaacataactatcacttatcaaggtctttttccctatcagggagaccatggtgatatcgtacttgggagtcggccat

SEQ ID NO: 437722 - DNA, 140 bp, Artificial Sequence
  Synthetic
atggccgactcccaagtacgatatcaccatggtctccctgatagggaaaaagaccttgataagtgatagttatgttagaatatgtacggccttgagggtatataataccgtcagccttagggagacccagcatggcgtat

SEQ ID NO: 437723 - DNA, 140 bp, Artificial Sequence
  Synthetic
atacgccatgctgggtctcctgcctcccttaattcttttaaggagtactttaacttacaccagtgtaagtttatgacttcatataatattactgaagatgagcacgacgagtggtttggtcgtacttgggagtcggccat

SEQ ID NO: 437724 - DNA, 140 bp, Artificial Sequence
  Synthetic
atggccgactcccaagtacgaccaaaccactcgtcgtgctcatcttcagtaatattatatgaagtcataaacttacactggtgtaagttaaagtactccttaaaagaattaagggaggcaggagacccagcatggcgtat

SEQ ID NO: 437725 - DNA, 140 bp, Artificial Sequence
  Synthetic
atacgccatgctgggtctccgtatgtttactctgcaggacatgctacaggcacaactccacaaaagttgtttgtagctaactattctcaggacgtcaaacagtttgctaatgggtttgtccgtacttgggagtcggccat

SEQ ID NO: 437726 - DNA, 140 bp, Artificial Sequence
  Synthetic
atggccgactcccaagtacggacaaacccattagcaaactgtttgacgtcctgagaatagttagctacaaacaacttttgtggagttgtgcctgtagcatgtcctgcagagtaaacatacggagacccagcatggcgtat

SEQ ID NO: 437727 - DNA, 140 bp, Artificial Sequence
  Synthetic
aggccctggctgctgatatggcagacatttgctacaatttcgtcctttgggattatgaacgtagcaatatttatggtactgccactattggtgtatgtaagtacactgatattgatgttagaccttttgggacagcggtg

SEQ ID NO: 437728 - DNA, 140 bp, Artificial Sequence
  Synthetic
caccgctgtcccaaaaggtctaacatcaatatcagtgtacttacatacaccaatagtggcagtaccataaatattgctacgttcataatcccaaaggacgaaattgtagcaaatgtctgccatatcagcagccagggcct

SEQ ID NO: 437729 - DNA, 140 bp, Artificial Sequence
  Synthetic
atacgccatgctgggtctccgtccgtataggagcagctgccaattccactggcactgttattattagcccatctaccagcgctactatacgaaaaatttaccctgcttttatgctgggttcgtacttgggagtcggccat

SEQ ID NO: 437730 - DNA, 140 bp, Artificial Sequence
  Synthetic
atggccgactcccaagtacgaacccagcataaaagcagggtaaatttttcgtatagtagcgctggtagatgggctaataataacagtgccagtggaattggcagctgctcctatacggacggagacccagcatggcgtat

SEQ ID NO: 437731 - DNA, 140 bp, Artificial Sequence
  Synthetic
atacgccatgctgggtctccctcttaagtattacactgttataccacgcagtattaggtcgcgtttttatgagcgcgaggcctgggctgctttttatgtgtataagcttcatagtctgaccgtacttgggagtcggccat

SEQ ID NO: 437732 - DNA, 140 bp, Artificial Sequence
  Synthetic
atggccgactcccaagtacggtcagactatgaagcttatacacataaaaagcagcccaggcctcgcgctcataaaaacgcgacctaatactgcgtggtataacagtgtaatacttaagagggagacccagcatggcgtat

SEQ ID NO: 437733 - DNA, 140 bp, Artificial Sequence
  Synthetic
atacgccatgctgggtctcccttcagttggtaatttctcagatggtaaaatgggccgcttcttcaatcatactctagttcttttgcccgatggatgtggcactttacttagagctttttacgtacttgggagtcggccat

SEQ ID NO: 437734 - DNA, 140 bp, Artificial Sequence
  Synthetic
atggccgactcccaagtacgtaaaaagctctaagtaaagtgccacatccatcgggcaaaagaactagagtatgattgaagaagcggcccattttaccatctgagaaattaccaactgaagggagacccagcatggcgtat

SEQ ID NO: 437735 - DNA, 140 bp, Artificial Sequence
  Synthetic
aggccctggctgctgatatgactctagttcttttgcccgatggatgtggcactttacttagagctttttattgtattctagagcctcgctctggaaatcattgtcctgctggcaattcctgaccttttgggacagcggtg

SEQ ID NO: 437736 - DNA, 140 bp, Artificial Sequence
  Synthetic
caccgctgtcccaaaaggtcaggaattgccagcaggacaatgatttccagagcgaggctctagaatacaataaaaagctctaagtaaagtgccacatccatcgggcaaaagaactagagtcatatcagcagccagggcct

SEQ ID NO: 437737 - DNA, 140 bp, Artificial Sequence
  Synthetic
atacgccatgctgggtctccatacttcttttgccacttatcacactcctgcaacagattgttctgatggcaattacaatcgtaatgccagtctgaactcttttaaggagtattttaatttcgtacttgggagtcggccat

SEQ ID NO: 437738 - DNA, 140 bp, Artificial Sequence
  Synthetic
atggccgactcccaagtacgaaattaaaatactccttaaaagagttcagactggcattacgattgtaattgccatcagaacaatctgttgcaggagtgtgataagtggcaaaagaagtatggagacccagcatggcgtat

SEQ ID NO: 437739 - DNA, 140 bp, Artificial Sequence
  Synthetic
aggccctggctgctgatatgaattacaatcgtaatgccagtctgaactcttttaaggagtattttaatttacgtaactgcacctttatgtacacttataacattaccgaagatgagatttgaccttttgggacagcggtg

SEQ ID NO: 437740 - DNA, 140 bp, Artificial Sequence
  Synthetic
caccgctgtcccaaaaggtcaaatctcatcttcggtaatgttataagtgtacataaaggtgcagttacgtaaattaaaatactccttaaaagagttcagactggcattacgattgtaattcatatcagcagccagggcct

SEQ ID NO: 437741 - DNA, 140 bp, Artificial Sequence
  Synthetic
atacgccatgctgggtctcccagaaccacttaaactttttgctgctgagacattacgtgccactgaggaggcatctaagcagtcctatgctatagccaccatcaaggaaattgttggtgacgtacttgggagtcggccat

SEQ ID NO: 437742 - DNA, 140 bp, Artificial Sequence
  Synthetic
atggccgactcccaagtacgtcaccaacaatttccttgatggtggctatagcataggactgcttagatgcctcctcagtggcacgtaatgtctcagcagcaaaaagtttaagtggttctgggagacccagcatggcgtat

SEQ ID NO: 437743 - DNA, 140 bp, Artificial Sequence
  Synthetic
aggccctggctgctgatatgtctcggtatgttgatttgtacggcggcaatatgtttcaatttgccaccttgcctgtttatgatactattaagtattactctatcattcctcacagtattcgaccttttgggacagcggtg

SEQ ID NO: 437744 - DNA, 140 bp, Artificial Sequence
  Synthetic
caccgctgtcccaaaaggtcgaatactgtgaggaatgatagagtaatacttaatagtatcataaacaggcaaggtggcaaattgaaacatattgccgccgtacaaatcaacataccgagacatatcagcagccagggcct

SEQ ID NO: 437745 - DNA, 140 bp, Artificial Sequence
  Synthetic
aggccctggctgctgatatggttctatccaaagtgatagaaaagcttgggctgccttctacgtatataaacttcaaccgttaactttcctgttggatttttctgttgatggttatatacggaccttttgggacagcggtg

SEQ ID NO: 437746 - DNA, 140 bp, Artificial Sequence
  Synthetic
caccgctgtcccaaaaggtccgtatataaccatcaacagaaaaatccaacaggaaagttaacggttgaagtttatatacgtagaaggcagcccaagcttttctatcactttggatagaaccatatcagcagccagggcct

SEQ ID NO: 437747 - DNA, 140 bp, Artificial Sequence
  Synthetic
atacgccatgctgggtctcccagagctatagactgtggttttaatgatttgtcacaactccactgctcatatgaatccttcgatgttgaatctggagtttattcagtttcgtctttcgaacgtacttgggagtcggccat

SEQ ID NO: 437748 - DNA, 140 bp, Artificial Sequence
  Synthetic
atggccgactcccaagtacgttcgaaagacgaaactgaataaactccagattcaacatcgaaggattcatatgagcagtggagttgtgacaaatcattaaaaccacagtctatagctctgggagacccagcatggcgtat

SEQ ID NO: 437749 - DNA, 140 bp, Artificial Sequence
  Synthetic
atacgccatgctgggtctcctataaaggcagtgttacgcatgatgctagctctgccattaatagacctcaattaacttttgtcaagagtttcatagctgccaaccccgcttggagtaaggcgtacttgggagtcggccat

SEQ ID NO: 437750 - DNA, 140 bp, Artificial Sequence
  Synthetic
atggccgactcccaagtacgccttactccaagcggggttggcagctatgaaactcttgacaaaagttaattgaggtctattaatggcagagctagcatcatgcgtaacactgcctttataggagacccagcatggcgtat

SEQ ID NO: 437751 - DNA, 140 bp, Artificial Sequence
  Synthetic
atacgccatgctgggtctccgcaaaaccttctggctcagttgtggaacaggctgaaggtgttgaatgtgatttttcacctcttctgtctggcacacctcctcaggtttataatttcaagccgtacttgggagtcggccat

SEQ ID NO: 437752 - DNA, 140 bp, Artificial Sequence
  Synthetic
atggccgactcccaagtacggcttgaaattataaacctgaggaggtgtgccagacagaagaggtgaaaaatcacattcaacaccttcagcctgttccacaactgagccagaaggttttgcggagacccagcatggcgtat

SEQ ID NO: 437753 - DNA, 140 bp, Artificial Sequence
  Synthetic
atacgccatgctgggtctccgtttggtttttaccaattgcaattataatcttaccaaattgctttcacttttttctgtgaatgattttacttgtagtcaaatatctccagcagcaattgccgtacttgggagtcggccat

SEQ ID NO: 437754 - DNA, 140 bp, Artificial Sequence
  Synthetic
atggccgactcccaagtacggcaattgctgctggagatatttgactacaagtaaaatcattcacagaaaaaagtgaaagcaatttggtaagattataattgcaattggtaaaaaccaaacggagacccagcatggcgtat

SEQ ID NO: 437755 - DNA, 140 bp, Artificial Sequence
  Synthetic
aggccctggctgctgatatgttttctgtgaatgattttacttgtagtcaaatatctccagcagcaattgctagcaactgttattcttcactgattttggattacttttcatacccacttagaccttttgggacagcggtg

SEQ ID NO: 437756 - DNA, 140 bp, Artificial Sequence
  Synthetic
caccgctgtcccaaaaggtctaagtgggtatgaaaagtaatccaaaatcagtgaagaataacagttgctagcaattgctgctggagatatttgactacaagtaaaatcattcacagaaaacatatcagcagccagggcct

SEQ ID NO: 437757 - DNA, 140 bp, Artificial Sequence
  Synthetic
atacgccatgctgggtctccttgatctatccaagttttcaataaaattaaaaggcacgcccgtgcttcaattaaaagagggtcagattaacgaactcgttatatcactcttgtcgcaaggcgtacttgggagtcggccat

SEQ ID NO: 437758 - DNA, 140 bp, Artificial Sequence
  Synthetic
atggccgactcccaagtacgccttgcgacaagagtgatataacgagttcgttaatctgaccctcttttaattgaagcacgggcgtgccttttaattttattgaaaacttggatagatcaaggagacccagcatggcgtat

SEQ ID NO: 437759 - DNA, 140 bp, Artificial Sequence
  Synthetic
atacgccatgctgggtctccttttactgattataaggtacagctctttgagaagtactttaagcactgggatcagccataccatgctaattgtgtggcgtgtgctgatgatcgttgtgttcgtacttgggagtcggccat

SEQ ID NO: 437760 - DNA, 140 bp, Artificial Sequence
  Synthetic
atggccgactcccaagtacgaacacaacgatcatcagcacacgccacacaattagcatggtatggctgatcccagtgcttaaagtacttctcaaagagctgtaccttataatcagtaaaaggagacccagcatggcgtat

SEQ ID NO: 437761 - DNA, 140 bp, Artificial Sequence
  Synthetic
atacgccatgctgggtctccaattataaacagtccttttctaatcccacatgtttgattttagcgactgttcctcataaccttactactattactaagcctcttaagtacagctatattacgtacttgggagtcggccat

SEQ ID NO: 437762 - DNA, 140 bp, Artificial Sequence
  Synthetic
atggccgactcccaagtacgtaatatagctgtacttaagaggcttagtaatagtagtaaggttatgaggaacagtcgctaaaatcaaacatgtgggattagaaaaggactgtttataattggagacccagcatggcgtat

SEQ ID NO: 437763 - DNA, 140 bp, Artificial Sequence
  Synthetic
atacgccatgctgggtctccacaagtgctctcgtcttctttctgatgatcgtactgaagtacctcagttagtgaacgctaatcaatactcaccctgtgtatccattgtcccatccactgtcgtacttgggagtcggccat

SEQ ID NO: 437764 - DNA, 140 bp, Artificial Sequence
  Synthetic
atggccgactcccaagtacgacagtggatgggacaatggatacacagggtgagtattgattagcgttcactaactgaggtacttcagtacgatcatcagaaagaagacgagagcacttgtggagacccagcatggcgtat

SEQ ID NO: 437765 - DNA, 140 bp, Artificial Sequence
  Synthetic
atacgccatgctgggtctccgtgggaagacggtgattattataggaaacaactatctccacttgaaggtggtggctggcttgttgctagtggctcaactgttgccatgactgagcaattacgtacttgggagtcggccat

SEQ ID NO: 437766 - DNA, 140 bp, Artificial Sequence
  Synthetic
atggccgactcccaagtacgtaattgctcagtcatggcaacagttgagccactagcaacaagccagccaccaccttcaagtggagatagttgtttcctataataatcaccgtcttcccacggagacccagcatggcgtat

SEQ ID NO: 437767 - DNA, 140 bp, Artificial Sequence
  Synthetic
atacgccatgctgggtctccaatcagggctttcaaggcaaacaaatcttaggtagtagtatgctggaggatgaattcacccctgaagatgttaacatgcagatcatgggtgttgtaatgccgtacttgggagtcggccat

SEQ ID NO: 437768 - DNA, 140 bp, Artificial Sequence
  Synthetic
atggccgactcccaagtacggcattacaacacccatgatctgcatgttaacatcttcaggggtgaattcatcctccagcatactactacctaagatttgtttgccttgaaagccctgattggagacccagcatggcgtat

SEQ ID NO: 437769 - DNA, 140 bp, Artificial Sequence
  Synthetic
atacgccatgctgggtctcccagatgggctttggtattacagttcaatatggtacagacaccaatagtgtttgccccaagcttgaatttgctaatgacacaaaaattgcctctcaattagcgtacttgggagtcggccat

SEQ ID NO: 437770 - DNA, 140 bp, Artificial Sequence
  Synthetic
atggccgactcccaagtacgctaattgagaggcaatttttgtgtcattagcaaattcaagcttggggcaaacactattggtgtctgtaccatattgaactgtaataccaaagcccatctgggagacccagcatggcgtat

SEQ ID NO: 437771 - DNA, 140 bp, Artificial Sequence
  Synthetic
atacgccatgctgggtctccgcaattgcgtggaatattccctctatggtgtttcgggccgtggtgtttttcagaattgcacagctgtaggtgttcgacagcagcgctttgtttatgatgccgtacttgggagtcggccat

SEQ ID NO: 437772 - DNA, 140 bp, Artificial Sequence
  Synthetic
atggccgactcccaagtacggcatcataaacaaagcgctgctgtcgaacacctacagctgtgcaattctgaaaaacaccacggcccgaaacaccatagagggaatattccacgcaattgcggagacccagcatggcgtat

SEQ ID NO: 437773 - DNA, 140 bp, Artificial Sequence
  Synthetic
atacgccatgctgggtctccgtaccagaatttagttggctattattctgatgatggcaactactactgtttgcgtgcttgtgttagtgttcctgtttctgtcatctatgataaagaaactcgtacttgggagtcggccat

SEQ ID NO: 437774 - DNA, 140 bp, Artificial Sequence
  Synthetic
atggccgactcccaagtacgagtttctttatcatagatgacagaaacaggaacactaacacaagcacgcaaacagtagtagttgccatcatcagaataatagccaactaaattctggtacggagacccagcatggcgtat

SEQ ID NO: 437775 - DNA, 140 bp, Artificial Sequence
  Synthetic
atacgccatgctgggtctccaaaacccacgctactctatttggtagtgttgcatgtgaacacatttcttctaccatgtctcaatactcccgttctacgcgatcaatgcttaaacggcgagcgtacttgggagtcggccat

SEQ ID NO: 437776 - DNA, 140 bp, Artificial Sequence
  Synthetic
atggccgactcccaagtacgctcgccgtttaagcattgatcgcgtagaacgggagtattgagacatggtagaagaaatgtgttcacatgcaacactaccaaatagagtagcgtgggttttggagacccagcatggcgtat

SEQ ID NO: 437777 - DNA, 140 bp, Artificial Sequence
  Synthetic
atacgccatgctgggtctccggtttgaatggcgactttaatttgacacttttgcaagtacccaaagttgttaccagtgagtacagctacaggagtgccattgaagacttgctgtttaacacgtacttgggagtcggccat

SEQ ID NO: 437778 - DNA, 140 bp, Artificial Sequence
  Synthetic
atggccgactcccaagtacgtgttaaacagcaagtcttcaatggcactcctgtagctgtactcactggtaacaactttgggtacttgcaaaagtgtcaaattaaagtcgccattcaaaccggagacccagcatggcgtat

SEQ ID NO: 437779 - DNA, 140 bp, Artificial Sequence
  Synthetic
atacgccatgctgggtctccaggtcactattgctgaccctggttacatgcaaggttatgatgagtgcatgaagcaaggacccccttctgctagggacctcatttgtgcgcagtttgtagccgtacttgggagtcggccat

SEQ ID NO: 437780 - DNA, 140 bp, Artificial Sequence
  Synthetic
atggccgactcccaagtacggctacaaactgcgcacaaatgaggtccctagcagaagggggtccttgcttcatgcactcatcataaccttgcatgtaaccagggtcagcaatagtgacctggagacccagcatggcgtat

SEQ ID NO: 437781 - DNA, 140 bp, Artificial Sequence
  Synthetic
atacgccatgctgggtctccctaagacgagaattctggtcgccaccaattctgaagatgtctttaacaagcttacagaagttaaagtgccagttggcttaactttttcttatgatggtctcgtacttgggagtcggccat

SEQ ID NO: 437782 - DNA, 140 bp, Artificial Sequence
  Synthetic
atggccgactcccaagtacgagaccatcataagaaaaagttaagccaactggcactttaacttctgtaagcttgttaaagacatcttcagaattggtggcgaccagaattctcgtcttagggagacccagcatggcgtat

SEQ ID NO: 437783 - DNA, 140 bp, Artificial Sequence
  Synthetic
atacgccatgctgggtctcctactaataaagagcaagctctagttcttacatccactggtgagcgtctctctcctgtcgatgagtttataaagcatgttcaagaggagggctcttttcatcgtacttgggagtcggccat

SEQ ID NO: 437784 - DNA, 140 bp, Artificial Sequence
  Synthetic
atggccgactcccaagtacgatgaaaagagccctcctcttgaacatgctttataaactcatcgacaggagagagacgctcaccagtggatgtaagaactagagcttgctctttattagtaggagacccagcatggcgtat

SEQ ID NO: 437785 - DNA, 140 bp, Artificial Sequence
  Synthetic
atacgccatgctgggtctccgcatcctcctttgctgctatacctttcgcacagagtgtcttctttcgtatgaacgggattggcatcactcagcaagttctctccgagaaccagaagcagacgtacttgggagtcggccat

SEQ ID NO: 437786 - DNA, 140 bp, Artificial Sequence
  Synthetic
atggccgactcccaagtacgtctgcttctggttctcggagagaacttgctgagtgatgccaatcccgttcatacgaaagaagacactctgtgcgaaaggtatagcagcaaaggaggatgcggagacccagcatggcgtat

SEQ ID NO: 437787 - DNA, 140 bp, Artificial Sequence
  Synthetic
atacgccatgctgggtctccgagcaattactgcgcgagtatggccagttttgttccaaaataaaccaggctctccatggtgccaatttacgccaggatgattctgtacgtaatttgtttgcgtacttgggagtcggccat

SEQ ID NO: 437788 - DNA, 140 bp, Artificial Sequence
  Synthetic
atggccgactcccaagtacgcaaacaaattacgtacagaatcatcctggcgtaaattggcaccatggagagcctggtttattttggaacaaaactggccatactcgcgcagtaattgctcggagacccagcatggcgtat

SEQ ID NO: 437789 - DNA, 140 bp, Artificial Sequence
  Synthetic
atacgccatgctgggtctccctcttcttgtatggaagttgacatgcgtcctgagtttttcaacaagaattggcccatgcctatcgacgctcttaaagctgatgggattatctaccctacacgtacttgggagtcggccat

SEQ ID NO: 437790 - DNA, 140 bp, Artificial Sequence
  Synthetic
atggccgactcccaagtacgtgtagggtagataatcccatcagctttaagagcgtcgataggcatgggccaattcttgttgaaaaactcaggacgcatgtcaacttccatacaagaagagggagacccagcatggcgtat

SEQ ID NO: 437791 - DNA, 140 bp, Artificial Sequence
  Synthetic
atacgccatgctgggtctcccgagcgtgaaaagctctcaatcatctcctatcataccaggttttggaggtgactttaatttgacacttctagaacctgtttctatatctactggcagtcgcgtacttgggagtcggccat

SEQ ID NO: 437792 - DNA, 140 bp, Artificial Sequence
  Synthetic
atggccgactcccaagtacgcgactgccagtagatatagaaacaggttctagaagtgtcaaattaaagtcacctccaaaacctggtatgataggagatgattgagagcttttcacgctcgggagacccagcatggcgtat

SEQ ID NO: 437793 - DNA, 140 bp, Artificial Sequence
  Synthetic
atacgccatgctgggtctccacaagctctatctaagttagcatcggagttatctaataccttcggtgctatatcttcgtccatcagtgacattctcaagcggcttgatgctgtagaacagcgtacttgggagtcggccat

SEQ ID NO: 437794 - DNA, 140 bp, Artificial Sequence
  Synthetic
atggccgactcccaagtacgctgttctacagcatcaagccgcttgagaatgtcactgatggacgaagatatagcaccgaaggtattagataactccgatgctaacttagatagagcttgtggagacccagcatggcgtat

SEQ ID NO: 437795 - DNA, 140 bp, Artificial Sequence
  Synthetic
atacgccatgctgggtctccgaggctcaaattgaccgtttgatcaatggtcgcctcacatccttgaacgcatttgttgctcaacaactcgtgcgttctgagacagctgccagatctgcaccgtacttgggagtcggccat

SEQ ID NO: 437796 - DNA, 140 bp, Artificial Sequence
  Synthetic
atggccgactcccaagtacggtgcagatctggcagctgtctcagaacgcacgagttgttgagcaacaaatgcgttcaaggatgtgaggcgaccattgatcaaacggtcaatttgagcctcggagacccagcatggcgtat

SEQ ID NO: 437797 - DNA, 140 bp, Artificial Sequence
  Synthetic
atacgccatgctgggtctcctttttctgtgaatgatttcacttgtagtcaaatatctccagcagcaatttctagtaactgttattcttcactgattttggattatttttcatacccacttcgtacttgggagtcggccat

SEQ ID NO: 437798 - DNA, 140 bp, Artificial Sequence
  Synthetic
atggccgactcccaagtacgaagtgggtatgaaaaataatccaaaatcagtgaagaataacagttactagaaattgctgctggagatatttgactacaagtgaaatcattcacagaaaaaggagacccagcatggcgtat

SEQ ID NO: 437799 - DNA, 140 bp, Artificial Sequence
  Synthetic
aggccctggctgctgatatgtaagtatcaagtcattgtcttaaaagacaatgtactttcttctatgcttagattgcacaccgttgagtcaggtgatattaacgttgttgcagcttccggagaccttttgggacagcggtg

SEQ ID NO: 437800 - DNA, 140 bp, Artificial Sequence
  Synthetic
caccgctgtcccaaaaggtctccggaagctgcaacaacgttaatatcacctgactcaacggtgtgcaatctaagcatagaagaaagtacattgtcttttaagacaatgacttgatacttacatatcagcagccagggcct

SEQ ID NO: 437801 - DNA, 140 bp, Artificial Sequence
  Synthetic
aggccctggctgctgatatgttgttggctgagtttgacacttatgaccctatttataagaatggtgccatgtataaggcaaaccaattctttgggtcaacaaagcatcttatgatactaagaccttttgggacagcggtg

SEQ ID NO: 437802 - DNA, 140 bp, Artificial Sequence
  Synthetic
caccgctgtcccaaaaggtcttagtatcataagatgctttgttgacccaaagaattggtttgccttatacatggcaccattcttataaatagggtcataagtgtcaaactcagccaacaacatatcagcagccagggcct

SEQ ID NO: 437803 - DNA, 140 bp, Artificial Sequence
  Synthetic
aggccctggctgctgatatggctgctattccatttgcacagagtatcttttataggttaaacggtgttggcattactcaacaggttctttcagagaaccaaaagcttattgccaataagtgaccttttgggacagcggtg

SEQ ID NO: 437804 - DNA, 140 bp, Artificial Sequence
  Synthetic
caccgctgtcccaaaaggtcacttattggcaataagcttttggttctctgaaagaacctgttgagtaatgccaacaccgtttaacctataaaagatactctgtgcaaatggaatagcagccatatcagcagccagggcct

SEQ ID NO: 437805 - DNA, 140 bp, Artificial Sequence
  Synthetic
atacgccatgctgggtctcctgcattgctcctattgacggctacttcgttcttaattctacaactactcgtgctgctgaccaggaatggtattacactggtagttctttctttagccctgcgtacttgggagtcggccat

SEQ ID NO: 437806 - DNA, 140 bp, Artificial Sequence
  Synthetic
atggccgactcccaagtacgcagggctaaagaaagaactaccagtgtaataccattcctggtcagcagcacgagtagttgtagaattaagaacgaagtagccgtcaataggagcaatgcaggagacccagcatggcgtat

SEQ ID NO: 437807 - DNA, 140 bp, Artificial Sequence
  Synthetic
aggccctggctgctgatatgcaatctctctgtgctcttcctgacacacctagtactcttacacctcgcagtgtgcgctctgttccaggtgaaatgcgcttggcatccattgcttttaatcgaccttttgggacagcggtg

SEQ ID NO: 437808 - DNA, 140 bp, Artificial Sequence
  Synthetic
caccgctgtcccaaaaggtcgattaaaagcaatggatgccaagcgcatttcacctggaacagagcgcacactgcgaggtgtaagagtactaggtgtgtcaggaagagcacagagagattgcatatcagcagccagggcct

SEQ ID NO: 437809 - DNA, 140 bp, Artificial Sequence
  Synthetic
atacgccatgctgggtctccagcctattacgatggcgaatgctcgttatgtttcgccagatactaagtacgagcaactcgataataaacttccacctcctctgcttagcaatcagacagacgtacttgggagtcggccat

SEQ ID NO: 437810 - DNA, 140 bp, Artificial Sequence
  Synthetic
atggccgactcccaagtacgtctgtctgattgctaagcagaggaggtggaagtttattatcgagttgctcgtacttagtatctggcgaaacataacgagcattcgccatcgtaataggctggagacccagcatggcgtat

SEQ ID NO: 437811 - DNA, 140 bp, Artificial Sequence
  Synthetic
atacgccatgctgggtctccttggagacatcatacaacgtcttgatgttctcgaacaggacgcccaaatagacagacttattaatggccgtttgacaacactaaatgcttttgttgcacacgtacttgggagtcggccat

SEQ ID NO: 437812 - DNA, 140 bp, Artificial Sequence
  Synthetic
atggccgactcccaagtacgtgtgcaacaaaagcatttagtgttgtcaaacggccattaataagtctgtctatttgggcgtcctgttcgagaacatcaagacgttgtatgatgtctccaaggagacccagcatggcgtat

SEQ ID NO: 437813 - DNA, 140 bp, Artificial Sequence
  Synthetic
aggccctggctgctgatatgacaattggcttaaaccttatggcggccaacctgtttctgagtaccatattactctagctttgctaaatctcactgatgaagatttagctagagatttttcgaccttttgggacagcggtg

SEQ ID NO: 437814 - DNA, 140 bp, Artificial Sequence
  Synthetic
caccgctgtcccaaaaggtcgaaaaatctctagctaaatcttcatcagtgagatttagcaaagctagagtaatatggtactcagaaacaggttggccgccataaggtttaagccaattgtcatatcagcagccagggcct

SEQ ID NO: 437815 - DNA, 140 bp, Artificial Sequence
  Synthetic
atacgccatgctgggtctccgcagcttgttcgttccgaatcagctgctctttccgctcaattggctaaagataaagtcaatgagtgtgtcaaggcacaatccaagcgttctggattttgccgtacttgggagtcggccat

SEQ ID NO: 437816 - DNA, 140 bp, Artificial Sequence
  Synthetic
atggccgactcccaagtacggcaaaatccagaacgcttggattgtgccttgacacactcattgactttatctttagccaattgagcggaaagagcagctgattcggaacgaacaagctgcggagacccagcatggcgtat

SEQ ID NO: 437817 - DNA, 140 bp, Artificial Sequence
  Synthetic
atacgccatgctgggtctccctatcaggagagatgaagatcctcaacgaggttgtcaagcaacttaatgagtcatacattgaccttaaggagcttggtaattatacctattaccagaaatcgtacttgggagtcggccat

SEQ ID NO: 437818 - DNA, 140 bp, Artificial Sequence
  Synthetic
atggccgactcccaagtacgatttctggtaataggtataattaccaagctccttaaggtcaatgtatgactcattaagttgcttgacaacctcgttgaggatcttcatctctcctgatagggagacccagcatggcgtat

SEQ ID NO: 437819 - DNA, 140 bp, Artificial Sequence
  Synthetic
atacgccatgctgggtctccggtcaaggcacacatatagtgtcctttgttgtaaatgcccctaatggcctttacttcatgcatgttggttattaccctagcaaccacattgaggttgtttcgtacttgggagtcggccat

SEQ ID NO: 437820 - DNA, 140 bp, Artificial Sequence
  Synthetic
atggccgactcccaagtacgaaacaacctcaatgtggttgctagggtaataaccaacatgcatgaagtaaaggccattaggggcatttacaacaaaggacactatatgtgtgccttgaccggagacccagcatggcgtat

SEQ ID NO: 437821 - DNA, 140 bp, Artificial Sequence
  Synthetic
atacgccatgctgggtctccaaagtattacctcctcttatggatgttaatatggaagccgcgtatacttcatctttgcttggcagcatagcaggtgttggctggactgctggcttatcctcgtacttgggagtcggccat

SEQ ID NO: 437822 - DNA, 140 bp, Artificial Sequence
  Synthetic
atggccgactcccaagtacgaggataagccagcagtccagccaacacctgctatgctgccaagcaaagatgaagtatacgcggcttccatattaacatccataagaggaggtaatactttggagacccagcatggcgtat

SEQ ID NO: 437823 - DNA, 140 bp, Artificial Sequence
  Synthetic
aggccctggctgctgatatggcaaatgtcccatactctcgtgttatttccaggatgggctttaaactcgatgcaacagttcctggatatcctaagcttttcattactcgtgaagaggctggaccttttgggacagcggtg

SEQ ID NO: 437824 - DNA, 140 bp, Artificial Sequence
  Synthetic
caccgctgtcccaaaaggtccagcctcttcacgagtaatgaaaagcttaggatatccaggaactgttgcatcgagtttaaagcccatcctggaaataacacgagagtatgggacatttgccatatcagcagccagggcct

SEQ ID NO: 437825 - DNA, 140 bp, Artificial Sequence
  Synthetic
atacgccatgctgggtctccgggcaagcttaagtgtaatcgttgctgtgacaagtacgatgattatgatgtagagccacataagattcatgtccattaacgaacttagttatgagagtgccgtacttgggagtcggccat

SEQ ID NO: 437826 - DNA, 140 bp, Artificial Sequence
  Synthetic
atggccgactcccaagtacggcactctcataactaagttcgttaatggacatgaatcttatgtggctctacatcataatcatcgtacttgtcacagcaacgattacacttaagcttgcccggagacccagcatggcgtat

SEQ ID NO: 437827 - DNA, 140 bp, Artificial Sequence
  Synthetic
atacgccatgctgggtctcctgtaatgcgtaattctaatggtgcttgtatttggaacgctgctgcatatatgaaactctcggatgcacttaaacgacagattcgcattgcatcaattgatcgtacttgggagtcggccat

SEQ ID NO: 437828 - DNA, 140 bp, Artificial Sequence
  Synthetic
atggccgactcccaagtacgatcaattgatgcaatgcgaatctgtcgtttaagtgcatccgagagtttcatatatgcagcagcgttccaaatacaagcaccattagaattacgcattacaggagacccagcatggcgtat

SEQ ID NO: 437829 - DNA, 140 bp, Artificial Sequence
  Synthetic
atacgccatgctgggtctccatactaagtatgttgcaccacaggtgacataccaaaacatttctactaacctccctcctcctcttctcggcaattccaccgggattgacttccaagatgacgtacttgggagtcggccat

SEQ ID NO: 437830 - DNA, 140 bp, Artificial Sequence
  Synthetic
atggccgactcccaagtacgtcatcttggaagtcaatcccggtggaattgccgagaagaggaggagggaggttagtagaaatgttttggtatgtcacctgtggtgcaacatacttagtatggagacccagcatggcgtat

SEQ ID NO: 437831 - DNA, 140 bp, Artificial Sequence
  Synthetic
atacgccatgctgggtctccgttggatgagtttttcaaaaatgttagcaccagtatacctaattttggttctctaacacagattaatactacattactcgatcttacctacgagatgttgcgtacttgggagtcggccat

SEQ ID NO: 437832 - DNA, 140 bp, Artificial Sequence
  Synthetic
atggccgactcccaagtacgcaacatctcgtaggtaagatcgagtaatgtagtattaatctgtgttagagaaccaaaattaggtatactggtgctaacatttttgaaaaactcatccaacggagacccagcatggcgtat

SEQ ID NO: 437833 - DNA, 140 bp, Artificial Sequence
  Synthetic
atacgccatgctgggtctcctctcttcaacaagttgttaaagcccttaatgagtcttacatagaccttaaagagcttggcaattatacttattacaacaaatggccgtggtacatttggccgtacttgggagtcggccat

SEQ ID NO: 437834 - DNA, 140 bp, Artificial Sequence
  Synthetic
atggccgactcccaagtacggccaaatgtaccacggccatttgttgtaataagtataattgccaagctctttaaggtctatgtaagactcattaagggctttaacaacttgttgaagagaggagacccagcatggcgtat

SEQ ID NO: 437835 - DNA, 140 bp, Artificial Sequence
  Synthetic
atacgccatgctgggtctccaacgaactttatggattacgtgtctttgcttaaccaggtttggcagcaatacactaattctgcagttattactggtacctacgttccaccaccagctgttcgtacttgggagtcggccat

SEQ ID NO: 437836 - DNA, 140 bp, Artificial Sequence
  Synthetic
atggccgactcccaagtacgaacagctggtggtggaacgtaggtaccagtaataactgcagaattagtgtattgctgccaaacctggttaagcaaagacacgtaatccataaagttcgttggagacccagcatggcgtat

SEQ ID NO: 437837 - DNA, 140 bp, Artificial Sequence
  Synthetic
aggccctggctgctgatatgtcgttgttgtgatagatacgaggaatacgacctcgagccgcataaggttcatgttcactaattaacgaactatcaatgagagttcaaagaccacccactcgaccttttgggacagcggtg

SEQ ID NO: 437838 - DNA, 140 bp, Artificial Sequence
  Synthetic
caccgctgtcccaaaaggtcgagtgggtggtctttgaactctcattgatagttcgttaattagtgaacatgaaccttatgcggctcgaggtcgtattcctcgtatctatcacaacaacgacatatcagcagccagggcct

SEQ ID NO: 437839 - DNA, 140 bp, Artificial Sequence
  Synthetic
aggccctggctgctgatatgatgttcactaattaacgaactatcaatgagagttcaaagaccacccactctcttgttagtgttctcactctctcttttggtcactgcattctcaaaacctgaccttttgggacagcggtg

SEQ ID NO: 437840 - DNA, 140 bp, Artificial Sequence
  Synthetic
caccgctgtcccaaaaggtcaggttttgagaatgcagtgaccaaaagagagagtgagaacactaacaagagagtgggtggtctttgaactctcattgatagttcgttaattagtgaacatcatatcagcagccagggcct

SEQ ID NO: 437841 - DNA, 140 bp, Artificial Sequence
  Synthetic
atacgccatgctgggtctcccattagcaaagcaggatgcagcacaacaggttgcctggcaattgcatcgccacggcaaactgtcaggcttcagccttcgatggcgttgtgtgtaatcgcacgtacttgggagtcggccat

SEQ ID NO: 437842 - DNA, 140 bp, Artificial Sequence
  Synthetic
atggccgactcccaagtacgtgcgattacacacaacgccatcgaaggctgaagcctgacagtttgccgtggcgatgcaattgccaggcaacctgttgtgctgcatcctgctttgctaatgggagacccagcatggcgtat

SEQ ID NO: 437843 - DNA, 140 bp, Artificial Sequence
  Synthetic
aggccctggctgctgatatgctctatgtacctgagcattgtcagaattattctggttgcatgcttagggcttgtattaaaactgcccaagctgatacagctggtctttatacaaattttcgaccttttgggacagcggtg

SEQ ID NO: 437844 - DNA, 140 bp, Artificial Sequence
  Synthetic
caccgctgtcccaaaaggtcgaaaatttgtataaagaccagctgtatcagcttgggcagttttaatacaagccctaagcatgcaaccagaataattctgacaatgctcaggtacatagagcatatcagcagccagggcct

SEQ ID NO: 437845 - DNA, 140 bp, Artificial Sequence
  Synthetic
atacgccatgctgggtctccaacgccatcacaatactgattcgaaactacgttatgctaaacgtagattctctcctcttaaaccatcagatgtaatggacatcgacccgcatccgggccccgtacttgggagtcggccat

SEQ ID NO: 437846 - DNA, 140 bp, Artificial Sequence
  Synthetic
atggccgactcccaagtacggggcccggatgcgggtcgatgtccattacatctgatggtttaagaggagagaatctacgtttagcataacgtagtttcgaatcagtattgtgatggcgttggagacccagcatggcgtat

SEQ ID NO: 437847 - DNA, 140 bp, Artificial Sequence
  Synthetic
atacgccatgctgggtctcccagtctttatttcaccttataattcacagaatgctgtggctcgttctatgctcggtttgtccactcagaccgtagattcttcgcagggttctgagtaccccgtacttgggagtcggccat

SEQ ID NO: 437848 - DNA, 140 bp, Artificial Sequence
  Synthetic
atggccgactcccaagtacggggtactcagaaccctgcgaagaatctacggtctgagtggacaaaccgagcatagaacgagccacagcattctgtgaattataaggtgaaataaagactgggagacccagcatggcgtat

SEQ ID NO: 437849 - DNA, 140 bp, Artificial Sequence
  Synthetic
atacgccatgctgggtctccttacattgtgctaatttcaatgtactcttttcaatgacaatgcctaagacatgcttcggaccgattgtccgtaagatttttgtcgatggtgttccttttgcgtacttgggagtcggccat

SEQ ID NO: 437850 - DNA, 140 bp, Artificial Sequence
  Synthetic
atggccgactcccaagtacgcaaaaggaacaccatcgacaaaaatcttacggacaatcggtccgaagcatgtcttaggcattgtcattgaaaagagtacattgaaattagcacaatgtaaggagacccagcatggcgtat

SEQ ID NO: 437851 - DNA, 140 bp, Artificial Sequence
  Synthetic
atacgccatgctgggtctccgctaagcctattactgagtatcatattacacttgctcttctatgttgcaaaccagacgagcaatttcatgatctcactccagtcgcaaacatgctcaaagcgtacttgggagtcggccat

SEQ ID NO: 437852 - DNA, 140 bp, Artificial Sequence
  Synthetic
atggccgactcccaagtacgctttgagcatgtttgcgactggagtgagatcatgaaattgctcgtctggtttgcaacatagaagagcaagtgtaatatgatactcagtaataggcttagcggagacccagcatggcgtat

SEQ ID NO: 437853 - DNA, 140 bp, Artificial Sequence
  Synthetic
aggccctggctgctgatatggttggcacttcattgcaccctgtgctgtggaactgtcagctatcctttgctggttatactgaatctgctgttaattctacaaaagctttggccaaacagggaccttttgggacagcggtg

SEQ ID NO: 437854 - DNA, 140 bp, Artificial Sequence
  Synthetic
caccgctgtcccaaaaggtccctgtttggccaaagcttttgtagaattaacagcagattcagtataaccagcaaaggatagctgacagttccacagcacagggtgcaatgaagtgccaaccatatcagcagccagggcct

SEQ ID NO: 437855 - DNA, 140 bp, Artificial Sequence
  Synthetic
atacgccatgctgggtctccacgcagctcagcgaatcgcttggttgctacataaggatggaggaatccctgatggatgttccctctacctccggcactcaagtttattcgcgcaaagcgacgtacttgggagtcggccat

SEQ ID NO: 437856 - DNA, 140 bp, Artificial Sequence
  Synthetic
atggccgactcccaagtacgtcgctttgcgcgaataaacttgagtgccggaggtagagggaacatccatcagggattcctccatccttatgtagcaaccaagcgattcgctgagctgcgtggagacccagcatggcgtat

SEQ ID NO: 437857 - DNA, 140 bp, Artificial Sequence
  Synthetic
atacgccatgctgggtctccaaagtggtgttaagaaagtgacgtatggtacctttcactggcttttagctacattggtattgtcgtacgtcgcagtcttgcaatgcaccaagtttacattcgtacttgggagtcggccat

SEQ ID NO: 437858 - DNA, 140 bp, Artificial Sequence
  Synthetic
atggccgactcccaagtacgaatgtaaacttggtgcattgcaagactgcgacgtacgacaataccaatgtagctaaaagccagtgaaaggtaccatacgtcactttcttaacaccactttggagacccagcatggcgtat

SEQ ID NO: 437859 - DNA, 140 bp, Artificial Sequence
  Synthetic
atacgccatgctgggtctccgatgaggccacacgctcttatataggtacccgtgcatatttcaagcagtatgtcacccgcattatagtggcaccccgctctttagagcttgtcactataccgtacttgggagtcggccat

SEQ ID NO: 437860 - DNA, 140 bp, Artificial Sequence
  Synthetic
atggccgactcccaagtacggtatagtgacaagctctaaagagcggggtgccactataatgcgggtgacatactgcttgaaatatgcacgggtacctatataagagcgtgtggcctcatcggagacccagcatggcgtat

SEQ ID NO: 437861 - DNA, 140 bp, Artificial Sequence
  Synthetic
atacgccatgctgggtctcctgtcttgcgtaattctaatggtgcttgtatttggaacgctgctgcatatatgaaactctcggatgcacttaaacgacagattcgcattgcatgccgtaagcgtacttgggagtcggccat

SEQ ID NO: 437862 - DNA, 140 bp, Artificial Sequence
  Synthetic
atggccgactcccaagtacgcttacggcatgcaatgcgaatctgtcgtttaagtgcatccgagagtttcatatatgcagcagcgttccaaatacaagcaccattagaattacgcaagacaggagacccagcatggcgtat

SEQ ID NO: 437863 - DNA, 140 bp, Artificial Sequence
  Synthetic
atacgccatgctgggtctccctatgtcagggttacattttcagaccccaacatgtggtatctacgttcgggtcatcatttacactcagttcacaattggcttaaaccttatggcggccaacgtacttgggagtcggccat

SEQ ID NO: 437864 - DNA, 140 bp, Artificial Sequence
  Synthetic
atggccgactcccaagtacgttggccgccataaggtttaagccaattgtgaactgagtgtaaatgatgacccgaacgtagataccacatgttggggtctgaaaatgtaaccctgacatagggagacccagcatggcgtat

SEQ ID NO: 437865 - DNA, 140 bp, Artificial Sequence
  Synthetic
aggccctggctgctgatatgtggacaggttcaaaccttctaccctcgactccaggcttctgcagattggaaacctggtcatgcaacttcattccactcctatgaatctgagtacttactcgaccttttgggacagcggtg

SEQ ID NO: 437866 - DNA, 140 bp, Artificial Sequence
  Synthetic
caccgctgtcccaaaaggtcgagtaagtactcagattcataggagtggaatgaagttgcatgaccaggtttccaatctgcagaagcctggagtcgagggtagaaggtttgaacctgtccacatatcagcagccagggcct

SEQ ID NO: 437867 - DNA, 140 bp, Artificial Sequence
  Synthetic
atacgccatgctgggtctccttttctaatggtgtgtttgggctctatttgaatcatactttagtgattttgcccgatggttgtggtaccaacctatgggtcttctattgtgtgcttgagccgtacttgggagtcggccat

SEQ ID NO: 437868 - DNA, 140 bp, Artificial Sequence
  Synthetic
atggccgactcccaagtacggctcaagcacacaatagaagacccataggttggtaccacaaccatcgggcaaaatcactaaagtatgattcaaatagagcccaaacacaccattagaaaaggagacccagcatggcgtat

SEQ ID NO: 437869 - DNA, 140 bp, Artificial Sequence
  Synthetic
aggccctggctgctgatatgatggcatcccctgctgcacctcgtgctgtttcctttgccgataacaatgatataacaaatacaaacctgtctcgaggtagaggacgtaatccaaaaccacgaccttttgggacagcggtg

SEQ ID NO: 437870 - DNA, 140 bp, Artificial Sequence
  Synthetic
caccgctgtcccaaaaggtcgtggttttggattacgtcctctacctcgagacaggtttgtatttgttatatcattgttatcggcaaaggaaacagcacgaggtgcagcaggggatgccatcatatcagcagccagggcct

SEQ ID NO: 437871 - DNA, 140 bp, Artificial Sequence
  Synthetic
atacgccatgctgggtctccgtaggttacagtgcagctttggctgttaatgcatgccttattccactcatactttgtcttaatcaggacacttgtatgcgtagtatagttaagaccctaacgtacttgggagtcggccat

SEQ ID NO: 437872 - DNA, 140 bp, Artificial Sequence
  Synthetic
atggccgactcccaagtacgttagggtcttaactatactacgcatacaagtgtcctgattaagacaaagtatgagtggaataaggcatgcattaacagccaaagctgcactgtaacctacggagacccagcatggcgtat

SEQ ID NO: 437873 - DNA, 140 bp, Artificial Sequence
  Synthetic
atacgccatgctgggtctccgcatcagagatctactgtgctaacatacatagatttaagcctgtgtatagagttaacacggcaatccctactattaaggattggcttctcgttcagggatcgtacttgggagtcggccat

SEQ ID NO: 437874 - DNA, 140 bp, Artificial Sequence
  Synthetic
atggccgactcccaagtacgatccctgaacgagaagccaatccttaatagtagggattgccgtgttaactctatacacaggcttaaatctatgtatgttagcacagtagatctctgatgcggagacccagcatggcgtat

SEQ ID NO: 437875 - DNA, 140 bp, Artificial Sequence
  Synthetic
atacgccatgctgggtctccactcccaaacctccttgaggtgtggcacgtgcatacgtagacctttcctttgctgcaagtgttgttatgaccacgttatagcaactcctcataagatggtcgtacttgggagtcggccat

SEQ ID NO: 437876 - DNA, 140 bp, Artificial Sequence
  Synthetic
atggccgactcccaagtacgaccatcttatgaggagttgctataacgtggtcataacaacacttgcagcaaaggaaaggtctacgtatgcacgtgccacacctcaaggaggtttgggagtggagacccagcatggcgtat

SEQ ID NO: 437877 - DNA, 140 bp, Artificial Sequence
  Synthetic
atacgccatgctgggtctcctttccctttaccatagtggcctccctttacatatgtcaatctctaaattgcatgcactggatgatgttactcgcaattacatcattacaatgccatgcttcgtacttgggagtcggccat

SEQ ID NO: 437878 - DNA, 140 bp, Artificial Sequence
  Synthetic
atggccgactcccaagtacgaagcatggcattgtaatgatgtaattgcgagtaacatcatccagtgcatgcaatttagagattgacatatgtaaagggaggccactatggtaaagggaaaggagacccagcatggcgtat

SEQ ID NO: 437879 - DNA, 140 bp, Artificial Sequence
  Synthetic
atacgccatgctgggtctccactatccatactttggtttgttgacagagttcgtttctgtctcatgctgaggtcctatattccacttattgacatgcgctctcattttgtgcgtgtcactcgtacttgggagtcggccat

SEQ ID NO: 437880 - DNA, 140 bp, Artificial Sequence
  Synthetic
atggccgactcccaagtacgagtgacacgcacaaaatgagagcgcatgtcaataagtggaatataggacctcagcatgagacagaaacgaactctgtcaacaaaccaaagtatggatagtggagacccagcatggcgtat

SEQ ID NO: 437881 - DNA, 140 bp, Artificial Sequence
  Synthetic
atacgccatgctgggtctcctaaaggcggtatacgtaaggctaaagattatggctttacggtatttgtctgtattgataattctgctaataccaagatcctgcgtagtaagggtgttgatcgtacttgggagtcggccat

SEQ ID NO: 437882 - DNA, 140 bp, Artificial Sequence
  Synthetic
atggccgactcccaagtacgatcaacacccttactacgcaggatcttggtattagcagaattatcaatacagacaaataccgtaaagccataatctttagccttacgtataccgcctttaggagacccagcatggcgtat

SEQ ID NO: 437883 - DNA, 140 bp, Artificial Sequence
  Synthetic
atacgccatgctgggtctccgtactcctgatgatacgttcctatacaggtattattccctaaaggctaaggttgctgggtggaagatgcttgtatgtgataaggcccgctctttgaggttcgtacttgggagtcggccat

SEQ ID NO: 437884 - DNA, 140 bp, Artificial Sequence
  Synthetic
atggccgactcccaagtacgaacctcaaagagcgggccttatcacatacaagcatcttccacccagcaaccttagcctttagggaataatacctgtataggaacgtatcatcaggagtacggagacccagcatggcgtat

SEQ ID NO: 437885 - DNA, 140 bp, Artificial Sequence
  Synthetic
atacgccatgctgggtctccaactggtgtgaactttgttgttcagccagttggtgttgtagacactgagtggggtaacatgttaacgggcattgctgcccgtcctccaccaggtgaacagcgtacttgggagtcggccat

SEQ ID NO: 437886 - DNA, 140 bp, Artificial Sequence
  Synthetic
atggccgactcccaagtacgctgttcacctggtggaggacgggcagcaatgcccgttaacatgttaccccactcagtgtctacaacaccaactggctgaacaacaaagttcacaccagttggagacccagcatggcgtat

SEQ ID NO: 437887 - DNA, 140 bp, Artificial Sequence
  Synthetic
atacgccatgctgggtctccattctgttgcttacattgagtgcacttatattagtcgtttcagcaaagtacagcttgtgtctgtaactgaattttcgctgaacaaccaccgatctactgtcgtacttgggagtcggccat

SEQ ID NO: 437888 - DNA, 140 bp, Artificial Sequence
  Synthetic
atggccgactcccaagtacgacagtagatcggtggttgttcagcgaaaattcagttacagacacaagctgtactttgctgaaacgactaatataagtgcactcaatgtaagcaacagaatggagacccagcatggcgtat

SEQ ID NO: 437889 - DNA, 140 bp, Artificial Sequence
  Synthetic
atacgccatgctgggtctccgtagctgctttagctgtcaatgtgtgtctcattcccctattattactgctacgtcaagatacttgtcgtcgcagcattatcagaactatggttctctattcgtacttgggagtcggccat

SEQ ID NO: 437890 - DNA, 140 bp, Artificial Sequence
  Synthetic
atggccgactcccaagtacgaatagagaaccatagttctgataatgctgcgacgacaagtatcttgacgtagcagtaataataggggaatgagacacacattgacagctaaagcagctacggagacccagcatggcgtat

SEQ ID NO: 437891 - DNA, 140 bp, Artificial Sequence
  Synthetic
atacgccatgctgggtctccgctaatccatttagtctctccttggacatttggaaaacgaactatgttaccctttgtccaagaacaaatagggtcattcatagtaaactttttcatttttcgtacttgggagtcggccat

SEQ ID NO: 437892 - DNA, 140 bp, Artificial Sequence
  Synthetic
atggccgactcccaagtacgaaaaatgaaaaagtttactatgaatgaccctatttgttcttggacaaagggtaacatagttcgttttccaaatgtccaaggagagactaaatggattagcggagacccagcatggcgtat

SEQ ID NO: 437893 - DNA, 140 bp, Artificial Sequence
  Synthetic
aggccctggctgctgatatgactttggtttgtagatagaattcgtttctgtctcatgctgaattcctacattccactgtttgacatgcgttcccactttattcgtgttagtacagtttctgaccttttgggacagcggtg

SEQ ID NO: 437894 - DNA, 140 bp, Artificial Sequence
  Synthetic
caccgctgtcccaaaaggtcagaaactgtactaacacgaataaagtgggaacgcatgtcaaacagtggaatgtaggaattcagcatgagacagaaacgaattctatctacaaaccaaagtcatatcagcagccagggcct

SEQ ID NO: 437895 - DNA, 140 bp, Artificial Sequence
  Synthetic
atacgccatgctgggtctccaacctgccatatatgtttataacactggacgttcagtctatgtgaagtttcaagagagtaagcccccactaccccctgatgagtgggtttaacgaactctcgtacttgggagtcggccat

SEQ ID NO: 437896 - DNA, 140 bp, Artificial Sequence
  Synthetic
atggccgactcccaagtacgagagttcgttaaacccactcatcagggggtagtgggggcttactctcttgaaacttcacatagactgaacgtccagtgttataaacatatatggcaggttggagacccagcatggcgtat

SEQ ID NO: 437897 - DNA, 140 bp, Artificial Sequence
  Synthetic
atacgccatgctgggtctccgagtgatgctaattgctacatgaatgtagtgattatgatgcttgatcttcttagagacattcggtttaccgtacctgctctgcagcaggcatatattaagcgtacttgggagtcggccat

SEQ ID NO: 437898 - DNA, 140 bp, Artificial Sequence
  Synthetic
atggccgactcccaagtacgcttaatatatgcctgctgcagagcaggtacggtaaaccgaatgtctctaagaagatcaagcatcataatcactacattcatgtagcaattagcatcactcggagacccagcatggcgtat

SEQ ID NO: 437899 - DNA, 140 bp, Artificial Sequence
  Synthetic
atacgccatgctgggtctcctgcaacgcgcgattcagttcctcttcacataatcgccccgagctcgcttatcgtttaagcagctctgcgctactatgggtcccgtgtagaggctaatccacgtacttgggagtcggccat

SEQ ID NO: 437900 - DNA, 140 bp, Artificial Sequence
  Synthetic
atggccgactcccaagtacgtggattagcctctacacgggacccatagtagcgcagagctgcttaaacgataagcgagctcggggcgattatgtgaagaggaactgaatcgcgcgttgcaggagacccagcatggcgtat

SEQ ID NO: 437901 - DNA, 140 bp, Artificial Sequence
  Synthetic
atacgccatgctgggtctccttagtctctctttggacatatggaaaacgaactatgttaccctttgtccaagaacgaatagggttgttcatagtaaactttttcatttttaccgtagtatcgtacttgggagtcggccat

SEQ ID NO: 437902 - DNA, 140 bp, Artificial Sequence
  Synthetic
atggccgactcccaagtacgatactacggtaaaaatgaaaaagtttactatgaacaaccctattcgttcttggacaaagggtaacatagttcgttttccatatgtccaaagagagactaaggagacccagcatggcgtat

SEQ ID NO: 437903 - DNA, 140 bp, Artificial Sequence
  Synthetic
atacgccatgctgggtctccgtgctataacactcttggtgtgtatggctttccttacggctactagattatgtgtgcaatgtatgacaggcttcaataccctgttagttcagcccgcattcgtacttgggagtcggccat

SEQ ID NO: 437904 - DNA, 140 bp, Artificial Sequence
  Synthetic
atggccgactcccaagtacgaatgcgggctgaactaacagggtattgaagcctgtcatacattgcacacataatctagtagccgtaaggaaagccatacacaccaagagtgttatagcacggagacccagcatggcgtat

SEQ ID NO: 437905 - DNA, 140 bp, Artificial Sequence
  Synthetic
atacgccatgctgggtctccatacttgtataatactggacgttcagtctatgtaaaattccaggatagtaaaccccctctaccacctgacgagtgggtttaacgaactccttcataatgtcgtacttgggagtcggccat

SEQ ID NO: 437906 - DNA, 140 bp, Artificial Sequence
  Synthetic
atggccgactcccaagtacgacattatgaaggagttcgttaaacccactcgtcaggtggtagagggggtttactatcctggaattttacatagactgaacgtccagtattatacaagtatggagacccagcatggcgtat

SEQ ID NO: 437907 - DNA, 140 bp, Artificial Sequence
  Synthetic
aggccctggctgctgatatgataatactttggtttgtagatagaattcgtttctgtctcatgctgaattccttcctacccctgtttgacatgcgttcccactttattcgtgttagtacaggaccttttgggacagcggtg

SEQ ID NO: 437908 - DNA, 140 bp, Artificial Sequence
  Synthetic
caccgctgtcccaaaaggtcctgtactaacacgaataaagtgggaacgcatgtcaaacaggggtaggaaggaattcagcatgagacagaaacgaattctatctacaaaccaaagtattatcatatcagcagccagggcct

SEQ ID NO: 437909 - DNA, 140 bp, Artificial Sequence
  Synthetic
atacgccatgctgggtctccctaatatgacgcaactcactgaggcgcagattattgccattattaaagactggaactttgcatggtccctgatctttctcttaattactatcgtactacacgtacttgggagtcggccat

SEQ ID NO: 437910 - DNA, 140 bp, Artificial Sequence
  Synthetic
atggccgactcccaagtacgtgtagtacgatagtaattaagagaaagatcagggaccatgcaaagttccagtctttaataatggcaataatctgcgcctcagtgagttgcgtcatattagggagacccagcatggcgtat

SEQ ID NO: 437911 - DNA, 140 bp, Artificial Sequence
  Synthetic
atacgccatgctgggtctccgtatggatacccatcccgtagtatgactgtctatgtctttaaaatgtttgttttatggctcctatggccatcttccatggcgctatcaatatttagcgcccgtacttgggagtcggccat

SEQ ID NO: 437912 - DNA, 140 bp, Artificial Sequence
  Synthetic
atggccgactcccaagtacgggcgctaaatattgatagcgccatggaagatggccataggagccataaaacaaacattttaaagacatagacagtcatactacgggatgggtatccatacggagacccagcatggcgtat

SEQ ID NO: 437913 - DNA, 140 bp, Artificial Sequence
  Synthetic
aggccctggctgctgatatgttttatggctcctatggccatcttccatggcgctatcaatatttagcgccgtttatccaattgatctagcttcccagataatctctggcattgtagcagcgaccttttgggacagcggtg

SEQ ID NO: 437914 - DNA, 140 bp, Artificial Sequence
  Synthetic
caccgctgtcccaaaaggtcgctgctacaatgccagagattatctgggaagctagatcaattggataaacggcgctaaatattgatagcgccatggaagatggccataggagccataaaacatatcagcagccagggcct

SEQ ID NO: 437915 - DNA, 140 bp, Artificial Sequence
  Synthetic
atacgccatgctgggtctccatcttaattttcattgttatggccacccctgcagcgccccgtgctgtgacctttggtgacaacaatgacaacaataccaacactcagcagtctagaggcccgtacttgggagtcggccat

SEQ ID NO: 437916 - DNA, 140 bp, Artificial Sequence
  Synthetic
atggccgactcccaagtacgggcctctagactgctgagtgttggtattgttgtcattgttgtcaccaaaggtcacagcacggggcgctgcaggggtggccataacaatgaaaattaagatggagacccagcatggcgtat

SEQ ID NO: 437917 - DNA, 140 bp, Artificial Sequence
  Synthetic
aggccctggctgctgatatgtgtttcagctatgatgtggatttcctactttgtgcagagtatccggctgtttatgagaactggatcatggtggtcattcaatcctgagactaattgccttgaccttttgggacagcggtg

SEQ ID NO: 437918 - DNA, 140 bp, Artificial Sequence
  Synthetic
caccgctgtcccaaaaggtcaaggcaattagtctcaggattgaatgaccaccatgatccagttctcataaacagccggatactctgcacaaagtaggaaatccacatcatagctgaaacacatatcagcagccagggcct

SEQ ID NO: 437919 - DNA, 140 bp, Artificial Sequence
  Synthetic
atacgccatgctgggtctccgtcacgcagaacactcaaggtgttcacctttattcttctagaaaaggtgacttgtacggcggcaacatgttcctctttgctacattaccagtgtatgaaacgtacttgggagtcggccat

SEQ ID NO: 437920 - DNA, 140 bp, Artificial Sequence
  Synthetic
atggccgactcccaagtacgtttcatacactggtaatgtagcaaagaggaacatgttgccgccgtacaagtcaccttttctagaagaataaaggtgaacaccttgagtgttctgcgtgacggagacccagcatggcgtat

SEQ ID NO: 437921 - DNA, 140 bp, Artificial Sequence
  Synthetic
atacgccatgctgggtctccttgaacgttccatttggtggtacaactgtcgtacgtccactcgtagaggactctaccagtgtaactgctgttgtaaccaatggccacctcaaaatggctgcgtacttgggagtcggccat

SEQ ID NO: 437922 - DNA, 140 bp, Artificial Sequence
  Synthetic
atggccgactcccaagtacgcagccattttgaggtggccattggttacaacagcagttacactggtagagtcctctacgagtggacgtacgacagttgtaccaccaaatggaacgttcaaggagacccagcatggcgtat

SEQ ID NO: 437923 - DNA, 140 bp, Artificial Sequence
  Synthetic
atacgccatgctgggtctccacagggcgtacctcttaatgccaattcaacccctgcacaaaatgctgggtattggcggagacaggaccgaaagattaatacaggaaatggaacaaagcagcgtacttgggagtcggccat

SEQ ID NO: 437924 - DNA, 140 bp, Artificial Sequence
  Synthetic
atggccgactcccaagtacgctgctttgttccatttcctgtattaatctttcggtcctgtctccgccaatacccagcattttgtgcaggggttgaattggcattaagaggtacgccctgtggagacccagcatggcgtat

SEQ ID NO: 437925 - DNA, 140 bp, Artificial Sequence
  Synthetic
atacgccatgctgggtctccgcatgcatttcggtgcttgtgactacgacagacttcctaatgaagtcaccgtggccaaacccaatgtgctgattgctttaaaaatggtgaagcggcaaagcgtacttgggagtcggccat

SEQ ID NO: 437926 - DNA, 140 bp, Artificial Sequence
  Synthetic
atggccgactcccaagtacgctttgccgcttcaccatttttaaagcaatcagcacattgggtttggccacggtgacttcattaggaagtctgtcgtagtcacaagcaccgaaatgcatgcggagacccagcatggcgtat

SEQ ID NO: 437927 - DNA, 140 bp, Artificial Sequence
  Synthetic
atacgccatgctgggtctccctggctcccaggtggttcttctactacactggaaccgggcctgaagctaacctccctttcagagctgtcaaggatggaatcgtctgggtacatgaagaagcgtacttgggagtcggccat

SEQ ID NO: 437928 - DNA, 140 bp, Artificial Sequence
  Synthetic
atggccgactcccaagtacgcttcttcatgtacccagacgattccatccttgacagctctgaaagggaggttagcttcaggcccggttccagtgtagtagaagaaccacctgggagccagggagacccagcatggcgtat

SEQ ID NO: 437929 - DNA, 140 bp, Artificial Sequence
  Synthetic
atacgccatgctgggtctccctacggaactaattccggcgttgccatttaccatagatataaggcaggtaattacaggagtccgcctattacggcggatattgaacttgcattgcttcgacgtacttgggagtcggccat

SEQ ID NO: 437930 - DNA, 140 bp, Artificial Sequence
  Synthetic
atggccgactcccaagtacgtcgaagcaatgcaagttcaatatccgccgtaataggcggactcctgtaattacctgccttatatctatggtaaatggcaacgccggaattagttccgtagggagacccagcatggcgtat

SEQ ID NO: 437931 - DNA, 140 bp, Artificial Sequence
  Synthetic
atacgccatgctgggtctccgtgctacagacgctccctccagttttgggacgcgtaaccctaacaacgatccggctattgttacacagttcgctccaggtactaggcttcctaaaaacttcgtacttgggagtcggccat

SEQ ID NO: 437932 - DNA, 140 bp, Artificial Sequence
  Synthetic
atggccgactcccaagtacgaagtttttaggaagcctagtacctggagcgaactgtgtaacaatagccggatcgttgttagggttacgcgtcccaaaactggagggagcgtctgtagcacggagacccagcatggcgtat

SEQ ID NO: 437933 - DNA, 140 bp, Artificial Sequence
  Synthetic
atacgccatgctgggtctccatgtctttcgtggctggtgtgaccgcgcaaggtgcgcgcggtacgtatcgagcagcgctcaactctgaaaaacatcaagaccatgtgtctctaactgtgccgtacttgggagtcggccat

SEQ ID NO: 437934 - DNA, 140 bp, Artificial Sequence
  Synthetic
atggccgactcccaagtacggcacagttagagacacatggtcttgatgtttttcagagttgagcgctgctcgatacgtaccgcgcgcaccttgcgcggtcacaccagccacgaaagacatggagacccagcatggcgtat

SEQ ID NO: 437935 - DNA, 140 bp, Artificial Sequence
  Synthetic
aggccctggctgctgatatgcttactcactttttgatttatccaagtttcaattaaaattaaaaggaacaccagttcttcaattaaaggagagtcaaattaacgaactcgtaatatctctgaccttttgggacagcggtg

SEQ ID NO: 437936 - DNA, 140 bp, Artificial Sequence
  Synthetic
caccgctgtcccaaaaggtcagagatattacgagttcgttaatttgactctcctttaattgaagaactggtgttccttttaattttaattgaaacttggataaatcaaaaagtgagtaagcatatcagcagccagggcct

SEQ ID NO: 437937 - DNA, 140 bp, Artificial Sequence
  Synthetic
atacgccatgctgggtctccacaatttaagcatttagtccccctcatgcataaaggggcggcatggccaattgtacggcggcgtatagtacagatgctatctgacactttggataagcttcgtacttgggagtcggccat

SEQ ID NO: 437938 - DNA, 140 bp, Artificial Sequence
  Synthetic
atggccgactcccaagtacgaagcttatccaaagtgtcagatagcatctgtactatacgccgccgtacaattggccatgccgcccctttatgcatgagggggactaaatgcttaaattgtggagacccagcatggcgtat

SEQ ID NO: 437939 - DNA, 140 bp, Artificial Sequence
  Synthetic
atacgccatgctgggtctcccaaaaccacgagctgcaccaaataacactgtctcttggtacactgggcttacccaacacgggaaagtccctcttacctttccacctgggcagggtgtacccgtacttgggagtcggccat

SEQ ID NO: 437940 - DNA, 140 bp, Artificial Sequence
  Synthetic
atggccgactcccaagtacgggtacaccctgcccaggtggaaaggtaagagggactttcccgtgttgggtaagcccagtgtaccaagagacagtgttatttggtgcagctcgtggttttgggagacccagcatggcgtat

SEQ ID NO: 437941 - DNA, 140 bp, Artificial Sequence
  Synthetic
aggccctggctgctgatatgacccaacacgggaaagtccctcttacctttccacctgggcagggtgtacctcttaatgccaattccacccctgcgcaaaatgctgggtattggcggagacgaccttttgggacagcggtg

SEQ ID NO: 437942 - DNA, 140 bp, Artificial Sequence
  Synthetic
caccgctgtcccaaaaggtcgtctccgccaatacccagcattttgcgcaggggtggaattggcattaagaggtacaccctgcccaggtggaaaggtaagagggactttcccgtgttgggtcatatcagcagccagggcct

SEQ ID NO: 437943 - DNA, 140 bp, Artificial Sequence
  Synthetic
aggccctggctgctgatatgcaggtcctcgtgtatacctggttgagaggctcattgcttgtgaaaattcattcatggttaaccaattggcttatagctctagtgcaaatggcagcttggtgaccttttgggacagcggtg

SEQ ID NO: 437944 - DNA, 140 bp, Artificial Sequence
  Synthetic
caccgctgtcccaaaaggtcaccaagctgccatttgcactagagctataagccaattggttaaccatgaatgaattttcacaagcaatgagcctctcaaccaggtatacacgaggacctgcatatcagcagccagggcct

SEQ ID NO: 437945 - DNA, 140 bp, Artificial Sequence
  Synthetic
atacgccatgctgggtctcctagtatcctgtggttaccactacaaggaattaggtttggtcatgaatatggatgttagtctccataggcatagactgtctcttaaggagttaatgatgtacgtacttgggagtcggccat

SEQ ID NO: 437946 - DNA, 140 bp, Artificial Sequence
  Synthetic
atggccgactcccaagtacgtacatcattaactccttaagagacagtctatgcctatggagactaacatccatattcatgaccaaacctaattccttgtagtggtaaccacaggatactaggagacccagcatggcgtat

SEQ ID NO: 437947 - DNA, 140 bp, Artificial Sequence
  Synthetic
atacgccatgctgggtctcctggtacttctactacactggaactggacccgaagcagcactcccattccgggctgttaaggatggcatcgtttgggtccatgaagatggcgccactgatgcgtacttgggagtcggccat

SEQ ID NO: 437948 - DNA, 140 bp, Artificial Sequence
  Synthetic
atggccgactcccaagtacgcatcagtggcgccatcttcatggacccaaacgatgccatccttaacagcccggaatgggagtgctgcttcgggtccagttccagtgtagtagaagtaccaggagacccagcatggcgtat

SEQ ID NO: 437949 - DNA, 140 bp, Artificial Sequence
  Synthetic
atacgccatgctgggtctccctccttcaacttttgggacgcggaaccctaacaatgattcagctattgttacacaattcgcgcccggtactaagcttcctaaaaacttccacattgagggcgtacttgggagtcggccat

SEQ ID NO: 437950 - DNA, 140 bp, Artificial Sequence
  Synthetic
atggccgactcccaagtacgccctcaatgtggaagtttttaggaagcttagtaccgggcgcgaattgtgtaacaatagctgaatcattgttagggttccgcgtcccaaaagttgaaggagggagacccagcatggcgtat

SEQ ID NO: 437951 - DNA, 140 bp, Artificial Sequence
  Synthetic
atacgccatgctgggtctccgactggaggcaatagtcaatcatcttcaagagcctctagcgtaagcagaaactcttccagatctagttcacaaggttcaagatcaggaaactctacccgccgtacttgggagtcggccat

SEQ ID NO: 437952 - DNA, 140 bp, Artificial Sequence
  Synthetic
atggccgactcccaagtacggcgggtagagtttcctgatcttgaaccttgtgaactagatctggaagagtttctgcttacgctagaggctcttgaagatgattgactattgcctccagtcggagacccagcatggcgtat

SEQ ID NO: 437953 - DNA, 140 bp, Artificial Sequence
  Synthetic
atacgccatgctgggtctccgtggaattatctgtttcagaccataccgactcagctaactccactaatgattattgtggctgcgtgtgttatgctgttggtaaagcataagcacaccttccgtacttgggagtcggccat

SEQ ID NO: 437954 - DNA, 140 bp, Artificial Sequence
  Synthetic
atggccgactcccaagtacggaaggtgtgcttatgctttaccaacagcataacacacgcagccacaataatcattagtggagttagctgagtcggtatggtctgaaacagataattccacggagacccagcatggcgtat

SEQ ID NO: 437955 - DNA, 140 bp, Artificial Sequence
  Synthetic
atacgccatgctgggtctccggcacttctccaggtccatctggaatcggagcagtaggaggtgatctactttaccttgatcttctgaacagactacaagcccttgagtctggcaaagtaacgtacttgggagtcggccat

SEQ ID NO: 437956 - DNA, 140 bp, Artificial Sequence
  Synthetic
atggccgactcccaagtacgttactttgccagactcaagggcttgtagtctgttcagaagatcaaggtaaagtagatcacctcctactgctccgattccagatggacctggagaagtgccggagacccagcatggcgtat

SEQ ID NO: 437957 - DNA, 140 bp, Artificial Sequence
  Synthetic
atacgccatgctgggtctccagcaatcgcagccaaaagtaatcactaagaaagatgctgctgctgctaaaaataagatgcgccacaagcgcacttccaccaaaagtttcaacatggtgcacgtacttgggagtcggccat

SEQ ID NO: 437958 - DNA, 140 bp, Artificial Sequence
  Synthetic
atggccgactcccaagtacgtgcaccatgttgaaacttttggtggaagtgcgcttgtggcgcatcttatttttagcagcagcagcatctttcttagtgattacttttggctgcgattgctggagacccagcatggcgtat

SEQ ID NO: 437959 - DNA, 140 bp, Artificial Sequence
  Synthetic
atacgccatgctgggtctccttaaaatactctataagggcaatgtgacgcatgatgctagctctgccattaatagaccaaccagtgaagttctacttgtataagaaagtcaataatgagtcgtacttgggagtcggccat

SEQ ID NO: 437960 - DNA, 140 bp, Artificial Sequence
  Synthetic
atggccgactcccaagtacgactcattattgactttcttatacaagtagaacttcactggttggtctattaatggcagagctagcatcatgcgtcacattgcccttatagagtattttaaggagacccagcatggcgtat

SEQ ID NO: 437961 - DNA, 140 bp, Artificial Sequence
  Synthetic
atacgccatgctgggtctccagcttttggtcttcgcggaccaggagacctccagggaaactttggtgatcttcaattgaataaactcggcactgaggacccacgttggccccaaattgctcgtacttgggagtcggccat

SEQ ID NO: 437962 - DNA, 140 bp, Artificial Sequence
  Synthetic
atggccgactcccaagtacgagcaatttggggccaacgtgggtcctcagtgccgagtttattcaattgaagatcaccaaagtttccctggaggtctcctggtccgcgaagaccaaaagctggagacccagcatggcgtat

SEQ ID NO: 437963 - DNA, 140 bp, Artificial Sequence
  Synthetic
atacgccatgctgggtctccgagcttgctcctacagccagtgcttttatgggtatgtcgcaatttaaacttacccatcagaacaatgatgatcatggcaaccctgtgtacttccttcggtcgtacttgggagtcggccat

SEQ ID NO: 437964 - DNA, 140 bp, Artificial Sequence
  Synthetic
atggccgactcccaagtacgaccgaaggaagtacacagggttgccatgatcatcattgttctgatgggtaagtttaaattgcgacatacccataaaagcactggctgtaggagcaagctcggagacccagcatggcgtat

SEQ ID NO: 437965 - DNA, 140 bp, Artificial Sequence
  Synthetic
aggccctggctgctgatatgtacccatcagaacaatgatgatcatggcaaccctgtgtacttccttcggtacagtggagccattaaacttgacccaaagaatcccaactacaataagtgggaccttttgggacagcggtg

SEQ ID NO: 437966 - DNA, 140 bp, Artificial Sequence
  Synthetic
caccgctgtcccaaaaggtcccacttattgtagttgggattctttgggtcaagtttaatggctccactgtaccgaaggaagtacacagggttgccatgatcatcattgttctgatgggtacatatcagcagccagggcct

SEQ ID NO: 437967 - DNA, 140 bp, Artificial Sequence
  Synthetic
atacgccatgctgggtctccgtcacctctgcgtgattgcaagtgaacagtgccccctgggaagagctctacagtgtgaagtgtaaataaaaatagctgttattcaattagattagctaatcgtacttgggagtcggccat

SEQ ID NO: 437968 - DNA, 140 bp, Artificial Sequence
  Synthetic
atggccgactcccaagtacgattagctaatctaattgaataacagctatttttatttacacttcacactgtagagctcttcccagggggcactgttcacttgcaatcacgcagaggtgacggagacccagcatggcgtat

SEQ ID NO: 437969 - DNA, 140 bp, Artificial Sequence
  Synthetic
atacgccatgctgggtctccttggagcttcttgagcaaaatattgatgcctacaaaaccttccctaagaaggaaaagaaacaaaaggcaccaaaagaagaatcaacagaccaaatgtctgcgtacttgggagtcggccat

SEQ ID NO: 437970 - DNA, 140 bp, Artificial Sequence
  Synthetic
atggccgactcccaagtacgcagacatttggtctgttgattcttcttttggtgccttttgtttcttttccttcttagggaaggttttgtaggcatcaatattttgctcaagaagctccaaggagacccagcatggcgtat

SEQ ID NO: 437971 - DNA, 140 bp, Artificial Sequence
  Synthetic
aggccctggctgctgatatgtcactgttgtaatgcgccctaactacacaattaagggttcctttctgtgtggttcttgtggtagtgttggttacaccaaggagggtagtgtgatcaatttgaccttttgggacagcggtg

SEQ ID NO: 437972 - DNA, 140 bp, Artificial Sequence
  Synthetic
caccgctgtcccaaaaggtcaaattgatcacactaccctccttggtgtaaccaacactaccacaagaaccacacagaaaggaacccttaattgtgtagttagggcgcattacaacagtgacatatcagcagccagggcct

SEQ ID NO: 437973 - DNA, 140 bp, Artificial Sequence
  Synthetic
atacgccatgctgggtctccaacctccaaaggagcagcgtgtgcaaggtagcatcactcagcgcactcgcacccgtccaagtgttcagcctggtccaatgattgatgttaacactgattacgtacttgggagtcggccat

SEQ ID NO: 437974 - DNA, 140 bp, Artificial Sequence
  Synthetic
atggccgactcccaagtacgtaatcagtgttaacatcaatcattggaccaggctgaacacttggacgggtgcgagtgcgctgagtgatgctaccttgcacacgctgctcctttggaggttggagacccagcatggcgtat

SEQ ID NO: 437975 - DNA, 140 bp, Artificial Sequence
  Synthetic
atacgccatgctgggtctccttgaagctgatccaaagggcaagtttgcccagaatctgcttaagaagttgactggtggtgatgtaacacctgtcgaccaatacatgtgtggtgttgatggcgtacttgggagtcggccat

SEQ ID NO: 437976 - DNA, 140 bp, Artificial Sequence
  Synthetic
atggccgactcccaagtacgccatcaacaccacacatgtattggtcgacaggtgttacatcaccaccagtcaacttcttaagcagattctgggcaaacttgccctttggatcagcttcaaggagacccagcatggcgtat

SEQ ID NO: 437977 - DNA, 140 bp, Artificial Sequence
  Synthetic
aggccctggctgctgatatgtgcacttgtctggtgggattgtggcattaatttgcctgctcatctaggcagtggacatatgctcaacactgggtataattctaattgaatactatttttcgaccttttgggacagcggtg

SEQ ID NO: 437978 - DNA, 140 bp, Artificial Sequence
  Synthetic
caccgctgtcccaaaaggtcgaaaaatagtattcaattagaattatacccagtgttgagcatatgtccactgcctagatgagcaggcaaattaatgccacaatcccaccagacaagtgcacatatcagcagccagggcct

SEQ ID NO: 437979 - DNA, 140 bp, Artificial Sequence
  Synthetic
atacgccatgctgggtctccattaaagtgtgtagctgtagagagaatgttaaagactgtcacctctgcgtgattgcaagtgaacagtgccccccgggaagagctctacagtgtgaaatgtcgtacttgggagtcggccat

SEQ ID NO: 437980 - DNA, 140 bp, Artificial Sequence
  Synthetic
atggccgactcccaagtacgacatttcacactgtagagctcttcccggggggcactgttcacttgcaatcacgcagaggtgacagtctttaacattctctctacagctacacactttaatggagacccagcatggcgtat

SEQ ID NO: 437981 - DNA, 140 bp, Artificial Sequence
  Synthetic
aggccctggctgctgatatggattgcaagtgaacagtgccccccgggaagagctctacagtgtgaaatgtaaataaaaatagctattattcaattagattaggctaattagatgatttgcgaccttttgggacagcggtg

SEQ ID NO: 437982 - DNA, 140 bp, Artificial Sequence
  Synthetic
caccgctgtcccaaaaggtcgcaaatcatctaattagcctaatctaattgaataatagctatttttatttacatttcacactgtagagctcttcccggggggcactgttcacttgcaatccatatcagcagccagggcct

SEQ ID NO: 437983 - DNA, 140 bp, Artificial Sequence
  Synthetic
aggccctggctgctgatatgcaagtgaacagtgccccccgggaagagctctacagtgtgaaatgtaaataaaaatagctattattcaattagattaggctaattagatgatttgcaaaaagaccttttgggacagcggtg

SEQ ID NO: 437984 - DNA, 140 bp, Artificial Sequence
  Synthetic
caccgctgtcccaaaaggtctttttgcaaatcatctaattagcctaatctaattgaataatagctatttttatttacatttcacactgtagagctcttcccggggggcactgttcacttgcatatcagcagccagggcct

SEQ ID NO: 437985 - DNA, 140 bp, Artificial Sequence
  Synthetic
aggccctggctgctgatatgtagcttggctatctcacttcccctcgttctcttgcagaactttgattttaacgaacttaaataaaagccctgttgtttagcgtattgttgcacttgtctggaccttttgggacagcggtg

SEQ ID NO: 437986 - DNA, 140 bp, Artificial Sequence
  Synthetic
caccgctgtcccaaaaggtccagacaagtgcaacaatacgctaaacaacagggcttttatttaagttcgttaaaatcaaagttctgcaagagaacgaggggaagtgagatagccaagctacatatcagcagccagggcct

SEQ ID NO: 437987 - DNA, 140 bp, Artificial Sequence
  Synthetic
aggccctggctgctgatatgatcaggctatgacttctatgtataagcaagcacgtgctgaagataagaaagcaaaaattgtcagtgctatgcaaactatgttgtttggtatgattaagaagaccttttgggacagcggtg

SEQ ID NO: 437988 - DNA, 140 bp, Artificial Sequence
  Synthetic
caccgctgtcccaaaaggtcttcttaatcataccaaacaacatagtttgcatagcactgacaatttttgctttcttatcttcagcacgtgcttgcttatacatagaagtcatagcctgatcatatcagcagccagggcct

SEQ ID NO: 437989 - DNA, 140 bp, Artificial Sequence
  Synthetic
aggccctggctgctgatatggtcctttaagaaagttgcaaccataccgtacaaggtttgcaactctgttaaggatactctgacttattatgctcacagcgtgttgtacagagtttttcctgaccttttgggacagcggtg

SEQ ID NO: 437990 - DNA, 140 bp, Artificial Sequence
  Synthetic
caccgctgtcccaaaaggtcaggaaaaactctgtacaacacgctgtgagcataataagtcagagtatccttaacagagttgcaaaccttgtacggtatggttgcaactttcttaaaggaccatatcagcagccagggcct

SEQ ID NO: 437991 - DNA, 140 bp, Artificial Sequence
  Synthetic
aggccctggctgctgatatgaggatactctgacttattatgctcacagcgtgttgtacagagtttttccttatgacatggattctggtgtgtcatcctttagtgaactactttttgattggaccttttgggacagcggtg

SEQ ID NO: 437992 - DNA, 140 bp, Artificial Sequence
  Synthetic
caccgctgtcccaaaaggtccaatcaaaaagtagttcactaaaggatgacacaccagaatccatgtcataaggaaaaactctgtacaacacgctgtgagcataataagtcagagtatcctcatatcagcagccagggcct

SEQ ID NO: 437993 - DNA, 140 bp, Artificial Sequence
  Synthetic
aggccctggctgctgatatggtaattcctgacttcaccgtctggaatcaggtagtcacatatccctcgcttaactacgctggggctttgtgggacattacagttataaacaatgtggacagaccttttgggacagcggtg

SEQ ID NO: 437994 - DNA, 140 bp, Artificial Sequence
  Synthetic
caccgctgtcccaaaaggtctgtccacattgtttataactgtaatgtcccacaaagccccagcgtagttaagcgagggatatgtgactacctgattccagacggtgaagtcaggaattaccatatcagcagccagggcct

SEQ ID NO: 437995 - DNA, 140 bp, Artificial Sequence
  Synthetic
atacgccatgctgggtctccataagactggcgactttatgtctacaattattacttcctgccaaactgctgttagtaagcttctagatacatgttttgaagctacagaagcaacatttaacgtacttgggagtcggccat

SEQ ID NO: 437996 - DNA, 140 bp, Artificial Sequence
  Synthetic
atggccgactcccaagtacgttaaatgttgcttctgtagcttcaaaacatgtatctagaagcttactaacagcagtttggcaggaagtaataattgtagacataaagtcgccagtcttatggagacccagcatggcgtat

SEQ ID NO: 437997 - DNA, 140 bp, Artificial Sequence
  Synthetic
aggccctggctgctgatatgctcctatgaatctgagtacttactcactttttgatttatccaagtttcaattaaaattaaaaggaacaccagttcttcaattaaaggagagtcaaattaagaccttttgggacagcggtg

SEQ ID NO: 437998 - DNA, 140 bp, Artificial Sequence
  Synthetic
caccgctgtcccaaaaggtcttaatttgactctcctttaattgaagaactggtgttccttttaattttaattgaaacttggataaatcaaaaagtgagtaagtactcagattcataggagcatatcagcagccagggcct

SEQ ID NO: 437999 - DNA, 140 bp, Artificial Sequence
  Synthetic
aggccctggctgctgatatgtgttgtctccatacggtcttccaatcagggtaataaacaaattgttcattcttaccccattttacatcacccatgattttaacgaactatggctttctcggaccttttgggacagcggtg

SEQ ID NO: 438000 - DNA, 140 bp, Artificial Sequence
  Synthetic
caccgctgtcccaaaaggtccgagaaagccatagttcgttaaaatcatgggtgatgtaaaatggggtaagaatgaacaatttgtttattaccctgattggaagaccgtatggagacaacacatatcagcagccagggcct

SEQ ID NO: 438001 - DNA, 140 bp, Artificial Sequence
  Synthetic
atacgccatgctgggtctcctcaaagatgaaccacctcaggtttataattttagtaggttggtttttaccaactgcaactataacttaacaaaactactcgccttgtttcaggtgagtcacgtacttgggagtcggccat

SEQ ID NO: 438002 - DNA, 140 bp, Artificial Sequence
  Synthetic
atggccgactcccaagtacgtgactcacctgaaacaaggcgagtagttttgttaagttatagttgcagttggtaaaaaccaacctactaaaattataaacctgaggtggttcatctttgaggagacccagcatggcgtat

SEQ ID NO: 438003 - DNA, 140 bp, Artificial Sequence
  Synthetic
atacgccatgctgggtctccaggctgtttatgcggacaggctcttggtggtccttcaaccccgaaactaattgcctcttgaatgttccaattggcggcactaccgttgtcagacccctcgcgtacttgggagtcggccat

SEQ ID NO: 438004 - DNA, 140 bp, Artificial Sequence
  Synthetic
atggccgactcccaagtacgcgaggggtctgacaacggtagtgccgccaattggaacattcaagaggcaattagtttcggggttgaaggaccaccaagagcctgtccgcataaacagcctggagacccagcatggcgtat

SEQ ID NO: 438005 - DNA, 140 bp, Artificial Sequence
  Synthetic
aggccctggctgctgatatggcagggagtctctaatattcccatcgggaacctattactgtgtcaccactaaggctaagtccgttcaacaagatcttgacgttattttgcctggtgagttgaccttttgggacagcggtg

SEQ ID NO: 438006 - DNA, 140 bp, Artificial Sequence
  Synthetic
caccgctgtcccaaaaggtcaactcaccaggcaaaataacgtcaagatcttgttgaacggacttagccttagtggtgacacagtaataggttcccgatgggaatattagagactccctgccatatcagcagccagggcct

SEQ ID NO: 438007 - DNA, 140 bp, Artificial Sequence
  Synthetic
aggccctggctgctgatatgtacagctggtctttatacaaattttcgaattgacgtcccatctgcagaatcaactggtactcaatcagtttctgtcgatcgtgagtcaacttcaactcatgaccttttgggacagcggtg

SEQ ID NO: 438008 - DNA, 140 bp, Artificial Sequence
  Synthetic
caccgctgtcccaaaaggtcatgagttgaagttgactcacgatcgacagaaactgattgagtaccagttgattctgcagatgggacgtcaattcgaaaatttgtataaagaccagctgtacatatcagcagccagggcct

SEQ ID NO: 438009 - DNA, 140 bp, Artificial Sequence
  Synthetic
atacgccatgctgggtctccggttactgacattttgtacccaggacaaaagtataccagcgattgtaatgtagtggtatactctttggatggtaataccaaggcagaagtcaatccagaccgtacttgggagtcggccat

SEQ ID NO: 438010 - DNA, 140 bp, Artificial Sequence
  Synthetic
atggccgactcccaagtacggtctggattgacttctgccttggtattaccatccaaagagtataccactacattacaatcgctggtatacttttgtcctgggtacaaaatgtcagtaaccggagacccagcatggcgtat

SEQ ID NO: 438011 - DNA, 140 bp, Artificial Sequence
  Synthetic
aggccctggctgctgatatggtagatgttgtctccatacggtcttccaatcagggtaataaacaaattgttcattcttatcccattttacatcatccaggattttaacgaactatggcttgaccttttgggacagcggtg

SEQ ID NO: 438012 - DNA, 140 bp, Artificial Sequence
  Synthetic
caccgctgtcccaaaaggtcaagccatagttcgttaaaatcctggatgatgtaaaatgggataagaatgaacaatttgtttattaccctgattggaagaccgtatggagacaacatctaccatatcagcagccagggcct

SEQ ID NO: 438013 - DNA, 140 bp, Artificial Sequence
  Synthetic
atacgccatgctgggtctccgttttcatgtcatcaagtgtcacccagtgcactagcatctggctgctactcttctcttactgtagactactttgcataccctacgtatatgtcttcgtatcgtacttgggagtcggccat

SEQ ID NO: 438014 - DNA, 140 bp, Artificial Sequence
  Synthetic
atggccgactcccaagtacgatacgaagacatatacgtagggtatgcaaagtagtctacagtaagagaagagtagcagccagatgctagtgcactgggtgacacttgatgacatgaaaacggagacccagcatggcgtat

SEQ ID NO: 438015 - DNA, 140 bp, Artificial Sequence
  Synthetic
atacgccatgctgggtctcctgcttgttctggaactgtaatgttccacgttaccctaataatgccattgtttgtaggtttgatactcgtgtgcactctgagttcaatttgccaggttgtgcgtacttgggagtcggccat

SEQ ID NO: 438016 - DNA, 140 bp, Artificial Sequence
  Synthetic
atggccgactcccaagtacgcacaacctggcaaattgaactcagagtgcacacgagtatcaaacctacaaacaatggcattattagggtaacgtggaacattacagttccagaacaagcaggagacccagcatggcgtat

SEQ ID NO: 438017 - DNA, 140 bp, Artificial Sequence
  Synthetic
aggccctggctgctgatatgaccaaaagcttattgccaataagtttaatcaggctctgggagctatgcatttaacgaactccttcataatgtctaatatgacgcaactcactgaggcgcagaccttttgggacagcggtg

SEQ ID NO: 438018 - DNA, 140 bp, Artificial Sequence
  Synthetic
caccgctgtcccaaaaggtctgcgcctcagtgagttgcgtcatattagacattatgaaggagttcgttaaatgcatagctcccagagcctgattaaacttattggcaataagcttttggtcatatcagcagccagggcct

SEQ ID NO: 438019 - DNA, 140 bp, Artificial Sequence
  Synthetic
atacgccatgctgggtctcctctgacgacgagtgggctgctgcagttgatgaagcgttccccctcgatgaagcagaagatgttactgaatctgtgcaagaagaagcacaaccagtagaagcgtacttgggagtcggccat

SEQ ID NO: 438020 - DNA, 140 bp, Artificial Sequence
  Synthetic
atggccgactcccaagtacgcttctactggttgtgcttcttcttgcacagattcagtaacatcttctgcttcatcgagggggaacgcttcatcaactgcagcagcccactcgtcgtcagaggagacccagcatggcgtat

SEQ ID NO: 438021 - DNA, 140 bp, Artificial Sequence
  Synthetic
aggccctggctgctgatatgtataatggtcgtccgactggtacattcactgttgtaatgcgccctaactacacaattaagggttcctttctgtgtggttcttgtggtagtgttggttacagaccttttgggacagcggtg

SEQ ID NO: 438022 - DNA, 140 bp, Artificial Sequence
  Synthetic
caccgctgtcccaaaaggtctgtaaccaacactaccacaagaaccacacagaaaggaacccttaattgtgtagttagggcgcattacaacagtgaatgtaccagtcggacgaccattatacatatcagcagccagggcct

SEQ ID NO: 438023 - DNA, 140 bp, Artificial Sequence
  Synthetic
aggccctggctgctgatatgcttgttttatagaacgtgtggattgggatatagagtatccttatatctcacatacagcccttgaccaggaaggtacaacagcttttctatacagaggacagaccttttgggacagcggtg

SEQ ID NO: 438024 - DNA, 140 bp, Artificial Sequence
  Synthetic
caccgctgtcccaaaaggtctgtcctctgtatagaaaagctgttgtaccttcctggtcaagggctgtatgtgagatataaggatactctatatcccaatccacacgttctataaaacaagcatatcagcagccagggcct

SEQ ID NO: 438025 - DNA, 140 bp, Artificial Sequence
  Synthetic
atacgccatgctgggtctccctacagcagggttcaactggtgaaataagccagttcaattataagcaggattttagtaatcctacttgtaggatactcgctactgtgcctgctaatcttacgtacttgggagtcggccat

SEQ ID NO: 438026 - DNA, 140 bp, Artificial Sequence
  Synthetic
atggccgactcccaagtacgtaagattagcaggcacagtagcgagtatcctacaagtaggattactaaaatcctgcttataattgaactggcttatttcaccagttgaaccctgctgtagggagacccagcatggcgtat

SEQ ID NO: 438027 - DNA, 140 bp, Artificial Sequence
  Synthetic
aggccctggctgctgatatgtgttactcctttggccgtagatgttgtctccatacggtcttccaatcagggtaataaacaaattgttcattcttaccccattttacatcatccaggatttgaccttttgggacagcggtg

SEQ ID NO: 438028 - DNA, 140 bp, Artificial Sequence
  Synthetic
caccgctgtcccaaaaggtcaaatcctggatgatgtaaaatggggtaagaatgaacaatttgtttattaccctgattggaagaccgtatggagacaacatctacggccaaaggagtaacacatatcagcagccagggcct

SEQ ID NO: 438029 - DNA, 140 bp, Artificial Sequence
  Synthetic
aggccctggctgctgatatgcacgtctaaggacactttagatgatatcttacaacaggctgtccgcactaatggtggttacaattcttggcatttagtcgagggtgaactattggtgcaagaccttttgggacagcggtg

SEQ ID NO: 438030 - DNA, 140 bp, Artificial Sequence
  Synthetic
caccgctgtcccaaaaggtcttgcaccaatagttcaccctcgactaaatgccaagaattgtaaccaccattagtgcggacagcctgttgtaagatatcatctaaagtgtccttagacgtgcatatcagcagccagggcct

SEQ ID NO: 438031 - DNA, 140 bp, Artificial Sequence
  Synthetic
atacgccatgctgggtctccctaactctcttcttgttgcccacagcactttgtttgacttatgcgaacatagtctatgagccttctacacctgtttcttcagcccttatagcagttgctacgtacttgggagtcggccat

SEQ ID NO: 438032 - DNA, 140 bp, Artificial Sequence
  Synthetic
atggccgactcccaagtacgtagcaactgctataagggctgaagaaacaggtgtagaaggctcatagactatgttcgcataagtcaaacaaagtgctgtgggcaacaagaagagagttagggagacccagcatggcgtat

SEQ ID NO: 438033 - DNA, 140 bp, Artificial Sequence
  Synthetic
aggccctggctgctgatatgtctttgagaagtactttaaatattgggatcagacgtatcacgcaaattgcgttaattgtactgatgaccgttgtgtgttacattgtgctaatttcaatgtgaccttttgggacagcggtg

SEQ ID NO: 438034 - DNA, 140 bp, Artificial Sequence
  Synthetic
caccgctgtcccaaaaggtcacattgaaattagcacaatgtaacacacaacggtcatcagtacaattaacgcaatttgcgtgatacgtctgatcccaatatttaaagtacttctcaaagacatatcagcagccagggcct

SEQ ID NO: 438035 - DNA, 140 bp, Artificial Sequence
  Synthetic
aggccctggctgctgatatgcaagcgtttggtttttaccaattgcaattataatcttaccaaattgctttcacttttttctgtgaatgatttcacttgtagtcaaatatctccaacagcagaccttttgggacagcggtg

SEQ ID NO: 438036 - DNA, 140 bp, Artificial Sequence
  Synthetic
caccgctgtcccaaaaggtctgctgttggagatatttgactacaagtgaaatcattcacagaaaaaagtgaaagcaatttggtaagattataattgcaattggtaaaaaccaaacgcttgcatatcagcagccagggcct

SEQ ID NO: 438037 - DNA, 140 bp, Artificial Sequence
  Synthetic
atacgccatgctgggtctcctactggtgtgaactttgttgttcaaccagtgggtgttgtagacactgagtgggggaatatgttaacgggaatatcagcccgtccccctccaggtgagcagcgtacttgggagtcggccat

SEQ ID NO: 438038 - DNA, 140 bp, Artificial Sequence
  Synthetic
atggccgactcccaagtacgctgctcacctggagggggacgggctgatattcccgttaacatattcccccactcagtgtctacaacacccactggttgaacaacaaagttcacaccagtaggagacccagcatggcgtat

SEQ ID NO: 438039 - DNA, 140 bp, Artificial Sequence
  Synthetic
atacgccatgctgggtctcctgcggtaatggttcatggcttacagggaatgctattcaagggtttgcctgtggttgtggggcatcatacacagctaatgatgtcgaagttcaatcatctgcgtacttgggagtcggccat

SEQ ID NO: 438040 - DNA, 140 bp, Artificial Sequence
  Synthetic
atggccgactcccaagtacgcagatgattgaacttcgacatcattagctgtgtatgatgccccacaaccacaggcaaacccttgaatagcattccctgtaagccatgaaccattaccgcaggagacccagcatggcgtat

SEQ ID NO: 438041 - DNA, 140 bp, Artificial Sequence
  Synthetic
aggccctggctgctgatatgttttttgaaccttaagcttagagcacctatgggtgtctatgactttaaggtctcaacacaagagttcaggttcatgactgctaacaatctaactgcacctgaccttttgggacagcggtg

SEQ ID NO: 438042 - DNA, 140 bp, Artificial Sequence
  Synthetic
caccgctgtcccaaaaggtcaggtgcagttagattgttagcagtcatgaacctgaactcttgtgttgagaccttaaagtcatagacacccataggtgctctaagcttaaggttcaaaaaacatatcagcagccagggcct

SEQ ID NO: 438043 - DNA, 140 bp, Artificial Sequence
  Synthetic
aggccctggctgctgatatgtagcatgctataatggtcgtccgactggtacattcactgttgtaatgcgccctaactacacaattaagggttcctttctgtgtggttcttgtggtagtgtgaccttttgggacagcggtg

SEQ ID NO: 438044 - DNA, 140 bp, Artificial Sequence
  Synthetic
caccgctgtcccaaaaggtcacactaccacaagaaccacacagaaaggaacccttaattgtgtagttagggcgcattacaacagtgaatgtaccagtcggacgaccattatagcatgctacatatcagcagccagggcct

SEQ ID NO: 438045 - DNA, 140 bp, Artificial Sequence
  Synthetic
atacgccatgctgggtctcccctcaacaaatgtttgttactcctttggccgtagatgttgtctccatacggtcttccaatcagggtaataaacaaattgttcattcttaccccattttaccgtacttgggagtcggccat

SEQ ID NO: 438046 - DNA, 140 bp, Artificial Sequence
  Synthetic
atggccgactcccaagtacggtaaaatggggtaagaatgaacaatttgtttattaccctgattggaagaccgtatggagacaacatctacggccaaaggagtaacaaacatttgttgaggggagacccagcatggcgtat

SEQ ID NO: 438047 - DNA, 140 bp, Artificial Sequence
  Synthetic
aggccctggctgctgatatgcttttcattactcgtgaagaggctgtaaggcaagttcgaagctggataggcttcgatgttgaggccaccttgcctgtttatgatactattaagtattactgaccttttgggacagcggtg

SEQ ID NO: 438048 - DNA, 140 bp, Artificial Sequence
  Synthetic
caccgctgtcccaaaaggtcagtaatacttaatagtatcataaacaggcaaggtggcctcaacatcgaagcctatccagcttcgaacttgccttacagcctcttcacgagtaatgaaaagcatatcagcagccagggcct

SEQ ID NO: 438049 - DNA, 140 bp, Artificial Sequence
  Synthetic
atacgccatgctgggtctcctctctactggcgtgaacttcgttgttcagccagcgggtgttgttgatactgagtgggggaatatgttaactggcattgctgctaggccccctccaggtgacgtacttgggagtcggccat

SEQ ID NO: 438050 - DNA, 140 bp, Artificial Sequence
  Synthetic
atggccgactcccaagtacgtcacctggagggggcctagcagcaatgccagttaacatattcccccactcagtatcaacaacacccgctggctgaacaacgaagttcacgccagtagagaggagacccagcatggcgtat

SEQ ID NO: 438051 - DNA, 140 bp, Artificial Sequence
  Synthetic
aggccctggctgctgatatgagtgatatttttgacactcctagcgtacttcaagctactctttctgagttttcacacttagctacctttgctgagttggaagctgcgcagaaagcctatcgaccttttgggacagcggtg

SEQ ID NO: 438052 - DNA, 140 bp, Artificial Sequence
  Synthetic
caccgctgtcccaaaaggtcgataggctttctgcgcagcttccaactcagcaaaggtagctaagtgtgaaaactcagaaagagtagcttgaagtacgctaggagtgtcaaaaatatcactcatatcagcagccagggcct

SEQ ID NO: 438053 - DNA, 140 bp, Artificial Sequence
  Synthetic
atacgccatgctgggtctccaaaccagtgttgtgggtttctaatggtttgtttgacgcagctctgtcaagatttaatagggcttctatacgtcaaatttatgatcctgaacctgttgaaccgtacttgggagtcggccat

SEQ ID NO: 438054 - DNA, 140 bp, Artificial Sequence
  Synthetic
atggccgactcccaagtacggttcaacaggttcaggatcataaatttgacgtatagaagccctattaaatcttgacagagctgcgtcaaacaaaccattagaaacccacaacactggtttggagacccagcatggcgtat

SEQ ID NO: 438055 - DNA, 140 bp, Artificial Sequence
  Synthetic
atacgccatgctgggtctccacacctatgacatcagctctccagatggcttttatcatttcagtgcaatatggcactgactctaatagcgtttgccccatgcaagctgttcgtaatgacacgtacttgggagtcggccat

SEQ ID NO: 438056 - DNA, 140 bp, Artificial Sequence
  Synthetic
atggccgactcccaagtacgtgtcattacgaacagcttgcatggggcaaacgctattagagtcagtgccatattgcactgaaatgataaaagccatctggagagctgatgtcataggtgtggagacccagcatggcgtat

SEQ ID NO: 438057 - DNA, 140 bp, Artificial Sequence
  Synthetic
atacgccatgctgggtctccttgaagactcaacaagtgtgacagctgttgtcaccaatggctacctcaagatcgcagggatgcactttggccagtgcgactaccgctcgcttcccaacgacgtacttgggagtcggccat

SEQ ID NO: 438058 - DNA, 140 bp, Artificial Sequence
  Synthetic
atggccgactcccaagtacgtcgttgggaagcgagcggtagtcgcactggccaaagtgcatccctgcgatcttgaggtagccattggtgacaacagctgtcacacttgttgagtcttcaaggagacccagcatggcgtat

SEQ ID NO: 438059 - DNA, 140 bp, Artificial Sequence
  Synthetic
atacgccatgctgggtctcccaatcctgagactaattgccttttgaacgttccatttggtggtgaagcggcaaagctacggaactaattccggcgttgccatttaccatagatataaggccgtacttgggagtcggccat

SEQ ID NO: 438060 - DNA, 140 bp, Artificial Sequence
  Synthetic
atggccgactcccaagtacggccttatatctatggtaaatggcaacgccggaattagttccgtagctttgccgcttcaccaccaaatggaacgttcaaaaggcaattagtctcaggattgggagacccagcatggcgtat

SEQ ID NO: 438061 - DNA, 140 bp, Artificial Sequence
  Synthetic
atacgccatgctgggtctccttcagcccgcattatacttgtataatactggacgttcagtctatgtaaaattccaggatagtaaaccccctctaccacctgacgagtgggttatgtctaacgtacttgggagtcggccat

SEQ ID NO: 438062 - DNA, 140 bp, Artificial Sequence
  Synthetic
atggccgactcccaagtacgttagacataacccactcgtcaggtggtagagggggtttactatcctggaattttacatagactgaacgtccagtattatacaagtataatgcgggctgaaggagacccagcatggcgtat

SEQ ID NO: 438063 - DNA, 140 bp, Artificial Sequence
  Synthetic
atacgccatgctgggtctccttgagaacaagttcacaccgcttgtagtagaggacctgcctcccattgttaaggatgtaaaacctattatagtaaatcctccagagctaaagttagttaacgtacttgggagtcggccat

SEQ ID NO: 438064 - DNA, 140 bp, Artificial Sequence
  Synthetic
atggccgactcccaagtacgttaactaactttagctctggaggatttactataataggttttacatccttaacaatgggaggcaggtcctctactacaagcggtgtgaacttgttctcaaggagacccagcatggcgtat

SEQ ID NO: 438065 - DNA, 140 bp, Artificial Sequence
  Synthetic
aggccctggctgctgatatgcttggaacaaggtcactcaaattgctaacatgttcttggaacagactcagcattcccttaactttgtgggagagttcgttgtcaacgatgttgtcctcgcgaccttttgggacagcggtg

SEQ ID NO: 438066 - DNA, 140 bp, Artificial Sequence
  Synthetic
caccgctgtcccaaaaggtcgcgaggacaacatcgttgacaacgaactctcccacaaagttaagggaatgctgagtctgttccaagaacatgttagcaatttgagtgaccttgttccaagcatatcagcagccagggcct

SEQ ID NO: 438067 - DNA, 140 bp, Artificial Sequence
  Synthetic
atacgccatgctgggtctcccgagcgttgatgacaagctaggcttgtgtattgattactccctctatggcattactgggagaggcgtttttcagaattgcactgctgttggtattaggcacgtacttgggagtcggccat

SEQ ID NO: 438068 - DNA, 140 bp, Artificial Sequence
  Synthetic
atggccgactcccaagtacgtgcctaataccaacagcagtgcaattctgaaaaacgcctctcccagtaatgccatagagggagtaatcaatacacaagcctagcttgtcatcaacgctcgggagacccagcatggcgtat

SEQ ID NO: 438069 - DNA, 140 bp, Artificial Sequence
  Synthetic
atacgccatgctgggtctccaaagttacttatacgcgacaatgacccgcttaatgtttctactgatgtgcttgttaacacctataaaaggagatgttgatcctggtctcccttccaattccgtacttgggagtcggccat

SEQ ID NO: 438070 - DNA, 140 bp, Artificial Sequence
  Synthetic
atggccgactcccaagtacggaattggaagggagaccaggatcaacatctccttttataggtgttaacaagcacatcagtagaaacattaagcgggtcattgtcgcgtataagtaactttggagacccagcatggcgtat

SEQ ID NO: 438071 - DNA, 140 bp, Artificial Sequence
  Synthetic
aggccctggctgctgatatggttgcatgtgaacacatttcttctaccatgtctcaatactcccgttctacgcgatcaatgcttaaacggcgagattctacatatggctttgacgttggttgaccttttgggacagcggtg

SEQ ID NO: 438072 - DNA, 140 bp, Artificial Sequence
  Synthetic
caccgctgtcccaaaaggtcaaccaacgtcaaagccatatgtagaatctcgccgtttaagcattgatcgcgtagaacgggagtattgagacatggtagaagaaatgtgttcacatgcaaccatatcagcagccagggcct

SEQ ID NO: 438073 - DNA, 140 bp, Artificial Sequence
  Synthetic
atacgccatgctgggtctccgtgcaaaggtttgaaaaagccgtttgttaaggataactttagctttgttgatgatagtgctggtgttacagttgtagaatacctcactcgtgatgacatgcgtacttgggagtcggccat

SEQ ID NO: 438074 - DNA, 140 bp, Artificial Sequence
  Synthetic
atggccgactcccaagtacgcatgtcatcacgagtgaggtattctacaactgtaacaccagcactatcatcaacaaagctaaagttatccttaacaaacggctttttcaaacctttgcacggagacccagcatggcgtat

SEQ ID NO: 438075 - DNA, 140 bp, Artificial Sequence
  Synthetic
aggccctggctgctgatatgtttatgtctacaattattacttcctgccaaactgctgttagtaagcttctagatacatgttttgaagctacagaagcaacatttaacttcttgttagattgaccttttgggacagcggtg

SEQ ID NO: 438076 - DNA, 140 bp, Artificial Sequence
  Synthetic
caccgctgtcccaaaaggtcaatctaacaagaagttaaatgttgcttctgtagcttcaaaacatgtatctagaagcttactaacagcagtttggcaggaagtaataattgtagacataaacatatcagcagccagggcct

SEQ ID NO: 438077 - DNA, 140 bp, Artificial Sequence
  Synthetic
aggccctggctgctgatatgaattccggcgttgccatttaccatagatataaggcaggtaattacaggagtccgcctattacggcggatattgaacttgcattgcttcgagcttaggctcgaccttttgggacagcggtg

SEQ ID NO: 438078 - DNA, 140 bp, Artificial Sequence
  Synthetic
caccgctgtcccaaaaggtcgagcctaagctcgaagcaatgcaagttcaatatccgccgtaataggcggactcctgtaattacctgccttatatctatggtaaatggcaacgccggaattcatatcagcagccagggcct

SEQ ID NO: 438079 - DNA, 140 bp, Artificial Sequence
  Synthetic
aggccctggctgctgatatgctactttttgattgcgttgatctttcagtagcttctacctattttagttgacggtgttcaatattattgctacacgtctaaggacactttagatgatatcgaccttttgggacagcggtg

SEQ ID NO: 438080 - DNA, 140 bp, Artificial Sequence
  Synthetic
caccgctgtcccaaaaggtcgatatcatctaaagtgtccttagacgtgtagcaataatattgaacaccgtcaactaaaataggtagaagctactgaaagatcaacgcaatcaaaaagtagcatatcagcagccagggcct

SEQ ID NO: 438081 - DNA, 140 bp, Artificial Sequence
  Synthetic
aggccctggctgctgatatgagattttctcttctgcgccctgaagaccttagtgttattgtccaaccaacacactatgtcagggttacattttcagaccccaacatgtggtatctacgttgaccttttgggacagcggtg

SEQ ID NO: 438082 - DNA, 140 bp, Artificial Sequence
  Synthetic
caccgctgtcccaaaaggtcaacgtagataccacatgttggggtctgaaaatgtaaccctgacatagtgtgttggttggacaataacactaaggtcttcagggcgcagaagagaaaatctcatatcagcagccagggcct

SEQ ID NO: 438083 - DNA, 140 bp, Artificial Sequence
  Synthetic
aggccctggctgctgatatggcactcgcacccgtccaagtgttcagcctggtccaatgattgatgttaacactgattagtgtcactcaaagtaacaagatcgcggcaatcgtttgtgtttgaccttttgggacagcggtg

SEQ ID NO: 438084 - DNA, 140 bp, Artificial Sequence
  Synthetic
caccgctgtcccaaaaggtcaaacacaaacgattgccgcgatcttgttactttgagtgacactaatcagtgttaacatcaatcattggaccaggctgaacacttggacgggtgcgagtgccatatcagcagccagggcct

SEQ ID NO: 438085 - DNA, 140 bp, Artificial Sequence
  Synthetic
atacgccatgctgggtctcctggttcaggaaacctggttgaaaaactttcaccatggttcatggatggcgaaaatgcctatgaagtggtgaaggccatgttacttaaaaaggagccacttcgtacttgggagtcggccat

SEQ ID NO: 438086 - DNA, 140 bp, Artificial Sequence
  Synthetic
atggccgactcccaagtacgaagtggctcctttttaagtaacatggccttcaccacttcataggcattttcgccatccatgaaccatggtgaaagtttttcaaccaggtttcctgaaccaggagacccagcatggcgtat

SEQ ID NO: 438087 - DNA, 140 bp, Artificial Sequence
  Synthetic
atacgccatgctgggtctcccaatggggttatgttggcaatcttgctactaatcacgatcgttattgctctgtccaccagggagcacatgtagcttctaatgacgcaataatgactcgttcgtacttgggagtcggccat

SEQ ID NO: 438088 - DNA, 140 bp, Artificial Sequence
  Synthetic
atggccgactcccaagtacgaacgagtcattattgcgtcattagaagctacatgtgctccctggtggacagagcaataacgatcgtgattagtagcaagattgccaacataaccccattgggagacccagcatggcgtat

SEQ ID NO: 438089 - DNA, 140 bp, Artificial Sequence
  Synthetic
atacgccatgctgggtctccattggctggctcctaataacatgtatatgaggacaacgcatacagatttaggcctttatttaagtctaagtttggcattggctgttgttgttaagcgtttcgtacttgggagtcggccat

SEQ ID NO: 438090 - DNA, 140 bp, Artificial Sequence
  Synthetic
atggccgactcccaagtacgaaacgcttaacaacaacagccaatgccaaacttagacttaaataaaggcctaaatctgtatgcgttgtcctcatatacatgttattaggagccagccaatggagacccagcatggcgtat

SEQ ID NO: 438091 - DNA, 140 bp, Artificial Sequence
  Synthetic
atacgccatgctgggtctccatctgtttttggaacagacccagcgttccctcaattttgtgggagaattcgttgtcaacgatgttgtactcgcaattctctctggtactacaactaatgtcgtacttgggagtcggccat

SEQ ID NO: 438092 - DNA, 140 bp, Artificial Sequence
  Synthetic
atggccgactcccaagtacgacattagttgtagtaccagagagaattgcgagtacaacatcgttgacaacgaattctcccacaaaattgagggaacgctgggtctgttccaaaaacagatggagacccagcatggcgtat

SEQ ID NO: 438093 - DNA, 140 bp, Artificial Sequence
  Synthetic
aggccctggctgctgatatgtgtcacaggaaagcaaaatattctcctgcgcaagtatggccgtggtggttaccatgtgagcgctcttgtctacaataataaattgttagccaagaaggaggaccttttgggacagcggtg

SEQ ID NO: 438094 - DNA, 140 bp, Artificial Sequence
  Synthetic
caccgctgtcccaaaaggtcctccttcttggctaacaatttattattgtagacaagagcgctcacatggtaaccaccacggccatacttgcgcaggagaatattttgctttcctgtgacacatatcagcagccagggcct

SEQ ID NO: 438095 - DNA, 140 bp, Artificial Sequence
  Synthetic
atacgccatgctgggtctccgttgtttttgacaggtccactaatactcatgcaaccttgtttggcagtgttgcttgtgagcacattggcacaatgatgcaacaattttcacgtatgacaccgtacttgggagtcggccat

SEQ ID NO: 438096 - DNA, 140 bp, Artificial Sequence
  Synthetic
atggccgactcccaagtacggtgtcatacgtgaaaattgttgcatcattgtgccaatgtgctcacaagcaacactgccaaacaaggttgcatgagtattagtggacctgtcaaaaacaacggagacccagcatggcgtat

SEQ ID NO: 438097 - DNA, 140 bp, Artificial Sequence
  Synthetic
atacgccatgctgggtctccggcgttgtgacaggtaatgttgtaaaacagtgttgcactgctgctgttgatttaagtatggataagttgcgccgtgtggattggaaatcaaccctacggtcgtacttgggagtcggccat

SEQ ID NO: 438098 - DNA, 140 bp, Artificial Sequence
  Synthetic
atggccgactcccaagtacgaccgtagggttgatttccaatccacacggcgcaacttatccatacttaaatcaacagcagcagtgcaacactgttttacaacattacctgtcacaacgccggagacccagcatggcgtat

SEQ ID NO: 438099 - DNA, 140 bp, Artificial Sequence
  Synthetic
aggccctggctgctgatatggaatagcttggctatctcacttcccctcgttctcttgcagaactttgattttaacgaacttaaataaaagccctgttgtttagcgtattgttgcacttgtgaccttttgggacagcggtg

SEQ ID NO: 438100 - DNA, 140 bp, Artificial Sequence
  Synthetic
caccgctgtcccaaaaggtcacaagtgcaacaatacgctaaacaacagggcttttatttaagttcgttaaaatcaaagttctgcaagagaacgaggggaagtgagatagccaagctattccatatcagcagccagggcct

SEQ ID NO: 438101 - DNA, 140 bp, Artificial Sequence
  Synthetic
atacgccatgctgggtctccagtcccgactgcgcatgcgtatttctgatgattctggtcctttgcaaacagccgtgggttgtgccatcggtcttgtgaattcttccttaattgttgacgacgtacttgggagtcggccat

SEQ ID NO: 438102 - DNA, 140 bp, Artificial Sequence
  Synthetic
atggccgactcccaagtacgtcgtcaacaattaaggaagaattcacaagaccgatggcacaacccacggctgtttgcaaaggaccagaatcatcagaaatacgcatgcgcagtcgggactggagacccagcatggcgtat

SEQ ID NO: 438103 - DNA, 140 bp, Artificial Sequence
  Synthetic
atacgccatgctgggtctccatgttgctatgttggcatgcaaactttggatgaattgcgtgcacgcactacttatacctgccaatgtggtggtgagcgtcatagacaactcattgagcaccgtacttgggagtcggccat

SEQ ID NO: 438104 - DNA, 140 bp, Artificial Sequence
  Synthetic
atggccgactcccaagtacggtgctcaatgagttgtctatgacgctcaccaccacattggcaggtataagtagtgcgtgcacgcaattcatccaaagtttgcatgccaacatagcaacatggagacccagcatggcgtat

SEQ ID NO: 438105 - DNA, 140 bp, Artificial Sequence
  Synthetic
aggccctggctgctgatatgtcgcttgtccactcttgcacagaatggaatcatgttgtaattacagtgcaataaggtaattataacccatttaattgatagctatgctttattaaagtgtgaccttttgggacagcggtg

SEQ ID NO: 438106 - DNA, 140 bp, Artificial Sequence
  Synthetic
caccgctgtcccaaaaggtcacactttaataaagcatagctatcaattaaatgggttataattaccttattgcactgtaattacaacatgattccattctgtgcaagagtggacaagcgacatatcagcagccagggcct

SEQ ID NO: 438107 - DNA, 140 bp, Artificial Sequence
  Synthetic
aggccctggctgctgatatggcatcttatgatactaatcttaataagttcaatagagctagtttgcgtcaaatttttgacgtagcccccattgaactcgaaaataaattcacacctttgagaccttttgggacagcggtg

SEQ ID NO: 438108 - DNA, 140 bp, Artificial Sequence
  Synthetic
caccgctgtcccaaaaggtctcaaaggtgtgaatttattttcgagttcaatgggggctacgtcaaaaatttgacgcaaactagctctattgaacttattaagattagtatcataagatgccatatcagcagccagggcct

SEQ ID NO: 438109 - DNA, 140 bp, Artificial Sequence
  Synthetic
aggccctggctgctgatatggtgtggagtctacaccagttgaacctccaactgtagatgtggtagcacttcaacaggaaatgacaattgtcaaatgtaagggtttaaataaacctttcgtgaccttttgggacagcggtg

SEQ ID NO: 438110 - DNA, 140 bp, Artificial Sequence
  Synthetic
caccgctgtcccaaaaggtcacgaaaggtttatttaaacccttacatttgacaattgtcatttcctgttgaagtgctaccacatctacagttggaggttcaactggtgtagactccacaccatatcagcagccagggcct

SEQ ID NO: 438111 - DNA, 140 bp, Artificial Sequence
  Synthetic
aggccctggctgctgatatgactctacccgcggcacttctccaggtccatctaagcccttgagtctggcaaagtaaagcaatcgcagccaaaagtaatcactaagaaagatgctgctgctgaccttttgggacagcggtg

SEQ ID NO: 438112 - DNA, 140 bp, Artificial Sequence
  Synthetic
caccgctgtcccaaaaggtcagcagcagcatctttcttagtgattacttttggctgcgattgctttactttgccagactcaagggcttagatggacctggagaagtgccgcgggtagagtcatatcagcagccagggcct

SEQ ID NO: 438113 - DNA, 140 bp, Artificial Sequence
  Synthetic
aggccctggctgctgatatgaaagatgctgctgctgctaaaaataagatgcgccacaagcgcacttccaccaaaagtttcaacatggtgcaagcttttggtcttcgcggaccaggagaccgaccttttgggacagcggtg

SEQ ID NO: 438114 - DNA, 140 bp, Artificial Sequence
  Synthetic
caccgctgtcccaaaaggtcggtctcctggtccgcgaagaccaaaagcttgcaccatgttgaaacttttggtggaagtgcgcttgtggcgcatcttatttttagcagcagcagcatctttcatatcagcagccagggcct

SEQ ID NO: 438115 - DNA, 140 bp, Artificial Sequence
  Synthetic
atacgccatgctgggtctcctagtgatgttttcattaagaagtatggcttggaaaactatgcttttgagcacgtagtctatggagacttctctcatactacgttaggcggtcttcacttgcgtacttgggagtcggccat

SEQ ID NO: 438116 - DNA, 140 bp, Artificial Sequence
  Synthetic
atggccgactcccaagtacgcaagtgaagaccgcctaacgtagtatgagagaagtctccatagactacgtgctcaaaagcatagttttccaagccatacttcttaatgaaaacatcactaggagacccagcatggcgtat

SEQ ID NO: 438117 - DNA, 140 bp, Artificial Sequence
  Synthetic
aggccctggctgctgatatgttttcgaattgacgtcccatctgcagaatcaactggtactcaatcagtttctgtcgatcgtgagtcaacttcaactcatgatggttttaacgaacatgttgaccttttgggacagcggtg

SEQ ID NO: 438118 - DNA, 140 bp, Artificial Sequence
  Synthetic
caccgctgtcccaaaaggtcaacatgttcgttaaaaccatcatgagttgaagttgactcacgatcgacagaaactgattgagtaccagttgattctgcagatgggacgtcaattcgaaaacatatcagcagccagggcct

SEQ ID NO: 438119 - DNA, 140 bp, Artificial Sequence
  Synthetic
atacgccatgctgggtctccttgcgccgtctaccctatagacttgtcaacccagatcatctctggcataatagctttcatctctgcatgcatgtggatttcctacttcgtgcagagcatccgtacttgggagtcggccat

SEQ ID NO: 438120 - DNA, 140 bp, Artificial Sequence
  Synthetic
atggccgactcccaagtacggatgctctgcacgaagtaggaaatccacatgcatgcagagatgaaagctattatgccagagatgatctgggttgacaagtctatagggtagacggcgcaaggagacccagcatggcgtat

SEQ ID NO: 438121 - DNA, 140 bp, Artificial Sequence
  Synthetic
aggccctggctgctgatatggctgttcttctaattgcaaacattcagttgctcagttggttagttacctttctgaacgctgtaatgttattgctgattctaagtccttcacacttatcttgaccttttgggacagcggtg

SEQ ID NO: 438122 - DNA, 140 bp, Artificial Sequence
  Synthetic
caccgctgtcccaaaaggtcaagataagtgtgaaggacttagaatcagcaataacattacagcgttcagaaaggtaactaaccaactgagcaactgaatgtttgcaattagaagaacagccatatcagcagccagggcct

SEQ ID NO: 438123 - DNA, 140 bp, Artificial Sequence
  Synthetic
atacgccatgctgggtctccagtgaccgtcgccaaacccaatgtactaatagctttgaaaatggtaaagagacaagactacggaacaaactccggtgtggctatttaccacagatacaagcgtacttgggagtcggccat

SEQ ID NO: 438124 - DNA, 140 bp, Artificial Sequence
  Synthetic
atggccgactcccaagtacgcttgtatctgtggtaaatagccacaccggagtttgttccgtagtcttgtctctttaccattttcaaagctattagtacattgggtttggcgacggtcactggagacccagcatggcgtat

SEQ ID NO: 438125 - DNA, 140 bp, Artificial Sequence
  Synthetic
aggccctggctgctgatatgttttttagtccgcctcttgcaagataagactggcgactttatgtctacaattattacttcctgccaaattgctgttagtaagtttctagatacatgttttgaccttttgggacagcggtg

SEQ ID NO: 438126 - DNA, 140 bp, Artificial Sequence
  Synthetic
caccgctgtcccaaaaggtcaaaacatgtatctagaaacttactaacagcaatttggcaggaagtaataattgtagacataaagtcgccagtcttatcttgcaagaggcggactaaaaaacatatcagcagccagggcct

SEQ ID NO: 438127 - DNA, 140 bp, Artificial Sequence
  Synthetic
atacgccatgctgggtctccttcacacagccacatgtgttgaatcctctcaactctagtggctttgttgttgaaattcccaccaatttttcgtttggtgttacacaggagtacattcagacgtacttgggagtcggccat

SEQ ID NO: 438128 - DNA, 140 bp, Artificial Sequence
  Synthetic
atggccgactcccaagtacgtctgaatgtactcctgtgtaacaccaaacgaaaaattggtgggaatttcaacaacaaagccactagagttgagaggattcaacacatgtggctgtgtgaaggagacccagcatggcgtat

SEQ ID NO: 438129 - DNA, 140 bp, Artificial Sequence
  Synthetic
atacgccatgctgggtctccatgatacactcagtgtttctactgatgttcttgttaacacctacagaaagttacgttgatgtagggccagattctgttaagtctgcttgtattgaggttgcgtacttgggagtcggccat

SEQ ID NO: 438130 - DNA, 140 bp, Artificial Sequence
  Synthetic
atggccgactcccaagtacgcaacctcaatacaagcagacttaacagaatctggccctacatcaacgtaactttctgtaggtgttaacaagaacatcagtagaaacactgagtgtatcatggagacccagcatggcgtat

SEQ ID NO: 438131 - DNA, 140 bp, Artificial Sequence
  Synthetic
atacgccatgctgggtctccagatttgctgatgggctctgcttattttggaactgtaatgtaccaaaatatcctaataatgcaattgtatgcaggtttgacacacgtgtgcattctgagtcgtacttgggagtcggccat

SEQ ID NO: 438132 - DNA, 140 bp, Artificial Sequence
  Synthetic
atggccgactcccaagtacgactcagaatgcacacgtgtgtcaaacctgcatacaattgcattattaggatattttggtacattacagttccaaaataagcagagcccatcagcaaatctggagacccagcatggcgtat

SEQ ID NO: 438133 - DNA, 140 bp, Artificial Sequence
  Synthetic
aggccctggctgctgatatgcgagtgatgagctttgcgtgaatcttaatttacccgcaaatgtcccatactctcgtgttatttccaggatgggctttaaactcgatgcaacagttcctgggaccttttgggacagcggtg

SEQ ID NO: 438134 - DNA, 140 bp, Artificial Sequence
  Synthetic
caccgctgtcccaaaaggtcccaggaactgttgcatcgagtttaaagcccatcctggaaataacacgagagtatgggacatttgcgggtaaattaagattcacgcaaagctcatcactcgcatatcagcagccagggcct

SEQ ID NO: 438135 - DNA, 140 bp, Artificial Sequence
  Synthetic
aggccctggctgctgatatgtattacgaacctgtgcagggtcgtaaaatgctgatggctcttctttctgataatgcctatctcaaatgggcgcctgtgctctcaatgaccgattgtctgggaccttttgggacagcggtg

SEQ ID NO: 438136 - DNA, 140 bp, Artificial Sequence
  Synthetic
caccgctgtcccaaaaggtcccagacaatcggtcattgagagcacaggcgcccatttgagataggcattatcagaaagaagagccatcagcattttacgaccctgcacaggttcgtaatacatatcagcagccagggcct

SEQ ID NO: 438137 - DNA, 140 bp, Artificial Sequence
  Synthetic
aggccctggctgctgatatgatctgagtacttactcactttttgatttatccaagtttcaattaaaattaaaaggaacaccagttcttcaattaaaggagagtcaaattaacgaactcgtgaccttttgggacagcggtg

SEQ ID NO: 438138 - DNA, 140 bp, Artificial Sequence
  Synthetic
caccgctgtcccaaaaggtcacgagttcgttaatttgactctcctttaattgaagaactggtgttccttttaattttaattgaaacttggataaatcaaaaagtgagtaagtactcagatcatatcagcagccagggcct

SEQ ID NO: 438139 - DNA, 140 bp, Artificial Sequence
  Synthetic
aggccctggctgctgatatgctgcgtgattgcaagtgaacagtgccccccgggaagagctctacagtgtgaaatgtaaataaaaatagctattattcaattagattaggctaattagatggaccttttgggacagcggtg

SEQ ID NO: 438140 - DNA, 140 bp, Artificial Sequence
  Synthetic
caccgctgtcccaaaaggtccatctaattagcctaatctaattgaataatagctatttttatttacatttcacactgtagagctcttcccggggggcactgttcacttgcaatcacgcagcatatcagcagccagggcct

SEQ ID NO: 438141 - DNA, 140 bp, Artificial Sequence
  Synthetic
atacgccatgctgggtctccatgcatccgtagaccatttctctgctgtaaatgcttgtctgtttctccttacgtttgtaatgcccctggttgtggcgtttcagacgttactaagctatatcgtacttgggagtcggccat

SEQ ID NO: 438142 - DNA, 140 bp, Artificial Sequence
  Synthetic
atggccgactcccaagtacgatatagcttagtaacgtctgaaacgccacaaccaggggcattacaaacgtaaggagaaacagacaagcatttacagcagagaaatggtctacggatgcatggagacccagcatggcgtat

SEQ ID NO: 438143 - DNA, 140 bp, Artificial Sequence
  Synthetic
atacgccatgctgggtctcccgaccattcagaaggttactgttgattgtaaacagtacgtttgtaatggtttcgctaagtgcgaacaactgctccgagaatatgggcagttttgtgctaacgtacttgggagtcggccat

SEQ ID NO: 438144 - DNA, 140 bp, Artificial Sequence
  Synthetic
atggccgactcccaagtacgttagcacaaaactgcccatattctcggagcagttgttcgcacttagcgaaaccattacaaacgtactgtttacaatcaacagtaaccttctgaatggtcgggagacccagcatggcgtat

SEQ ID NO: 438145 - DNA, 140 bp, Artificial Sequence
  Synthetic
aggccctggctgctgatatgtcatagctgacaccttacaggaaactcctgttgtgcctgatactgttggagtcccaccgcaagtggtggaacttccgtctgaacctcagactatccagccgaccttttgggacagcggtg

SEQ ID NO: 438146 - DNA, 140 bp, Artificial Sequence
  Synthetic
caccgctgtcccaaaaggtcggctggatagtctgaggttcagacggaagttccaccacttgcggtgggactccaacagtatcaggcacaacaggagtttcctgtaaggtgtcagctatgacatatcagcagccagggcct

SEQ ID NO: 438147 - DNA, 140 bp, Artificial Sequence
  Synthetic
atacgccatgctgggtctcctgcttgaacaatatggccagttttgctcaaaaattaatcaagctcttcatggtgctaatttgcgccaagatgactcagttcgtaacttgtttgagagtgtcgtacttgggagtcggccat

SEQ ID NO: 438148 - DNA, 140 bp, Artificial Sequence
  Synthetic
atggccgactcccaagtacgacactctcaaacaagttacgaactgagtcatcttggcgcaaattagcaccatgaagagcttgattaatttttgagcaaaactggccatattgttcaagcaggagacccagcatggcgtat

SEQ ID NO: 438149 - DNA, 140 bp, Artificial Sequence
  Synthetic
aggccctggctgctgatatgcaatggcaaagtttctacacttgtcaaacaagtgttagacttgcttaataagggtatgcaacttttgcatacaaaggtctcctgggctggttctaatatcgaccttttgggacagcggtg

SEQ ID NO: 438150 - DNA, 140 bp, Artificial Sequence
  Synthetic
caccgctgtcccaaaaggtcgatattagaaccagcccaggagacctttgtatgcaaaagttgcatacccttattaagcaagtctaacacttgtttgacaagtgtagaaactttgccattgcatatcagcagccagggcct

SEQ ID NO: 438151 - DNA, 140 bp, Artificial Sequence
  Synthetic
atacgccatgctgggtctccgtacactccatctctgtctaatcttgcacttgccttgtgcagtttagttatgtgggtttacacttatagtatcggtgagcattcttcacctgtggcttaccgtacttgggagtcggccat

SEQ ID NO: 438152 - DNA, 140 bp, Artificial Sequence
  Synthetic
atggccgactcccaagtacggtaagccacaggtgaagaatgctcaccgatactataagtgtaaacccacataactaaactgcacaaggcaagtgcaagattagacagagatggagtgtacggagacccagcatggcgtat

SEQ ID NO: 438153 - DNA, 140 bp, Artificial Sequence
  Synthetic
atacgccatgctgggtctccgttgttgtcttccctttatcacttgtacatctttaacgaggttgtttcaagtgatgcattgttagaggatgccactggagttacagcactctataaagagcgtacttgggagtcggccat

SEQ ID NO: 438154 - DNA, 140 bp, Artificial Sequence
  Synthetic
atggccgactcccaagtacgctctttatagagtgctgtaactccagtggcatcctctaacaatgcatcacttgaaacaacctcgttaaagatgtacaagtgataaagggaagacaacaacggagacccagcatggcgtat

SEQ ID NO: 438155 - DNA, 140 bp, Artificial Sequence
  Synthetic
aggccctggctgctgatatgtcttgcagaactttgattttaacgaacttaaataaaagccctgttgtttagcgtattgttgcacttgtctggtgggattgtggcattaatttgcctgctcgaccttttgggacagcggtg

SEQ ID NO: 438156 - DNA, 140 bp, Artificial Sequence
  Synthetic
caccgctgtcccaaaaggtcgagcaggcaaattaatgccacaatcccaccagacaagtgcaacaatacgctaaacaacagggcttttatttaagttcgttaaaatcaaagttctgcaagacatatcagcagccagggcct

SEQ ID NO: 438157 - DNA, 140 bp, Artificial Sequence
  Synthetic
atacgccatgctgggtctcctacctgcggtagcatgactcttaatggtctttggcttgacaacacagtctggtgcccacgacacgtaatgtgcccggctgaccagttgtctgatcctaatcgtacttgggagtcggccat

SEQ ID NO: 438158 - DNA, 140 bp, Artificial Sequence
  Synthetic
atggccgactcccaagtacgattaggatcagacaactggtcagccgggcacattacgtgtcgtgggcaccagactgtgttgtcaagccaaagaccattaagagtcatgctaccgcaggtaggagacccagcatggcgtat

SEQ ID NO: 438159 - DNA, 140 bp, Artificial Sequence
  Synthetic
atacgccatgctgggtctccaataaaccaagctttgcatggtgctaatcttaggcaggatgaatccattgccaacttatttgcaaatataaagacagaggccacccaaccacttgatgctcgtacttgggagtcggccat

SEQ ID NO: 438160 - DNA, 140 bp, Artificial Sequence
  Synthetic
atggccgactcccaagtacgagcatcaagtggttgggtggcctctgtctttatatttgcaaataagttggcaatggattcatcctgcctaagattagcaccatgcaaagcttggtttattggagacccagcatggcgtat

SEQ ID NO: 438161 - DNA, 140 bp, Artificial Sequence
  Synthetic
atacgccatgctgggtctcccttcgtgcctgctgtgcgcgactcagtacctctccacataatcgcaccaagcgtgctttcggtttaagctcgcttagcgcttctatggtcccatgtagagcgtacttgggagtcggccat

SEQ ID NO: 438162 - DNA, 140 bp, Artificial Sequence
  Synthetic
atggccgactcccaagtacgctctacatgggaccatagaagcgctaagcgagcttaaaccgaaagcacgcttggtgcgattatgtggagaggtactgagtcgcgcacagcaggcacgaagggagacccagcatggcgtat

SEQ ID NO: 438163 - DNA, 140 bp, Artificial Sequence
  Synthetic
atacgccatgctgggtctccactccatgcgaagttcatggtaatggtagtatgatagaggatattgattatgtaccccttaaatctgcagtctgtattacagcgtgcaatttaggtggggcgtacttgggagtcggccat

SEQ ID NO: 438164 - DNA, 140 bp, Artificial Sequence
  Synthetic
atggccgactcccaagtacgccccacctaaattgcacgctgtaatacagactgcagatttaaggggtacataatcaatatcctctatcatactaccattaccatgaacttcgcatggagtggagacccagcatggcgtat

SEQ ID NO: 438165 - DNA, 140 bp, Artificial Sequence
  Synthetic
atacgccatgctgggtctccgctcgtagctatcttggtatcacttctgcctgtgatggtgttgcacgtgattatagagccaattcatttgacatctctaattattgtgcgaaccgctctgcgtacttgggagtcggccat

SEQ ID NO: 438166 - DNA, 140 bp, Artificial Sequence
  Synthetic
atggccgactcccaagtacgcagagcggttcgcacaataattagagatgtcaaatgaattggctctataatcacgtgcaacaccatcacaggcagaagtgataccaagatagctacgagcggagacccagcatggcgtat

SEQ ID NO: 438167 - DNA, 140 bp, Artificial Sequence
  Synthetic
aggccctggctgctgatatgcttatcacactcctgcaacagattgttctgatggcaattacaatcgtaatgccagtctgaactcttttaaggagtattttaatttacgtaactccaccttgaccttttgggacagcggtg

SEQ ID NO: 438168 - DNA, 140 bp, Artificial Sequence
  Synthetic
caccgctgtcccaaaaggtcaaggtggagttacgtaaattaaaatactccttaaaagagttcagactggcattacgattgtaattgccatcagaacaatctgttgcaggagtgtgataagcatatcagcagccagggcct

SEQ ID NO: 438169 - DNA, 140 bp, Artificial Sequence
  Synthetic
aggccctggctgctgatatgcctacttataagaatggtgccatgtataaaggcaaaccaattctttgggtcaacaaagcatcttatgatactaatcttaataagttcaatagagctagttgaccttttgggacagcggtg

SEQ ID NO: 438170 - DNA, 140 bp, Artificial Sequence
  Synthetic
caccgctgtcccaaaaggtcaactagctctattgaacttattaagattagtatcataagatgctttgttgacccaaagaattggtttgcctttatacatggcaccattcttataagtaggcatatcagcagccagggcct

SEQ ID NO: 438171 - DNA, 140 bp, Artificial Sequence
  Synthetic
atacgccatgctgggtctccgttacaataattatgtaccctcatatgttaaacctgatagtgtgtctaccagtgatttaggtagaaagccttacaaacatacagcgagactggtagtgatcgtacttgggagtcggccat

SEQ ID NO: 438172 - DNA, 140 bp, Artificial Sequence
  Synthetic
atggccgactcccaagtacgatcactaccagtctcgctgtatgtttgtaaggctttctacctaaatcactggtagacacactatcaggtttaacatatgagggtacataattattgtaacggagacccagcatggcgtat

SEQ ID NO: 438173 - DNA, 140 bp, Artificial Sequence
  Synthetic
aggccctggctgctgatatggttgttgagtatctgtctaaagaagacctacatacattgtatgtagaccctaagtatcaagtcattgtcttaaaagacaatgtactttcttctatgcttagaccttttgggacagcggtg

SEQ ID NO: 438174 - DNA, 140 bp, Artificial Sequence
  Synthetic
caccgctgtcccaaaaggtctaagcatagaagaaagtacattgtcttttaagacaatgacttgatacttagggtctacatacaatgtatgtaggtcttctttagacagatactcaacaaccatatcagcagccagggcct

SEQ ID NO: 438175 - DNA, 140 bp, Artificial Sequence
  Synthetic
atacgccatgctgggtctccctgtttgtaggaagcatgctacagagtacagagattatatggaagcatataacctcgtatctgcttcaggtttccgattttggtgctataagacctttgacgtacttgggagtcggccat

SEQ ID NO: 438176 - DNA, 140 bp, Artificial Sequence
  Synthetic
atggccgactcccaagtacgtcaaaggtcttatagcaccaaaatcggaaacctgaagcagatacgaggttatatgcttccatataatctctgtactctgtagcatgcttcctacaaacagggagacccagcatggcgtat

SEQ ID NO: 438177 - DNA, 140 bp, Artificial Sequence
  Synthetic
atacgccatgctgggtctcctactatgtaagtggtgcctattaggtcaagactccattacacattattctgctctcaagatggtacaaacacatttaagccactatgttcttaacgtagacgtacttgggagtcggccat

SEQ ID NO: 438178 - DNA, 140 bp, Artificial Sequence
  Synthetic
atggccgactcccaagtacgtctacgttaagaacatagtggcttaaatgtgtttgtaccatcttgagagcagaataatgtgtaatggagtcttgacctaataggcaccacttacatagtaggagacccagcatggcgtat

SEQ ID NO: 438179 - DNA, 140 bp, Artificial Sequence
  Synthetic
aggccctggctgctgatatgttgccactttaatgactttttctggtaatgtagatcttgatgcgttagctagtgatatttttgattttaaggagtattttaatttacgtaactgcaccttgaccttttgggacagcggtg

SEQ ID NO: 438180 - DNA, 140 bp, Artificial Sequence
  Synthetic
caccgctgtcccaaaaggtcaaggtgcagttacgtaaattaaaatactccttaaaatcaaaaatatcactagctaacgcatcaagatctacattaccagaaaaagtcattaaagtggcaacatatcagcagccagggcct

SEQ ID NO: 438181 - DNA, 140 bp, Artificial Sequence
  Synthetic
aggccctggctgctgatatgtttcattactcgtgaagaggctgtaaggcaagttcgaagctggataggcttcgatgttgagggtcttcacttgcttattggtttatacaagaagcaacaggaccttttgggacagcggtg

SEQ ID NO: 438182 - DNA, 140 bp, Artificial Sequence
  Synthetic
caccgctgtcccaaaaggtcctgttgcttcttgtataaaccaataagcaagtgaagaccctcaacatcgaagcctatccagcttcgaacttgccttacagcctcttcacgagtaatgaaacatatcagcagccagggcct

SEQ ID NO: 438183 - DNA, 140 bp, Artificial Sequence
  Synthetic
aggccctggctgctgatatgttgatgcctgtgctctcaatgaccgattgtctggccgctgagacacatagggattgtgattttcttcgtacttacctctcactctgtggctaccttgacggaccttttgggacagcggtg

SEQ ID NO: 438184 - DNA, 140 bp, Artificial Sequence
  Synthetic
caccgctgtcccaaaaggtccgtcaaggtagccacagagtgagaggtaagtacgaagaaaatcacaatccctatgtgtctcagcggccagacaatcggtcattgagagcacaggcatcaacatatcagcagccagggcct

SEQ ID NO: 438185 - DNA, 140 bp, Artificial Sequence
  Synthetic
aggccctggctgctgatatgagacggtcaaccatgctacgagcggtttcccctctgcgcttttacaaatctagataagttgaagttcaaagaggtctgtaaaactactactggtatacctgaccttttgggacagcggtg

SEQ ID NO: 438186 - DNA, 140 bp, Artificial Sequence
  Synthetic
caccgctgtcccaaaaggtcaggtataccagtagtagttttacagacctctttgaacttcaacttatctagatttgtaaaagcgcagaggggaaaccgctcgtagcatggttgaccgtctcatatcagcagccagggcct

SEQ ID NO: 438187 - DNA, 140 bp, Artificial Sequence
  Synthetic
aggccctggctgctgatatgctcatgtggcttctaatgatgcaataatgactcgttgtttagctattcattcttgttttatagaacgtgtggattgggatatagagtatccttatatctcgaccttttgggacagcggtg

SEQ ID NO: 438188 - DNA, 140 bp, Artificial Sequence
  Synthetic
caccgctgtcccaaaaggtcgagatataaggatactctatatcccaatccacacgttctataaaacaagaatgaatagctaaacaacgagtcattattgcatcattagaagccacatgagcatatcagcagccagggcct

SEQ ID NO: 438189 - DNA, 140 bp, Artificial Sequence
  Synthetic
aggccctggctgctgatatggcacgaggtcccgcaggtgtggagtctgatgttgagaccaatgaaattgttgactctgtgcagtatgctcataaacatgacatacaacttactaatgagagaccttttgggacagcggtg

SEQ ID NO: 438190 - DNA, 140 bp, Artificial Sequence
  Synthetic
caccgctgtcccaaaaggtctctcattagtaagttgtatgtcatgtttatgagcatactgcacagagtcaacaatttcattggtctcaacatcagactccacacctgcgggacctcgtgccatatcagcagccagggcct

SEQ ID NO: 438191 - DNA, 140 bp, Artificial Sequence
  Synthetic
atacgccatgctgggtctccgctataataattatgtaccctcatatgttaaacctgatagtgtgtctaccagcgatttaggtagtctcattgattgtaatgcggcttcagttaaccaaaccgtacttgggagtcggccat

SEQ ID NO: 438192 - DNA, 140 bp, Artificial Sequence
  Synthetic
atggccgactcccaagtacggtttggttaactgaagccgcattacaatcaatgagactacctaaatcgctggtagacacactatcaggtttaacatatgagggtacataattattatagcggagacccagcatggcgtat

SEQ ID NO: 438193 - DNA, 140 bp, Artificial Sequence
  Synthetic
aggccctggctgctgatatgccgggaagagctctacagtgtgaaatgtaaataaaaatagctattattcaattagattaggctaattagatgatttgcaaaaaaaaaaaaaaaaaaaaaagaccttttgggacagcggtg

SEQ ID NO: 438194 - DNA, 140 bp, Artificial Sequence
  Synthetic
caccgctgtcccaaaaggtcttttttttttttttttttttttgcaaatcatctaattagcctaatctaattgaataatagctatttttatttacatttcacactgtagagctcttcccggcatatcagcagccagggcct

SEQ ID NO: 438195 - DNA, 140 bp, Artificial Sequence
  Synthetic
atacgccatgctgggtctcctggctataaagttttgcctccactttatgaccctaacatggaagctgcatacacttcctctcttgttgggtctattctaggcgctggttggactgctggacgtacttgggagtcggccat

SEQ ID NO: 438196 - DNA, 140 bp, Artificial Sequence
  Synthetic
atggccgactcccaagtacgtccagcagtccaaccagcgcctagaatagacccaacaagagaggaagtgtatgcagcttccatgttagggtcataaagtggaggcaaaactttatagccaggagacccagcatggcgtat

SEQ ID NO: 438197 - DNA, 140 bp, Artificial Sequence
  Synthetic
aggccctggctgctgatatgacactcagagtcgctcttgtagtgacttcctacccctgtctgacatggagaaagactttctatcttttgatagtgatgttttcattaagaagtatggcttgaccttttgggacagcggtg

SEQ ID NO: 438198 - DNA, 140 bp, Artificial Sequence
  Synthetic
caccgctgtcccaaaaggtcaagccatacttcttaatgaaaacatcactatcaaaagatagaaagtctttctccatgtcagacaggggtaggaagtcactacaagagcgactctgagtgtcatatcagcagccagggcct

SEQ ID NO: 438199 - DNA, 140 bp, Artificial Sequence
  Synthetic
aggccctggctgctgatatgaattacaagcaatctattcctatgcctcgcggtgtgcacatgaacatcgctaaatatatgcaattgtgccagtatttgaatacttgcacaatagctgtacgaccttttgggacagcggtg

SEQ ID NO: 438200 - DNA, 140 bp, Artificial Sequence
  Synthetic
caccgctgtcccaaaaggtcgtacagctattgtgcaagtattcaaatactggcacaattgcatatatttagcgatgttcatgtgcacaccgcgaggcataggaatagattgcttgtaattcatatcagcagccagggcct

SEQ ID NO: 438201 - DNA, 140 bp, Artificial Sequence
  Synthetic
atacgccatgctgggtctcccagacttcattgtttgtggactggcgttcctataactatgtggtctcatgcatttacttgttcttcacgcatattccacttgatggtcttgttagaatctcgtacttgggagtcggccat

SEQ ID NO: 438202 - DNA, 140 bp, Artificial Sequence
  Synthetic
atggccgactcccaagtacgagattctaacaagaccatcaagtggaatatgcgtgaagaacaagtaaatgcatgagaccacatagttataggaacgccagtccacaaacaatgaagtctgggagacccagcatggcgtat

SEQ ID NO: 438203 - DNA, 140 bp, Artificial Sequence
  Synthetic
aggccctggctgctgatatgttttaaggagtactttaatttacgtaactgcacctttatgtacacttataacattaccgaagatgagattttagagtggtttggcattacacaaactgctgaccttttgggacagcggtg

SEQ ID NO: 438204 - DNA, 140 bp, Artificial Sequence
  Synthetic
caccgctgtcccaaaaggtcagcagtttgtgtaatgccaaaccactctaaaatctcatcttcggtaatgttataagtgtacataaaggtgcagttacgtaaattaaagtactccttaaaacatatcagcagccagggcct

SEQ ID NO: 438205 - DNA, 140 bp, Artificial Sequence
  Synthetic
atacgccatgctgggtctccctgtgtgcttcaaataaacttcgcgttgtaattcctgacttcaccgtctggaatcaggtagtcacatatccctcgcttaactacgctggggctttgtgggcgtacttgggagtcggccat

SEQ ID NO: 438206 - DNA, 140 bp, Artificial Sequence
  Synthetic
atggccgactcccaagtacgcccacaaagccccagcgtagttaagcgagggatatgtgactacctgattccagacggtgaagtcaggaattacaacgcgaagtttatttgaagcacacagggagacccagcatggcgtat

SEQ ID NO: 438207 - DNA, 140 bp, Artificial Sequence
  Synthetic
aggccctggctgctgatatgttggcactcaatccgttgacatgttagctgtcaaaacaggcgttgctattgaacagctgctttatgcgatccaacaattgtatactgggttccagggaaagaccttttgggacagcggtg

SEQ ID NO: 438208 - DNA, 140 bp, Artificial Sequence
  Synthetic
caccgctgtcccaaaaggtctttccctggaacccagtatacaattgttggatcgcataaagcagctgttcaatagcaacgcctgttttgacagctaacatgtcaacggattgagtgccaacatatcagcagccagggcct

SEQ ID NO: 438209 - DNA, 140 bp, Artificial Sequence
  Synthetic
atacgccatgctgggtctccttgaactatatgcgaaacgcgctgttcgttcgcatccagatttcaagctgctacacaatttacaagcagacatttgctacaagttcgtcctgtgggactacgtacttgggagtcggccat

SEQ ID NO: 438210 - DNA, 140 bp, Artificial Sequence
  Synthetic
atggccgactcccaagtacgtagtcccacaggacgaacttgtagcaaatgtctgcttgtaaattgtgtagcagcttgaaatctggatgcgaacgaacagcgcgtttcgcatatagttcaaggagacccagcatggcgtat

SEQ ID NO: 438211 - DNA, 140 bp, Artificial Sequence
  Synthetic
atacgccatgctgggtctccctggtctttgttaccacactgaccagtgattatacagtcactgttttcacagcagtgaattttgcaaaatttttaacttacctcatctactcctactcgccgtacttgggagtcggccat

SEQ ID NO: 438212 - DNA, 140 bp, Artificial Sequence
  Synthetic
atggccgactcccaagtacggcgagtaggagtagatgaggtaagttaaaaattttgcaaaattcactgctgtgaaaacagtgactgtataatcactggtcagtgtggtaacaaagaccagggagacccagcatggcgtat

SEQ ID NO: 438213 - DNA, 140 bp, Artificial Sequence
  Synthetic
atacgccatgctgggtctccacaatgttctagcttgcctttggtttctgcgtcgtttttataaccatgttattaatggatgtaaggatacagcatgtctcctttgttataagaggaatcgcgtacttgggagtcggccat

SEQ ID NO: 438214 - DNA, 140 bp, Artificial Sequence
  Synthetic
atggccgactcccaagtacgcgattcctcttataacaaaggagacatgctgtatccttacatccattaataacatggttataaaaacgacgcagaaaccaaaggcaagctagaacattgtggagacccagcatggcgtat

SEQ ID NO: 438215 - DNA, 140 bp, Artificial Sequence
  Synthetic
aggccctggctgctgatatgcccgtccaagtgttcagcctggtccaatgattgatgttaacactgattagtgtcactcaaagtaacaagatcgcggcaatcgtttgtgtttggcaaccccgaccttttgggacagcggtg

SEQ ID NO: 438216 - DNA, 140 bp, Artificial Sequence
  Synthetic
caccgctgtcccaaaaggtcggggttgccaaacacaaacgattgccgcgatcttgttactttgagtgacactaatcagtgttaacatcaatcattggaccaggctgaacacttggacgggcatatcagcagccagggcct

SEQ ID NO: 438217 - DNA, 140 bp, Artificial Sequence
  Synthetic
aggccctggctgctgatatgcctgtgcagggtcgtaaaatgctgatggctcttctttctgataatgcctatcttaaatgggctcgtgttgaaggtaaggatggatttgttagtgtagagcgaccttttgggacagcggtg

SEQ ID NO: 438218 - DNA, 140 bp, Artificial Sequence
  Synthetic
caccgctgtcccaaaaggtcgctctacactaacaaatccatccttaccttcaacacgagcccatttaagataggcattatcagaaagaagagccatcagcattttacgaccctgcacaggcatatcagcagccagggcct

SEQ ID NO: 438219 - DNA, 140 bp, Artificial Sequence
  Synthetic
atacgccatgctgggtctccttgccaacaagttcaatcaagctctgggagctatgcagactggcttcaccaccacaaatcttgccttttcaaaggtgcaagatgccgtgaatgccaatgccgtacttgggagtcggccat

SEQ ID NO: 438220 - DNA, 140 bp, Artificial Sequence
  Synthetic
atggccgactcccaagtacggcattggcattcacggcatcttgcacctttgaaaaggcaagatttgtggtggtgaagccagtctgcatagctcccagagcttgattgaacttgttggcaaggagacccagcatggcgtat

SEQ ID NO: 438221 - DNA, 140 bp, Artificial Sequence
  Synthetic
atacgccatgctgggtctccgttaattgtactgatgaccgttgtgtgttacattgtgctaacttcaatgtgttgtttgctatgaccatgcctaagacttgtttcggacccatagtccgaacgtacttgggagtcggccat

SEQ ID NO: 438222 - DNA, 140 bp, Artificial Sequence
  Synthetic
atggccgactcccaagtacgttcggactatgggtccgaaacaagtcttaggcatggtcatagcaaacaacacattgaagttagcacaatgtaacacacaacggtcatcagtacaattaacggagacccagcatggcgtat

SEQ ID NO: 438223 - DNA, 140 bp, Artificial Sequence
  Synthetic
atacgccatgctgggtctcctttgactcgtgttgaagcctctaccgttgtatgtggtgcaaaacgtacgttttacattacagctaacggtggcacctcattctgtcgcaagcataattggcgtacttgggagtcggccat

SEQ ID NO: 438224 - DNA, 140 bp, Artificial Sequence
  Synthetic
atggccgactcccaagtacgccaattatgcttgcgacagaatgaggtgccaccgttagctgtaatgtaaaacgtacgttttgcaccacatacaacggtagaggcttcaacacgagtcaaaggagacccagcatggcgtat

SEQ ID NO: 438225 - DNA, 140 bp, Artificial Sequence
  Synthetic
aggccctggctgctgatatggcaaccacattgaggttgtttctgcttatggtctttgcgatgcagctaaccctactaattgtatagcccctgttaatggctactttattaaaactaataagaccttttgggacagcggtg

SEQ ID NO: 438226 - DNA, 140 bp, Artificial Sequence
  Synthetic
caccgctgtcccaaaaggtcttattagttttaataaagtagccattaacaggggctatacaattagtagggttagctgcatcgcaaagaccataagcagaaacaacctcaatgtggttgccatatcagcagccagggcct

SEQ ID NO: 438227 - DNA, 140 bp, Artificial Sequence
  Synthetic
atacgccatgctgggtctccggtaaatccttcactctggcatttggtggcgtcgtttacgcatacctggggtgtcttgaaggtactatgtactttattcctcgtgctaaatccattgtctcgtacttgggagtcggccat

SEQ ID NO: 438228 - DNA, 140 bp, Artificial Sequence
  Synthetic
atggccgactcccaagtacgagacaatggatttagcacgaggaataaagtacatagtaccttcaagacaccccaggtatgcgtaaacgacgccaccaaatgccagagtgaaggatttaccggagacccagcatggcgtat

SEQ ID NO: 438229 - DNA, 140 bp, Artificial Sequence
  Synthetic
aggccctggctgctgatatgtctggtgggattgtggcattaatttgcctgctcatctaggcagtggacatatgctcaacactgggtataattctaattgaatactatttttcagttagaggaccttttgggacagcggtg

SEQ ID NO: 438230 - DNA, 140 bp, Artificial Sequence
  Synthetic
caccgctgtcccaaaaggtcctctaactgaaaaatagtattcaattagaattatacccagtgttgagcatatgtccactgcctagatgagcaggcaaattaatgccacaatcccaccagacatatcagcagccagggcct

SEQ ID NO: 438231 - DNA, 140 bp, Artificial Sequence
  Synthetic
atacgccatgctgggtctcctcatgggttttcatgaaacaaatgacactgttgaagaatgccatctttctttgggacaatcactctgtgctatacccccaaacaccaacttgcgttcaggcgtacttgggagtcggccat

SEQ ID NO: 438232 - DNA, 140 bp, Artificial Sequence
  Synthetic
atggccgactcccaagtacgcctgaacgcaagttggtgtttgggggtatagcacagagtgattgtcccaaagaaagatggcattcttcaacagtgtcatttgtttcatgaaaacccatgaggagacccagcatggcgtat

SEQ ID NO: 438233 - DNA, 140 bp, Artificial Sequence
  Synthetic
aggccctggctgctgatatgcctcgttctcttgcagaactttgattttaacgaacttaaataaaagccctgttgtttagcgtattgttgcacttgtctggtgggattgtggcattaatttgaccttttgggacagcggtg

SEQ ID NO: 438234 - DNA, 140 bp, Artificial Sequence
  Synthetic
caccgctgtcccaaaaggtcaaattaatgccacaatcccaccagacaagtgcaacaatacgctaaacaacagggcttttatttaagttcgttaaaatcaaagttctgcaagagaacgaggcatatcagcagccagggcct

SEQ ID NO: 438235 - DNA, 140 bp, Artificial Sequence
  Synthetic
aggccctggctgctgatatgaacgatgttcttaatggtatcatttctaacgctaggaatggttgtatacctcttagtgtcattccactgtgtgcttcaaataaacttcgcgttgtaattcgaccttttgggacagcggtg

SEQ ID NO: 438236 - DNA, 140 bp, Artificial Sequence
  Synthetic
caccgctgtcccaaaaggtcgaattacaacgcgaagtttatttgaagcacacagtggaatgacactaagaggtatacaaccattcctagcgttagaaatgataccattaagaacatcgttcatatcagcagccagggcct

SEQ ID NO: 438237 - DNA, 140 bp, Artificial Sequence
  Synthetic
aggccctggctgctgatatgctttagggcatttgacatctgcaactataaggctaaggttgctggtattggaaaatactacaagactaatacttgtaggtttgtagaattagatgaccaagaccttttgggacagcggtg

SEQ ID NO: 438238 - DNA, 140 bp, Artificial Sequence
  Synthetic
caccgctgtcccaaaaggtcttggtcatctaattctacaaacctacaagtattagtcttgtagtattttccaataccagcaaccttagccttatagttgcagatgtcaaatgccctaaagcatatcagcagccagggcct

SEQ ID NO: 438239 - DNA, 140 bp, Artificial Sequence
  Synthetic
atacgccatgctgggtctcctagcccctgttaatggctactttattaaaactaataacactaggattgttgatgagtggtcatatactggacacctttagttggcacttcattgcaccctcgtacttgggagtcggccat

SEQ ID NO: 438240 - DNA, 140 bp, Artificial Sequence
  Synthetic
atggccgactcccaagtacgagggtgcaatgaagtgccaactaaaggtgtccagtatatgaccactcatcaacaatcctagtgttattagttttaataaagtagccattaacaggggctaggagacccagcatggcgtat

SEQ ID NO: 438241 - DNA, 140 bp, Artificial Sequence
  Synthetic
atacgccatgctgggtctcccagataagtcgcattactatgtggagtctgttttggttaaggacactgcggtgcagtttacttatgatagagacggtcaaacctgctatgagcggttccccgtacttgggagtcggccat

SEQ ID NO: 438242 - DNA, 140 bp, Artificial Sequence
  Synthetic
atggccgactcccaagtacggggaaccgctcatagcaggtttgaccgtctctatcataagtaaactgcaccgcagtgtccttaaccaaaacagactccacatagtaatgcgacttatctgggagacccagcatggcgtat

SEQ ID NO: 438243 - DNA, 140 bp, Artificial Sequence
  Synthetic
aggccctggctgctgatatgaagtgaatagcttggctatctcacttcccctcgttctcttgcagaactttgattttaacgaacttaaataaaagccctgttgtttagcgtattgttgcacgaccttttgggacagcggtg

SEQ ID NO: 438244 - DNA, 140 bp, Artificial Sequence
  Synthetic
caccgctgtcccaaaaggtcgtgcaacaatacgctaaacaacagggcttttatttaagttcgttaaaatcaaagttctgcaagagaacgaggggaagtgagatagccaagctattcacttcatatcagcagccagggcct

SEQ ID NO: 438245 - DNA, 140 bp, Artificial Sequence
  Synthetic
aggccctggctgctgatatgatgtattctgggtctacttacagtatatagaaaaactgtataaagaccttacaggacacatgcttgacagtctttgcaggctgtcggttcatgcgttgtagaccttttgggacagcggtg

SEQ ID NO: 438246 - DNA, 140 bp, Artificial Sequence
  Synthetic
caccgctgtcccaaaaggtctacaacgcatgaaccgacagcctgcaaagactgtcaagcatgtgtcctgtaaggtctttatacagtttttctatatactgtaagtagacccagaatacatcatatcagcagccagggcct

SEQ ID NO: 438247 - DNA, 140 bp, Artificial Sequence
  Synthetic
atacgccatgctgggtctccaattagcctctgataaggttaatgaatgcgtaaaatcgcagtccaagcgtaatggcttttgcggatctggtactcatattgtctcgtttgtcataaatgccgtacttgggagtcggccat

SEQ ID NO: 438248 - DNA, 140 bp, Artificial Sequence
  Synthetic
atggccgactcccaagtacggcatttatgacaaacgagacaatatgagtaccagatccgcaaaagccattacgcttggactgcgattttacgcattcattaaccttatcagaggctaattggagacccagcatggcgtat

SEQ ID NO: 438249 - DNA, 140 bp, Artificial Sequence
  Synthetic
atacgccatgctgggtctccctaattataataaaggtgtccaaggcctgggcaaactttttgtttccgactatgccactaaagctgaaacatttggtgatggctttgttgttcgtatcggcgtacttgggagtcggccat

SEQ ID NO: 438250 - DNA, 140 bp, Artificial Sequence
  Synthetic
atggccgactcccaagtacgccgatacgaacaacaaagccatcaccaaatgtttcagctttagtggcatagtcggaaacaaaaagtttgcccaggccttggacacctttattataattagggagacccagcatggcgtat

SEQ ID NO: 438251 - DNA, 140 bp, Artificial Sequence
  Synthetic
aggccctggctgctgatatgtaaaacccacgctactctatttggtagtgttgcatgtgaacacatttcttctaccatgtctcaatactcccgttctacgcgatcaatgcttaaacggcgagaccttttgggacagcggtg

SEQ ID NO: 438252 - DNA, 140 bp, Artificial Sequence
  Synthetic
caccgctgtcccaaaaggtctcgccgtttaagcattgatcgcgtagaacgggagtattgagacatggtagaagaaatgtgttcacatgcaacactaccaaatagagtagcgtgggttttacatatcagcagccagggcct

SEQ ID NO: 438253 - DNA, 140 bp, Artificial Sequence
  Synthetic
aggccctggctgctgatatgtgcttggcagcatagcaggtgttggctggactgctggcttatcctcctttgctgctattccatttgcacagagtatcttttataggttaaacggtgttgggaccttttgggacagcggtg

SEQ ID NO: 438254 - DNA, 140 bp, Artificial Sequence
  Synthetic
caccgctgtcccaaaaggtcccaacaccgtttaacctataaaagatactctgtgcaaatggaatagcagcaaaggaggataagccagcagtccagccaacacctgctatgctgccaagcacatatcagcagccagggcct

SEQ ID NO: 438255 - DNA, 140 bp, Artificial Sequence
  Synthetic
atacgccatgctgggtctccatgatacactcagtgtttctactgatgttcttgttaacacctacagaaagttacgttgatgtagggctagattctgctaagtctgcttgtattgaggttgcgtacttgggagtcggccat

SEQ ID NO: 438256 - DNA, 140 bp, Artificial Sequence
  Synthetic
atggccgactcccaagtacgcaacctcaatacaagcagacttagcagaatctagccctacatcaacgtaactttctgtaggtgttaacaagaacatcagtagaaacactgagtgtatcatggagacccagcatggcgtat

SEQ ID NO: 438257 - DNA, 140 bp, Artificial Sequence
  Synthetic
atacgccatgctgggtctcctttattgacacaccatgttattgttttaatagtgatggtgatttatcttggtcttcaactatgatcttttcattacatcctgtggaatgtgaagatgattcgtacttgggagtcggccat

SEQ ID NO: 438258 - DNA, 140 bp, Artificial Sequence
  Synthetic
atggccgactcccaagtacgaatcatcttcacattccacaggatgtaatgaaaagatcatagttgaagaccaagataaatcaccatcactattaaaacaataacatggtgtgtcaataaaggagacccagcatggcgtat

SEQ ID NO: 438259 - DNA, 140 bp, Artificial Sequence
  Synthetic
aggccctggctgctgatatgcgaattgacgtcccatctgcagaatcaactggtactcaatcagtttctgtcgatcgtgagtcaacttcaactcatgatggtcctaccgaacatgttactagaccttttgggacagcggtg

SEQ ID NO: 438260 - DNA, 140 bp, Artificial Sequence
  Synthetic
caccgctgtcccaaaaggtctagtaacatgttcggtaggaccatcatgagttgaagttgactcacgatcgacagaaactgattgagtaccagttgattctgcagatgggacgtcaattcgcatatcagcagccagggcct

SEQ ID NO: 438261 - DNA, 140 bp, Artificial Sequence
  Synthetic
atacgccatgctgggtctccaacgcttttcttgatttgaggacatcatgttttagtgtcgctgcacttacaactggtttgacttttcaaactgtgcgttctggcaattttaaccaagactcgtacttgggagtcggccat

SEQ ID NO: 438262 - DNA, 140 bp, Artificial Sequence
  Synthetic
atggccgactcccaagtacgagtcttggttaaaattgccagaacgcacagtttgaaaagtcaaaccagttgtaagtgcagcgacactaaaacatgatgtcctcaaatcaagaaaagcgttggagacccagcatggcgtat

SEQ ID NO: 438263 - DNA, 140 bp, Artificial Sequence
  Synthetic
atacgccatgctgggtctccgccaaacgggctctacttcttccatgtaggctttgtgcctaccagctttgtaaatgcaaccgctgcttatgggttgtgtaatacggagaatccgcctaggcgtacttgggagtcggccat

SEQ ID NO: 438264 - DNA, 140 bp, Artificial Sequence
  Synthetic
atggccgactcccaagtacgcctaggcggattctccgtattacacaacccataagcagcggttgcatttacaaagctggtaggcacaaagcctacatggaagaagtagagcccgtttggcggagacccagcatggcgtat

SEQ ID NO: 438265 - DNA, 140 bp, Artificial Sequence
  Synthetic
aggccctggctgctgatatgtagggttgttcatagtaaactttttcatttttaccgtagtatgtgctataacactcttggtgtgtatggctttccttacggctactagattatgtgtgcagaccttttgggacagcggtg

SEQ ID NO: 438266 - DNA, 140 bp, Artificial Sequence
  Synthetic
caccgctgtcccaaaaggtctgcacacataatctagtagccgtaaggaaagccatacacaccaagagtgttatagcacatactacggtaaaaatgaaaaagtttactatgaacaaccctacatatcagcagccagggcct

SEQ ID NO: 438267 - DNA, 140 bp, Artificial Sequence
  Synthetic
aggccctggctgctgatatgttttaacgaacttaaataaaagccctgttgtttagcgtattgttgcacttgtctggtgggattgtggcattaatttgcctgctcatctaggcagtggacagaccttttgggacagcggtg

SEQ ID NO: 438268 - DNA, 140 bp, Artificial Sequence
  Synthetic
caccgctgtcccaaaaggtctgtccactgcctagatgagcaggcaaattaatgccacaatcccaccagacaagtgcaacaatacgctaaacaacagggcttttatttaagttcgttaaaacatatcagcagccagggcct

SEQ ID NO: 438269 - DNA, 140 bp, Artificial Sequence
  Synthetic
atacgccatgctgggtctccctcagacgatgttggtgtttccagaggttaagatgattttattgatgtacacattcattggttatgtgtgtacctgttattttggtgtcttttcgttgttcgtacttgggagtcggccat

SEQ ID NO: 438270 - DNA, 140 bp, Artificial Sequence
  Synthetic
atggccgactcccaagtacgaacaacgaaaagacaccaaaataacaggtacacacataaccaatgaatgtgtacatcaataaaatcatcttaacctctggaaacaccaacatcgtctgagggagacccagcatggcgtat

SEQ ID NO: 438271 - DNA, 140 bp, Artificial Sequence
  Synthetic
aggccctggctgctgatatgcgtaccagaatttagttggctattattctgatgatggcaactactactgtttgcgtgcttgtgttagtgttcctgtttctgtcatctatgacaaaaaaacgaccttttgggacagcggtg

SEQ ID NO: 438272 - DNA, 140 bp, Artificial Sequence
  Synthetic
caccgctgtcccaaaaggtcgtttttttgtcatagatgacagaaacaggaacactaacacaagcacgcaaacagtagtagttgccatcatcagaataatagccaactaaattctggtacgcatatcagcagccagggcct

SEQ ID NO: 438273 - DNA, 140 bp, Artificial Sequence
  Synthetic
aggccctggctgctgatatgaaagttctacaaagaagttagagcttacctaggaatctcttctgcttgtgacggtcttgcttcagcttatagggcgaattcctttgatgtacctacattcgaccttttgggacagcggtg

SEQ ID NO: 438274 - DNA, 140 bp, Artificial Sequence
  Synthetic
caccgctgtcccaaaaggtcgaatgtaggtacatcaaaggaattcgccctataagctgaagcaagaccgtcacaagcagaagagattcctaggtaagctctaacttctttgtagaactttcatatcagcagccagggcct

SEQ ID NO: 438275 - DNA, 140 bp, Artificial Sequence
  Synthetic
aggccctggctgctgatatgctctctgtgctcttcctgacacacctagtactctcacacctcgcagtgtgcgctctgttccaggtcaaatgcgcttggcatctattgcttttaatcatccgaccttttgggacagcggtg

SEQ ID NO: 438276 - DNA, 140 bp, Artificial Sequence
  Synthetic
caccgctgtcccaaaaggtcggatgattaaaagcaatagatgccaagcgcatttgacctggaacagagcgcacactgcgaggtgtgagagtactaggtgtgtcaggaagagcacagagagcatatcagcagccagggcct

SEQ ID NO: 438277 - DNA, 140 bp, Artificial Sequence
  Synthetic
atacgccatgctgggtctccgtactgatgaccgttgtgtgttacattgtgctaatttcaatgtattgtttgctatgaccatgcctaagacttgtttcggacccatagtccgaaagatcttcgtacttgggagtcggccat

SEQ ID NO: 438278 - DNA, 140 bp, Artificial Sequence
  Synthetic
atggccgactcccaagtacgaagatctttcggactatgggtccgaaacaagtcttaggcatggtcatagcaaacaatacattgaaattagcacaatgtaacacacaacggtcatcagtacggagacccagcatggcgtat

SEQ ID NO: 438279 - DNA, 140 bp, Artificial Sequence
  Synthetic
aggccctggctgctgatatgtgactttaatttgacacttctagaacctgtttctatatctactggcagtcgtagttcacgtattgctattgaggatttgctatttgacaaagtcactatagaccttttgggacagcggtg

SEQ ID NO: 438280 - DNA, 140 bp, Artificial Sequence
  Synthetic
caccgctgtcccaaaaggtctatagtgactttgtcaaatagcaaatcctcaatagcaatacgtgaactacgactgccagtagatatagaaacaggttctagaagtgtcaaattaaagtcacatatcagcagccagggcct

SEQ ID NO: 438281 - DNA, 140 bp, Artificial Sequence
  Synthetic
aggccctggctgctgatatgtctgagtacttactcactttttgatttatccaagtttcaattaaaattaaaaggaacaccagttcttcaattaaaggagagtcaaattaacgaactcgtagaccttttgggacagcggtg

SEQ ID NO: 438282 - DNA, 140 bp, Artificial Sequence
  Synthetic
caccgctgtcccaaaaggtctacgagttcgttaatttgactctcctttaattgaagaactggtgttccttttaattttaattgaaacttggataaatcaaaaagtgagtaagtactcagacatatcagcagccagggcct

SEQ ID NO: 438283 - DNA, 140 bp, Artificial Sequence
  Synthetic
atacgccatgctgggtctcctttaatcaggctctgggagctatgcaaacaggcttcactacaactaatgaagcttttcagaaggttcaggatgctgtgaacaacaatgcacaggctctatcgtacttgggagtcggccat

SEQ ID NO: 438284 - DNA, 140 bp, Artificial Sequence
  Synthetic
atggccgactcccaagtacgatagagcctgtgcattgttgttcacagcatcctgaaccttctgaaaagcttcattagttgtagtgaagcctgtttgcatagctcccagagcctgattaaaggagacccagcatggcgtat

SEQ ID NO: 438285 - DNA, 140 bp, Artificial Sequence
  Synthetic
aggccctggctgctgatatggacttctatgatttcgtggtatctaaaggtttctttaaggagggctcttcagtgacgctcaaacattttttctttgctcaagatggtaatgctgctattagaccttttgggacagcggtg

SEQ ID NO: 438286 - DNA, 140 bp, Artificial Sequence
  Synthetic
caccgctgtcccaaaaggtctaatagcagcattaccatcttgagcaaagaaaaaatgtttgagcgtcactgaagagccctccttaaagaaacctttagataccacgaaatcatagaagtccatatcagcagccagggcct

SEQ ID NO: 438287 - DNA, 140 bp, Artificial Sequence
  Synthetic
aggccctggctgctgatatgtgctaacactaaagttcttaggaacaagggtgttgattatactaagaagtttcttacagttgacggtgtgcaatattattgctacacgtctaaggacactgaccttttgggacagcggtg

SEQ ID NO: 438288 - DNA, 140 bp, Artificial Sequence
  Synthetic
caccgctgtcccaaaaggtcagtgtccttagacgtgtagcaataatattgcacaccgtcaactgtaagaaacttcttagtataatcaacacccttgttcctaagaactttagtgttagcacatatcagcagccagggcct

SEQ ID NO: 438289 - DNA, 140 bp, Artificial Sequence
  Synthetic
aggccctggctgctgatatgctctgggagctatgcaaacaggcttcactacaactaatgaagcttttcagaaggttcaggatgctgtgaacaacaatgcacaggctctatccaaattagcgaccttttgggacagcggtg

SEQ ID NO: 438290 - DNA, 140 bp, Artificial Sequence
  Synthetic
caccgctgtcccaaaaggtcgctaatttggatagagcctgtgcattgttgttcacagcatcctgaaccttctgaaaagcttcattagttgtagtgaagcctgtttgcatagctcccagagcatatcagcagccagggcct

SEQ ID NO: 438291 - DNA, 140 bp, Artificial Sequence
  Synthetic
aggccctggctgctgatatgcttcgtacttacctctcactctgtggctaccttgacggcgcccacaattgtgaatcaagagaggtatgttaaaattactgggttgtacccaaccattacggaccttttgggacagcggtg

SEQ ID NO: 438292 - DNA, 140 bp, Artificial Sequence
  Synthetic
caccgctgtcccaaaaggtccgtaatggttgggtacaacccagtaattttaacatacctctcttgattcacaattgtgggcgccgtcaaggtagccacagagtgagaggtaagtacgaagcatatcagcagccagggcct

SEQ ID NO: 438293 - DNA, 140 bp, Artificial Sequence
  Synthetic
aggccctggctgctgatatgacagtgccccccgggaagagctctacagtgtgaaatgtaaataaaaatagctattattcaattagattaggctaattagatgatttgcaaaaaaaaaaaagaccttttgggacagcggtg

SEQ ID NO: 438294 - DNA, 140 bp, Artificial Sequence
  Synthetic
caccgctgtcccaaaaggtcttttttttttttgcaaatcatctaattagcctaatctaattgaataatagctatttttatttacatttcacactgtagagctcttcccggggggcactgtcatatcagcagccagggcct

SEQ ID NO: 438295 - DNA, 140 bp, Artificial Sequence
  Synthetic
aggccctggctgctgatatggtgctgcactggttgtggcacaaactgtatgggaaaacttaagcgtaatcgttgttgtgatagatatgaggaatacgacctcgagccgcataaggttcatgaccttttgggacagcggtg

SEQ ID NO: 438296 - DNA, 140 bp, Artificial Sequence
  Synthetic
caccgctgtcccaaaaggtcatgaaccttatgcggctcgaggtcgtattcctcatatctatcacaacaacgattacgcttaagttttcccatacagtttgtgccacaaccagtgcagcaccatatcagcagccagggcct

SEQ ID NO: 438297 - DNA, 140 bp, Artificial Sequence
  Synthetic
atacgccatgctgggtctccctcaactgcgcgcgacggcattaagcgaggcgaaaatttgcaacctgttcttaagaccttcattgatgctgccagagggcctgcaggtgtcgagtctgatcgtacttgggagtcggccat

SEQ ID NO: 438298 - DNA, 140 bp, Artificial Sequence
  Synthetic
atggccgactcccaagtacgatcagactcgacacctgcaggccctctggcagcatcaatgaaggtcttaagaacaggttgcaaattttcgcctcgcttaatgccgtcgcgcgcagttgagggagacccagcatggcgtat

SEQ ID NO: 438299 - DNA, 140 bp, Artificial Sequence
  Synthetic
atacgccatgctgggtctcctcaagatttcaaagaagagctggaggagttctttaagaatgtttcttctcaaggtcctaactttcaggagatatcaaaaataaatgctaccttgctggatcgtacttgggagtcggccat

SEQ ID NO: 438300 - DNA, 140 bp, Artificial Sequence
  Synthetic
atggccgactcccaagtacgatccagcaaggtagcatttatttttgatatctcctgaaagttaggaccttgagaagaaacattcttaaagaactcctccagctcttctttgaaatcttgaggagacccagcatggcgtat

SEQ ID NO: 438301 - DNA, 140 bp, Artificial Sequence
  Synthetic
atacgccatgctgggtctccgaggaagaactcctaagcctagaccagctcccaataacaccgtctcctggtacactggccttacccaacacgggaaggtccctctttcctttccacctggcgtacttgggagtcggccat

SEQ ID NO: 438302 - DNA, 140 bp, Artificial Sequence
  Synthetic
atggccgactcccaagtacgccaggtggaaaggaaagagggaccttcccgtgttgggtaaggccagtgtaccaggagacggtgttattgggagctggtctaggcttaggagttcttcctcggagacccagcatggcgtat

SEQ ID NO: 438303 - DNA, 140 bp, Artificial Sequence
  Synthetic
aggccctggctgctgatatgtcatacaacgtcttgatgttctcgaacaggacgcccaaatagacagacttattaatggccgtttgacaacactaaatgcttttgttgcgcagcagcttgtgaccttttgggacagcggtg

SEQ ID NO: 438304 - DNA, 140 bp, Artificial Sequence
  Synthetic
caccgctgtcccaaaaggtcacaagctgctgcgcaacaaaagcatttagtgttgtcaaacggccattaataagtctgtctatttgggcgtcctgttcgagaacatcaagacgttgtatgacatatcagcagccagggcct

SEQ ID NO: 438305 - DNA, 140 bp, Artificial Sequence
  Synthetic
atacgccatgctgggtctccgcggttctcctaacaatcctaagcagattgtcaagtctttaccaataccatctagtgtttggtaacgaactatggctttctctgcttctttgtttcggcccgtacttgggagtcggccat

SEQ ID NO: 438306 - DNA, 140 bp, Artificial Sequence
  Synthetic
atggccgactcccaagtacgggccgaaacaaagaagcagagaaagccatagttcgttaccaaacactagatggtattggtaaagacttgacaatctgcttaggattgttaggagaaccgcggagacccagcatggcgtat

SEQ ID NO: 438307 - DNA, 140 bp, Artificial Sequence
  Synthetic
atacgccatgctgggtctccgtagatactggagtctactcagtttcttcattcgaagctcagccgcgtggttcatttattgagcaagctcaaggcacggagtgtgatttttctccactgccgtacttgggagtcggccat

SEQ ID NO: 438308 - DNA, 140 bp, Artificial Sequence
  Synthetic
atggccgactcccaagtacggcagtggagaaaaatcacactccgtgccttgagcttgctcaataaatgaaccacgcggctgagcttcgaatgaagaaactgagtagactccagtatctacggagacccagcatggcgtat

SEQ ID NO: 438309 - DNA, 140 bp, Artificial Sequence
  Synthetic
atacgccatgctgggtctccatggtggtagtttgtatgtcaacaagcacgcctttcacacaccagcttatgatgtgagtgcatttagagatctgaaacctttaccattcttctattattccgtacttgggagtcggccat

SEQ ID NO: 438310 - DNA, 140 bp, Artificial Sequence
  Synthetic
atggccgactcccaagtacggaataatagaagaatggtaaaggtttcagatctctaaatgcactcacatcataagctggtgtgtgaaaggcgtgcttgttgacatacaaactaccaccatggagacccagcatggcgtat

SEQ ID NO: 438311 - DNA, 140 bp, Artificial Sequence
  Synthetic
atacgccatgctgggtctcctgctgcttctaactccactggctctgtcataatttcccaaacgcagaagaccatcaagaaaatttacccagctttcatgcttggaactgctgtgggcaaccgtacttgggagtcggccat

SEQ ID NO: 438312 - DNA, 140 bp, Artificial Sequence
  Synthetic
atggccgactcccaagtacggttgcccacagcagttccaagcatgaaagctgggtaaattttcttgatggtcttctgcgtttgggaaattatgacagagccagtggagttagaagcagcaggagacccagcatggcgtat

SEQ ID NO: 438313 - DNA, 140 bp, Artificial Sequence
  Synthetic
aggccctggctgctgatatgttgtggcattaatttgcctgctcatctaggcagtggacatatgctcaacactgggtataattctaattgaatactatttttcagttagagcgtcgtgtctgaccttttgggacagcggtg

SEQ ID NO: 438314 - DNA, 140 bp, Artificial Sequence
  Synthetic
caccgctgtcccaaaaggtcagacacgacgctctaactgaaaaatagtattcaattagaattatacccagtgttgagcatatgtccactgcctagatgagcaggcaaattaatgccacaacatatcagcagccagggcct

SEQ ID NO: 438315 - DNA, 140 bp, Artificial Sequence
  Synthetic
atacgccatgctgggtctcctaagttagaacgtatggctgaacaggctatgacgtcaatgtacaagcaggcacgtgctgaggacaagaagtctaaaatagttagtgctatgcaaactatgcgtacttgggagtcggccat

SEQ ID NO: 438316 - DNA, 140 bp, Artificial Sequence
  Synthetic
atggccgactcccaagtacgcatagtttgcatagcactaactattttagacttcttgtcctcagcacgtgcctgcttgtacattgacgtcatagcctgttcagccatacgttctaacttaggagacccagcatggcgtat

SEQ ID NO: 438317 - DNA, 140 bp, Artificial Sequence
  Synthetic
aggccctggctgctgatatgcttctcatggtatggtccctgtcatacacaccaaaccattatttattagaaacttcgatcagcgttgcagctgttctcgttgtttttatttgcactcttcgaccttttgggacagcggtg

SEQ ID NO: 438318 - DNA, 140 bp, Artificial Sequence
  Synthetic
caccgctgtcccaaaaggtcgaagagtgcaaataaaaacaacgagaacagctgcaacgctgatcgaagtttctaataaataatggtttggtgtgtatgacagggaccataccatgagaagcatatcagcagccagggcct

SEQ ID NO: 438319 - DNA, 140 bp, Artificial Sequence
  Synthetic
atacgccatgctgggtctccagcctgatagtgtggctactagtgatttaggtagcttaatagattgtaatgcagcctctgttaatccagctaacatgcgcaatgctaatggtgcttgtatcgtacttgggagtcggccat

SEQ ID NO: 438320 - DNA, 140 bp, Artificial Sequence
  Synthetic
atggccgactcccaagtacgatacaagcaccattagcattgcgcatgttagctggattaacagaggctgcattacaatctattaagctacctaaatcactagtagccacactatcaggctggagacccagcatggcgtat

SEQ ID NO: 438321 - DNA, 140 bp, Artificial Sequence
  Synthetic
aggccctggctgctgatatgggcaagcagcactgccccaatccaaggattccaattttttaaacgagtccggggttctattgtaaatgcccgaatagaaccctgtgcaagtggtttgtccgaccttttgggacagcggtg

SEQ ID NO: 438322 - DNA, 140 bp, Artificial Sequence
  Synthetic
caccgctgtcccaaaaggtcggacaaaccacttgcacagggttctattcgggcatttacaatagaaccccggactcgtttaaaaaattggaatccttggattggggcagtgctgcttgcccatatcagcagccagggcct

SEQ ID NO: 438323 - DNA, 140 bp, Artificial Sequence
  Synthetic
aggccctggctgctgatatgcattttacatcatccaggattttaacgaactatggctttctcggcgtctttatttaaacccgtccatctagtctcattttctcctgcatttcatcgcattgaccttttgggacagcggtg

SEQ ID NO: 438324 - DNA, 140 bp, Artificial Sequence
  Synthetic
caccgctgtcccaaaaggtcaatgcgatgaaatgcaggagaaaatgagactagatggacgggtttaaataaagacgccgagaaagccatagttcgttaaaatcctggatgatgtaaaatgcatatcagcagccagggcct

SEQ ID NO: 438325 - DNA, 140 bp, Artificial Sequence
  Synthetic
atacgccatgctgggtctccagacacctcccaggtcctcgtgtgtacctggttgagaggctcattgcttgtgaaaatccattcatggttaaccaattggcttatagctctagtgcaaatgcgtacttgggagtcggccat

SEQ ID NO: 438326 - DNA, 140 bp, Artificial Sequence
  Synthetic
atggccgactcccaagtacgcatttgcactagagctataagccaattggttaaccatgaatggattttcacaagcaatgagcctctcaaccaggtacacacgaggacctgggaggtgtctggagacccagcatggcgtat

SEQ ID NO: 438327 - DNA, 140 bp, Artificial Sequence
  Synthetic
atacgccatgctgggtctccggccttggtacatctggttgggtttcattgcaggacttgtggctctagccctgtgtgtcttcttcttgctttgctgtactggctgtggtaccaactgcatcgtacttgggagtcggccat

SEQ ID NO: 438328 - DNA, 140 bp, Artificial Sequence
  Synthetic
atggccgactcccaagtacgatgcagttggtaccacagccagtacagcaaagcaagaagaagacacacagggctagagccacaagtcctgcaatgaaacccaaccagatgtaccaaggccggagacccagcatggcgtat

SEQ ID NO: 438329 - DNA, 140 bp, Artificial Sequence
  Synthetic
aggccctggctgctgatatgttgccaccttgcctgtttatgatactattaagtattattctatcattcctcacagtattcgttctatccaaagtgatagaaaagcttgggctgccttctagaccttttgggacagcggtg

SEQ ID NO: 438330 - DNA, 140 bp, Artificial Sequence
  Synthetic
caccgctgtcccaaaaggtctagaaggcagcccaagcttttctatcactttggatagaacgaatactgtgaggaatgatagaataatacttaatagtatcataaacaggcaaggtggcaacatatcagcagccagggcct

SEQ ID NO: 438331 - DNA, 140 bp, Artificial Sequence
  Synthetic
aggccctggctgctgatatgtcccatctgcagaatcaactggtactcaatcagtttctgtcgatcgtgagtttacttcaactcatgatggtcctaccgaacatgttactagtgtgaatctgaccttttgggacagcggtg

SEQ ID NO: 438332 - DNA, 140 bp, Artificial Sequence
  Synthetic
caccgctgtcccaaaaggtcagattcacactagtaacatgttcggtaggaccatcatgagttgaagtaaactcacgatcgacagaaactgattgagtaccagttgattctgcagatgggacatatcagcagccagggcct

SEQ ID NO: 438333 - DNA, 140 bp, Artificial Sequence
  Synthetic
atacgccatgctgggtctccaaccttgaacgttgtgagcttgctaattacaagcaatctattcctatgcctcgcggtgtgccattagccgtgcctgccaatatgcgtgttatacattttgcgtacttgggagtcggccat

SEQ ID NO: 438334 - DNA, 140 bp, Artificial Sequence
  Synthetic
atggccgactcccaagtacgcaaaatgtataacacgcatattggcaggcacggctaatggcacaccgcgaggcataggaatagattgcttgtaattagcaagctcacaacgttcaaggttggagacccagcatggcgtat

SEQ ID NO: 438335 - DNA, 140 bp, Artificial Sequence
  Synthetic
atacgccatgctgggtctccaaactttaagttacgctcgcccatgggtgtgtatgactttaaagtttcaactcaagagttcagatacatgaccgctaacggcctgcacgcacctcgtaatcgtacttgggagtcggccat

SEQ ID NO: 438336 - DNA, 140 bp, Artificial Sequence
  Synthetic
atggccgactcccaagtacgattacgaggtgcgtgcaggccgttagcggtcatgtatctgaactcttgagttgaaactttaaagtcatacacacccatgggcgagcgtaacttaaagtttggagacccagcatggcgtat

SEQ ID NO: 438337 - DNA, 140 bp, Artificial Sequence
  Synthetic
atacgccatgctgggtctccttggaacgctgctgcatattttaaactttccgatgcgcttaagcgtcaaatacgaatagcttgtcggaagtgtaatcttaactttaggctaactacgtctcgtacttgggagtcggccat

SEQ ID NO: 438338 - DNA, 140 bp, Artificial Sequence
  Synthetic
atggccgactcccaagtacgagacgtagttagcctaaagttaagattacacttccgacaagctattcgtatttgacgcttaagcgcatcggaaagtttaaaatatgcagcagcgttccaaggagacccagcatggcgtat

SEQ ID NO: 438339 - DNA, 140 bp, Artificial Sequence
  Synthetic
aggccctggctgctgatatggcactcaagtttattcgcgcaaagcgaggaagaggagtcattctccaactaagaaactgcgctacgttaagcgtagattttctcttctgcgccctgaagagaccttttgggacagcggtg

SEQ ID NO: 438340 - DNA, 140 bp, Artificial Sequence
  Synthetic
caccgctgtcccaaaaggtctcttcagggcgcagaagagaaaatctacgcttaacgtagcgcagtttcttagttggagaatgactcctcttcctcgctttgcgcgaataaacttgagtgccatatcagcagccagggcct

SEQ ID NO: 438341 - DNA, 140 bp, Artificial Sequence
  Synthetic
atacgccatgctgggtctccctgccaatatgcgtgtaatacattttggtgctggttctgataaaggtgtcgctcctggtacctctgttttaagacaatggcttcctacagatgccattatcgtacttgggagtcggccat

SEQ ID NO: 438342 - DNA, 140 bp, Artificial Sequence
  Synthetic
atggccgactcccaagtacgataatggcatctgtaggaagccattgtcttaaaacagaggtaccaggagcgacacctttatcagaaccagcaccaaaatgtattacacgcatattggcagggagacccagcatggcgtat

SEQ ID NO: 438343 - DNA, 140 bp, Artificial Sequence
  Synthetic
aggccctggctgctgatatgttgcaagtgaacagtgccccccgggaagagctctacagtgtgaaatgtaaataaaaatagctattattcaattagattaggctaattagatgatttgcaagaccttttgggacagcggtg

SEQ ID NO: 438344 - DNA, 140 bp, Artificial Sequence
  Synthetic
caccgctgtcccaaaaggtcttgcaaatcatctaattagcctaatctaattgaataatagctatttttatttacatttcacactgtagagctcttcccggggggcactgttcacttgcaacatatcagcagccagggcct

SEQ ID NO: 438345 - DNA, 140 bp, Artificial Sequence
  Synthetic
aggccctggctgctgatatggagcgctcttgtctacaataataaattgttagccaagaaggagctttcaggccagtgctttaaaatactctataagggcaatgtgacgcatgatgctagcgaccttttgggacagcggtg

SEQ ID NO: 438346 - DNA, 140 bp, Artificial Sequence
  Synthetic
caccgctgtcccaaaaggtcgctagcatcatgcgtcacattgcccttatagagtattttaaagcactggcctgaaagctccttcttggctaacaatttattattgtagacaagagcgctccatatcagcagccagggcct

SEQ ID NO: 438347 - DNA, 140 bp, Artificial Sequence
  Synthetic
aggccctggctgctgatatgagtgtcactcaaagtaacaagatcgcggcaatcgtttgtgtttggcaaccccatctcaccatcgcttgtccactcttgcacagaatggaatcatgttgtagaccttttgggacagcggtg

SEQ ID NO: 438348 - DNA, 140 bp, Artificial Sequence
  Synthetic
caccgctgtcccaaaaggtctacaacatgattccattctgtgcaagagtggacaagcgatggtgagatggggttgccaaacacaaacgattgccgcgatcttgttactttgagtgacactcatatcagcagccagggcct

SEQ ID NO: 438349 - DNA, 140 bp, Artificial Sequence
  Synthetic
atacgccatgctgggtctccttgtgaccacatggtcaaggctggtttagtcggtgttctcacacttgacaaccaggaccttaacggcaagtggtatgattttggtgactttgtagtcacacgtacttgggagtcggccat

SEQ ID NO: 438350 - DNA, 140 bp, Artificial Sequence
  Synthetic
atggccgactcccaagtacgtgtgactacaaagtcaccaaaatcataccacttgccgttaaggtcctggttgtcaagtgtgagaacaccgactaaaccagccttgaccatgtggtcacaaggagacccagcatggcgtat

SEQ ID NO: 438351 - DNA, 140 bp, Artificial Sequence
  Synthetic
aggccctggctgctgatatgcagtgccccccgggaagagctctacagtgtgaaatgtaaataaaaatagctattattcaattagattaggctaattagatgatttgcaaaaaaaaaaaaagaccttttgggacagcggtg

SEQ ID NO: 438352 - DNA, 140 bp, Artificial Sequence
  Synthetic
caccgctgtcccaaaaggtctttttttttttttgcaaatcatctaattagcctaatctaattgaataatagctatttttatttacatttcacactgtagagctcttcccggggggcactgcatatcagcagccagggcct

SEQ ID NO: 438353 - DNA, 140 bp, Artificial Sequence
  Synthetic
aggccctggctgctgatatgagtgccccccgggaagagctctacagtgtgaaatgtaaataaaaatagctattattcaattagattaggctaattagatgatttgcaaaaaaaaaaaaaagaccttttgggacagcggtg

SEQ ID NO: 438354 - DNA, 140 bp, Artificial Sequence
  Synthetic
caccgctgtcccaaaaggtcttttttttttttttgcaaatcatctaattagcctaatctaattgaataatagctatttttatttacatttcacactgtagagctcttcccggggggcactcatatcagcagccagggcct

SEQ ID NO: 438355 - DNA, 140 bp, Artificial Sequence
  Synthetic
atacgccatgctgggtctccagagacctccaactttgttgttgttaatcgcactttcactctttgctaatgcattctccagacctactgttgcttatatacctgagcattgtcagtcctacgtacttgggagtcggccat

SEQ ID NO: 438356 - DNA, 140 bp, Artificial Sequence
  Synthetic
atggccgactcccaagtacgtaggactgacaatgctcaggtatataagcaacagtaggtctggagaatgcattagcaaagagtgaaagtgcgattaacaacaacaaagttggaggtctctggagacccagcatggcgtat

SEQ ID NO: 438357 - DNA, 140 bp, Artificial Sequence
  Synthetic
aggccctggctgctgatatgagtttttccttatgacatggattctggtgtgtcatcctttagtgaactactttttgattgcgttgatctttcagtagcttctacctattttttagtccgcgaccttttgggacagcggtg

SEQ ID NO: 438358 - DNA, 140 bp, Artificial Sequence
  Synthetic
caccgctgtcccaaaaggtcgcggactaaaaaataggtagaagctactgaaagatcaacgcaatcaaaaagtagttcactaaaggatgacacaccagaatccatgtcataaggaaaaactcatatcagcagccagggcct

SEQ ID NO: 438359 - DNA, 140 bp, Artificial Sequence
  Synthetic
atacgccatgctgggtctccaagttgctggtatagggaaatactacaagactaatacttgtaggtttgttgagaaggatgaccaaggtcaccagttagactcctactttgtggttaaacgcgtacttgggagtcggccat

SEQ ID NO: 438360 - DNA, 140 bp, Artificial Sequence
  Synthetic
atggccgactcccaagtacgcgtttaaccacaaagtaggagtctaactggtgaccttggtcatccttctcaacaaacctacaagtattagtcttgtagtatttccctataccagcaacttggagacccagcatggcgtat

SEQ ID NO: 438361 - DNA, 140 bp, Artificial Sequence
  Synthetic
aggccctggctgctgatatgaatcagggtaataaacaaattgttcattcttaccccattttacatcatccaggattttaacgaactatggctttctcggcgtctttatttaaacccgtccgaccttttgggacagcggtg

SEQ ID NO: 438362 - DNA, 140 bp, Artificial Sequence
  Synthetic
caccgctgtcccaaaaggtcggacgggtttaaataaagacgccgagaaagccatagttcgttaaaatcctggatgatgtaaaatggggtaagaatgaacaatttgtttattaccctgattcatatcagcagccagggcct

SEQ ID NO: 438363 - DNA, 140 bp, Artificial Sequence
  Synthetic
aggccctggctgctgatatgttaagaagtatggcttggaaaactatgcttttgagcacgtagtctatggagacttctctcatactacgttaggcggtcttcacttgcttattggtttatagaccttttgggacagcggtg

SEQ ID NO: 438364 - DNA, 140 bp, Artificial Sequence
  Synthetic
caccgctgtcccaaaaggtctataaaccaataagcaagtgaagaccgcctaacgtagtatgagagaagtctccatagactacgtgctcaaaagcatagttttccaagccatacttcttaacatatcagcagccagggcct

SEQ ID NO: 438365 - DNA, 140 bp, Artificial Sequence
  Synthetic
atacgccatgctgggtctcctactggcaaaatgctcaaggcttgcatcgcacagaccaagtttgacactgctggcatgtacaccaaccgtgtcatctcagttcctgtcgctactggtgctcgtacttgggagtcggccat

SEQ ID NO: 438366 - DNA, 140 bp, Artificial Sequence
  Synthetic
atggccgactcccaagtacgagcaccagtagcgacaggaactgagatgacacggttggtgtacatgccagcagtgtcaaacttggtctgtgcgatgcaagccttgagcattttgccagtaggagacccagcatggcgtat

SEQ ID NO: 438367 - DNA, 140 bp, Artificial Sequence
  Synthetic
aggccctggctgctgatatgtgcctctaattcttcggtgttgtcacttgttaacttcaccgttgatcctcaaaaagcttatctcgatttcgtcaatgcgggaggtgccccattgacaaatgaccttttgggacagcggtg

SEQ ID NO: 438368 - DNA, 140 bp, Artificial Sequence
  Synthetic
caccgctgtcccaaaaggtcatttgtcaatggggcacctcccgcattgacgaaatcgagataagctttttgaggatcaacggtgaagttaacaagtgacaacaccgaagaattagaggcacatatcagcagccagggcct

SEQ ID NO: 438369 - DNA, 140 bp, Artificial Sequence
  Synthetic
aggccctggctgctgatatggttcgtagaggactgcaagttgcctctcggtcaatctctctgtgctcttcctgacacacctagtactctcacacctcgcagtgtgcgctctgttccaggtgaccttttgggacagcggtg

SEQ ID NO: 438370 - DNA, 140 bp, Artificial Sequence
  Synthetic
caccgctgtcccaaaaggtcacctggaacagagcgcacactgcgaggtgtgagagtactaggtgtgtcaggaagagcacagagagattgaccgagaggcaacttgcagtcctctacgaaccatatcagcagccagggcct

SEQ ID NO: 438371 - DNA, 140 bp, Artificial Sequence
  Synthetic
aggccctggctgctgatatgcttccacttatatagagtgcacttatattagccgttttagtaagattagcctagtttctgtaactgacttctccttaaacggcaatgtttccactgttttgaccttttgggacagcggtg

SEQ ID NO: 438372 - DNA, 140 bp, Artificial Sequence
  Synthetic
caccgctgtcccaaaaggtcaaaacagtggaaacattgccgtttaaggagaagtcagttacagaaactaggctaatcttactaaaacggctaatataagtgcactctatataagtggaagcatatcagcagccagggcct

SEQ ID NO: 438373 - DNA, 140 bp, Artificial Sequence
  Synthetic
aggccctggctgctgatatgtgaacctcctaaggagcagcgtgtgcaaggtagcatcactcagcgcactcgcacccgtccaagtgttcagcctggtccaatgattgatgttaacactgatgaccttttgggacagcggtg

SEQ ID NO: 438374 - DNA, 140 bp, Artificial Sequence
  Synthetic
caccgctgtcccaaaaggtcatcagtgttaacatcaatcattggaccaggctgaacacttggacgggtgcgagtgcgctgagtgatgctaccttgcacacgctgctccttaggaggttcacatatcagcagccagggcct

SEQ ID NO: 438375 - DNA, 140 bp, Artificial Sequence
  Synthetic
aggccctggctgctgatatgactggtactcaatcagtttctgtcgatcgtgagtcaacttcaactcatgatggtcctactagtgtgaatctttttgacgttggttactcagttaattaacgaccttttgggacagcggtg

SEQ ID NO: 438376 - DNA, 140 bp, Artificial Sequence
  Synthetic
caccgctgtcccaaaaggtcgttaattaactgagtaaccaacgtcaaaaagattcacactagtaggaccatcatgagttgaagttgactcacgatcgacagaaactgattgagtaccagtcatatcagcagccagggcct

SEQ ID NO: 438377 - DNA, 140 bp, Artificial Sequence
  Synthetic
  misc_feature (39)..(39): n is a, c, g, or t
  misc_feature (41)..(41): n is a, c, g, or t
atacgccatgctgggtctccctttgattttaacgaactnanataaaagccctgttgtttagcgtattgttgcacttgtctggtgggattgtggcattaatttgcctgctcatctaggcagcgtacttgggagtcggccat

SEQ ID NO: 438378 - DNA, 140 bp, Artificial Sequence
  Synthetic
  misc_feature (100)..(100): n is a, c, g, or t
  misc_feature (102)..(102): n is a, c, g, or t
atggccgactcccaagtacgctgcctagatgagcaggcaaattaatgccacaatcccaccagacaagtgcaacaatacgctaaacaacagggcttttatntnagttcgttaaaatcaaagggagacccagcatggcgtat

SEQ ID NO: 438379 - DNA, 140 bp, Artificial Sequence
  Synthetic
aggccctggctgctgatatggcccttgaccaggaaggtacaacagcttttctatacagaggacatggcctcaagatttgctgatgggctctgcttattttggaactgtaatgtaccaaaagaccttttgggacagcggtg

SEQ ID NO: 438380 - DNA, 140 bp, Artificial Sequence
  Synthetic
caccgctgtcccaaaaggtcttttggtacattacagttccaaaataagcagagcccatcagcaaatcttgaggccatgtcctctgtatagaaaagctgttgtaccttcctggtcaagggccatatcagcagccagggcct

SEQ ID NO: 438381 - DNA, 140 bp, Artificial Sequence
  Synthetic
atacgccatgctgggtctcccatctaacaagcttagagttgttattccagacttcaccgtttggaatcaagttgtcacgtaccctgcacttaattatgcaggtgcgctctgggatattgccgtacttgggagtcggccat

SEQ ID NO: 438382 - DNA, 140 bp, Artificial Sequence
  Synthetic
atggccgactcccaagtacggcaatatcccagagcgcacctgcataattaagtgcagggtacgtgacaacttgattccaaacggtgaagtctggaataacaactctaagcttgttagatgggagacccagcatggcgtat

SEQ ID NO: 438383 - DNA, 140 bp, Artificial Sequence
  Synthetic
  misc_feature (23)..(23): n is a, c, g, or t
  misc_feature (28)..(28): n is a, c, g, or t
  misc_feature (41)..(41): n is a, c, g, or t
  misc_feature (43)..(43): n is a, c, g, or t
  misc_feature (58)..(58): n is a, c, g, or t
atacgccatgctgggtctcctcncccantgcgctctttttncncaatgtcagatttgngctacatgagttcgccttgctgcgcaaaactcttgttcttaatgcatcagagatctactgtgcgtacttgggagtcggccat

SEQ ID NO: 438384 - DNA, 140 bp, Artificial Sequence
  Synthetic
  misc_feature (83)..(83): n is a, c, g, or t
  misc_feature (98)..(98): n is a, c, g, or t
  misc_feature (100)..(100): n is a, c, g, or t
  misc_feature (113)..(113): n is a, c, g, or t
  misc_feature (118)..(118): n is a, c, g, or t
atggccgactcccaagtacgcacagtagatctctgatgcattaagaacaagagttttgcgcagcaaggcgaactcatgtagcncaaatctgacattgngnaaaaagagcgcantgggngaggagacccagcatggcgtat

SEQ ID NO: 438385 - DNA, 140 bp, Artificial Sequence
  Synthetic
aggccctggctgctgatatgaactttgattttaacgaacttaaataaaagccctgttgtttagcgtattgttgcacttgtctggtgggattgtggcattaatttgcctgctcatctaggcgaccttttgggacagcggtg

SEQ ID NO: 438386 - DNA, 140 bp, Artificial Sequence
  Synthetic
caccgctgtcccaaaaggtcgcctagatgagcaggcaaattaatgccacaatcccaccagacaagtgcaacaatacgctaaacaacagggcttttatttaagttcgttaaaatcaaagttcatatcagcagccagggcct

SEQ ID NO: 438387 - DNA, 140 bp, Artificial Sequence
  Synthetic
atacgccatgctgggtctcctctgattattgtacgtttgtttgttgggcccatggttttgagcttacatctgcatcttacttttgtaagataggtaaagagcaaaagtgctgtatgtgtacgtacttgggagtcggccat

SEQ ID NO: 438388 - DNA, 140 bp, Artificial Sequence
  Synthetic
atggccgactcccaagtacgtacacatacagcacttttgctctttacctatcttacaaaagtaagatgcagatgtaagctcaaaaccatgggcccaacaaacaaacgtacaataatcagaggagacccagcatggcgtat

SEQ ID NO: 438389 - DNA, 140 bp, Artificial Sequence
  Synthetic
aggccctggctgctgatatgtctcagattgtaactggcctttttaaagattgctctagagaaactttcggcctctcacctgcttatgcaccaacatacgttagtgttgatgacaagtatagaccttttgggacagcggtg

SEQ ID NO: 438390 - DNA, 140 bp, Artificial Sequence
  Synthetic
caccgctgtcccaaaaggtctatacttgtcatcaacactaacgtatgttggtgcataagcaggtgagaggccgaaagtttctctagagcaatctttaaaaaggccagttacaatctgagacatatcagcagccagggcct

SEQ ID NO: 438391 - DNA, 140 bp, Artificial Sequence
  Synthetic
atacgccatgctgggtctcctaatgcaaatgcatcctcatccgaaggatttctcataggtattaattacttgggtactattaaagaaaatatagatggcggtgctatgcatgccaattatcgtacttgggagtcggccat

SEQ ID NO: 438392 - DNA, 140 bp, Artificial Sequence
  Synthetic
atggccgactcccaagtacgataattggcatgcatagcaccgccatctatattttctttaatagtacccaagtaattaatacctatgagaaatccttcggatgaggatgcatttgcattaggagacccagcatggcgtat

SEQ ID NO: 438393 - DNA, 140 bp, Artificial Sequence
  Synthetic
atacgccatgctgggtctccgtggtcattcaatcctgagactaattgccttttgaacgttccatttgggtgtaactgctgttgtaaccaatggccacctcaaaatggctggcatgcatttcgtacttgggagtcggccat

SEQ ID NO: 438394 - DNA, 140 bp, Artificial Sequence
  Synthetic
atggccgactcccaagtacgaaatgcatgccagccattttgaggtggccattggttacaacagcagttacacccaaatggaacgttcaaaaggcaattagtctcaggattgaatgaccacggagacccagcatggcgtat

SEQ ID NO: 438395 - DNA, 140 bp, Artificial Sequence
  Synthetic
aggccctggctgctgatatgcgcaaaatgctgggtattggcggagacaggacagaaaaattaataccgggaatggaattaagcaactggctcccaggtggtacttctactacactggaacgaccttttgggacagcggtg

SEQ ID NO: 438396 - DNA, 140 bp, Artificial Sequence
  Synthetic
caccgctgtcccaaaaggtcgttccagtgtagtagaagtaccacctgggagccagttgcttaattccattcccggtattaatttttctgtcctgtctccgccaatacccagcattttgcgcatatcagcagccagggcct

SEQ ID NO: 438397 - DNA, 140 bp, Artificial Sequence
  Synthetic
atacgccatgctgggtctcctcgtgggaggctatggcgttgaactttaagcttattggtattggcggtactccttgtataaaggtagctagcgttcaatccaaattgactgatttgaaatcgtacttgggagtcggccat

SEQ ID NO: 438398 - DNA, 140 bp, Artificial Sequence
  Synthetic
atggccgactcccaagtacgatttcaaatcagtcaatttggattgaacgctagctacctttatacaaggagtaccgccaataccaataagcttaaagttcaacgccatagcctcccacgaggagacccagcatggcgtat

SEQ ID NO: 438399 - DNA, 140 bp, Artificial Sequence
  Synthetic
atacgccatgctgggtctccgctttcacacctgtcactggtacttcattgcaccccgtgcagtggcagtgccagctaacctttgacgggtttactggactggctgtgaatagcactaaggcgtacttgggagtcggccat

SEQ ID NO: 438400 - DNA, 140 bp, Artificial Sequence
  Synthetic
atggccgactcccaagtacgccttagtgctattcacagccagtccagtaaacccgtcaaaggttagctggcactgccactgcacggggtgcaatgaagtaccagtgacaggtgtgaaagcggagacccagcatggcgtat

SEQ ID NO: 438401 - DNA, 140 bp, Artificial Sequence
  Synthetic
aggccctggctgctgatatggattttaacgaacttaaataaaagccctgttgtttagcgtattgttgcacttgtctggtgggattgtggcattaatttgcctgctcatctaggcagtggagaccttttgggacagcggtg

SEQ ID NO: 438402 - DNA, 140 bp, Artificial Sequence
  Synthetic
caccgctgtcccaaaaggtctccactgcctagatgagcaggcaaattaatgccacaatcccaccagacaagtgcaacaatacgctaaacaacagggcttttatttaagttcgttaaaatccatatcagcagccagggcct

SEQ ID NO: 438403 - DNA, 140 bp, Artificial Sequence
  Synthetic
aggccctggctgctgatatgagaaattccactcctatgaatctgagtacttactcactttttgatttatccaagtttcaattaaaattaaaaggaacaccagttcttcaattaaaggagagaccttttgggacagcggtg

SEQ ID NO: 438404 - DNA, 140 bp, Artificial Sequence
  Synthetic
caccgctgtcccaaaaggtctctcctttaattgaagaactggtgttccttttaattttaattgaaacttggataaatcaaaaagtgagtaagtactcagattcataggagtggaatttctcatatcagcagccagggcct

SEQ ID NO: 438405 - DNA, 140 bp, Artificial Sequence
  Synthetic
atacgccatgctgggtctccaccttataagagtttctcggacagtggttgcattctaccttcggaatgtactatgtttagggatgcagagggcaaaatggtgccttactgctatgaccctcgtacttgggagtcggccat

SEQ ID NO: 438406 - DNA, 140 bp, Artificial Sequence
  Synthetic
atggccgactcccaagtacgagggtcatagcagtaaggcaccattttgccctctgcatccctaaacatagtacattccgaaggtagaatgcaaccactgtccgagaaactcttataaggtggagacccagcatggcgtat

SEQ ID NO: 438407 - DNA, 140 bp, Artificial Sequence
  Synthetic
aggccctggctgctgatatggacaccaatagtgtttgccccaagcttgaatttgctaatgacacaaaaattgcctctcaattaggcaattgcgtggaatattccctctatggtgtttcgggaccttttgggacagcggtg

SEQ ID NO: 438408 - DNA, 140 bp, Artificial Sequence
  Synthetic
caccgctgtcccaaaaggtcccgaaacaccatagagggaatattccacgcaattgcctaattgagaggcaatttttgtgtcattagcaaattcaagcttggggcaaacactattggtgtccatatcagcagccagggcct

SEQ ID NO: 438409 - DNA, 140 bp, Artificial Sequence
  Synthetic
aggccctggctgctgatatgctatgaatctgagtacttactcactttttgatttatccaagtttcaattaaaattaaaaggaacaccagttcttcaattaaaggagagtcaaattaacgagaccttttgggacagcggtg

SEQ ID NO: 438410 - DNA, 140 bp, Artificial Sequence
  Synthetic
caccgctgtcccaaaaggtctcgttaatttgactctcctttaattgaagaactggtgttccttttaattttaattgaaacttggataaatcaaaaagtgagtaagtactcagattcatagcatatcagcagccagggcct

SEQ ID NO: 438411 - DNA, 140 bp, Artificial Sequence
  Synthetic
aggccctggctgctgatatgtggagaaattccactcctatgaatctgagtacttactcactttttgatttatccaagtttcaattaaaattaaaaggaacaccagttcttcaattaaagggaccttttgggacagcggtg

SEQ ID NO: 438412 - DNA, 140 bp, Artificial Sequence
  Synthetic
caccgctgtcccaaaaggtccctttaattgaagaactggtgttccttttaattttaattgaaacttggataaatcaaaaagtgagtaagtactcagattcataggagtggaatttctccacatatcagcagccagggcct

SEQ ID NO: 438413 - DNA, 140 bp, Artificial Sequence
  Synthetic
aggccctggctgctgatatggaagctggataggcttcgatgttgagggtgctcatgcttcccgtaatgcatgtggcaccaatgttcctctacaattaggattctcaactggtgtgaacttgaccttttgggacagcggtg

SEQ ID NO: 438414 - DNA, 140 bp, Artificial Sequence
  Synthetic
caccgctgtcccaaaaggtcaagttcacaccagttgagaatcctaattgtagaggaacattggtgccacatgcattacgggaagcatgagcaccctcaacatcgaagcctatccagcttccatatcagcagccagggcct

SEQ ID NO: 438415 - DNA, 140 bp, Artificial Sequence
  Synthetic
aggccctggctgctgatatgccaagaaggagctttcaggccagtgctttaaaatactctataagggcaatgtgacgcatgatgctagctctgccattaatagaccacaactcacatttgtgaccttttgggacagcggtg

SEQ ID NO: 438416 - DNA, 140 bp, Artificial Sequence
  Synthetic
caccgctgtcccaaaaggtcacaaatgtgagttgtggtctattaatggcagagctagcatcatgcgtcacattgcccttatagagtattttaaagcactggcctgaaagctccttcttggcatatcagcagccagggcct

SEQ ID NO: 438417 - DNA, 140 bp, Artificial Sequence
  Synthetic
atacgccatgctgggtctccataagactggcgacttatgtctacaattattacttcctgccaaactgctgttagtaagcttctagatacatgttttgaagctacagaagcaacatttaaccgtacttgggagtcggccat

SEQ ID NO: 438418 - DNA, 140 bp, Artificial Sequence
  Synthetic
atggccgactcccaagtacggttaaatgttgcttctgtagcttcaaaacatgtatctagaagcttactaacagcagtttggcaggaagtaataattgtagacataagtcgccagtcttatggagacccagcatggcgtat

SEQ ID NO: 438419 - DNA, 140 bp, Artificial Sequence
  Synthetic
aggccctggctgctgatatgatctttcagtagcttctacctattttttagtccgcctcttgcaagataagactggcgactttatgtctacaattattacttcctgccaaactgctgttaggaccttttgggacagcggtg

SEQ ID NO: 438420 - DNA, 140 bp, Artificial Sequence
  Synthetic
caccgctgtcccaaaaggtcctaacagcagtttggcaggaagtaataattgtagacataaagtcgccagtcttatcttgcaagaggcggactaaaaaataggtagaagctactgaaagatcatatcagcagccagggcct

SEQ ID NO: 438421 - DNA, 140 bp, Artificial Sequence
  Synthetic
aggccctggctgctgatatgcgttacgacttgtatgatggtaacatgtttattaaatttcctgaagtagtatttgaaagtacacttaggattactagaactctgtcaactcagtactgccgaccttttgggacagcggtg

SEQ ID NO: 438422 - DNA, 140 bp, Artificial Sequence
  Synthetic
caccgctgtcccaaaaggtcggcagtactgagttgacagagttctagtaatcctaagtgtactttcaaatactacttcaggaaatttaataaacatgttaccatcatacaagtcgtaacgcatatcagcagccagggcct

SEQ ID NO: 438423 - DNA, 140 bp, Artificial Sequence
  Synthetic
atacgccatgctgggtctcctgttaacttttataggggcaaacgctaaaatcgttaccttgcctggtaacgatgcaactggctattgtccatctgtagatatgcagcctagttatttcatcgtacttgggagtcggccat

SEQ ID NO: 438424 - DNA, 140 bp, Artificial Sequence
  Synthetic
atggccgactcccaagtacgatgaaataactaggctgcatatctacagatggacaatagccagttgcatcgttaccaggcaaggtaacgattttagcgtttgcccctataaaagttaacaggagacccagcatggcgtat

SEQ ID NO: 438425 - DNA, 140 bp, Artificial Sequence
  Synthetic
atacgccatgctgggtctccgaagttcatgtctactcccaatgccatctttatttctgatagaaaaattaagaaatacccttgtatggtaggtcctgattatgcttacttcaatggtgctcgtacttgggagtcggccat

SEQ ID NO: 438426 - DNA, 140 bp, Artificial Sequence
  Synthetic
atggccgactcccaagtacgagcaccattgaagtaagcataatcaggacctaccatacaagggtatttcttaatttttctatcagaaataaagatggcattgggagtagacatgaacttcggagacccagcatggcgtat

SEQ ID NO: 438427 - DNA, 140 bp, Artificial Sequence
  Synthetic
aggccctggctgctgatatgtcatctatgataaagaaactaaaacccacgctactctatttggtagtgttgcatgtgaacacatttcttctaccatgtctcaatactcccgttctacgcggaccttttgggacagcggtg

SEQ ID NO: 438428 - DNA, 140 bp, Artificial Sequence
  Synthetic
caccgctgtcccaaaaggtccgcgtagaacgggagtattgagacatggtagaagaaatgtgttcacatgcaacactaccaaatagagtagcgtgggttttagtttctttatcatagatgacatatcagcagccagggcct

SEQ ID NO: 438429 - DNA, 140 bp, Artificial Sequence
  Synthetic
atacgccatgctgggtctccctttgattttaacgaacttaaataaaagccctgttgtttagcgtattgtcgcacttgtctggtgggattgtggcattaatttgcctgctcatctaggcagcgtacttgggagtcggccat

SEQ ID NO: 438430 - DNA, 140 bp, Artificial Sequence
  Synthetic
atggccgactcccaagtacgctgcctagatgagcaggcaaattaatgccacaatcccaccagacaagtgcgacaatacgctaaacaacagggcttttatttaagttcgttaaaatcaaagggagacccagcatggcgtat

SEQ ID NO: 438431 - DNA, 140 bp, Artificial Sequence
  Synthetic
aggccctggctgctgatatgttgttgaaaatcccagtgttattggtgtttatcataaacttggagaacgtgtaccttaaaacattgtacaaagatgttgataatccgcatcttatgggttgaccttttgggacagcggtg

SEQ ID NO: 438432 - DNA, 140 bp, Artificial Sequence
  Synthetic
caccgctgtcccaaaaggtcaacccataagatgcggattatcaacatctttgtacaatgttttaaggtacacgttctccaagtttatgataaacaccaataacactgggattttcaacaacatatcagcagccagggcct

SEQ ID NO: 438433 - DNA, 140 bp, Artificial Sequence
  Synthetic
atacgccatgctgggtctcctacccattacctgagagttatctttgacccttctcacacttggcatgtgagttctggtcatatgcttgatgatgttcagaagtggctgcaaccttatggtcgtacttgggagtcggccat

SEQ ID NO: 438434 - DNA, 140 bp, Artificial Sequence
  Synthetic
atggccgactcccaagtacgaccataaggttgcagccacttctgaacatcatcaagcatatgaccagaactcacatgccaagtgtgagaagggtcaaagataactctcaggtaatgggtaggagacccagcatggcgtat

SEQ ID NO: 438435 - DNA, 140 bp, Artificial Sequence
  Synthetic
atacgccatgctgggtctcccgcgcaacggtactaagtgccccaataatggtgattatgttacatacgccacatgggacactccctatattgattgtcgtagtgggggttataacgccaacgtacttgggagtcggccat

SEQ ID NO: 438436 - DNA, 140 bp, Artificial Sequence
  Synthetic
atggccgactcccaagtacgttggcgttataacccccactacgacaatcaatatagggagtgtcccatgtggcgtatgtaacataatcaccattattggggcacttagtaccgttgcgcgggagacccagcatggcgtat

SEQ ID NO: 438437 - DNA, 140 bp, Artificial Sequence
  Synthetic
aggccctggctgctgatatgatatctccagcagcaattgctagcaactgttattcttcactgattttggattacttttcatacccacttagtatgaaatccgatctcagtgttagttctggaccttttgggacagcggtg

SEQ ID NO: 438438 - DNA, 140 bp, Artificial Sequence
  Synthetic
caccgctgtcccaaaaggtccagaactaacactgagatcggatttcatactaagtgggtatgaaaagtaatccaaaatcagtgaagaataacagttgctagcaattgctgctggagatatcatatcagcagccagggcct

SEQ ID NO: 438439 - DNA, 140 bp, Artificial Sequence
  Synthetic
aggccctggctgctgatatgtgaaactctcggatgcacttaaacgacagattcgcattgcatcaattgatctagttcccagataatctctggcattgtagcagctgtttcagctatgatggaccttttgggacagcggtg

SEQ ID NO: 438440 - DNA, 140 bp, Artificial Sequence
  Synthetic
caccgctgtcccaaaaggtccatcatagctgaaacagctgctacaatgccagagattatctgggaactagatcaattgatgcaatgcgaatctgtcgtttaagtgcatccgagagtttcacatatcagcagccagggcct

SEQ ID NO: 438441 - DNA, 140 bp, Artificial Sequence
  Synthetic
aggccctggctgctgatatgttggaaaactatgcttttgagcacgtagtctatggagacttctctcatactacgttaggcggtcttcacttgcttattggtttatacaagaagcaacagggaccttttgggacagcggtg

SEQ ID NO: 438442 - DNA, 140 bp, Artificial Sequence
  Synthetic
caccgctgtcccaaaaggtccctgttgcttcttgtataaaccaataagcaagtgaagaccgcctaacgtagtatgagagaagtctccatagactacgtgctcaaaagcatagttttccaacatatcagcagccagggcct

SEQ ID NO: 438443 - DNA, 140 bp, Artificial Sequence
  Synthetic
aggccctggctgctgatatgtgtctaaagaagatctacatacattgtatgtagaccctaagtatcaagtcattgtcttaaaagacaatgtactttcttctatgcttagattgcacaccgtgaccttttgggacagcggtg

SEQ ID NO: 438444 - DNA, 140 bp, Artificial Sequence
  Synthetic
caccgctgtcccaaaaggtcacggtgtgcaatctaagcatagaagaaagtacattgtcttttaagacaatgacttgatacttagggtctacatacaatgtatgtagatcttctttagacacatatcagcagccagggcct

SEQ ID NO: 438445 - DNA, 140 bp, Artificial Sequence
  Synthetic
atacgccatgctgggtctccagctttaacaagctccttcattggtcagatcaaaccatatgttataaggatgataagttttatgtggtaaagaacaatgttactttgccatttgaaactgcgtacttgggagtcggccat

SEQ ID NO: 438446 - DNA, 140 bp, Artificial Sequence
  Synthetic
atggccgactcccaagtacgcagtttcaaatggcaaagtaacattgttctttaccacataaaacttatcatccttataacatatggtttgatctgaccaatgaaggagcttgttaaagctggagacccagcatggcgtat

SEQ ID NO: 438447 - DNA, 140 bp, Artificial Sequence
  Synthetic
aggccctggctgctgatatggcctaccactttgcaggctgtcggttcatgcgttgtatgccattcacagacttccctacgctgtgggacatgcatccgtagaccatttctctgctgtaaagaccttttgggacagcggtg

SEQ ID NO: 438448 - DNA, 140 bp, Artificial Sequence
  Synthetic
caccgctgtcccaaaaggtctttacagcagagaaatggtctacggatgcatgtcccacagcgtagggaagtctgtgaatggcatacaacgcatgaaccgacagcctgcaaagtggtaggccatatcagcagccagggcct

SEQ ID NO: 438449 - DNA, 140 bp, Artificial Sequence
  Synthetic
aggccctggctgctgatatgatacagaggacatggcctcaagatttgctgatgggctctgcttattttggaactgtaatgtaccaaaatatcctaataatgcaattgtatgcaggtttgagaccttttgggacagcggtg

SEQ ID NO: 438450 - DNA, 140 bp, Artificial Sequence
  Synthetic
caccgctgtcccaaaaggtctcaaacctgcatacaattgcattattaggatattttggtacattacagttccaaaataagcagagcccatcagcaaatcttgaggccatgtcctctgtatcatatcagcagccagggcct

SEQ ID NO: 438451 - DNA, 140 bp, Artificial Sequence
  Synthetic
aggccctggctgctgatatggcaaatgttgtcagacactttagacaaattgtctgattactgtacgtttgttgttgggctcatgggaaaactatgcttttgagcacgtagtctatggagagaccttttgggacagcggtg

SEQ ID NO: 438452 - DNA, 140 bp, Artificial Sequence
  Synthetic
caccgctgtcccaaaaggtctctccatagactacgtgctcaaaagcatagttttcccatgagcccaacaacaaacgtacagtaatcagacaatttgtctaaagtgtctgacaacatttgccatatcagcagccagggcct

SEQ ID NO: 438453 - DNA, 140 bp, Artificial Sequence
  Synthetic
atacgccatgctgggtctccctttggtgttataagacctttgatatttataatctctggtctacttttacaaaagttcaaggtttggaaaatatatacgcagagctatagactgtggtttcgtacttgggagtcggccat

SEQ ID NO: 438454 - DNA, 140 bp, Artificial Sequence
  Synthetic
atggccgactcccaagtacgaaaccacagtctatagctctgcgtatatattttccaaaccttgaacttttgtaaaagtagaccagagattataaatatcaaaggtcttataacaccaaagggagacccagcatggcgtat

SEQ ID NO: 438455 - DNA, 140 bp, Artificial Sequence
  Synthetic
aggccctggctgctgatatgggcaccacagaggttaaagtgagtgctttgaaaacagctggcgttgtgacaggtaatgttgtaaaacagtgttgcactgctgctgttgatttaagtatgggaccttttgggacagcggtg

SEQ ID NO: 438456 - DNA, 140 bp, Artificial Sequence
  Synthetic
caccgctgtcccaaaaggtcccatacttaaatcaacagcagcagtgcaacactgttttacaacattacctgtcacaacgccagctgttttcaaagcactcactttaacctctgtggtgcccatatcagcagccagggcct

SEQ ID NO: 438457 - DNA, 140 bp, Artificial Sequence
  Synthetic
aggccctggctgctgatatgttttacgcaagttttatcagcatgtaatcaatggttgcaaagatacggcatgcttgctctgctataagaggaaccgacttactagagttgaagcttctacgaccttttgggacagcggtg

SEQ ID NO: 438458 - DNA, 140 bp, Artificial Sequence
  Synthetic
caccgctgtcccaaaaggtcgtagaagcttcaactctagtaagtcggttcctcttatagcagagcaagcatgccgtatctttgcaaccattgattacatgctgataaaacttgcgtaaaacatatcagcagccagggcct

SEQ ID NO: 438459 - DNA, 140 bp, Artificial Sequence
  Synthetic
aggccctggctgctgatatgtaaccttactactattactaagcctcttaagtacagctatattaacaagtgctctcgtcttctttctgatgatcgtactgaagtacctcagttagtgaacgaccttttgggacagcggtg

SEQ ID NO: 438460 - DNA, 140 bp, Artificial Sequence
  Synthetic
caccgctgtcccaaaaggtcgttcactaactgaggtacttcagtacgatcatcagaaagaagacgagagcacttgttaatatagctgtacttaagaggcttagtaatagtagtaaggttacatatcagcagccagggcct

SEQ ID NO: 438461 - DNA, 140 bp, Artificial Sequence
  Synthetic
atacgccatgctgggtctccgcacatctgtggttttactctcagtgttgcaacagctccacttagaggccaatagtaaggcgtgggcctactgtgttaagtgtcataatgacattttgaccgtacttgggagtcggccat

SEQ ID NO: 438462 - DNA, 140 bp, Artificial Sequence
  Synthetic
atggccgactcccaagtacggtcaaaatgtcattatgacacttaacacagtaggcccacgccttactattggcctctaagtggagctgttgcaacactgagagtaaaaccacagatgtgcggagacccagcatggcgtat

SEQ ID NO: 438463 - DNA, 140 bp, Artificial Sequence
  Synthetic
atacgccatgctgggtctccatgtgctttttgagctgagtgatttcaatgtcttgggcagaacattagttctgaatgctcatgagctgcagcgctatggcatgaccaggcctgttaacatcgtacttgggagtcggccat

SEQ ID NO: 438464 - DNA, 140 bp, Artificial Sequence
  Synthetic
atggccgactcccaagtacgatgttaacaggcctggtcatgccatagcgctgcagctcatgagcattcagaactaatgttctgcccaagacattgaaatcactcagctcaaaaagcacatggagacccagcatggcgtat

SEQ ID NO: 438465 - DNA, 140 bp, Artificial Sequence
  Synthetic
atacgccatgctgggtctccaaattgcgtgcgcatgacaatttattgtcagttcgttttagtgccactaagattgttggtggcgccccatcatggctgacgagtttgtatagctttacgtcgtacttgggagtcggccat

SEQ ID NO: 438466 - DNA, 140 bp, Artificial Sequence
  Synthetic
atggccgactcccaagtacgacgtaaagctatacaaactcgtcagccatgatggggcgccaccaacaatcttagtggcactaaaacgaactgacaataaattgtcatgcgcacgcaatttggagacccagcatggcgtat

SEQ ID NO: 438467 - DNA, 140 bp, Artificial Sequence
  Synthetic
aggccctggctgctgatatgaagtgaacagtgccccccgggaagagctctacagtgtgaaatgtaaataaaaatagctattattcaattagattaggctaattagatgatttgcaaaaaagaccttttgggacagcggtg

SEQ ID NO: 438468 - DNA, 140 bp, Artificial Sequence
  Synthetic
caccgctgtcccaaaaggtcttttttgcaaatcatctaattagcctaatctaattgaataatagctatttttatttacatttcacactgtagagctcttcccggggggcactgttcacttcatatcagcagccagggcct

SEQ ID NO: 438469 - DNA, 140 bp, Artificial Sequence
  Synthetic
atacgccatgctgggtctcctgtttcaatttgccaccttgcctgtttatgatactattaagtattattctatcattcctcacagtattcgttctatccaaagtgatagaaaagcttgggccgtacttgggagtcggccat

SEQ ID NO: 438470 - DNA, 140 bp, Artificial Sequence
  Synthetic
atggccgactcccaagtacggcccaagcttttctatcactttggatagaacgaatactgtgaggaatgatagaataatacttaatagtatcataaacaggcaaggtggcaaattgaaacaggagacccagcatggcgtat

SEQ ID NO: 438471 - DNA, 140 bp, Artificial Sequence
  Synthetic
aggccctggctgctgatatgggccaacaagtggatcttgttatttccgacatgtatgatcctactactaagaatgtaacaggtagtaatgagtcaaaggctttattcttacttacctgtggaccttttgggacagcggtg

SEQ ID NO: 438472 - DNA, 140 bp, Artificial Sequence
  Synthetic
caccgctgtcccaaaaggtccacaggtaagtaagaataaagcctttgactcattactacctgttacattcttagtagtaggatcatacatgtcggaaataacaagatccacttgttggcccatatcagcagccagggcct

SEQ ID NO: 438473 - DNA, 140 bp, Artificial Sequence
  Synthetic
aggccctggctgctgatatgcgttctcttgcagaactttgattttaacgaacttaaataaaagccctgttgtttagcgtattgttgcacttgtctggtgggattgtggcattaatttgccgaccttttgggacagcggtg

SEQ ID NO: 438474 - DNA, 140 bp, Artificial Sequence
  Synthetic
caccgctgtcccaaaaggtcggcaaattaatgccacaatcccaccagacaagtgcaacaatacgctaaacaacagggcttttatttaagttcgttaaaatcaaagttctgcaagagaacgcatatcagcagccagggcct

SEQ ID NO: 438475 - DNA, 140 bp, Artificial Sequence
  Synthetic
atacgccatgctgggtctccttgtattaaaactgcccaagctgatacagctggtctttatacaaattttcgaattgacgtcccatctgcagaatcaactggtactcaatcagtttctgtccgtacttgggagtcggccat

SEQ ID NO: 438476 - DNA, 140 bp, Artificial Sequence
  Synthetic
atggccgactcccaagtacggacagaaactgattgagtaccagttgattctgcagatgggacgtcaattcgaaaatttgtataaagaccagctgtatcagcttgggcagttttaatacaaggagacccagcatggcgtat

SEQ ID NO: 438477 - DNA, 140 bp, Artificial Sequence
  Synthetic
atacgccatgctgggtctccgatctaccctgcacttatgttgggtagttcttttggtaatttttctgctaataataagtcgggtgcttattttaatcacactcttcttatcttacctagccgtacttgggagtcggccat

SEQ ID NO: 438478 - DNA, 140 bp, Artificial Sequence
  Synthetic
atggccgactcccaagtacggctaggtaagataagaagagtgtgattaaaataagcacccgacttattattagcagaaaaattaccaaaagaactacccaacataagtgcagggtagatcggagacccagcatggcgtat

SEQ ID NO: 438479 - DNA, 140 bp, Artificial Sequence
  Synthetic
atacgccatgctgggtctccttgctgccattacagcaccttttgttgttctcactggtcttggtgagtcctttaagaaagttgcagccattccgtacaaggcatgcaaatctattaaagacgtacttgggagtcggccat

SEQ ID NO: 438480 - DNA, 140 bp, Artificial Sequence
  Synthetic
atggccgactcccaagtacgtctttaatagatttgcatgccttgtacggaatggctgcaactttcttaaaggactcaccaagaccagtgagaacaacaaaaggtgctgtaatggcagcaaggagacccagcatggcgtat

SEQ ID NO: 438481 - DNA, 140 bp, Artificial Sequence
  Synthetic
aggccctggctgctgatatgagtcattgtcttaaaagacaatgtactttcttctatgcttagattgcttgtaatgcggcttcagttaaccaaattgtcttgcgtaattctaatggtgcttgaccttttgggacagcggtg

SEQ ID NO: 438482 - DNA, 140 bp, Artificial Sequence
  Synthetic
caccgctgtcccaaaaggtcaagcaccattagaattacgcaagacaatttggttaactgaagccgcattacaagcaatctaagcatagaagaaagtacattgtcttttaagacaatgactcatatcagcagccagggcct

SEQ ID NO: 438483 - DNA, 140 bp, Artificial Sequence
  Synthetic
aggccctggctgctgatatgactattggtgtatgtaagtacactgatattgatgttaattcagctttgaatatgttttgacatacgcgataatggttcattggagaagtttatgtctactgaccttttgggacagcggtg

SEQ ID NO: 438484 - DNA, 140 bp, Artificial Sequence
  Synthetic
caccgctgtcccaaaaggtcagtagacataaacttctccaatgaaccattatcgcgtatgtcaaaacatattcaaagctgaattaacatcaatatcagtgtacttacatacaccaatagtcatatcagcagccagggcct

SEQ ID NO: 438485 - DNA, 140 bp, Artificial Sequence
  Synthetic
atacgccatgctgggtctcctacatgatccaggattttaacgaactatggccttttctgcggccttgtttaaacctgtacaactggttcctgtttctcctgtagatcatggtggtgaatccgtacttgggagtcggccat

SEQ ID NO: 438486 - DNA, 140 bp, Artificial Sequence
  Synthetic
atggccgactcccaagtacggattcaccaccatgatctacaggagaaacaggaaccagttgtacaggtttaaacaaggccgcagaaaaggccatagttcgttaaaatcctggatcatgtaggagacccagcatggcgtat

SEQ ID NO: 438487 - DNA, 140 bp, Artificial Sequence
  Synthetic
aggccctggctgctgatatgtaagggggctgcatggcctattgttagacgacgtatagtgcaaatgttgtcagacactttagacaaattgtctgattactgtacgtttgtttgttgggctgaccttttgggacagcggtg

SEQ ID NO: 438488 - DNA, 140 bp, Artificial Sequence
  Synthetic
caccgctgtcccaaaaggtcagcccaacaaacaaacgtacagtaatcagacaatttgtctaaagtgtctgacaacatttgcactatacgtcgtctaacaataggccatgcagcccccttacatatcagcagccagggcct

SEQ ID NO: 438489 - DNA, 140 bp, Artificial Sequence
  Synthetic
aggccctggctgctgatatgtaagaaagtcaataatgagtttattgatcccactgagtgtatttacactcagagtcgctcttgtagtgacttcctacccctgtctgacatggagaaagacgaccttttgggacagcggtg

SEQ ID NO: 438490 - DNA, 140 bp, Artificial Sequence
  Synthetic
caccgctgtcccaaaaggtcgtctttctccatgtcagacaggggtaggaagtcactacaagagcgactctgagtgtaaatacactcagtgggatcaataaactcattattgactttcttacatatcagcagccagggcct

SEQ ID NO: 438491 - DNA, 140 bp, Artificial Sequence
  Synthetic
atacgccatgctgggtctccaaattcacacctttgagtgtggagtctacaccagttgaacctccaactgtagatgtggtagcacttcaacaggaaatgacaattgtcaaatgtaagggttcgtacttgggagtcggccat

SEQ ID NO: 438492 - DNA, 140 bp, Artificial Sequence
  Synthetic
atggccgactcccaagtacgaacccttacatttgacaattgtcatttcctgttgaagtgctaccacatctacagttggaggttcaactggtgtagactccacactcaaaggtgtgaatttggagacccagcatggcgtat

SEQ ID NO: 438493 - DNA, 140 bp, Artificial Sequence
  Synthetic
atacgccatgctgggtctcctgcttaaaagcatacttgttaagtatgggtgttgtgacacgtcgtactttgataataaactctggtttgattttgttgaaaatccagggattattggtgtcgtacttgggagtcggccat

SEQ ID NO: 438494 - DNA, 140 bp, Artificial Sequence
  Synthetic
atggccgactcccaagtacgacaccaataatccctggattttcaacaaaatcaaaccagagtttattatcaaagtacgacgtgtcacaacacccatacttaacaagtatgcttttaagcaggagacccagcatggcgtat

SEQ ID NO: 438495 - DNA, 140 bp, Artificial Sequence
  Synthetic
aggccctggctgctgatatgaagagtttctctgatagtggttgcattcttccatctgagtgcactatgtttagggatgcagagggccgtatgacaccatactgccatgatcctcaggttagaccttttgggacagcggtg

SEQ ID NO: 438496 - DNA, 140 bp, Artificial Sequence
  Synthetic
caccgctgtcccaaaaggtctaacctgaggatcatggcagtatggtgtcatacggccctctgcatccctaaacatagtgcactcagatggaagaatgcaaccactatcagagaaactcttcatatcagcagccagggcct

SEQ ID NO: 438497 - DNA, 140 bp, Artificial Sequence
  Synthetic
aggccctggctgctgatatgactatggagaattatgaactagagaagcactgttacgatttgttacgtgactgtgatgctgtagctcccccaccttgcctgtttagatactattaagtatgaccttttgggacagcggtg

SEQ ID NO: 438498 - DNA, 140 bp, Artificial Sequence
  Synthetic
caccgctgtcccaaaaggtcatacttaatagtatctaaacaggcaaggtgggggagctacagcatcacagtcacgtaacaaatcgtaacagtgcttctctagttcataattctccatagtcatatcagcagccagggcct

SEQ ID NO: 438499 - DNA, 140 bp, Artificial Sequence
  Synthetic
atacgccatgctgggtctccccaactaagaaactgcgctacgttaagcgtagattttctcttctgcgccctgaagaccttagtgttagtccaaccaacacactatgtcagggttacatttcgtacttgggagtcggccat

SEQ ID NO: 438500 - DNA, 140 bp, Artificial Sequence
  Synthetic
atggccgactcccaagtacgaaatgtaaccctgacatagtgtgttggttggactaacactaaggtcttcagggcgcagaagagaaaatctacgcttaacgtagcgcagtttcttagttggggagacccagcatggcgtat

SEQ ID NO: 438501 - DNA, 140 bp, Artificial Sequence
  Synthetic
atacgccatgctgggtctccattcacccagtgattgttcttccacttctgatgaaatacgcagaaatgggttacgagacattagaaaattcttcaacttggtcaattgcacttattttgacgtacttgggagtcggccat

SEQ ID NO: 438502 - DNA, 140 bp, Artificial Sequence
  Synthetic
atggccgactcccaagtacgtcaaaataagtgcaattgaccaagttgaagaattttctaatgtctcgtaacccatttctgcgtatttcatcagaagtggaagaacaatcactgggtgaatggagacccagcatggcgtat

SEQ ID NO: 438503 - DNA, 140 bp, Artificial Sequence
  Synthetic
aggccctggctgctgatatgacaataattatgtaccctcatatgttaaacctgatagtgtgtctaccagtgatttaggtagtctcattgattgtaatgcggcttcagttaaccaaattgtgaccttttgggacagcggtg

SEQ ID NO: 438504 - DNA, 140 bp, Artificial Sequence
  Synthetic
caccgctgtcccaaaaggtcacaatttggttaactgaagccgcattacaatcaatgagactacctaaatcactggtagacacactatcaggtttaacatatgagggtacataattattgtcatatcagcagccagggcct

SEQ ID NO: 438505 - DNA, 140 bp, Artificial Sequence
  Synthetic
atacgccatgctgggtctccgatttaagtgaatagcctagctatctcacgctccccccgttctcttgaagaactttgatcttaacgaacttaaataaaagccctgttgtttaacgtattgcgtacttgggagtcggccat

SEQ ID NO: 438506 - DNA, 140 bp, Artificial Sequence
  Synthetic
atggccgactcccaagtacgcaatacgttaaacaacagggcttttatttaagttcgttaagatcaaagttcttcaagagaacggggggagcgtgagatagctaggctattcacttaaatcggagacccagcatggcgtat

SEQ ID NO: 438507 - DNA, 140 bp, Artificial Sequence
  Synthetic
atacgccatgctgggtctccttgcgcattcctggtgagattgtggcattaagttgcctgctcatcttgggttgtggacatatgttcaacactgggtacaattctaattgaatactattttcgtacttgggagtcggccat

SEQ ID NO: 438508 - DNA, 140 bp, Artificial Sequence
  Synthetic
atggccgactcccaagtacgaaaatagtattcaattagaattgtacccagtgttgaacatatgtccacaacccaagatgagcaggcaacttaatgccacaatctcaccaggaatgcgcaaggagacccagcatggcgtat

SEQ ID NO: 438509 - DNA, 140 bp, Artificial Sequence
  Synthetic
aggccctggctgctgatatgcttctgccgttaagttgcaaaataatgagatcaaaccttcaggtttaaaaaccatggttgttctgcaggtcaagagcaaactaactgtaatactagttccgaccttttgggacagcggtg

SEQ ID NO: 438510 - DNA, 140 bp, Artificial Sequence
  Synthetic
caccgctgtcccaaaaggtcggaactagtattacagttagtttgctcttgacctgcagaacaaccatggtttttaaacctgaaggtttgatctcattattttgcaacttaacggcagaagcatatcagcagccagggcct

SEQ ID NO: 438511 - DNA, 140 bp, Artificial Sequence
  Synthetic
atacgccatgctgggtctcctcagttagagcgtcgtgtctcttgtacatctcggtcacaatatacggtttcgtccggtgcgtggcaattcggggcacatcatgtcttttgtggctggtgtcgtacttgggagtcggccat

SEQ ID NO: 438512 - DNA, 140 bp, Artificial Sequence
  Synthetic
atggccgactcccaagtacgacaccagccacaaaagacatgatgtgccccgaattgccacgcaccggacgaaaccgtatattgtgaccgagatgtacaagagacacgacgctctaactgaggagacccagcatggcgtat

SEQ ID NO: 438513 - DNA, 140 bp, Artificial Sequence
  Synthetic
atacgccatgctgggtctccgaccgcgcaaggtgcgcgcggtatgtatcgagcagcgctcaactctgaaaaacatcaagaccatgtgtctctaactgtcccactttgtggtgcaggagaccgtacttgggagtcggccat

SEQ ID NO: 438514 - DNA, 140 bp, Artificial Sequence
  Synthetic
atggccgactcccaagtacggtctcctgcaccacaaagtgggacagttagagacacatggtcttgatgtttttcagagttgagcgctgctcgatacataccgcgcgcaccttgcgcggtcggagacccagcatggcgtat

SEQ ID NO: 438515 - DNA, 140 bp, Artificial Sequence
  Synthetic
atacgccatgctgggtctccctggttacaaaactttcaccatggttcatggatggctatgaagcctgtgaagcggtgaaggtcatgttatctaacaatgagcaattgctctttgtgcccacgtacttgggagtcggccat

SEQ ID NO: 438516 - DNA, 140 bp, Artificial Sequence
  Synthetic
atggccgactcccaagtacgtgggcacaaagagcaattgctcattgttagataacatgaccttcaccgcttcacaggcttcatagccatccatgaaccatggtgaaagttttgtaaccagggagacccagcatggcgtat

SEQ ID NO: 438517 - DNA, 140 bp, Artificial Sequence
  Synthetic
aggccctggctgctgatatgacctccaaaggagcagcgtgtgcaaggtagcatcactcagcgcactcgcacccgtccaagtgttcagcctggtccaatgattgatgttaacactgattaggaccttttgggacagcggtg

SEQ ID NO: 438518 - DNA, 140 bp, Artificial Sequence
  Synthetic
caccgctgtcccaaaaggtcctaatcagtgttaacatcaatcattggaccaggctgaacacttggacgggtgcgagtgcgctgagtgatgctaccttgcacacgctgctcctttggaggtcatatcagcagccagggcct

SEQ ID NO: 438519 - DNA, 140 bp, Artificial Sequence
  Synthetic
atacgccatgctgggtctcctccatctggttgggtatactaagcatctcccaggccctcgtgtttacctggttgagaggctgatcaagtgtgttgatccattcatggttaaccagttggccgtacttgggagtcggccat

SEQ ID NO: 438520 - DNA, 140 bp, Artificial Sequence
  Synthetic
atggccgactcccaagtacggccaactggttaaccatgaatggatcaacacacttgatcagcctctcaaccaggtaaacacgagggcctgggagatgcttagtatacccaaccagatggaggagacccagcatggcgtat

SEQ ID NO: 438521 - DNA, 140 bp, Artificial Sequence
  Synthetic
aggccctggctgctgatatggttgtttagcgtattgttgcacttgtctggtgggattgtggcattaatttgcctgctcatctaggcagtggacatatgctcaacactgggtataattctagaccttttgggacagcggtg

SEQ ID NO: 438522 - DNA, 140 bp, Artificial Sequence
  Synthetic
caccgctgtcccaaaaggtctagaattatacccagtgttgagcatatgtccactgcctagatgagcaggcaaattaatgccacaatcccaccagacaagtgcaacaatacgctaaacaaccatatcagcagccagggcct

SEQ ID NO: 438523 - DNA, 140 bp, Artificial Sequence
  Synthetic
atacgccatgctgggtctccttatagctctagtgcaaatgatggccttgttggcacaactttgcagggtaagcctattggtatgttcttcccttatgacgctgaacttgctacaggagaacgtacttgggagtcggccat

SEQ ID NO: 438524 - DNA, 140 bp, Artificial Sequence
  Synthetic
atggccgactcccaagtacgttctcctgtagcaagttcagcgtcataagggaagaacataccaataggcttaccctgcaaagttgtgccaacaaggccatcatttgcactagagctataaggagacccagcatggcgtat

SEQ ID NO: 438525 - DNA, 140 bp, Artificial Sequence
  Synthetic
atacgccatgctgggtctccgaaaccatcttactccgtaagtatggccgtggtggttaccactacaagagagtgccttaccagcgtaataacacctctttttctgagtggattgatgatccgtacttgggagtcggccat

SEQ ID NO: 438526 - DNA, 140 bp, Artificial Sequence
  Synthetic
atggccgactcccaagtacggatcatcaatccactcagaaaaagaggtgttattacgctggtaaggcactctcttgtagtggtaaccaccacggccatacttacggagtaagatggtttcggagacccagcatggcgtat

SEQ ID NO: 438527 - DNA, 140 bp, Artificial Sequence
  Synthetic
aggccctggctgctgatatgaatggctactttattaaaactaataacactaggattgttgatgagtggtcatatactggctcgtccttctatgcacctgagcccatcacctcccttaatagaccttttgggacagcggtg

SEQ ID NO: 438528 - DNA, 140 bp, Artificial Sequence
  Synthetic
caccgctgtcccaaaaggtctattaagggaggtgatgggctcaggtgcatagaaggacgagccagtatatgaccactcatcaacaatcctagtgttattagttttaataaagtagccattcatatcagcagccagggcct

SEQ ID NO: 438529 - DNA, 140 bp, Artificial Sequence
  Synthetic
atacgccatgctgggtctcctaaacccattagcacttatgcatctttaatagccaaggaaggaataaccaaattggctgatgttgaagctgacgttgcatcacgtgttgatgacgaaggccgtacttgggagtcggccat

SEQ ID NO: 438530 - DNA, 140 bp, Artificial Sequence
  Synthetic
atggccgactcccaagtacggccttcgtcatcaacacgtgatgcaacgtcagcttcaacatcagccaatttggttattccttccttggctattaaagatgcataagtgctaatgggtttaggagacccagcatggcgtat

SEQ ID NO: 438531 - DNA, 140 bp, Artificial Sequence
  Synthetic
aggccctggctgctgatatgcccagataatctctggcattgtagcagctgtttcagctatgatgtggatttcctactttgtgcagagtatccggctgtttatgagaactggatcatggtggaccttttgggacagcggtg

SEQ ID NO: 438532 - DNA, 140 bp, Artificial Sequence
  Synthetic
caccgctgtcccaaaaggtccaccatgatccagttctcataaacagccggatactctgcacaaagtaggaaatccacatcatagctgaaacagctgctacaatgccagagattatctgggcatatcagcagccagggcct

SEQ ID NO: 438533 - DNA, 140 bp, Artificial Sequence
  Synthetic
atacgccatgctgggtctccttcatcatgttaaagaacaaactgtataggttggtttggcatgttgagcgtagagacgttccgtattccaaacagtcaatctttactattaatagtgtggcgtacttgggagtcggccat

SEQ ID NO: 438534 - DNA, 140 bp, Artificial Sequence
  Synthetic
atggccgactcccaagtacgccacactattaatagtaaagattgactgtttggaatacggaacgtctctacgctcaacatgccaaaccaacctatacagtttgttctttaacatgatgaaggagacccagcatggcgtat

SEQ ID NO: 438535 - DNA, 140 bp, Artificial Sequence
  Synthetic
atacgccatgctgggtctccttcaaaaggatagtgttgaagacactcctcctcactattttactcttggtggcaaaattgatatactcacaccacgcaacaagtggagtggtatagctaacgtacttgggagtcggccat

SEQ ID NO: 438536 - DNA, 140 bp, Artificial Sequence
  Synthetic
atggccgactcccaagtacgttagctataccactccacttgttgcgtggtgtgagtatatcaattttgccaccaagagtaaaatagtgaggaggagtgtcttcaacactatccttttgaaggagacccagcatggcgtat

SEQ ID NO: 438537 - DNA, 140 bp, Artificial Sequence
  Synthetic
atacgccatgctgggtctccaatgcctctcaaacaaagaattctttacacattctatggtaaagagtctcttcaagatccttcttacatctaccattctgcgttcactgattgtggaggccgtacttgggagtcggccat

SEQ ID NO: 438538 - DNA, 140 bp, Artificial Sequence
  Synthetic
atggccgactcccaagtacggcctccacaatcagtgaacgcagaatggtagatgtaagaaggatcttgaagagactctttaccatagaatgtgtaaagaattctttgtttgagaggcattggagacccagcatggcgtat

SEQ ID NO: 438539 - DNA, 140 bp, Artificial Sequence
  Synthetic
aggccctggctgctgatatgcacggcaatccctactattaaggattggcttctcgttcagggattttccctttaccatagtggcctccctttacatatgtcaatctctaaattgcatgcagaccttttgggacagcggtg

SEQ ID NO: 438540 - DNA, 140 bp, Artificial Sequence
  Synthetic
caccgctgtcccaaaaggtctgcatgcaatttagagattgacatatgtaaagggaggccactatggtaaagggaaaatccctgaacgagaagccaatccttaatagtagggattgccgtgcatatcagcagccagggcct

SEQ ID NO: 438541 - DNA, 140 bp, Artificial Sequence
  Synthetic
atacgccatgctgggtctcccataagggcggtgattctaccgatttcattgccctcattatgacttatggcaattgtacatttggtgccccagatgatgccactcgactactccacatcgcgtacttgggagtcggccat

SEQ ID NO: 438542 - DNA, 140 bp, Artificial Sequence
  Synthetic
atggccgactcccaagtacgcgatgtggagtagtcgagtggcatcatctggggcaccaaatgtacaattgccataagtcataatgagggcaatgaaatcggtagaatcaccgcccttatgggagacccagcatggcgtat

SEQ ID NO: 438543 - DNA, 140 bp, Artificial Sequence
  Synthetic
atacgccatgctgggtctccgcctaattaagcccaatgctttgttttgtgctacttgtccttttgctaagggcgatagctgttcatcaagctgcaaacattcagtggcccagttggtaagcgtacttgggagtcggccat

SEQ ID NO: 438544 - DNA, 140 bp, Artificial Sequence
  Synthetic
atggccgactcccaagtacgcttaccaactgggccactgaatgtttgcagcttgatgaacagctatcgcccttagcaaaaggacaagtagcacaaaacaaagcattgggcttaattaggcggagacccagcatggcgtat

SEQ ID NO: 438545 - DNA, 140 bp, Artificial Sequence
  Synthetic
atacgccatgctgggtctccttacctttctgagcgctgtaatgttattgcagattcgaagtcctttacgctcgtctttggaggtgttgcttacgcctattttggatgcgcggaaggtactcgtacttgggagtcggccat

SEQ ID NO: 438546 - DNA, 140 bp, Artificial Sequence
  Synthetic
atggccgactcccaagtacgagtaccttccgcgcatccaaaataggcgtaagcaacacctccaaagacgagcgtaaaggacttcgaatctgcaataacattacagcgctcagaaaggtaaggagacccagcatggcgtat

SEQ ID NO: 438547 - DNA, 140 bp, Artificial Sequence
  Synthetic
atacgccatgctgggtctccatgtattttgtcccaagagctaaatctgtggtttcgaagataggagattccgtcttcacaggctgtacaggctcttggcgcaaagttattcagattgctacgtacttgggagtcggccat

SEQ ID NO: 438548 - DNA, 140 bp, Artificial Sequence
  Synthetic
atggccgactcccaagtacgtagcaatctgaataactttgcgccaagagcctgtacagcctgtgaagacggaatctcctatcttcgaaaccacagatttagctcttgggacaaaatacatggagacccagcatggcgtat

SEQ ID NO: 438549 - DNA, 140 bp, Artificial Sequence
  Synthetic
atacgccatgctgggtctccaactctgctgtattatgctgaaagcattttatacagagtttttccgtatgagatctcgtctgatgtctctactttttctgaactgctgttagactgtgttcgtacttgggagtcggccat

SEQ ID NO: 438550 - DNA, 140 bp, Artificial Sequence
  Synthetic
atggccgactcccaagtacgaacacagtctaacagcagttcagaaaaagtagagacatcagacgagatctcatacggaaaaactctgtataaaatgctttcagcataatacagcagagttggagacccagcatggcgtat

SEQ ID NO: 438551 - DNA, 140 bp, Artificial Sequence
  Synthetic
aggccctggctgctgatatggcttggttgctacataaggatggaggaatccctgatggatgttccctctacctccggcactcaagtttattcgcgcaaagcgaggaagaggagtcattctgaccttttgggacagcggtg

SEQ ID NO: 438552 - DNA, 140 bp, Artificial Sequence
  Synthetic
caccgctgtcccaaaaggtcagaatgactcctcttcctcgctttgcgcgaataaacttgagtgccggaggtagagggaacatccatcagggattcctccatccttatgtagcaaccaagccatatcagcagccagggcct

SEQ ID NO: 438553 - DNA, 140 bp, Artificial Sequence
  Synthetic
aggccctggctgctgatatgagatacttgtcgtcgcagcattatcagaactatggttctctatttccttgttctgtataactttttattagccattgtattagtcaatggtgtacattatgaccttttgggacagcggtg

SEQ ID NO: 438554 - DNA, 140 bp, Artificial Sequence
  Synthetic
caccgctgtcccaaaaggtcataatgtacaccattgactaatacaatggctaataaaaagttatacagaacaaggaaatagagaaccatagttctgataatgctgcgacgacaagtatctcatatcagcagccagggcct

SEQ ID NO: 438555 - DNA, 140 bp, Artificial Sequence
  Synthetic
atacgccatgctgggtctccggacaaaatacggcaacttctgaaggatgctactcttgagaagttacgtgattacttagctgactatgacgtagcagtcacagctggcccttttatggatcgtacttgggagtcggccat

SEQ ID NO: 438556 - DNA, 140 bp, Artificial Sequence
  Synthetic
atggccgactcccaagtacgatccataaaagggccagctgtgactgctacgtcatagtcagctaagtaatcacgtaacttctcaagagtagcatccttcagaagttgccgtattttgtccggagacccagcatggcgtat

SEQ ID NO: 438557 - DNA, 140 bp, Artificial Sequence
  Synthetic
atacgccatgctgggtctccaatgccattaatgtcggtggtagaggtttacaatacgccgccattacagcaccttttgtagttctcaatggattaggtgagtcctttaagaaaattgcagcgtacttgggagtcggccat

SEQ ID NO: 438558 - DNA, 140 bp, Artificial Sequence
  Synthetic
atggccgactcccaagtacgctgcaattttcttaaaggactcacctaatccattgagaactacaaaaggtgctgtaatggcggcgtattgtaaacctctaccaccgacattaatggcattggagacccagcatggcgtat

SEQ ID NO: 438559 - DNA, 140 bp, Artificial Sequence
  Synthetic
aggccctggctgctgatatgactgctggcttatcctcctttgctgctattccatttgcacagagtatcttttataggttaaacggtcaattatctagcttcccagataatctctggcattgaccttttgggacagcggtg

SEQ ID NO: 438560 - DNA, 140 bp, Artificial Sequence
  Synthetic
caccgctgtcccaaaaggtcaatgccagagattatctgggaagctagataattgaccgtttaacctataaaagatactctgtgcaaatggaatagcagcaaaggaggataagccagcagtcatatcagcagccagggcct

SEQ ID NO: 438561 - DNA, 140 bp, Artificial Sequence
  Synthetic
atacgccatgctgggtctcctcattccgtataaggtctgcaagtctcttaaagacactctggaatattatgctcatagcatattgtacagagtgtttccttatgatattgaatctgacaacgtacttgggagtcggccat

SEQ ID NO: 438562 - DNA, 140 bp, Artificial Sequence
  Synthetic
atggccgactcccaagtacgttgtcagattcaatatcataaggaaacactctgtacaatatgctatgagcataatattccagagtgtctttaagagacttgcagaccttatacggaatgaggagacccagcatggcgtat

SEQ ID NO: 438563 - DNA, 140 bp, Artificial Sequence
  Synthetic
atacgccatgctgggtctcctgtcgatgctgtgtcatcttttactgagctactttttgactgtgttggtctctcagtggctttaacctattttataattcgactgttagaagataaaactcgtacttgggagtcggccat

SEQ ID NO: 438564 - DNA, 140 bp, Artificial Sequence
  Synthetic
atggccgactcccaagtacgagttttatcttctaacagtcgaattataaaataggttaaagccactgagagaccaacacagtcaaaaagtagctcagtaaaagatgacacagcatcgacaggagacccagcatggcgtat

SEQ ID NO: 438565 - DNA, 140 bp, Artificial Sequence
  Synthetic
aggccctggctgctgatatgactgacttctccttaaacggcaatgtttccactgttttcgtgcctgcaacgcgcgattcagttcctcttcacataatcgccccgagctcgcttatcgtttgaccttttgggacagcggtg

SEQ ID NO: 438566 - DNA, 140 bp, Artificial Sequence
  Synthetic
caccgctgtcccaaaaggtcaaacgataagcgagctcggggcgattatgtgaagaggaactgaatcgcgcgttgcaggcacgaaaacagtggaaacattgccgtttaaggagaagtcagtcatatcagcagccagggcct

SEQ ID NO: 438567 - DNA, 140 bp, Artificial Sequence
  Synthetic
atacgccatgctgggtctccggcgattttatgtccactattattacttcctgtcaaaatgctgtcagtaagcttctagacacttgttttgaggctacagaggcaactatcagttttcttccgtacttgggagtcggccat

SEQ ID NO: 438568 - DNA, 140 bp, Artificial Sequence
  Synthetic
atggccgactcccaagtacggaagaaaactgatagttgcctctgtagcctcaaaacaagtgtctagaagcttactgacagcattttgacaggaagtaataatagtggacataaaatcgccggagacccagcatggcgtat

SEQ ID NO: 438569 - DNA, 140 bp, Artificial Sequence
  Synthetic
atacgccatgctgggtctcctggatttggcaggattgttcaaagttttcatccgcggagcatatgtgtacacttcacagggctttgtggttcttcaaggtaaagtttctacacttgttaacgtacttgggagtcggccat

SEQ ID NO: 438570 - DNA, 140 bp, Artificial Sequence
  Synthetic
atggccgactcccaagtacgttaacaagtgtagaaactttaccttgaagaaccacaaagccctgtgaagtgtacacatatgctccgcggatgaaaactttgaacaatcctgccaaatccaggagacccagcatggcgtat

SEQ ID NO: 438571 - DNA, 140 bp, Artificial Sequence
  Synthetic
atacgccatgctgggtctccacaagtgttagacttacttaataagggtatgcagcttttgcacactaaaatctcatgggctggttctaaaattaatgcagtcatctttaacggtagagagcgtacttgggagtcggccat

SEQ ID NO: 438572 - DNA, 140 bp, Artificial Sequence
  Synthetic
atggccgactcccaagtacgctctctaccgttaaagatgactgcattaattttagaaccagcccatgagattttagtgtgcaaaagctgcatacccttattaagtaagtctaacacttgtggagacccagcatggcgtat

SEQ ID NO: 438573 - DNA, 140 bp, Artificial Sequence
  Synthetic
aggccctggctgctgatatggatgttgaggcttgtatggttcaggttacctgcggtagcatgactcttaatggtctttggcttgacaacacagtctggtgcccacgacacgtaatgtgccgaccttttgggacagcggtg

SEQ ID NO: 438574 - DNA, 140 bp, Artificial Sequence
  Synthetic
caccgctgtcccaaaaggtcggcacattacgtgtcgtgggcaccagactgtgttgtcaagccaaagaccattaagagtcatgctaccgcaggtaacctgaaccatacaagcctcaacatccatatcagcagccagggcct

SEQ ID NO: 438575 - DNA, 140 bp, Artificial Sequence
  Synthetic
atacgccatgctgggtctcctctttgattttctctactggtacctattattgtgtcaccactaaggcaaagtctgttcaacaagattttgatgtggttttgccaggtgagtgtttaaagacgtacttgggagtcggccat

SEQ ID NO: 438576 - DNA, 140 bp, Artificial Sequence
  Synthetic
atggccgactcccaagtacgtctttaaacactcacctggcaaaaccacatcaaaatcttgttgaacagactttgccttagtggtgacacaataataggtaccagtagagaaaatcaaagaggagacccagcatggcgtat

SEQ ID NO: 438577 - DNA, 140 bp, Artificial Sequence
  Synthetic
aggccctggctgctgatatgagtctgaactcttttaaggagtactttaatttacgtaactgcacctttatgtacacttataacattaccgaagatgagattttagagtggttagcttcccgaccttttgggacagcggtg

SEQ ID NO: 438578 - DNA, 140 bp, Artificial Sequence
  Synthetic
caccgctgtcccaaaaggtcgggaagctaaccactctaaaatctcatcttcggtaatgttataagtgtacataaaggtgcagttacgtaaattaaagtactccttaaaagagttcagactcatatcagcagccagggcct

SEQ ID NO: 438579 - DNA, 140 bp, Artificial Sequence
  Synthetic
atacgccatgctgggtctccagcagctaggactgcttcaacctactgacaattcaacaacagttagtgttactgtgtccagtaatacggttgaaactgttgttggtcaattggaacagaccgtacttgggagtcggccat

SEQ ID NO: 438580 - DNA, 140 bp, Artificial Sequence
  Synthetic
atggccgactcccaagtacggtctgttccaattgaccaacaacagtttcaaccgtattactggacacagtaacactaactgttgttgaattgtcagtaggttgaagcagtcctagctgctggagacccagcatggcgtat

SEQ ID NO: 438581 - DNA, 140 bp, Artificial Sequence
  Synthetic
atacgccatgctgggtctcctaatatgcatggccctgatgttatagtaggagactatgttattattagtgaaaaattgtttgtacgtagtaaggagggtgacagttttgtcttctaccctcgtacttgggagtcggccat

SEQ ID NO: 438582 - DNA, 140 bp, Artificial Sequence
  Synthetic
atggccgactcccaagtacgagggtagaagacaaaactgtcaccctccttactacgtacaaacaatttttcactaataataacatagtctcctactataacatcagggccatgcatattaggagacccagcatggcgtat

SEQ ID NO: 438583 - DNA, 140 bp, Artificial Sequence
  Synthetic
atacgccatgctgggtctccgcttgtacaaatggttgtgctgtacctaccttatttaaacttaagggtggtgcacctgttagagagctgacctttggtgacgatgaagtacatgaggtagcgtacttgggagtcggccat

SEQ ID NO: 438584 - DNA, 140 bp, Artificial Sequence
  Synthetic
atggccgactcccaagtacgctacctcatgtacttcatcgtcaccaaaggtcagctctctaacaggtgcaccacccttaagtttaaataaggtaggtacagcacaaccatttgtacaagcggagacccagcatggcgtat

SEQ ID NO: 438585 - DNA, 140 bp, Artificial Sequence
  Synthetic
atacgccatgctgggtctcccagctataagaagtgttactgttgagtacaacattcatgttgtattagacgcacttttggcttcttctagtcttagaacctttgttgtagacaagtctttcgtacttgggagtcggccat

SEQ ID NO: 438586 - DNA, 140 bp, Artificial Sequence
  Synthetic
atggccgactcccaagtacgaaagacttgtctacaacaaaggttctaagactagaagaagccaaaagtgcgtctaatacaacatgaatgttgtactcaacagtaacacttcttatagctgggagacccagcatggcgtat

SEQ ID NO: 438587 - DNA, 140 bp, Artificial Sequence
  Synthetic
atacgccatgctgggtctccatcagtcgatgaatttgtccatgtggtaaaggagcaggttgtagacttgcttgctaaattgctacgtggtaagcaaattcccgattttgatttagacgaccgtacttgggagtcggccat

SEQ ID NO: 438588 - DNA, 140 bp, Artificial Sequence
  Synthetic
atggccgactcccaagtacggtcgtctaaatcaaaatcgggaatttgcttaccacgtagcaatttagcaagcaagtctacaacctgctcctttaccacatggacaaattcatcgactgatggagacccagcatggcgtat

SEQ ID NO: 438589 - DNA, 140 bp, Artificial Sequence
  Synthetic
atacgccatgctgggtctccttaattgattttaacgaatctcaatttcattgttatggcatcccctgctgcacctcgtgctgtttcctttgccgataacaatgatataacaaatacaaaccgtacttgggagtcggccat

SEQ ID NO: 438590 - DNA, 140 bp, Artificial Sequence
  Synthetic
atggccgactcccaagtacggtttgtatttgttatatcattgttatcggcaaaggaaacagcacgaggtgcagcaggggatgccataacaatgaaattgagattcgttaaaatcaattaaggagacccagcatggcgtat

SEQ ID NO: 438591 - DNA, 140 bp, Artificial Sequence
  Synthetic
atacgccatgctgggtctccatgttgaagaagaagctgatggtgtcgaggaagaagtcaccgttgatactactgttgagtcagctgtacaggctggcttgcagcatgaagattctgatgacgtacttgggagtcggccat

SEQ ID NO: 438592 - DNA, 140 bp, Artificial Sequence
  Synthetic
atggccgactcccaagtacgtcatcagaatcttcatgctgcaagccagcctgtacagctgactcaacagtagtatcaacggtgacttcttcctcgacaccatcagcttcttcttcaacatggagacccagcatggcgtat

SEQ ID NO: 438593 - DNA, 140 bp, Artificial Sequence
  Synthetic
atacgccatgctgggtctcctgatggttgggctgcagctgttgaagaagcatttcctcttgatgaatctgaagaattttctgctgaagttgtgtgtgaagatctcacccaacttgtagagcgtacttgggagtcggccat

SEQ ID NO: 438594 - DNA, 140 bp, Artificial Sequence
  Synthetic
atggccgactcccaagtacgctctacaagttgggtgagatcttcacacacaacttcagcagaaaattcttcagattcatcaagaggaaatgcttcttcaacagctgcagcccaaccatcaggagacccagcatggcgtat

SEQ ID NO: 438595 - DNA, 140 bp, Artificial Sequence
  Synthetic
atacgccatgctgggtctccgaacctgctaaggatttacctgagcaggtctctttggtttctgtacaggaattagtgccgaatactatggatgaagttgtacctgagcaggtaacacttccgtacttgggagtcggccat

SEQ ID NO: 438596 - DNA, 140 bp, Artificial Sequence
  Synthetic
atggccgactcccaagtacggaagtgttacctgctcaggtacaacttcatccatagtattcggcactaattcctgtacagaaaccaaagagacctgctcaggtaaatccttagcaggttcggagacccagcatggcgtat

SEQ ID NO: 438597 - DNA, 140 bp, Artificial Sequence
  Synthetic
aggccctggctgctgatatgctatgttaccctttgtccaagaacgaatagggttgttcatagtaaactttttcatttttaccgtagtatgtgctataacactcttggtgtgtatggctttgaccttttgggacagcggtg

SEQ ID NO: 438598 - DNA, 140 bp, Artificial Sequence
  Synthetic
caccgctgtcccaaaaggtcaaagccatacacaccaagagtgttatagcacatactacggtaaaaatgaaaaagtttactatgaacaaccctattcgttcttggacaaagggtaacatagcatatcagcagccagggcct

SEQ ID NO: 438599 - DNA, 140 bp, Artificial Sequence
  Synthetic
atacgccatgctgggtctccctaaagaacctcaagttattcaacctgaggttttagaggtaactcctgtctacgaggctgacaccgaacagacacagagtgccattgtaaagcctaagagcgtacttgggagtcggccat

SEQ ID NO: 438600 - DNA, 140 bp, Artificial Sequence
  Synthetic
atggccgactcccaagtacgctcttaggctttacaatggcactctgtgtctgttcggtgtcagcctcgtagacaggagttacctctaaaacctcaggttgaataacttgaggttctttagggagacccagcatggcgtat

SEQ ID NO: 438601 - DNA, 140 bp, Artificial Sequence
  Synthetic
atacgccatgctgggtctccattacgcaagaagcgtaatgtcgaccctttgtccaactttgaacataaggtcataacagattgtgtcactatagttttaggagacgcaattcaagtagcacgtacttgggagtcggccat

SEQ ID NO: 438602 - DNA, 140 bp, Artificial Sequence
  Synthetic
atggccgactcccaagtacgtgctacttgaattgcgtctcctaaaactatagtgacacaatctgttatgaccttatgttcaaagttggacaaagggtcgacattacgcttcttgcgtaatggagacccagcatggcgtat

SEQ ID NO: 438603 - DNA, 140 bp, Artificial Sequence
  Synthetic
atacgccatgctgggtctccaaatgctatgaacaatctgtgttagttaatgctgctaacacacatcttaagcatggcggcggtatagctgctgctattaatgcagctacgaaaggagctgcgtacttgggagtcggccat

SEQ ID NO: 438604 - DNA, 140 bp, Artificial Sequence
  Synthetic
atggccgactcccaagtacgcagctcctttcgtagctgcattaatagcagcagctataccgccgccatgcttaagatgtgtgttagcagcattaactaacacagattgttcatagcatttggagacccagcatggcgtat

SEQ ID NO: 438605 - DNA, 140 bp, Artificial Sequence
  Synthetic
atacgccatgctgggtctccttcaacaagagtcagatgagtatattctgactagaggtcccttgcaagtaggagaatcagctctcctgcaaggtcattctcttgctaaaaacatcttgcacgtacttgggagtcggccat

SEQ ID NO: 438606 - DNA, 140 bp, Artificial Sequence
  Synthetic
atggccgactcccaagtacgtgcaagatgtttttagcaagagaatgaccttgcaggagagctgattctcctacttgcaagggacctctagtcagaatatactcatctgactcttgttgaaggagacccagcatggcgtat

SEQ ID NO: 438607 - DNA, 140 bp, Artificial Sequence
  Synthetic
atacgccatgctgggtctcctgttgtaggccctgatgctcgtgcaaagcaagatgtttctcttcttagtaagtgctacagagctatgaatgcatatcctctcgtagtaactcctcttgtacgtacttgggagtcggccat

SEQ ID NO: 438608 - DNA, 140 bp, Artificial Sequence
  Synthetic
atggccgactcccaagtacgtacaagaggagttactacgagaggatatgcattcatagctctgtagcacttactaagaagagaaacatcttgctttgcacgagcatcagggcctacaacaggagacccagcatggcgtat

SEQ ID NO: 438609 - DNA, 140 bp, Artificial Sequence
  Synthetic
atacgccatgctgggtctcctctgcgggcatatttggtgttaagccatctgtgtcatttgattatcttattagagaagttgaaactagagtactagttgttgtcaactctcatgatgtttcgtacttgggagtcggccat

SEQ ID NO: 438610 - DNA, 140 bp, Artificial Sequence
  Synthetic
atggccgactcccaagtacgaaacatcatgagagttgacaacaactagtactctagtttcaacttctctaataagataatcaaatgacacagatggcttaacaccaaatatgcccgcagaggagacccagcatggcgtat

SEQ ID NO: 438611 - DNA, 140 bp, Artificial Sequence
  Synthetic
atacgccatgctgggtctccataagagtcttacaactgtgagcgtgcctcagggtttgactttctcctatgatggattgcgtggtgccatacgtaaagctaaagattatggttttacggtcgtacttgggagtcggccat

SEQ ID NO: 438612 - DNA, 140 bp, Artificial Sequence
  Synthetic
atggccgactcccaagtacgaccgtaaaaccataatctttagctttacgtatggcaccacgcaatccatcataggagaaagtcaaaccctgaggcacgctcacagttgtaagactcttatggagacccagcatggcgtat

SEQ ID NO: 438613 - DNA, 140 bp, Artificial Sequence
  Synthetic
aggccctggctgctgatatgcgatgttgtcctcgcaattctctctggaaccacaactaatgttgacaaaatacgccagcttctcaaaggtgtcacccttgacaagttgcgtgattatttagaccttttgggacagcggtg

SEQ ID NO: 438614 - DNA, 140 bp, Artificial Sequence
  Synthetic
caccgctgtcccaaaaggtctaaataatcacgcaacttgtcaagggtgacacctttgagaagctggcgtattttgtcaacattagttgtggttccagagagaattgcgaggacaacatcgcatatcagcagccagggcct

SEQ ID NO: 438615 - DNA, 140 bp, Artificial Sequence
  Synthetic
atacgccatgctgggtctccttttgtgtgcactgacaattcagttaacaccaaaattcttaggaataagggtgttgattatactaagaaatcccttaccgttgatggtgtgcaatattatcgtacttgggagtcggccat

SEQ ID NO: 438616 - DNA, 140 bp, Artificial Sequence
  Synthetic
atggccgactcccaagtacgataatattgcacaccatcaacggtaagggatttcttagtataatcaacacccttattcctaagaattttggtgttaactgaattgtcagtgcacacaaaaggagacccagcatggcgtat

SEQ ID NO: 438617 - DNA, 140 bp, Artificial Sequence
  Synthetic
atacgccatgctgggtctcctgttacacgtctagggattctttagatacaattttacaagaggctaataagtctattggtattgtatctatgcctttggggtatgtttcccatggcttagcgtacttgggagtcggccat

SEQ ID NO: 438618 - DNA, 140 bp, Artificial Sequence
  Synthetic
atggccgactcccaagtacgctaagccatgggaaacataccccaaaggcatagatacaataccaatagacttattagcctcttgtaaaattgtatctaaagaatccctagacgtgtaacaggagacccagcatggcgtat

SEQ ID NO: 438619 - DNA, 140 bp, Artificial Sequence
  Synthetic
atacgccatgctgggtctcctgctcgcaaaagctgagttatgcgttactgcgcgcatggtatggagagagtggtgcaacgtctgtggcacgaaagatgttacttttcaaggccttaaggccgtacttgggagtcggccat

SEQ ID NO: 438620 - DNA, 140 bp, Artificial Sequence
  Synthetic
atggccgactcccaagtacggccttaaggccttgaaaagtaacatctttcgtgccacagacgttgcaccactctctccataccatgcgcgcagtaacgcataactcagcttttgcgagcaggagacccagcatggcgtat

SEQ ID NO: 438621 - DNA, 140 bp, Artificial Sequence
  Synthetic
atacgccatgctgggtctccatttaatgcaagctggtagttttgtacgtaaggtcaaagtaccttatgtgtgccttctagctaataaggagcaacaagccattttgatgtctgaagatgtcgtacttgggagtcggccat

SEQ ID NO: 438622 - DNA, 140 bp, Artificial Sequence
  Synthetic
atggccgactcccaagtacgacatcttcagacatcaaaatggcttgttgctccttattagctagaaggcacacataaggtactttgaccttacgtacaaaactaccagcttgcattaaatggagacccagcatggcgtat

SEQ ID NO: 438623 - DNA, 140 bp, Artificial Sequence
  Synthetic
atacgccatgctgggtctcctaagttaagcccttcagccgattttattaagtatgttcgcactaatggtggttacaattcttggcatttagtcgagggtgaactattggtacagaaacagcgtacttgggagtcggccat

SEQ ID NO: 438624 - DNA, 140 bp, Artificial Sequence
  Synthetic
atggccgactcccaagtacgctgtttctgtaccaatagttcaccctcgactaaatgccaagaattgtaaccaccattagtgcgaacatacttaataaaatcggctgaagggcttaacttaggagacccagcatggcgtat

SEQ ID NO: 438625 - DNA, 140 bp, Artificial Sequence
  Synthetic
aggccctggctgctgatatgtatctctattttgttaaaaatcttaacaaccttcatcgcgggcaagtgttagggcacattgctgcgactgttagattgcaagctggttctaacaccgagtgaccttttgggacagcggtg

SEQ ID NO: 438626 - DNA, 140 bp, Artificial Sequence
  Synthetic
caccgctgtcccaaaaggtcactcggtgttagaaccagcttgcaatctaacagtcgcagcaatgtgccctaacacttgcccgcgatgaaggttgttaagatttttaacaaaatagagatacatatcagcagccagggcct

SEQ ID NO: 438627 - DNA, 140 bp, Artificial Sequence
  Synthetic
atacgccatgctgggtctccggttttacagcagcatcatgctattttgtagtgcgactgctggatgagaaagccgaagcacttttgtccactgtattctcttcttgtcaggctgcagtttcgtacttgggagtcggccat

SEQ ID NO: 438628 - DNA, 140 bp, Artificial Sequence
  Synthetic
atggccgactcccaagtacgaaactgcagcctgacaagaagagaatacagtggacaaaagtgcttcggctttctcatccagcagtcgcactacaaaatagcatgatgctgctgtaaaaccggagacccagcatggcgtat

SEQ ID NO: 438629 - DNA, 140 bp, Artificial Sequence
  Synthetic
atacgccatgctgggtctccttgaggcttgtcgcacttatcttgattcacgtacgacacagcaattaacaatcgaagtgttggttactgtcgatggtgttaattttagaacagttgttctcgtacttgggagtcggccat

SEQ ID NO: 438630 - DNA, 140 bp, Artificial Sequence
  Synthetic
atggccgactcccaagtacgagaacaactgttctaaaattaacaccatcgacagtaaccaacacttcgattgttaattgctgtgtcgtacgtgaatcaagataagtgcgacaagcctcaaggagacccagcatggcgtat

SEQ ID NO: 438631 - DNA, 140 bp, Artificial Sequence
  Synthetic
atacgccatgctgggtctccgatgtcgataatccgcatcttatgggttgggattaccctaagtgtgatcgtgctatgcctaacatgtgtaggatttttgcatctctgattttggcacgcacgtacttgggagtcggccat

SEQ ID NO: 438632 - DNA, 140 bp, Artificial Sequence
  Synthetic
atggccgactcccaagtacgtgcgtgccaaaatcagagatgcaaaaatcctacacatgttaggcatagcacgatcacacttagggtaatcccaacccataagatgcggattatcgacatcggagacccagcatggcgtat

SEQ ID NO: 438633 - DNA, 140 bp, Artificial Sequence
  Synthetic
atacgccatgctgggtctccaaataataagaactcctataggtcacagttgggatgtgtcttctttaacggagctgatatttctgataccattcctgatgaaaaacagcatggttgcagtcgtacttgggagtcggccat

SEQ ID NO: 438634 - DNA, 140 bp, Artificial Sequence
  Synthetic
atggccgactcccaagtacgactgcaaccatgctgtttttcatcaggaatggtatcagaaatatcagctccgttaaagaagacacatcccaactgtgacctataggagttcttattatttggagacccagcatggcgtat

SEQ ID NO: 438635 - DNA, 140 bp, Artificial Sequence
  Synthetic
atacgccatgctgggtctccttgtatttagcagacaatttgactgctgatgaaacaaaagcgcttaaagagttatatggcgctgttgatgctactttcctacacagattctattcactaacgtacttgggagtcggccat

SEQ ID NO: 438636 - DNA, 140 bp, Artificial Sequence
  Synthetic
atggccgactcccaagtacgttagtgaatagaatctgtgtaggaaagtagcatcaacagcgccatataactctttaagcgcttttgtttcatcagcagtcaaattgtctgctaaatacaaggagacccagcatggcgtat

SEQ ID NO: 438637 - DNA, 140 bp, Artificial Sequence
  Synthetic
atacgccatgctgggtctccaggctgcggtccagaagtggaagatggttgtgtgtgataagacacgttctcttaaattaagtgataataattgctaccttaacggggttattatgacactcgtacttgggagtcggccat

SEQ ID NO: 438638 - DNA, 140 bp, Artificial Sequence
  Synthetic
atggccgactcccaagtacgagtgtcataataaccccgttaaggtagcaattattatcacttaatttaagagaacgtgtcttatcacacacaaccatcttccacttctggaccgcagcctggagacccagcatggcgtat

SEQ ID NO: 438639 - DNA, 140 bp, Artificial Sequence
  Synthetic
aggccctggctgctgatatgcgtggctggtgtgaccgcgcaaggtgcgcgcggtacgtatcgagcagcgctcaactctgaaaaacatcaagaccatgtgtctctaactgtgccactctgtgaccttttgggacagcggtg

SEQ ID NO: 438640 - DNA, 140 bp, Artificial Sequence
  Synthetic
caccgctgtcccaaaaggtcacagagtggcacagttagagacacatggtcttgatgtttttcagagttgagcgctgctcgatacgtaccgcgcgcaccttgcgcggtcacaccagccacgcatatcagcagccagggcct

SEQ ID NO: 438641 - DNA, 140 bp, Artificial Sequence
  Synthetic
atacgccatgctgggtctcctgatttattgaaggacattaagtttgttgtacctgctttacagcatgcttttatgaaacataagggtggtgactctactgatttcattgctctcattatgcgtacttgggagtcggccat

SEQ ID NO: 438642 - DNA, 140 bp, Artificial Sequence
  Synthetic
atggccgactcccaagtacgcataatgagagcaatgaaatcagtagagtcaccacccttatgtttcataaaagcatgctgtaaagcaggtacaacaaacttaatgtccttcaataaatcaggagacccagcatggcgtat

SEQ ID NO: 438643 - DNA, 140 bp, Artificial Sequence
  Synthetic
aggccctggctgctgatatgaaatgcctatgaagtggtgaaggccatgttacttaaaaaggagccacttctctatgtgcccatccggctggctggacacactagacacctcccaggtcctgaccttttgggacagcggtg

SEQ ID NO: 438644 - DNA, 140 bp, Artificial Sequence
  Synthetic
caccgctgtcccaaaaggtcaggacctgggaggtgtctagtgtgtccagccagccggatgggcacatagagaagtggctcctttttaagtaacatggccttcaccacttcataggcatttcatatcagcagccagggcct

SEQ ID NO: 438645 - DNA, 140 bp, Artificial Sequence
  Synthetic
atacgccatgctgggtctccttacttgttagatttttcagtcgatggctatatacgtagggcaatagactgtggccacgatgacttggcacagcttcgttgctcttatgagtcttttgatcgtacttgggagtcggccat

SEQ ID NO: 438646 - DNA, 140 bp, Artificial Sequence
  Synthetic
atggccgactcccaagtacgatcaaaagactcataagagcaacgaagctgtgccaagtcatcgtggccacagtctattgccctacgtatatagccatcgactgaaaaatctaacaagtaaggagacccagcatggcgtat

SEQ ID NO: 438647 - DNA, 140 bp, Artificial Sequence
  Synthetic
atacgccatgctgggtctccggagagagtggtgcaacgtgtgtggcataaaagatgttgttatacaaggccttaaggcatgttgttacgttggtatgcaaactttagacgatctgcatgccgtacttgggagtcggccat

SEQ ID NO: 438648 - DNA, 140 bp, Artificial Sequence
  Synthetic
atggccgactcccaagtacggcatgcagatcgtctaaagtttgcataccaacgtaacaacatgccttaaggccttgtataacaacatcttttatgccacacacgttgcaccactctctccggagacccagcatggcgtat

SEQ ID NO: 438649 - DNA, 140 bp, Artificial Sequence
  Synthetic
atacgccatgctgggtctccctttgcagggcaagcctattggtatgttcttcccttatgacatcgaacttgtcacaggaaagcaaaatattctcctgcgcaagtatggccgtggtggttacgtacttgggagtcggccat

SEQ ID NO: 438650 - DNA, 140 bp, Artificial Sequence
  Synthetic
atggccgactcccaagtacgtaaccaccacggccatacttgcgcaggagaatattttgctttcctgtgacaagttcgatgtcataagggaagaacataccaataggcttgccctgcaaagggagacccagcatggcgtat

SEQ ID NO: 438651 - DNA, 140 bp, Artificial Sequence
  Synthetic
atacgccatgctgggtctccttggtgagttcacctgattttgtagcttttaatgtctttcatggcatggaaacggctgttggccattatgtccatgcccgtttgaaggatggtcttatttcgtacttgggagtcggccat

SEQ ID NO: 438652 - DNA, 140 bp, Artificial Sequence
  Synthetic
atggccgactcccaagtacgaaataagaccatccttcaaacgggcatggacataatggccaacagccgtttccatgccatgaaagacattaaaagctacaaaatcaggtgaactcaccaaggagacccagcatggcgtat

SEQ ID NO: 438653 - DNA, 140 bp, Artificial Sequence
  Synthetic
atacgccatgctgggtctcctaaaatttgactctggcactttaagtaaagcttcagactggaagtgtaaagtgacagatgttcttttccccggacagaagtacagtagtgactgtaatgtcgtacttgggagtcggccat

SEQ ID NO: 438654 - DNA, 140 bp, Artificial Sequence
  Synthetic
atggccgactcccaagtacgacattacagtcactactgtacttctgtccggggaaaagaacatctgtcactttacacttccagtctgaagctttacttaaagtgccagagtcaaattttaggagacccagcatggcgtat

SEQ ID NO: 438655 - DNA, 140 bp, Artificial Sequence
  Synthetic
atacgccatgctgggtctcccgtgcggtattctcttgatggtatttttaagacagaggttgatcctgacctatctgggttttatgttaaggatggtaaatacttcacaagtcaaccctcccgtacttgggagtcggccat

SEQ ID NO: 438656 - DNA, 140 bp, Artificial Sequence
  Synthetic
atggccgactcccaagtacgggagggttgacttgtgaagtatttaccatccttaacataaaacccagataggtcaggatcaacctctgtcttaaaaataccatcaagagaataccgcacgggagacccagcatggcgtat

SEQ ID NO: 438657 - DNA, 140 bp, Artificial Sequence
  Synthetic
atacgccatgctgggtctccataacttattcaccagctacaattctaactggtagtgtttatactaatagttgcctagtatcttcagatggagaaccaggcggtgatgctattagtttaacgtacttgggagtcggccat

SEQ ID NO: 438658 - DNA, 140 bp, Artificial Sequence
  Synthetic
atggccgactcccaagtacgttaaactaatagcatcaccgcctggttctccatctgaagatactaggcaactattagtataaacactaccagttagaattgtagctggtgaataagttatggagacccagcatggcgtat

SEQ ID NO: 438659 - DNA, 140 bp, Artificial Sequence
  Synthetic
atacgccatgctgggtctccgctttaataaccttttagggtttgattctagcaaaccagtcactaagaagtatacatactcttttctccctaaggaagatggtgatgttttgttggctgacgtacttgggagtcggccat

SEQ ID NO: 438660 - DNA, 140 bp, Artificial Sequence
  Synthetic
atggccgactcccaagtacgtcagccaacaaaacatcaccatcttccttagggagaaaagagtatgtatacttcttagtgactggtttgctagaatcaaaccctaaaaggttattaaagcggagacccagcatggcgtat

SEQ ID NO: 438661 - DNA, 140 bp, Artificial Sequence
  Synthetic
atacgccatgctgggtctccgtttgctacatatgaccctatttataagaatggcgccatgtataaaggcaaacctattctttgggtcactaaagcatcttatgatgctaatcttaataagcgtacttgggagtcggccat

SEQ ID NO: 438662 - DNA, 140 bp, Artificial Sequence
  Synthetic
atggccgactcccaagtacgcttattaagattagcatcataagatgctttagtgacccaaagaataggtttgcctttatacatggcgccattcttataaatagggtcatatgtagcaaacggagacccagcatggcgtat

SEQ ID NO: 438663 - DNA, 140 bp, Artificial Sequence
  Synthetic
atacgccatgctgggtctccttcaacagggctagtcttcgtcaaatttttgatgttgctcctgttgaaattgagaataagttcacacctttgagtgttgaacctacacctgtagagccaccgtacttgggagtcggccat

SEQ ID NO: 438664 - DNA, 140 bp, Artificial Sequence
  Synthetic
atggccgactcccaagtacggtggctctacaggtgtaggttcaacactcaaaggtgtgaacttattctcaatttcaacaggagcaacatcaaaaatttgacgaagactagccctgttgaaggagacccagcatggcgtat

SEQ ID NO: 438665 - DNA, 140 bp, Artificial Sequence
  Synthetic
atacgccatgctgggtctcccaactgtacaggtgtcaccacctcaatcagaaatgactattgtcaaatgcaagggcttgaacaagccttttgttaaggataatgtcagttttgttgttgacgtacttgggagtcggccat

SEQ ID NO: 438666 - DNA, 140 bp, Artificial Sequence
  Synthetic
atggccgactcccaagtacgtcaacaacaaaactgacattatccttaacaaaaggcttgttcaagcccttgcatttgacaatagtcatttctgattgaggtggtgacacctgtacagttgggagacccagcatggcgtat

SEQ ID NO: 438667 - DNA, 140 bp, Artificial Sequence
  Synthetic
aggccctggctgctgatatgagtccttcacacttatctttggtggcgtagcttacgcctactttggatgtgaggaaggtactatgtactttgtgcctagagctaagtctgttgtctcaaggaccttttgggacagcggtg

SEQ ID NO: 438668 - DNA, 140 bp, Artificial Sequence
  Synthetic
caccgctgtcccaaaaggtccttgagacaacagacttagctctaggcacaaagtacatagtaccttcctcacatccaaagtaggcgtaagctacgccaccaaagataagtgtgaaggactcatatcagcagccagggcct

SEQ ID NO: 438669 - DNA, 140 bp, Artificial Sequence
  Synthetic
aggccctggctgctgatatgcaacttttgggacgcggaaccctaacaatgattcagctattgttacacaattcgcgcccggtactaagcttcctaaaaacttccacattgaggggactgggaccttttgggacagcggtg

SEQ ID NO: 438670 - DNA, 140 bp, Artificial Sequence
  Synthetic
caccgctgtcccaaaaggtcccagtcccctcaatgtggaagtttttaggaagcttagtaccgggcgcgaattgtgtaacaatagctgaatcattgttagggttccgcgtcccaaaagttgcatatcagcagccagggcct

SEQ ID NO: 438671 - DNA, 140 bp, Artificial Sequence
  Synthetic
atacgccatgctgggtctccctttctactatgcttagactgcacactgttgaatctggtgatataaacgttgttgcagcatcgggatctttaacgtgtaaggtgaaactattgtttagagcgtacttgggagtcggccat

SEQ ID NO: 438672 - DNA, 140 bp, Artificial Sequence
  Synthetic
atggccgactcccaagtacgctctaaacaatagtttcaccttacacgttaaagatcccgatgctgcaacaacgtttatatcaccagattcaacagtgtgcagtctaagcatagtagaaagggagacccagcatggcgtat

SEQ ID NO: 438673 - DNA, 140 bp, Artificial Sequence
  Synthetic
atacgccatgctgggtctcccttcattttactttaaagagtttgctactcgtactttcactgctaccactgtagtaggtagttgtataaaaagtgttgtgcgacatttaggttttactaacgtacttgggagtcggccat

SEQ ID NO: 438674 - DNA, 140 bp, Artificial Sequence
  Synthetic
atggccgactcccaagtacgttagtaaaacctaaatgtcgcacaacactttttatacaactacctactacagtggtagcagtgaaagtacgagtagcaaactctttaaagtaaaatgaagggagacccagcatggcgtat

SEQ ID NO: 438675 - DNA, 140 bp, Artificial Sequence
  Synthetic
aggccctggctgctgatatgcacaactaatgttgacaaaatacgccagcttctcaaaggtgtcacccttgacaagttgcgtgattatttagctgactatgacgtagcagtcactgccggcgaccttttgggacagcggtg

SEQ ID NO: 438676 - DNA, 140 bp, Artificial Sequence
  Synthetic
caccgctgtcccaaaaggtcgccggcagtgactgctacgtcatagtcagctaaataatcacgcaacttgtcaagggtgacacctttgagaagctggcgtattttgtcaacattagttgtgcatatcagcagccagggcct

SEQ ID NO: 438677 - DNA, 140 bp, Artificial Sequence
  Synthetic
atacgccatgctgggtctccacaagttgcgtgattatttagctgactatgacgtagcagtcactgccggcccattcatggataatgctattaatgttggtggtacaggattacagtatgccgtacttgggagtcggccat

SEQ ID NO: 438678 - DNA, 140 bp, Artificial Sequence
  Synthetic
atggccgactcccaagtacggcatactgtaatcctgtaccaccaacattaatagcattatccatgaatgggccggcagtgactgctacgtcatagtcagctaaataatcacgcaacttgtggagacccagcatggcgtat

SEQ ID NO: 438679 - DNA, 140 bp, Artificial Sequence
  Synthetic
atacgccatgctgggtctcccgccattactgcaccttatgtagttctcactggcttaggtgagtcctttaagaaagttgcaaccataccgtacaaggtttgcaactctgttaaggatactcgtacttgggagtcggccat

SEQ ID NO: 438680 - DNA, 140 bp, Artificial Sequence
  Synthetic
atggccgactcccaagtacgagtatccttaacagagttgcaaaccttgtacggtatggttgcaactttcttaaaggactcacctaagccagtgagaactacataaggtgcagtaatggcgggagacccagcatggcgtat

SEQ ID NO: 438681 - DNA, 140 bp, Artificial Sequence
  Synthetic
atacgccatgctgggtctccggaaagcgaccttacgattgttacttatgctaagcacaactatggttttgttgtcttccgtatatcaactgtatgtctttaatcaagtcttgtcaagtgacgtacttgggagtcggccat

SEQ ID NO: 438682 - DNA, 140 bp, Artificial Sequence
  Synthetic
atggccgactcccaagtacgtcacttgacaagacttgattaaagacatacagttgatatacggaagacaacaaaaccatagttgtgcttagcataagtaacaatcgtaaggtcgctttccggagacccagcatggcgtat

SEQ ID NO: 438683 - DNA, 140 bp, Artificial Sequence
  Synthetic
atacgccatgctgggtctccatcaactggtactcaatcagtttctgtcgatcgtgagtcaacttcaactcatgatgattttaccgaacatgttactagtgtgaatctttttgacgttggtcgtacttgggagtcggccat

SEQ ID NO: 438684 - DNA, 140 bp, Artificial Sequence
  Synthetic
atggccgactcccaagtacgaccaacgtcaaaaagattcacactagtaacatgttcggtaaaatcatcatgagttgaagttgactcacgatcgacagaaactgattgagtaccagttgatggagacccagcatggcgtat

SEQ ID NO: 438685 - DNA, 140 bp, Artificial Sequence
  Synthetic
aggccctggctgctgatatgtttcagtagcttctacctattttttagtccgcctcttgcaagataagactggcgactttatgtctacaattattacttcctgccaaactgctgttagtaagaccttttgggacagcggtg

SEQ ID NO: 438686 - DNA, 140 bp, Artificial Sequence
  Synthetic
caccgctgtcccaaaaggtcttactaacagcagtttggcaggaagtaataattgtagacataaagtcgccagtcttatcttgcaagaggcggactaaaaaataggtagaagctactgaaacatatcagcagccagggcct

SEQ ID NO: 438687 - DNA, 140 bp, Artificial Sequence
  Synthetic
aggccctggctgctgatatgccatacggtcttccaatcagggtaataaacaaattgttcattcttaccccattttacatcatccaggattttaacgaactatggctttctcggcgtctttgaccttttgggacagcggtg

SEQ ID NO: 438688 - DNA, 140 bp, Artificial Sequence
  Synthetic
caccgctgtcccaaaaggtcaaagacgccgagaaagccatagttcgttaaaatcctggatgatgtaaaatggggtaagaatgaacaatttgtttattaccctgattggaagaccgtatggcatatcagcagccagggcct

SEQ ID NO: 438689 - DNA, 140 bp, Artificial Sequence
  Synthetic
aggccctggctgctgatatgattttacatcatccaggattttaacgaactatggctttctcggcgtctttatttaaacccgtccagctagtcccagtttctcctgcatttcatcgcattggaccttttgggacagcggtg

SEQ ID NO: 438690 - DNA, 140 bp, Artificial Sequence
  Synthetic
caccgctgtcccaaaaggtccaatgcgatgaaatgcaggagaaactgggactagctggacgggtttaaataaagacgccgagaaagccatagttcgttaaaatcctggatgatgtaaaatcatatcagcagccagggcct

SEQ ID NO: 438691 - DNA, 140 bp, Artificial Sequence
  Synthetic
aggccctggctgctgatatgacttcacaagggtttgtggtggtcaatggcaaagtttctacacttgtcaaacaagtgttagacttgcttaataagggtatgcaacttttgcatacaaagggaccttttgggacagcggtg

SEQ ID NO: 438692 - DNA, 140 bp, Artificial Sequence
  Synthetic
caccgctgtcccaaaaggtccctttgtatgcaaaagttgcatacccttattaagcaagtctaacacttgtttgacaagtgtagaaactttgccattgaccaccacaaacccttgtgaagtcatatcagcagccagggcct

SEQ ID NO: 438693 - DNA, 140 bp, Artificial Sequence
  Synthetic
aggccctggctgctgatatgaggtagtctcattgattgtaatgcggcttcagttaaccaacacttaaacgacagattcgcattgcatgccgtaagtgtaatttagctttccggttaaccagaccttttgggacagcggtg

SEQ ID NO: 438694 - DNA, 140 bp, Artificial Sequence
  Synthetic
caccgctgtcccaaaaggtctggttaaccggaaagctaaattacacttacggcatgcaatgcgaatctgtcgtttaagtgttggttaactgaagccgcattacaatcaatgagactacctcatatcagcagccagggcct

SEQ ID NO: 438695 - DNA, 140 bp, Artificial Sequence
  Synthetic
atacgccatgctgggtctcctctcctgggctggttctaatatcagtgctgttatctacagcggcagggagtctctaatattcccatcgggaacctattactgtgtcaccactaaggctaacgtacttgggagtcggccat

SEQ ID NO: 438696 - DNA, 140 bp, Artificial Sequence
  Synthetic
atggccgactcccaagtacgttagccttagtggtgacacagtaataggttcccgatgggaatattagagactccctgccgctgtagataacagcactgatattagaaccagcccaggagaggagacccagcatggcgtat

SEQ ID NO: 438697 - DNA, 140 bp, Artificial Sequence
  Synthetic
atacgccatgctgggtctccttttggttatttacccacattcccatgttgggtttggttagaatttacaacttattagcatgcctttggcttttacgtaagttctatcaacacgttattacgtacttgggagtcggccat

SEQ ID NO: 438698 - DNA, 140 bp, Artificial Sequence
  Synthetic
atggccgactcccaagtacgtaataacgtgttgatagaacttacgtaaaagccaaaggcatgctaataagttgtaaattctaaccaaacccaacatgggaatgtgggtaaataaccaaaaggagacccagcatggcgtat

SEQ ID NO: 438699 - DNA, 140 bp, Artificial Sequence
  Synthetic
atacgccatgctgggtctcctgatttaggtattcctgttgttgagtacctatctaaggatgatctacatgcactttatgtagatcctaagtatcaagtcattgtcttaaaggataatgtacgtacttgggagtcggccat

SEQ ID NO: 438700 - DNA, 140 bp, Artificial Sequence
  Synthetic
atggccgactcccaagtacgtacattatcctttaagacaatgacttgatacttaggatctacataaagtgcatgtagatcatccttagataggtactcaacaacaggaatacctaaatcaggagacccagcatggcgtat

SEQ ID NO: 438701 - DNA, 140 bp, Artificial Sequence
  Synthetic
aggccctggctgctgatatgataatggtcgtccgactggtacattcactgttgtaatgcgccctaactacacaattaagggttcctttctgtgtggttcttgtggtagtgttggttacacgaccttttgggacagcggtg

SEQ ID NO: 438702 - DNA, 140 bp, Artificial Sequence
  Synthetic
caccgctgtcccaaaaggtcgtgtaaccaacactaccacaagaaccacacagaaaggaacccttaattgtgtagttagggcgcattacaacagtgaatgtaccagtcggacgaccattatcatatcagcagccagggcct

SEQ ID NO: 438703 - DNA, 140 bp, Artificial Sequence
  Synthetic
atacgccatgctgggtctcccattgcagctaatggcggtatctcattctgtcgtagacataattggaattgtgttgattgcgacaccgcaggtgtagggaataccttcatctgtgaagaacgtacttgggagtcggccat

SEQ ID NO: 438704 - DNA, 140 bp, Artificial Sequence
  Synthetic
atggccgactcccaagtacgttcttcacagatgaaggtattccctacacctgcggtgtcgcaatcaacacaattccaattatgtctacgacagaatgagataccgccattagctgcaatgggagacccagcatggcgtat

SEQ ID NO: 438705 - DNA, 140 bp, Artificial Sequence
  Synthetic
aggccctggctgctgatatgttaacaatgattgagtttatgttatggtgtaaggatggacaggttcaaaccttctaccctcgactccaggcttctgcagattggaaacctggtcatgcaagaccttttgggacagcggtg

SEQ ID NO: 438706 - DNA, 140 bp, Artificial Sequence
  Synthetic
caccgctgtcccaaaaggtcttgcatgaccaggtttccaatctgcagaagcctggagtcgagggtagaaggtttgaacctgtccatccttacaccataacataaactcaatcattgttaacatatcagcagccagggcct

SEQ ID NO: 438707 - DNA, 140 bp, Artificial Sequence
  Synthetic
atacgccatgctgggtctccgttgcaagtgacctcactacctctctacgcaggcctgtaaaccctacagataagtcacattattatgtggattctgttgaggttaaagaaactgtagtaccgtacttgggagtcggccat

SEQ ID NO: 438708 - DNA, 140 bp, Artificial Sequence
  Synthetic
atggccgactcccaagtacggtactacagtttctttaacctcaacagaatccacataataatgtgacttatctgtagggtttacaggcctgcgtagagaggtagtgaggtcacttgcaacggagacccagcatggcgtat

SEQ ID NO: 438709 - DNA, 140 bp, Artificial Sequence
  Synthetic
atacgccatgctgggtctccagtttaactatcgcagagacggccaaccatgctatgagcggtttcccctctgtgcttttactaatttagataagttgaagttcaaagaggtttgtaaaaccgtacttgggagtcggccat

SEQ ID NO: 438710 - DNA, 140 bp, Artificial Sequence
  Synthetic
atggccgactcccaagtacggttttacaaacctctttgaacttcaacttatctaaattagtaaaagcacagaggggaaaccgctcatagcatggttggccgtctctgcgatagttaaactggagacccagcatggcgtat

SEQ ID NO: 438711 - DNA, 140 bp, Artificial Sequence
  Synthetic
atacgccatgctgggtctcctaccactggtgtacctgaatacaactttatcatctatgactcatcagaccgtggccaggaaagtttagctaggtctgcatgtgtgtattattcccaagtacgtacttgggagtcggccat

SEQ ID NO: 438712 - DNA, 140 bp, Artificial Sequence
  Synthetic
atggccgactcccaagtacgtacttgggaataatacacacatgcagacctagctaaactttcctggccacggtctgatgagtcatagatgataaagttgtattcaggtacaccagtggtaggagacccagcatggcgtat

SEQ ID NO: 438713 - DNA, 140 bp, Artificial Sequence
  Synthetic
aggccctggctgctgatatggattgcaagtgaacagtgccccctgggaagagctctacagtgtgaaatgtaaataaaaatagctattattcaattagattaggctaattagatgatttgcgaccttttgggacagcggtg

SEQ ID NO: 438714 - DNA, 140 bp, Artificial Sequence
  Synthetic
caccgctgtcccaaaaggtcgcaaatcatctaattagcctaatctaattgaataatagctatttttatttacatttcacactgtagagctcttcccagggggcactgttcacttgcaatccatatcagcagccagggcct

SEQ ID NO: 438715 - DNA, 140 bp, Artificial Sequence
  Synthetic
atacgccatgctgggtctccttggccaaatcaatacttttggtcgattcaagcttggttacttctgttggcaacactagtgaaattgccatcaagatgtttgattcctttgttaatagttcgtacttgggagtcggccat

SEQ ID NO: 438716 - DNA, 140 bp, Artificial Sequence
  Synthetic
atggccgactcccaagtacgaactattaacaaaggaatcaaacatcttgatggcaatttcactagtgttgccaacagaagtaaccaagcttgaatcgaccaaaagtattgatttggccaaggagacccagcatggcgtat

SEQ ID NO: 438717 - DNA, 140 bp, Artificial Sequence
  Synthetic
atacgccatgctgggtctcctcgtctctttgtacaatgtcacacgtgataagttggagaaacttattaatactgctcgtgatggcgttagaagaggcgacaacttccatagtgtcttaaccgtacttgggagtcggccat

SEQ ID NO: 438718 - DNA, 140 bp, Artificial Sequence
  Synthetic
atggccgactcccaagtacggttaagacactatggaagttgtcgcctcttctaacgccatcacgagcagtattaataagtttctccaacttatcacgtgtgacattgtacaaagagacgaggagacccagcatggcgtat

SEQ ID NO: 438719 - DNA, 140 bp, Artificial Sequence
  Synthetic
aggccctggctgctgatatgatgttactgaatctgtgcaagaagaagcacaaccagtagaagtacctgttgaagatattgcgcaggttgtcatagctgacaccttacaggaaactcctgtgaccttttgggacagcggtg

SEQ ID NO: 438720 - DNA, 140 bp, Artificial Sequence
  Synthetic
caccgctgtcccaaaaggtcacaggagtttcctgtaaggtgtcagctatgacaacctgcgcaatatcttcaacaggtacttctactggttgtgcttcttcttgcacagattcagtaacatcatatcagcagccagggcct

SEQ ID NO: 438721 - DNA, 140 bp, Artificial Sequence
  Synthetic
aggccctggctgctgatatgtgattcctcacagggttcagaataccagtatgttatcttctgtcaaacaggtacttactcactttttgatttatccaagtttcaattaaaattaaaaggagaccttttgggacagcggtg

SEQ ID NO: 438722 - DNA, 140 bp, Artificial Sequence
  Synthetic
caccgctgtcccaaaaggtctccttttaattttaattgaaacttggataaatcaaaaagtgagtaagtacctgtttgacagaagataacatactggtattctgaaccctgtgaggaatcacatatcagcagccagggcct

SEQ ID NO: 438723 - DNA, 140 bp, Artificial Sequence
  Synthetic
atacgccatgctgggtctcccaacttactaatgagagctacaataattatgtgccctcatatgtcaaacctgatagtgtttctaccagtgatctaggtagtctcatagattgtaatgcggcgtacttgggagtcggccat

SEQ ID NO: 438724 - DNA, 140 bp, Artificial Sequence
  Synthetic
atggccgactcccaagtacgccgcattacaatctatgagactacctagatcactggtagaaacactatcaggtttgacatatgagggcacataattattgtagctctcattagtaagttgggagacccagcatggcgtat

SEQ ID NO: 438725 - DNA, 140 bp, Artificial Sequence
  Synthetic
aggccctggctgctgatatgaacctcagactatccagcccgaggtaaaagaagttgcacctgtctatgaggctgataccgaacagacacagagtgttactgttaaacctaagaggttacggaccttttgggacagcggtg

SEQ ID NO: 438726 - DNA, 140 bp, Artificial Sequence
  Synthetic
caccgctgtcccaaaaggtccgtaacctcttaggtttaacagtaacactctgtgtctgttcggtatcagcctcatagacaggtgcaacttcttttacctcgggctggatagtctgaggttcatatcagcagccagggcct

SEQ ID NO: 438727 - DNA, 140 bp, Artificial Sequence
  Synthetic
atacgccatgctgggtctcccttctgtaaaccaaactagcatgcgcaacgctaatggcgcatgcatttggaacgcttctgcatacatgaaactttcggatgctcttaaacgacagattcgcgtacttgggagtcggccat

SEQ ID NO: 438728 - DNA, 140 bp, Artificial Sequence
  Synthetic
atggccgactcccaagtacgcgaatctgtcgtttaagagcatccgaaagtttcatgtatgcagaagcgttccaaatgcatgcgccattagcgttgcgcatgctagtttggtttacagaagggagacccagcatggcgtat

SEQ ID NO: 438729 - DNA, 140 bp, Artificial Sequence
  Synthetic
atacgccatgctgggtctcctatagcatgccgtaagtgtaatttagctttccgtcttaccacctcaaagcttcgtgctaatgataatattttgtcagttagattcactgctactaagattcgtacttgggagtcggccat

SEQ ID NO: 438730 - DNA, 140 bp, Artificial Sequence
  Synthetic
atggccgactcccaagtacgaatcttagtagcagtgaatctaactgacaaaatattatcattagcacgaagctttgaggtggtaagacggaaagctaaattacacttacggcatgctataggagacccagcatggcgtat

SEQ ID NO: 438731 - DNA, 140 bp, Artificial Sequence
  Synthetic
atacgccatgctgggtctccgttggcggtgctcctacatggtataatacattgcgtgactttacgttgaagagttacgtctttgttaccattatagtcttactgtgtgctgtgttaatgtcgtacttgggagtcggccat

SEQ ID NO: 438732 - DNA, 140 bp, Artificial Sequence
  Synthetic
atggccgactcccaagtacgacattaacacagcacacagtaagactataatggtaacaaagacgtaactcttcaacgtaaagtcacgcaatgtattataccatgtaggagcaccgccaacggagacccagcatggcgtat

SEQ ID NO: 438733 - DNA, 140 bp, Artificial Sequence
  Synthetic
aggccctggctgctgatatggattctgttaagtctgcttgtattgaggttgatatacaacagactttctttgataaaacttggcctaggccaattgatgtttctaaggctgacggtattagaccttttgggacagcggtg

SEQ ID NO: 438734 - DNA, 140 bp, Artificial Sequence
  Synthetic
caccgctgtcccaaaaggtctaataccgtcagccttagaaacatcaattggcctaggccaagttttatcaaagaaagtctgttgtatatcaacctcaatacaagcagacttaacagaatccatatcagcagccagggcct

SEQ ID NO: 438735 - DNA, 140 bp, Artificial Sequence
  Synthetic
aggccctggctgctgatatgcggaactaattccggcgttgccatttaccatagatataaggcaggtaattacaggagtccgcctattacggcggatattgaacttgcattgcttcgagctgaccttttgggacagcggtg

SEQ ID NO: 438736 - DNA, 140 bp, Artificial Sequence
  Synthetic
caccgctgtcccaaaaggtcagctcgaagcaatgcaagttcaatatccgccgtaataggcggactcctgtaattacctgccttatatctatggtaaatggcaacgccggaattagttccgcatatcagcagccagggcct

SEQ ID NO: 438737 - DNA, 140 bp, Artificial Sequence
  Synthetic
atacgccatgctgggtctccccctgatgataagtgctttgctaataagtaccggtcttttactcaatggtatcatgagcatgttggtggtgtttacgataattctatcacatgtcccctgcgtacttgggagtcggccat

SEQ ID NO: 438738 - DNA, 140 bp, Artificial Sequence
  Synthetic
atggccgactcccaagtacgcaggggacatgtgatagaattatcgtaaacaccaccaacatgctcatgataccattgagtaaaagaccggtacttattagcaaagcacttatcatcagggggagacccagcatggcgtat

SEQ ID NO: 438739 - DNA, 140 bp, Artificial Sequence
  Synthetic
atacgccatgctgggtctccacagttgcagtaatagctggagtagcaggtgctagaattccagatgtacctactacattggcttgggtaaacaatcagataattttctttgtttctcgagcgtacttgggagtcggccat

SEQ ID NO: 438740 - DNA, 140 bp, Artificial Sequence
  Synthetic
atggccgactcccaagtacgctcgagaaacaaagaaaattatctgattgtttacccaagccaatgtagtaggtacatctggaattctagcacctgctactccagctattactgcaactgtggagacccagcatggcgtat

SEQ ID NO: 438741 - DNA, 140 bp, Artificial Sequence
  Synthetic
aggccctggctgctgatatgtaacccatttaattgatagctatgctttattaaagtgtgtagctgtagagagaatgttaaagactgtcacctctgcctgattgcaagtgaacagtgccccgaccttttgggacagcggtg

SEQ ID NO: 438742 - DNA, 140 bp, Artificial Sequence
  Synthetic
caccgctgtcccaaaaggtcggggcactgttcacttgcaatcaggcagaggtgacagtctttaacattctctctacagctacacactttaataaagcatagctatcaattaaatgggttacatatcagcagccagggcct

SEQ ID NO: 438743 - DNA, 140 bp, Artificial Sequence
  Synthetic
atacgccatgctgggtctcctctttgctaatactggtagtgtttgttacacgcctatagatgagataccttataaaggcttctctgatagtggttgcattctctcttctgagtgcacgatcgtacttgggagtcggccat

SEQ ID NO: 438744 - DNA, 140 bp, Artificial Sequence
  Synthetic
atggccgactcccaagtacgatcgtgcactcagaagagagaatgcaaccactatcagagaagcctttataaggtatctcatctataggcgtgtaacaaacactaccagtattagcaaagaggagacccagcatggcgtat

SEQ ID NO: 438745 - DNA, 140 bp, Artificial Sequence
  Synthetic
aggccctggctgctgatatgcaggatgggctttaaactcgatgcaacagttcctggatatcctaagcttttcattactcgtgaagaggctgtaaggcaagttcgaagctggataggcttcgaccttttgggacagcggtg

SEQ ID NO: 438746 - DNA, 140 bp, Artificial Sequence
  Synthetic
caccgctgtcccaaaaggtcgaagcctatccagcttcgaacttgccttacagcctcttcacgagtaatgaaaagcttaggatatccaggaactgttgcatcgagtttaaagcccatcctgcatatcagcagccagggcct

SEQ ID NO: 438747 - DNA, 140 bp, Artificial Sequence
  Synthetic
aggccctggctgctgatatgtcattactcgtgaagaggctgtaaggcaagttcgaagctggataggcttcgatgttgagggtgctcatgcttcccgtaatgcatgtggcaccaatgtgccgaccttttgggacagcggtg

SEQ ID NO: 438748 - DNA, 140 bp, Artificial Sequence
  Synthetic
caccgctgtcccaaaaggtcggcacattggtgccacatgcattacgggaagcatgagcaccctcaacatcgaagcctatccagcttcgaacttgccttacagcctcttcacgagtaatgacatatcagcagccagggcct

SEQ ID NO: 438749 - DNA, 140 bp, Artificial Sequence
  Synthetic
atacgccatgctgggtctccgacttgtatgatggtaacatgtttattaaatttcctgaagttgtatttgaaagtactcttaggattactaaaactctgactactcagtactgccggtttgcgtacttgggagtcggccat

SEQ ID NO: 438750 - DNA, 140 bp, Artificial Sequence
  Synthetic
atggccgactcccaagtacgcaaaccggcagtactgagtagtcagagttttagtaatcctaagagtactttcaaatacaacttcaggaaatttaataaacatgttaccatcatacaagtcggagacccagcatggcgtat

SEQ ID NO: 438751 - DNA, 140 bp, Artificial Sequence
  Synthetic
aggccctggctgctgatatgcttgattagccaagattccataactcattactcagctcttaagatggttcaaacacatcttagccactatgttcttaacatagattggttgtggtttgcagaccttttgggacagcggtg

SEQ ID NO: 438752 - DNA, 140 bp, Artificial Sequence
  Synthetic
caccgctgtcccaaaaggtctgcaaaccacaaccaatctatgttaagaacatagtggctaagatgtgtttgaaccatcttaagagctgagtaatgagttatggaatcttggctaatcaagcatatcagcagccagggcct

SEQ ID NO: 438753 - DNA, 140 bp, Artificial Sequence
  Synthetic
atacgccatgctgggtctccaggtatcatggcaaactgttttagttttgttaagatgctatttatgctaccactagcctattttagtgattcaaaacctagcactacagaagttaaagtacgtacttgggagtcggccat

SEQ ID NO: 438754 - DNA, 140 bp, Artificial Sequence
  Synthetic
atggccgactcccaagtacgtactttaacttctgtagtgctaggttttgaatcactaaaataggctagtggtagcataaatagcatcttaacaaaactaaaacagtttgccatgatacctggagacccagcatggcgtat

SEQ ID NO: 438755 - DNA, 140 bp, Artificial Sequence
  Synthetic
atacgccatgctgggtctccttcagattatgttgacattgtcaggcgtttagcaatttcgctgtttcaacctattacctacttccaattaactacttctttggttttgggtataggtttgcgtacttgggagtcggccat

SEQ ID NO: 438756 - DNA, 140 bp, Artificial Sequence
  Synthetic
atggccgactcccaagtacgcaaacctatacccaaaaccaaagaagtagttaattggaagtaggtaataggttgaaacagcgaaattgctaaacgcctgacaatgtcaacataatctgaaggagacccagcatggcgtat

SEQ ID NO: 438757 - DNA, 140 bp, Artificial Sequence
  Synthetic
atacgccatgctgggtctcctgtgcgtttctgactttgctcttctattatattaataaagtaaaacgtgcatttgcggactatactcagtgtgccgtgattgccgtatgtgctgccattccgtacttgggagtcggccat

SEQ ID NO: 438758 - DNA, 140 bp, Artificial Sequence
  Synthetic
atggccgactcccaagtacggaatggcagcacatacggcaatcacggcacactgagtatagtccgcaaatgcacgttttactttattaatataatagaagagcaaagtcagaaacgcacaggagacccagcatggcgtat

SEQ ID NO: 438759 - DNA, 140 bp, Artificial Sequence
  Synthetic
aggccctggctgctgatatgctggtttagtcggtgtgctcacactagacaaccaggaccttaatggcaagtggtatgattttggtgacttcgtaatcactcaacctggttcaggagtagcgaccttttgggacagcggtg

SEQ ID NO: 438760 - DNA, 140 bp, Artificial Sequence
  Synthetic
caccgctgtcccaaaaggtcgctactcctgaaccaggttgagtgattacgaagtcaccaaaatcataccacttgccattaaggtcctggttgtctagtgtgagcacaccgactaaaccagcatatcagcagccagggcct

SEQ ID NO: 438761 - DNA, 140 bp, Artificial Sequence
  Synthetic
atacgccatgctgggtctccttaatagtttatgcatttgctttgttgcttctatacccctttgtatagttccatacactgcattgtactactatgctacattttattttaccaatgaacccgtacttgggagtcggccat

SEQ ID NO: 438762 - DNA, 140 bp, Artificial Sequence
  Synthetic
atggccgactcccaagtacgggttcattggtaaaataaaatgtagcatagtagtacaatgcagtgtatggaactatacaaaggggtatagaagcaacaaagcaaatgcataaactattaaggagacccagcatggcgtat

SEQ ID NO: 438763 - DNA, 140 bp, Artificial Sequence
  Synthetic
atacgccatgctgggtctccgcactcatatagtgtcttttgttattaatgcccctaatggcctttatttcatgcatgttggttatcatcctagccaacatattgaggttgtagctgcttacgtacttgggagtcggccat

SEQ ID NO: 438764 - DNA, 140 bp, Artificial Sequence
  Synthetic
atggccgactcccaagtacgtaagcagctacaacctcaatatgttggctaggatgataaccaacatgcatgaaataaaggccattaggggcattaataacaaaagacactatatgagtgcggagacccagcatggcgtat

SEQ ID NO: 438765 - DNA, 140 bp, Artificial Sequence
  Synthetic
atacgccatgctgggtctccagcatttattatgcatgtctcttggtacattatgtttggtcccattgttcctatttggatgacctgtgtctatacagttgcaatgtgttttagacatttccgtacttgggagtcggccat

SEQ ID NO: 438766 - DNA, 140 bp, Artificial Sequence
  Synthetic
atggccgactcccaagtacggaaatgtctaaaacacattgcaactgtatagacacaggtcatccaaataggaacaatgggaccaaacataatgtaccaagagacatgcataataaatgctggagacccagcatggcgtat

SEQ ID NO: 438767 - DNA, 140 bp, Artificial Sequence
  Synthetic
atacgccatgctgggtctccatgcttagggcttgtattaaaactgcccaagctgatacagctggtctttatacaaattttcgaattgacgtcccatctaactggtactcaatcagtttctcgtacttgggagtcggccat

SEQ ID NO: 438768 - DNA, 140 bp, Artificial Sequence
  Synthetic
atggccgactcccaagtacgagaaactgattgagtaccagttagatgggacgtcaattcgaaaatttgtataaagaccagctgtatcagcttgggcagttttaatacaagccctaagcatggagacccagcatggcgtat

SEQ ID NO: 438769 - DNA, 140 bp, Artificial Sequence
  Synthetic
atacgccatgctgggtctccttctgggttttggcctatttcagtaaaaagcatgtagaagtttttactgacggtaagcttaattgtagtttccaggatgcagcttctaatatctttgtcgcgtacttgggagtcggccat

SEQ ID NO: 438770 - DNA, 140 bp, Artificial Sequence
  Synthetic
atggccgactcccaagtacgcgacaaagatattagaagctgcatcctggaaactacaattaagcttaccgtcagtaaaaacttctacatgctttttactgaaataggccaaaacccagaaggagacccagcatggcgtat

SEQ ID NO: 438771 - DNA, 140 bp, Artificial Sequence
  Synthetic
atacgccatgctgggtctccagtgctttaaaaacagcgggtattgtaacaggtaatgttgtaaaacaatgctgcattgctgctgttgatcttagtatggataagttgcgtcctgtggattcgtacttgggagtcggccat

SEQ ID NO: 438772 - DNA, 140 bp, Artificial Sequence
  Synthetic
atggccgactcccaagtacgaatccacaggacgcaacttatccatactaagatcaacagcagcaatgcagcattgttttacaacattacctgttacaatacccgctgtttttaaagcactggagacccagcatggcgtat

SEQ ID NO: 438773 - DNA, 140 bp, Artificial Sequence
  Synthetic
atacgccatgctgggtctcctatggaaacagccgcgtatcgtgaagctgcagcatgtcatcttgctagagccttacaaacttacagtgaaactggtagtgacttgctttaccagccacctcgtacttgggagtcggccat

SEQ ID NO: 438774 - DNA, 140 bp, Artificial Sequence
  Synthetic
atggccgactcccaagtacgaggtggctggtaaagcaagtcactaccagtttcactgtaagtttgtaaggctctagcaagatgacatgctgcagcttcacgatacgcggctgtttccataggagacccagcatggcgtat

SEQ ID NO: 438775 - DNA, 140 bp, Artificial Sequence
  Synthetic
aggccctggctgctgatatgtctagtcttagaacctttgttgtagataagtctttgtcaattgaggagtttgctgtcgtagtaaaggaacaagtcgtgtgcaatattvttgctacacgtcgaccttttgggacagcggtg

SEQ ID NO: 438776 - DNA, 140 bp, Artificial Sequence
  Synthetic
caccgctgtcccaaaaggtcgacgtgtagcaavaatattgcacacgacttgttcctttactacgacagcaaactcctcaattgacaaagacttatctacaacaaaggttctaagactagacatatcagcagccagggcct

SEQ ID NO: 438777 - DNA, 140 bp, Artificial Sequence
  Synthetic
atacgccatgctgggtctccaattgtagcattacttctggtgtgttacagagtggtttggtaaaaatgtcacatcctagtggtgatgttgaggcttgtatggttcaggttacctgtggtacgtacttgggagtcggccat

SEQ ID NO: 438778 - DNA, 140 bp, Artificial Sequence
  Synthetic
atggccgactcccaagtacgtaccacaggtaacctgaaccatacaagcctcaacatcaccactaggatgtgacatttttaccaaaccactctgtaacacaccagaagtaatgctacaattggagacccagcatggcgtat

SEQ ID NO: 438779 - DNA, 140 bp, Artificial Sequence
  Synthetic
aggccctggctgctgatatgtgtctaatatgacgcaactcactgaggcgcagattattgccattattaaagactggaactttgcatccattgatctagcttcccagataatctctggcatgaccttttgggacagcggtg

SEQ ID NO: 438780 - DNA, 140 bp, Artificial Sequence
  Synthetic
caccgctgtcccaaaaggtcatgccagagattatctgggaagctagatcaatggatgcaaagttccagtctttaataatggcaataatctgcgcctcagtgagttgcgtcatattagacacatatcagcagccagggcct

SEQ ID NO: 438781 - DNA, 140 bp, Artificial Sequence
  Synthetic
atacgccatgctgggtctccgcatgactcttaatgggctgtggcttgataatactgtctggtgtccaagacatgttatgtgcccagcagatcagttgtctgatcctaactatgatgccttcgtacttgggagtcggccat

SEQ ID NO: 438782 - DNA, 140 bp, Artificial Sequence
  Synthetic
atggccgactcccaagtacgaaggcatcatagttaggatcagacaactgatctgctgggcacataacatgtcttggacaccagacagtattatcaagccacagcccattaagagtcatgcggagacccagcatggcgtat

SEQ ID NO: 438783 - DNA, 140 bp, Artificial Sequence
  Synthetic
atacgccatgctgggtctccgcttgtttctatgactaaccatagttttagtgtacaaaagcatgttggtgctcctgccaacttgcgtgttgttggtcactctatgcaaggcactcttttgcgtacttgggagtcggccat

SEQ ID NO: 438784 - DNA, 140 bp, Artificial Sequence
  Synthetic
atggccgactcccaagtacgcaaaagagtgccttgcatagagtgaccaacaacacgcaagttggcaggagcaccaacatgcttttgtacactaaaactatggttagtcatagaaacaagcggagacccagcatggcgtat

SEQ ID NO: 438785 - DNA, 140 bp, Artificial Sequence
  Synthetic
aggccctggctgctgatatgtgcaagtgaacagtgccccccgggaagagctctacagtgtgaaatgtaaataaaaatagctattattcaattagattaggctaattagatgatttgcaaagaccttttgggacagcggtg

SEQ ID NO: 438786 - DNA, 140 bp, Artificial Sequence
  Synthetic
caccgctgtcccaaaaggtctttgcaaatcatctaattagcctaatctaattgaataatagctatttttatttacatttcacactgtagagctcttcccggggggcactgttcacttgcacatatcagcagccagggcct

SEQ ID NO: 438787 - DNA, 140 bp, Artificial Sequence
  Synthetic
atacgccatgctgggtctccaagttgactgtcgatgtagctaaccctagcactccagcctacacttttactacagtgaaacctggtgcatcatttagtgtgcttgcatgctataatggtccgtacttgggagtcggccat

SEQ ID NO: 438788 - DNA, 140 bp, Artificial Sequence
  Synthetic
atggccgactcccaagtacggaccattatagcatgcaagcacactaaatgatgcaccaggtttcactgtagtaaaagtgtaggctggagtgctagggttagctacatcgacagtcaacttggagacccagcatggcgtat

SEQ ID NO: 438789 - DNA, 140 bp, Artificial Sequence
  Synthetic
aggccctggctgctgatatgggtgggtctgttgctattaaaataacagaacactcttggagcgttgaactttatgaacttatgggaaaatttgcttggtggactgttttctgcaccaaaagaccttttgggacagcggtg

SEQ ID NO: 438790 - DNA, 140 bp, Artificial Sequence
  Synthetic
caccgctgtcccaaaaggtcttttggtgcagaaaacagtccaccaagcaaattttcccataagttcataaagttcaacgctccaagagtgttctgttattttaatagcaacagacccacccatatcagcagccagggcct

SEQ ID NO: 438791 - DNA, 140 bp, Artificial Sequence
  Synthetic
atacgccatgctgggtctccgtcctactggtacttttactgttataatgcgccctaactacacaattaagggttcctttttgtgtggttcttgcggtagtgttggttacactaaagaaggcgtacttgggagtcggccat

SEQ ID NO: 438792 - DNA, 140 bp, Artificial Sequence
  Synthetic
atggccgactcccaagtacgccttctttagtgtaaccaacactaccgcaagaaccacacaaaaaggaacccttaattgtgtagttagggcgcattataacagtaaaagtaccagtaggacggagacccagcatggcgtat

SEQ ID NO: 438793 - DNA, 140 bp, Artificial Sequence
  Synthetic
atacgccatgctgggtctcctaatgtgattaacttttgttatatgcatcaaatggagcttgctaatggtactcatacaggctcagcatttgacggtactatgtatggtgcctttatggaccgtacttgggagtcggccat

SEQ ID NO: 438794 - DNA, 140 bp, Artificial Sequence
  Synthetic
atggccgactcccaagtacggtccataaaggcaccatacatagtaccgtcaaatgctgagcctgtatgagtaccattagcaagctccatttgatgcatataacaaaagttaatcacattaggagacccagcatggcgtat

SEQ ID NO: 438795 - DNA, 140 bp, Artificial Sequence
  Synthetic
atacgccatgctgggtctccaaacaagtgcaccagattcagttaacagacaaatactgcagtgttaatgtagtagcttggctttatgcagcaatacttaatggttgtgcttggtttgttacgtacttgggagtcggccat

SEQ ID NO: 438796 - DNA, 140 bp, Artificial Sequence
  Synthetic
atggccgactcccaagtacgtaacaaaccaagcacaaccattaagtattgctgcataaagccaagctactacattaacactgcagtatttgtctgttaactgaatctggtgcacttgtttggagacccagcatggcgtat

SEQ ID NO: 438797 - DNA, 140 bp, Artificial Sequence
  Synthetic
atacgccatgctgggtctccaacccaatcgcactagtgttgtctcttttaatgagtgggctattgccaatcaattcactgaatttgttggcactcagtccattgatatgttagctgttaacgtacttgggagtcggccat

SEQ ID NO: 438798 - DNA, 140 bp, Artificial Sequence
  Synthetic
atggccgactcccaagtacgttaacagctaacatatcaatggactgagtgccaacaaattcagtgaattgattggcaatagcccactcattaaaagagacaacactagtgcgattgggttggagacccagcatggcgtat

SEQ ID NO: 438799 - DNA, 140 bp, Artificial Sequence
  Synthetic
atacgccatgctgggtctccgacaggtgttgctattgaacagcttctttatgcgatccaacaattgtatacgggtttccaaggaaagcaaattcttggcagtactatgttggaagatgagcgtacttgggagtcggccat

SEQ ID NO: 438800 - DNA, 140 bp, Artificial Sequence
  Synthetic
atggccgactcccaagtacgctcatcttccaacatagtactgccaagaatttgctttccttggaaacccgtatacaattgttggatcgcataaagaagctgttcaatagcaacacctgtcggagacccagcatggcgtat

SEQ ID NO: 438801 - DNA, 140 bp, Artificial Sequence
  Synthetic
aggccctggctgctgatatggcttggctatctcacttcccctcgttctcttgcagaactttgattttaacgaacttaaataaaagccctgttgtttagcgtattgttgcacttgtctggtgaccttttgggacagcggtg

SEQ ID NO: 438802 - DNA, 140 bp, Artificial Sequence
  Synthetic
caccgctgtcccaaaaggtcaccagacaagtgcaacaatacgctaaacaacagggcttttatttaagttcgttaaaatcaaagttctgcaagagaacgaggggaagtgagatagccaagccatatcagcagccagggcct

SEQ ID NO: 438803 - DNA, 140 bp, Artificial Sequence
  Synthetic
atacgccatgctgggtctcctttacacctgaagatgttaatatgcagattatgggtgtaattatgcagagtggagctagaaaagtcacatatggtatggtgcattggttgtttgctactccgtacttgggagtcggccat

SEQ ID NO: 438804 - DNA, 140 bp, Artificial Sequence
  Synthetic
atggccgactcccaagtacggagtagcaaacaaccaatgcaccataccatatgtgacttttctagctccactctgcataattacacccataatctgcatattaacatcttcaggtgtaaaggagacccagcatggcgtat

SEQ ID NO: 438805 - DNA, 140 bp, Artificial Sequence
  Synthetic
aggccctggctgctgatatgaccaaaacatttctactaacctccctcctcctcttctcggcaattccattgggattgacttccaagatgagttggatgagtttttcaaaaatgttagcacgaccttttgggacagcggtg

SEQ ID NO: 438806 - DNA, 140 bp, Artificial Sequence
  Synthetic
caccgctgtcccaaaaggtcgtgctaacatttttgaaaaactcatccaactcatcttggaagtcaatcccaatggaattgccgagaagaggaggagggaggttagtagaaatgttttggtcatatcagcagccagggcct

SEQ ID NO: 438807 - DNA, 140 bp, Artificial Sequence
  Synthetic
atacgccatgctgggtctcctgttatgttcgaagatgcccagggattgaaaaagttctacaaagatgttagagcttacctaggtgtttcttcttcttgtgatggtcttgctgcggcttatcgtacttgggagtcggccat

SEQ ID NO: 438808 - DNA, 140 bp, Artificial Sequence
  Synthetic
atggccgactcccaagtacgataagccgcagcaagaccatcacaagaagaagaaacacctaggtaagctctaacatctttgtagaactttttcaatccctgggcatcttcgaacataacaggagacccagcatggcgtat

SEQ ID NO: 438809 - DNA, 140 bp, Artificial Sequence
  Synthetic
atacgccatgctgggtctccgactatggcttgtgttatgttgttggtgaagcataaacacacctttttgacattatttttgttgcccgtagcaatttgtttgacttatgcaaacattgtacgtacttgggagtcggccat

SEQ ID NO: 438810 - DNA, 140 bp, Artificial Sequence
  Synthetic
atggccgactcccaagtacgtacaatgtttgcataagtcaaacaaattgctacgggcaacaaaaataatgtcaaaaaggtgtgtttatgcttcaccaacaacataacacaagccatagtcggagacccagcatggcgtat

SEQ ID NO: 438811 - DNA, 140 bp, Artificial Sequence
  Synthetic
atacgccatgctgggtctcctacgagccttctactcccatttcttcagcattgattgctgtagctaattggttagctcctactaatgtttatatgcgcaccacacatgctgatattggtacgtacttgggagtcggccat

SEQ ID NO: 438812 - DNA, 140 bp, Artificial Sequence
  Synthetic
atggccgactcccaagtacgtaccaatatcagcatgtgtggtgcgcatataaacattagtaggagctaaccaattagctacagcaatcaatgctgaagaaatgggagtagaaggctcgtaggagacccagcatggcgtat

SEQ ID NO: 438813 - DNA, 140 bp, Artificial Sequence
  Synthetic
aggccctggctgctgatatgattgtattctagagcctcgctctggaaattattgtcctgctggcaattcctatacttcttttgccacttatcacactcctgcaacagattgttctgatgggaccttttgggacagcggtg

SEQ ID NO: 438814 - DNA, 140 bp, Artificial Sequence
  Synthetic
caccgctgtcccaaaaggtcccatcagaacaatctgttgcaggagtgtgataagtggcaaaagaagtataggaattgccagcaggacaataatttccagagcgaggctctagaatacaatcatatcagcagccagggcct

SEQ ID NO: 438815 - DNA, 140 bp, Artificial Sequence
  Synthetic
atacgccatgctgggtctcctgtacgttagtatgtcacttgtattagctatagtggtgaaaagattgtataacccttcgctatctaactttgctttggcattgtgtagcggtgtaatgtgcgtacttgggagtcggccat

SEQ ID NO: 438816 - DNA, 140 bp, Artificial Sequence
  Synthetic
atggccgactcccaagtacgcacattacaccgctacacaatgccaaagcaaagttagatagcgaagggttatacaatcttttcaccactatagctaatacaagtgacatactaacgtacaggagacccagcatggcgtat

SEQ ID NO: 438817 - DNA, 140 bp, Artificial Sequence
  Synthetic
atacgccatgctgggtctccaagtttcaacatggttcaggcgtttggacgtcggggaccaggcgacctccagggaaactttggtgacctacagttgaacaagctcggcacagaagaccctcgtacttgggagtcggccat

SEQ ID NO: 438818 - DNA, 140 bp, Artificial Sequence
  Synthetic
atggccgactcccaagtacgagggtcttctgtgccgagcttgttcaactgtaggtcaccaaagtttccctggaggtcgcctggtccccgacgtccaaacgcctgaaccatgttgaaacttggagacccagcatggcgtat

SEQ ID NO: 438819 - DNA, 140 bp, Artificial Sequence
  Synthetic
atacgccatgctgggtctccgttgtatacttatagcattggagagacttctagccccattgcctaccttgtctttgttactacacttactagtgattatacggttacagtatttgttactcgtacttgggagtcggccat

SEQ ID NO: 438820 - DNA, 140 bp, Artificial Sequence
  Synthetic
atggccgactcccaagtacgagtaacaaatactgtaaccgtataatcactagtaagtgtagtaacaaagacaaggtaggcaatggggctagaagtctctccaatgctataagtatacaacggagacccagcatggcgtat

SEQ ID NO: 438821 - DNA, 140 bp, Artificial Sequence
  Synthetic
aggccctggctgctgatatgaacagtgccccctgggaagagctctacagtgtgaaatgtaaataaaaatagctattattcaattagattaggctaattagatgatttgcaaaaaaaaaaagaccttttgggacagcggtg

SEQ ID NO: 438822 - DNA, 140 bp, Artificial Sequence
  Synthetic
caccgctgtcccaaaaggtctttttttttttgcaaatcatctaattagcctaatctaattgaataatagctatttttatttacatttcacactgtagagctcttcccagggggcactgttcatatcagcagccagggcct

SEQ ID NO: 438823 - DNA, 140 bp, Artificial Sequence
  Synthetic
aggccctggctgctgatatgtcgttacgacttgtatgatggtaacatgtttattaaatttcctgaagtagtatttgaaagtacacttaggattactagaactctgtcaactcagtactgcgaccttttgggacagcggtg

SEQ ID NO: 438824 - DNA, 140 bp, Artificial Sequence
  Synthetic
caccgctgtcccaaaaggtcgcagtactgagttgacagagttctagtaatcctaagtgtactttcaaatactacttcaggaaatttaataaacatgttaccatcatacaagtcgtaacgacatatcagcagccagggcct

SEQ ID NO: 438825 - DNA, 140 bp, Artificial Sequence
  Synthetic
atacgccatgctgggtctccagggctaactcatttgatgtacctacattctgtgcaaaccgttctgctatgtgtaactggtgtttgataagccaggattctataacgcattatacagccccgtacttgggagtcggccat

SEQ ID NO: 438826 - DNA, 140 bp, Artificial Sequence
  Synthetic
atggccgactcccaagtacggggctgtataatgcgttatagaatcctggcttatcaaacaccagttacacatagcagaacggtttgcacagaatgtaggtacatcaaatgagttagccctggagacccagcatggcgtat

SEQ ID NO: 438827 - DNA, 140 bp, Artificial Sequence
  Synthetic
atacgccatgctgggtctccagagttcagattcatgactgctaacaatttaacagcacctaggaattcctgggaagccatgtctttgaactttaagttgctaggtattggtggtacacctcgtacttgggagtcggccat

SEQ ID NO: 438828 - DNA, 140 bp, Artificial Sequence
  Synthetic
atggccgactcccaagtacgaggtgtaccaccaatacctagcaacttaaagttcaaagacatggcttcccaggaattcctaggtgctgttaaattgttagcagtcatgaatctgaactctggagacccagcatggcgtat

SEQ ID NO: 438829 - DNA, 140 bp, Artificial Sequence
  Synthetic
atacgccatgctgggtctcctgtataaaagttgctgccatacagtcaaaacttactgacattaagtgcacatcagtggttcttctctcagtgcttcagcagttgcacttagaggctaatacgtacttgggagtcggccat

SEQ ID NO: 438830 - DNA, 140 bp, Artificial Sequence
  Synthetic
atggccgactcccaagtacgtattagcctctaagtgcaactgctgaagcactgagagaagaaccactgatgtgcacttaatgtcagtaagttttgactgtatggcagcaacttttatacaggagacccagcatggcgtat

SEQ ID NO: 438831 - DNA, 140 bp, Artificial Sequence
  Synthetic
aggccctggctgctgatatgatagctctagtgcaaatggcagcctggttggcacaactttgcagggcaagcctattggtatgttcttcccttatgacatcgaacttgtcacaggaaagcagaccttttgggacagcggtg

SEQ ID NO: 438832 - DNA, 140 bp, Artificial Sequence
  Synthetic
caccgctgtcccaaaaggtctgctttcctgtgacaagttcgatgtcataagggaagaacataccaataggcttgccctgcaaagttgtgccaaccaggctgccatttgcactagagctatcatatcagcagccagggcct

SEQ ID NO: 438833 - DNA, 140 bp, Artificial Sequence
  Synthetic
atacgccatgctgggtctccgcaaggcttgggctttctgtgtcaagtgccataatgacatattggcggctacagaccctagtgaggctttcgaaaagttcgtgagcctttttgccacattcgtacttgggagtcggccat

SEQ ID NO: 438834 - DNA, 140 bp, Artificial Sequence
  Synthetic
atggccgactcccaagtacgaatgtggcaaaaaggctcacgaacttttcgaaagcctcactagggtctgtagccgccaatatgtcattatggcacttgacacagaaagcccaagccttgcggagacccagcatggcgtat

SEQ ID NO: 438835 - DNA, 140 bp, Artificial Sequence
  Synthetic
aggccctggctgctgatatgactgtcacctctgcgtgattgcaagtgaacagtgccccccgggaagagctctacagtgtgaaatgtaaataaaaatagctattattcaattagattaggcgaccttttgggacagcggtg

SEQ ID NO: 438836 - DNA, 140 bp, Artificial Sequence
  Synthetic
caccgctgtcccaaaaggtcgcctaatctaattgaataatagctatttttatttacatttcacactgtagagctcttcccggggggcactgttcacttgcaatcacgcagaggtgacagtcatatcagcagccagggcct

SEQ ID NO: 438837 - DNA, 140 bp, Artificial Sequence
  Synthetic
atacgccatgctgggtctccaatgaccttttctggtaatgtagatcttgatgcgttggctagtgacatctttgacactcccagtgtgcttcaagctactctttctgaattttctcacttacgtacttgggagtcggccat

SEQ ID NO: 438838 - DNA, 140 bp, Artificial Sequence
  Synthetic
atggccgactcccaagtacgtaagtgagaaaattcagaaagagtagcttgaagcacactgggagtgtcaaagatgtcactagccaacgcatcaagatctacattaccagaaaaggtcattggagacccagcatggcgtat

SEQ ID NO: 438839 - DNA, 140 bp, Artificial Sequence
  Synthetic
aggccctggctgctgatatgacctgagcccatcacctcccttaatactaagtatgttgcaccacaggtgacataccaaaacatttctactaacctccctcctcctcttctcggcaattccgaccttttgggacagcggtg

SEQ ID NO: 438840 - DNA, 140 bp, Artificial Sequence
  Synthetic
caccgctgtcccaaaaggtcggaattgccgagaagaggaggagggaggttagtagaaatgttttggtatgtcacctgtggtgcaacatacttagtattaagggaggtgatgggctcaggtcatatcagcagccagggcct

SEQ ID NO: 438841 - DNA, 140 bp, Artificial Sequence
  Synthetic
atacgccatgctgggtctccgctacgtttgctgagttggaagctgcacagaaagcctatcaggaagccttagactctggtgatgcgtcacctcaagttcttaaggctttacagaaggctgcgtacttgggagtcggccat

SEQ ID NO: 438842 - DNA, 140 bp, Artificial Sequence
  Synthetic
atggccgactcccaagtacgcagccttctgtaaagccttaagaacttgaggtgacgcatcaccagagtctaaggcttcctgataggctttctgtgcagcttccaactcagcaaacgtagcggagacccagcatggcgtat

SEQ ID NO: 438843 - DNA, 140 bp, Artificial Sequence
  Synthetic
atacgccatgctgggtctcctcaagatgattcaaacacattttagccactatgttcttaacgtagattggttgtggtttgcactggaggctgttttagcatacatactttatacctcggccgtacttgggagtcggccat

SEQ ID NO: 438844 - DNA, 140 bp, Artificial Sequence
  Synthetic
atggccgactcccaagtacggccgaggtataaagtatgtatgctaaaacagcctccagtgcaaaccacaaccaatctacgttaagaacatagtggctaaaatgtgtttgaatcatcttgaggagacccagcatggcgtat

SEQ ID NO: 438845 - DNA, 140 bp, Artificial Sequence
  Synthetic
aggccctggctgctgatatgtcgatcttacctacgagatgttgtctcttcaacaagttgttaaagcccttaatgagtcttacatagaccttaaagagcttggcaattatacttattacaagaccttttgggacagcggtg

SEQ ID NO: 438846 - DNA, 140 bp, Artificial Sequence
  Synthetic
caccgctgtcccaaaaggtcttgtaataagtataattgccaagctctttaaggtctatgtaagactcattaagggctttaacaacttgttgaagagacaacatctcgtaggtaagatcgacatatcagcagccagggcct

SEQ ID NO: 438847 - DNA, 140 bp, Artificial Sequence
  Synthetic
atacgccatgctgggtctcctgctgaagacaagaaggcaaaaattgtcagtgctatgcaaactatgctttttggtatgattaagaaattagataatgatgttcttaatggtatcatttctcgtacttgggagtcggccat

SEQ ID NO: 438848 - DNA, 140 bp, Artificial Sequence
  Synthetic
atggccgactcccaagtacgagaaatgataccattaagaacatcattatctaatttcttaatcataccaaaaagcatagtttgcatagcactgacaatttttgccttcttgtcttcagcaggagacccagcatggcgtat

SEQ ID NO: 438849 - DNA, 140 bp, Artificial Sequence
  Synthetic
atacgccatgctgggtctccaacgctaggaatggttgtataccacttagtgttgttccactgtgtgcttcaaacaaattacgtgtagtaattccagattttacagtttggaaccaagttgcgtacttgggagtcggccat

SEQ ID NO: 438850 - DNA, 140 bp, Artificial Sequence
  Synthetic
atggccgactcccaagtacgcaacttggttccaaactgtaaaatctggaattactacacgtaatttgtttgaagcacacagtggaacaacactaagtggtatacaaccattcctagcgttggagacccagcatggcgtat

SEQ ID NO: 438851 - DNA, 140 bp, Artificial Sequence
  Synthetic
aggccctggctgctgatatgaacatgacatacaaattactaatgagagttacaataattatgtaccctcatatgttaaacctgatagtgtgcaagtttcaattaaaattaaaaggaacacgaccttttgggacagcggtg

SEQ ID NO: 438852 - DNA, 140 bp, Artificial Sequence
  Synthetic
caccgctgtcccaaaaggtcgtgttccttttaattttaattgaaacttgcacactatcaggtttaacatatgagggtacataattattgtaactctcattagtaatttgtatgtcatgttcatatcagcagccagggcct

SEQ ID NO: 438853 - DNA, 140 bp, Artificial Sequence
  Synthetic
atacgccatgctgggtctcctaacatatccctcgcttaattatgctggggctttgtgggacattacagttataaacaatgtggataatgagattgttaaatcttcagatgttgttgaaaccgtacttgggagtcggccat

SEQ ID NO: 438854 - DNA, 140 bp, Artificial Sequence
  Synthetic
atggccgactcccaagtacggtttcaacaacatctgaagatttaacaatctcattatccacattgtttataactgtaatgtcccacaaagccccagcataattaagcgagggatatgttaggagacccagcatggcgtat

SEQ ID NO: 438855 - DNA, 140 bp, Artificial Sequence
  Synthetic
atacgccatgctgggtctcctaatgaaagtttaacatggccacttgtcttagaatgcactagggctgctacctctgcagttaagttgcaaaataatgagatcaaaccttctggtcttaagcgtacttgggagtcggccat

SEQ ID NO: 438856 - DNA, 140 bp, Artificial Sequence
  Synthetic
atggccgactcccaagtacgcttaagaccagaaggtttgatctcattattttgcaacttaactgcagaggtagcagccctagtgcattctaagacaagtggccatgttaaactttcattaggagacccagcatggcgtat

SEQ ID NO: 438857 - DNA, 140 bp, Artificial Sequence
  Synthetic
aggccctggctgctgatatgcgtgattgcaagtgaacagtgccccccgggaagagctctacagtgtgaaatgtaaataaaaatagctattattcaattagattaggctaattagatgattgaccttttgggacagcggtg

SEQ ID NO: 438858 - DNA, 140 bp, Artificial Sequence
  Synthetic
caccgctgtcccaaaaggtcaatcatctaattagcctaatctaattgaataatagctatttttatttacatttcacactgtagagctcttcccggggggcactgttcacttgcaatcacgcatatcagcagccagggcct

SEQ ID NO: 438859 - DNA, 140 bp, Artificial Sequence
  Synthetic
atacgccatgctgggtctccactatggtagtgtctgcaggtcaagagcagactaattgtaatactagctctttagcttattacgaacctgttcagggccgtaaaatgctgatggcacttccgtacttgggagtcggccat

SEQ ID NO: 438860 - DNA, 140 bp, Artificial Sequence
  Synthetic
atggccgactcccaagtacggaagtgccatcagcattttacggccctgaacaggttcgtaataagctaaagagctagtattacaattagtctgctcttgacctgcagacactaccatagtggagacccagcatggcgtat

SEQ ID NO: 438861 - DNA, 140 bp, Artificial Sequence
  Synthetic
atacgccatgctgggtctccctttaactggttgttgctggcaggtacattgcagtatttctttgcacagacatccgtatttgtggattggcgttcatacaattatgttgtgtctggtgcacgtacttgggagtcggccat

SEQ ID NO: 438862 - DNA, 140 bp, Artificial Sequence
  Synthetic
atggccgactcccaagtacgtgcaccagacacaacataattgtatgaacgccaatccacaaatacggatgtctgtgcaaagaaatactgcaatgtacctgccagcaacaaccagttaaagggagacccagcatggcgtat

SEQ ID NO: 438863 - DNA, 140 bp, Artificial Sequence
  Synthetic
atacgccatgctgggtctcctaagggacctgagatccgatacctctattttgttaagaatcttaacaaccttcatcgcgggcaagtgcttggtcatattgctgcgactgttagattacagcgtacttgggagtcggccat

SEQ ID NO: 438864 - DNA, 140 bp, Artificial Sequence
  Synthetic
atggccgactcccaagtacgctgtaatctaacagtcgcagcaatatgaccaagcacttgcccgcgatgaaggttgttaagattcttaacaaaatagaggtatcggatctcaggtcccttaggagacccagcatggcgtat

SEQ ID NO: 438865 - DNA, 140 bp, Artificial Sequence
  Synthetic
aggccctggctgctgatatgatacaaattactaatgagagttacaataattatgtaccctcatatgttaaacctgatagtgtgtctaccagtgatttaggtagtctcattgattgtaatggaccttttgggacagcggtg

SEQ ID NO: 438866 - DNA, 140 bp, Artificial Sequence
  Synthetic
caccgctgtcccaaaaggtccattacaatcaatgagactacctaaatcactggtagacacactatcaggtttaacatatgagggtacataattattgtaactctcattagtaatttgtatcatatcagcagccagggcct

SEQ ID NO: 438867 - DNA, 140 bp, Artificial Sequence
  Synthetic
atacgccatgctgggtctccgccggttctaatactgagtttgcttctaattcttcggtgttgtcacttgtcaattttaccgtagaacctcaaaaagcttatctcgattttgttaatgctgcgtacttgggagtcggccat

SEQ ID NO: 438868 - DNA, 140 bp, Artificial Sequence
  Synthetic
atggccgactcccaagtacgcagcattaacaaaatcgagataagctttttgaggttctacggtaaaattgacaagtgacaacaccgaagaattagaagcaaactcagtattagaaccggcggagacccagcatggcgtat

SEQ ID NO: 438869 - DNA, 140 bp, Artificial Sequence
  Synthetic
aggccctggctgctgatatggtctcagattgtaactggcctttttaaagattgctctagagaaacttctggcctctcacctgcttatgcaccaacatacgttagtgttgatgacaagtatgaccttttgggacagcggtg

SEQ ID NO: 438870 - DNA, 140 bp, Artificial Sequence
  Synthetic
caccgctgtcccaaaaggtcatacttgtcatcaacactaacgtatgttggtgcataagcaggtgagaggccagaagtttctctagagcaatctttaaaaaggccagttacaatctgagaccatatcagcagccagggcct

SEQ ID NO: 438871 - DNA, 140 bp, Artificial Sequence
  Synthetic
atacgccatgctgggtctccctatggcggtgcatctgtttgtctctattgccgcgcgcatatagaacatcctgatgtttctggcgtttgtaaatataagggtaagtttgtccaaattccacgtacttgggagtcggccat

SEQ ID NO: 438872 - DNA, 140 bp, Artificial Sequence
  Synthetic
atggccgactcccaagtacgtggaatttggacaaacttacccttatatttacaaacgccagaaacatcaggatgttctatatgcgcgcggcaatagagacaaacagatgcaccgccatagggagacccagcatggcgtat

SEQ ID NO: 438873 - DNA, 140 bp, Artificial Sequence
  Synthetic
aggccctggctgctgatatgctgatgtttctggcgtttgtaaatataagggtaagtttgtccaaattccatctcagtgtactcgtgaccctgttggattttgtttgtcaaataccccctggaccttttgggacagcggtg

SEQ ID NO: 438874 - DNA, 140 bp, Artificial Sequence
  Synthetic
caccgctgtcccaaaaggtccagggggtatttgacaaacaaaatccaacagggtcacgagtacactgagatggaatttggacaaacttacccttatatttacaaacgccagaaacatcagcatatcagcagccagggcct

SEQ ID NO: 438875 - DNA, 140 bp, Artificial Sequence
  Synthetic
atacgccatgctgggtctccgttatacattttggcgctggttctgataaaggtatcgctcctggtacatcagttttacgacagtggcttcctacagatgccattattatagataatgattcgtacttgggagtcggccat

SEQ ID NO: 438876 - DNA, 140 bp, Artificial Sequence
  Synthetic
atggccgactcccaagtacgaatcattatctataataatggcatctgtaggaagccactgtcgtaaaactgatgtaccaggagcgatacctttatcagaaccagcgccaaaatgtataacggagacccagcatggcgtat

SEQ ID NO: 438877 - DNA, 140 bp, Artificial Sequence
  Synthetic
atacgccatgctgggtctcctgctgttgatcccactgaggctttcgagaaattcgtttgcctctttgccactcttatgaccttttcaggcaatgtagacttggatggtcttgctagtgatcgtacttgggagtcggccat

SEQ ID NO: 438878 - DNA, 140 bp, Artificial Sequence
  Synthetic
atggccgactcccaagtacgatcactagcaagaccatccaagtctacattgcctgaaaaggtcataagagtggcaaagaggcaaacgaatttctcgaaagcctcagtgggatcaacagcaggagacccagcatggcgtat

SEQ ID NO: 438879 - DNA, 140 bp, Artificial Sequence
  Synthetic
aggccctggctgctgatatgggttgatatacaacagaccttctttgataaaacttggcctaggccaattgatgtttctaaggctgacggtattatataccctcaaggccgtacatattctgaccttttgggacagcggtg

SEQ ID NO: 438880 - DNA, 140 bp, Artificial Sequence
  Synthetic
caccgctgtcccaaaaggtcagaatatgtacggccttgagggtatataataccgtcagccttagaaacatcaattggcctaggccaagttttatcaaagaaggtctgttgtatatcaacccatatcagcagccagggcct

SEQ ID NO: 438881 - DNA, 140 bp, Artificial Sequence
  Synthetic
atacgccatgctgggtctcctagatgatcaaggtcatcatttagactcctattttgtcgttaagcggcatacaatggagaattatgaattagagaaacactgttacgaattgttacgtgacgtacttgggagtcggccat

SEQ ID NO: 438882 - DNA, 140 bp, Artificial Sequence
  Synthetic
atggccgactcccaagtacgtcacgtaacaattcgtaacagtgtttctctaattcataattctccattgtatgccgcttaacgacaaaataggagtctaaatgatgaccttgatcatctaggagacccagcatggcgtat

SEQ ID NO: 438883 - DNA, 140 bp, Artificial Sequence
  Synthetic
aggccctggctgctgatatggagtctttgctaatacaggcagtgtttgctacactcctatagatgagataccctataagagtttctctgatagtggttgcattcttccatctgagtgcacgaccttttgggacagcggtg

SEQ ID NO: 438884 - DNA, 140 bp, Artificial Sequence
  Synthetic
caccgctgtcccaaaaggtcgtgcactcagatggaagaatgcaaccactatcagagaaactcttatagggtatctcatctataggagtgtagcaaacactgcctgtattagcaaagactccatatcagcagccagggcct

SEQ ID NO: 438885 - DNA, 140 bp, Artificial Sequence
  Synthetic
atacgccatgctgggtctccctgtgatgctgtagctcctcatgattttttcgtctttgacgtggataaaactaaaactccacatattgtgcgtcagcgtttaactgagtacactatgatgcgtacttgggagtcggccat

SEQ ID NO: 438886 - DNA, 140 bp, Artificial Sequence
  Synthetic
atggccgactcccaagtacgcatcatagtgtactcagttaaacgctgacgcacaatatgtggagttttagttttatccacgtcaaagacgaaaaaatcatgaggagctacagcatcacagggagacccagcatggcgtat

SEQ ID NO: 438887 - DNA, 140 bp, Artificial Sequence
  Synthetic
atacgccatgctgggtctccgatttagtttacgctttgagacattttgaccaaaataactgtgaggttctcaaggccatcctagttaagtatggttgttgtgatgctacatactttgaaacgtacttgggagtcggccat

SEQ ID NO: 438888 - DNA, 140 bp, Artificial Sequence
  Synthetic
atggccgactcccaagtacgtttcaaagtatgtagcatcacaacaaccatacttaactaggatggccttgagaacctcacagttattttggtcaaaatgtctcaaagcgtaaactaaatcggagacccagcatggcgtat

SEQ ID NO: 438889 - DNA, 140 bp, Artificial Sequence
  Synthetic
aggccctggctgctgatatgattccactcctatgaatctgagtacttactcactttttgatttatccaagtttcaattaaaattaaaaggaacaccagttcttcaattaaaggagagtcagaccttttgggacagcggtg

SEQ ID NO: 438890 - DNA, 140 bp, Artificial Sequence
  Synthetic
caccgctgtcccaaaaggtctgactctcctttaattgaagaactggtgttccttttaattttaattgaaacttggataaatcaaaaagtgagtaagtactcagattcataggagtggaatcatatcagcagccagggcct

SEQ ID NO: 438891 - DNA, 140 bp, Artificial Sequence
  Synthetic
atacgccatgctgggtctccataaactctggtttgattttgtagaaaatcccagtgttattggtgtttatcataaacttggagaacgtattcgacaggctgttttaaacactgttaaattcgtacttgggagtcggccat

SEQ ID NO: 438892 - DNA, 140 bp, Artificial Sequence
  Synthetic
atggccgactcccaagtacgaatttaacagtgtttaaaacagcctgtcgaatacgttctccaagtttatgataaacaccaataacactgggattttctacaaaatcaaaccagagtttatggagacccagcatggcgtat

SEQ ID NO: 438893 - DNA, 140 bp, Artificial Sequence
  Synthetic
atacgccatgctgggtctccacggttgtaaggacacggcatgccttctttgttataaaaggaatcgtcttaccagagttgaagcttctaccgttgtctgtggtggaaaacgtacgttttacgtacttgggagtcggccat

SEQ ID NO: 438894 - DNA, 140 bp, Artificial Sequence
  Synthetic
atggccgactcccaagtacgtaaaacgtacgttttccaccacagacaacggtagaagcttcaactctggtaagacgattccttttataacaaagaaggcatgccgtgtccttacaaccgtggagacccagcatggcgtat

SEQ ID NO: 438895 - DNA, 140 bp, Artificial Sequence
  Synthetic
atacgccatgctgggtctcccaacctggttcaggagtggctatagttgatagctactactcgtatttgatgcctgtgctttcaatgaccaactgtttggccgctgagacacacagggattcgtacttgggagtcggccat

SEQ ID NO: 438896 - DNA, 140 bp, Artificial Sequence
  Synthetic
atggccgactcccaagtacgaatccctgtgtgtctcagcggccaaacagttggtcattgaaagcacaggcatcaaatacgagtagtagctatcaactatagccactcctgaaccaggttgggagacccagcatggcgtat

SEQ ID NO: 438897 - DNA, 140 bp, Artificial Sequence
  Synthetic
atacgccatgctgggtctccgtgattttaataaaccacttatcgagtggccacttactgagtatgattttactgattataaggtacaactttttgaaaagtactttaagtattgggatcacgtacttgggagtcggccat

SEQ ID NO: 438898 - DNA, 140 bp, Artificial Sequence
  Synthetic
atggccgactcccaagtacgtgatcccaatacttaaagtacttttcaaaaagttgtaccttataatcagtaaaatcatactcagtaagtggccactcgataagtggtttattaaaatcacggagacccagcatggcgtat

SEQ ID NO: 438899 - DNA, 140 bp, Artificial Sequence
  Synthetic
atacgccatgctgggtctccgacgtatcacgctaattgcgttaattgtactgatgatcgttgtgtattacattgtgctaatttcaatgtattgtttgctatgactatgcctaagacttgtcgtacttgggagtcggccat

SEQ ID NO: 438900 - DNA, 140 bp, Artificial Sequence
  Synthetic
atggccgactcccaagtacgacaagtcttaggcatagtcatagcaaacaatacattgaaattagcacaatgtaatacacaacgatcatcagtacaattaacgcaattagcgtgatacgtcggagacccagcatggcgtat

SEQ ID NO: 438901 - DNA, 140 bp, Artificial Sequence
  Synthetic
atacgccatgctgggtctcccgctggcctcagattgctgaactcgctccctcagccagcgctttcatgggtatgtctcagtttaaactaacccaccaaagcaatgatgctgatggttccccgtacttgggagtcggccat

SEQ ID NO: 438902 - DNA, 140 bp, Artificial Sequence
  Synthetic
atggccgactcccaagtacggggaaccatcagcatcattgctttggtgggttagtttaaactgagacatacccatgaaagcgctggctgagggagcgagttcagcaatctgaggccagcgggagacccagcatggcgtat

SEQ ID NO: 438903 - DNA, 140 bp, Artificial Sequence
  Synthetic
atacgccatgctgggtctcctttggacccatagtccgaaaaatctttgtcgatggcgtgccatttgtagtgtcttgtggttatcactacaaagaattaggtttagtcatgaatatggatgcgtacttgggagtcggccat

SEQ ID NO: 438904 - DNA, 140 bp, Artificial Sequence
  Synthetic
atggccgactcccaagtacgcatccatattcatgactaaacctaattctttgtagtgataaccacaagacactacaaatggcacgccatcgacaaagatttttcggactatgggtccaaaggagacccagcatggcgtat

SEQ ID NO: 438905 - DNA, 140 bp, Artificial Sequence
  Synthetic
atacgccatgctgggtctccttagtctccatagacatcgactctcccttaaggaattaatgatgtatgctgctgatccagccatgcacattgcttcctctaatgcttttcttgatttgagcgtacttgggagtcggccat

SEQ ID NO: 438906 - DNA, 140 bp, Artificial Sequence
  Synthetic
atggccgactcccaagtacgctcaaatcaagaaaagcattagaggaagcaatgtgcatggctggatcagcagcatacatcattaattccttaagggagagtcgatgtctatggagactaaggagacccagcatggcgtat

SEQ ID NO: 438907 - DNA, 140 bp, Artificial Sequence
  Synthetic
aggccctggctgctgatatgcaacttaatagtagttattttaaattaagtatacccactaatttttcctttggtgtgactcaggagtacattcagacaaccattcagaaagttactgttggaccttttgggacagcggtg

SEQ ID NO: 438908 - DNA, 140 bp, Artificial Sequence
  Synthetic
caccgctgtcccaaaaggtccaacagtaactttctgaatggttgtctgaatgtactcctgagtcacaccaaaggaaaaattagtgggtatacttaatttaaaataactactattaagttgcatatcagcagccagggcct

SEQ ID NO: 438909 - DNA, 140 bp, Artificial Sequence
  Synthetic
atacgccatgctgggtctccgacatcatgttttagtgtcgctgcactaacaactggtttgacttttcaaactgtgcggcctggcaattttaaccaagatttctatgatttcgtggtctctcgtacttgggagtcggccat

SEQ ID NO: 438910 - DNA, 140 bp, Artificial Sequence
  Synthetic
atggccgactcccaagtacgagagaccacgaaatcatagaaatcttggttaaaattgccaggccgcacagtttgaaaagtcaaaccagttgttagtgcagcgacactaaaacatgatgtcggagacccagcatggcgtat

SEQ ID NO: 438911 - DNA, 140 bp, Artificial Sequence
  Synthetic
atacgccatgctgggtctccaaaggtttctttaaagagggctcttcagtgacgctcaaacattttttctttgcccaagatggcaatgctgctattacagattataattattattcttatacgtacttgggagtcggccat

SEQ ID NO: 438912 - DNA, 140 bp, Artificial Sequence
  Synthetic
atggccgactcccaagtacgtataagaataataattataatctgtaatagcagcattgccatcttgggcaaagaaaaaatgtttgagcgtcactgaagagccctctttaaagaaacctttggagacccagcatggcgtat

SEQ ID NO: 438913 - DNA, 140 bp, Artificial Sequence
  Synthetic
aggccctggctgctgatatggagattttagagtggtttggcattacacaaactgctcaaggtgttcacctcttctcatctcggtatgttgatttgtacggcggcaatatgtttcaatttggaccttttgggacagcggtg

SEQ ID NO: 438914 - DNA, 140 bp, Artificial Sequence
  Synthetic
caccgctgtcccaaaaggtccaaattgaaacatattgccgccgtacaaatcaacataccgagatgagaagaggtgaacaccttgagcagtttgtgtaatgccaaaccactctaaaatctccatatcagcagccagggcct

SEQ ID NO: 438915 - DNA, 140 bp, Artificial Sequence
  Synthetic
atacgccatgctgggtctccatctgcctaccatgtgtgacattaagcaaatgttattttgcatggaggttgtaaacaagtacttcgagatttatgacggtggttgtcttaatgcctccgacgtacttgggagtcggccat

SEQ ID NO: 438916 - DNA, 140 bp, Artificial Sequence
  Synthetic
atggccgactcccaagtacgtcggaggcattaagacaaccaccgtcataaatctcgaagtacttgtttacaacctccatgcaaaataacatttgcttaatgtcacacatggtaggcagatggagacccagcatggcgtat

SEQ ID NO: 438917 - DNA, 140 bp, Artificial Sequence
  Synthetic
atacgccatgctgggtctcccaccgtatactacttgtttgtatatccctaaacccacagctaagtatacacctttagttggcacttcattgcaccctgtgctgtggaactgtcagctatccgtacttgggagtcggccat

SEQ ID NO: 438918 - DNA, 140 bp, Artificial Sequence
  Synthetic
atggccgactcccaagtacggatagctgacagttccacagcacagggtgcaatgaagtgccaactaaaggtgtatacttagctgtgggtttagggatatacaaacaagtagtatacggtgggagacccagcatggcgtat

SEQ ID NO: 438919 - DNA, 140 bp, Artificial Sequence
  Synthetic
  misc_feature (75)..(75): n is a, c, g, or t
  misc_feature (84)..(84): n is a, c, g, or t
  misc_feature (97)..(97): n is a, c, g, or t
atacgccatgctgggtctccgaactctttgctatgacaaagcgtaacgtcattcctaccatgactcaaatgaatntaaaatatnctattagtgctangaatagggctcgcaccgttgccgcgtacttgggagtcggccat

SEQ ID NO: 438920 - DNA, 140 bp, Artificial Sequence
  Synthetic
  misc_feature (44)..(44): n is a, c, g, or t
  misc_feature (57)..(57): n is a, c, g, or t
  misc_feature (66)..(66): n is a, c, g, or t
atggccgactcccaagtacgcggcaacggtgcgagccctattcntagcactaatagnatattttanattcatttgagtcatggtaggaatgacgttacgctttgtcatagcaaagagttcggagacccagcatggcgtat

SEQ ID NO: 438921 - DNA, 140 bp, Artificial Sequence
  Synthetic
atacgccatgctgggtctccgtgtatctatacttagcacaatgactaatcgtcagtaccatcagaaaatgcttaagtcaatggctgcaactcgtggagcgacttgcgtcattggtactaccgtacttgggagtcggccat

SEQ ID NO: 438922 - DNA, 140 bp, Artificial Sequence
  Synthetic
atggccgactcccaagtacggtagtaccaatgacgcaagtcgctccacgagttgcagccattgacttaagcattttctgatggtactgacgattagtcattgtgctaagtatagatacacggagacccagcatggcgtat

SEQ ID NO: 438923 - DNA, 140 bp, Artificial Sequence
  Synthetic
atacgccatgctgggtctccaaagttctatggtggctgggattttatgcttaaaacattgtacaaagatgttgataacccacatcttatgggttgggattaccctaagtgtgatagagctcgtacttgggagtcggccat

SEQ ID NO: 438924 - DNA, 140 bp, Artificial Sequence
  Synthetic
atggccgactcccaagtacgagctctatcacacttagggtaatcccaacccataagatgtgggttatcaacatctttgtacaatgttttaagcataaaatcccagccaccatagaactttggagacccagcatggcgtat

SEQ ID NO: 438925 - DNA, 140 bp, Artificial Sequence
  Synthetic
atacgccatgctgggtctccatgcccaatatgtgcagaatttttgcttctctcatattggctcgcaaacatggcacttgttgtaccacaagagacagattttatcgcttggcaaatgagtcgtacttgggagtcggccat

SEQ ID NO: 438926 - DNA, 140 bp, Artificial Sequence
  Synthetic
atggccgactcccaagtacgactcatttgccaagcgataaaatctgtctcttgtggtacaacaagtgccatgtttgcgagccaatatgagagaagcaaaaattctgcacatattgggcatggagacccagcatggcgtat

SEQ ID NO: 438927 - DNA, 140 bp, Artificial Sequence
  Synthetic
  misc_feature (27)..(27): n is a, c, g, or t
  misc_feature (32)..(32): n is a, c, g, or t
atacgccatgctgggtctcccaatganattgntgactctgtgcagtatgctcataaacatgacatacaaattactaatgagagttacaataattatgtaccctcatatgttaaacctgatcgtacttgggagtcggccat

SEQ ID NO: 438928 - DNA, 140 bp, Artificial Sequence
  Synthetic
  misc_feature (109)..(109): n is a, c, g, or t
  misc_feature (114)..(114): n is a, c, g, or t
atggccgactcccaagtacgatcaggtttaacatatgagggtacataattattgtaactctcattagtaatttgtatgtcatgtttatgagcatactgcacagagtcancaatntcattgggagacccagcatggcgtat

SEQ ID NO: 438929 - DNA, 140 bp, Artificial Sequence
  Synthetic
atacgccatgctgggtctccgcgctcaagtgctaagtgaatatgttctatgcggtggtggttactacgttaaacctggaggtaccagtagcggagacgctactactgcatacgccaatagcgtacttgggagtcggccat

SEQ ID NO: 438930 - DNA, 140 bp, Artificial Sequence
  Synthetic
atggccgactcccaagtacgctattggcgtatgcagtagtagcgtctccgctactggtacctccaggtttaacgtagtaaccaccaccgcatagaacatattcacttagcacttgagcgcggagacccagcatggcgtat

SEQ ID NO: 438931 - DNA, 140 bp, Artificial Sequence
  Synthetic
atacgccatgctgggtctcctgtatttaacattttgcaagcaactactgcgaatgttagtgcacttatgggtgctaatggcaacaagattgttgataaagaagttaaagacatgcagtttcgtacttgggagtcggccat

SEQ ID NO: 438932 - DNA, 140 bp, Artificial Sequence
  Synthetic
atggccgactcccaagtacgaaactgcatgtctttaacttctttatcaacaatcttgttgccattagcacccataagtgcactaacattcgcagtagttgcttgcaaaatgttaaatacaggagacccagcatggcgtat

SEQ ID NO: 438933 - DNA, 140 bp, Artificial Sequence
  Synthetic
aggccctggctgctgatatggtgattgcaagtgaacagtgccccccgggaagagctctacagtgtgaaatgtaaataaaaatagctattattcaattagattaggctaattagatgatttgaccttttgggacagcggtg

SEQ ID NO: 438934 - DNA, 140 bp, Artificial Sequence
  Synthetic
caccgctgtcccaaaaggtcaaatcatctaattagcctaatctaattgaataatagctatttttatttacatttcacactgtagagctcttcccggggggcactgttcacttgcaatcaccatatcagcagccagggcct

SEQ ID NO: 438935 - DNA, 140 bp, Artificial Sequence
  Synthetic
atacgccatgctgggtctccgatttgtatgtcaatgtttacaggagtactaaccctgaccctaaatttgttgataaatattatgcttttctcaataagcatttttctatgatgatactgtcgtacttgggagtcggccat

SEQ ID NO: 438936 - DNA, 140 bp, Artificial Sequence
  Synthetic
atggccgactcccaagtacgacagtatcatcatagaaaaatgcttattgagaaaagcataatatttatcaacaaatttagggtcagggttagtactcctgtaaacattgacatacaaatcggagacccagcatggcgtat

SEQ ID NO: 438937 - DNA, 140 bp, Artificial Sequence
  Synthetic
atacgccatgctgggtctccctgatgatggtgttgtttgctataatagcgactatgcagctaaaggttacattgctggtatacagaattttaaggaaactctgtattaccagaacaatgtcgtacttgggagtcggccat

SEQ ID NO: 438938 - DNA, 140 bp, Artificial Sequence
  Synthetic
atggccgactcccaagtacgacattgttctggtaatacagagtttccttaaaattctgtataccagcaatgtaacctttagctgcatagtcgctattatagcaaacaacaccatcatcagggagacccagcatggcgtat

SEQ ID NO: 438939 - DNA, 140 bp, Artificial Sequence
  Synthetic
atacgccatgctgggtctccctttatgtctgaagctaaatgctgggtggaaaccgatctgaagaaaggtccacatgaattttgttcgcagcatacgctttatattaaggatggtgacgatcgtacttgggagtcggccat

SEQ ID NO: 438940 - DNA, 140 bp, Artificial Sequence
  Synthetic
atggccgactcccaagtacgatcgtcaccatccttaatataaagcgtatgctgcgaacaaaattcatgtggacctttcttcagatcggtttccacccagcatttagcttcagacataaagggagacccagcatggcgtat

SEQ ID NO: 438941 - DNA, 140 bp, Artificial Sequence
  Synthetic
atacgccatgctgggtctccggttacttcctgccttatccagacccttctaggatattgtctgctggttgctttgtagatgatatcgtcaagactgacggtactctcatggttgagcggtcgtacttgggagtcggccat

SEQ ID NO: 438942 - DNA, 140 bp, Artificial Sequence
  Synthetic
atggccgactcccaagtacgaccgctcaaccatgagagtaccgtcagtcttgacgatatcatctacaaagcaaccagcagacaatatcctagaagggtctggataaggcaggaagtaaccggagacccagcatggcgtat

SEQ ID NO: 438943 - DNA, 140 bp, Artificial Sequence
  Synthetic
atacgccatgctgggtctccttgtgtctttggctatagatgcttaccctcttacaaagcatgaagatatagaataccagaatgtattctgggtctatttgcagtatattgaaaaactgtacgtacttgggagtcggccat

SEQ ID NO: 438944 - DNA, 140 bp, Artificial Sequence
  Synthetic
atggccgactcccaagtacgtacagtttttcaatatactgcaaatagacccagaatacattctggtattctatatcttcatgctttgtaagagggtaagcatctatagccaaagacacaaggagacccagcatggcgtat

SEQ ID NO: 438945 - DNA, 140 bp, Artificial Sequence
  Synthetic
atacgccatgctgggtctcccaaggaccttacaggccacatgctagacagttattctgtaatgttatgtggtgataattctgctaagttttgggaagaggcattctatagagagctctatcgtacttgggagtcggccat

SEQ ID NO: 438946 - DNA, 140 bp, Artificial Sequence
  Synthetic
atggccgactcccaagtacgatagagctctctatagaatgcctcttcccaaaacttagcagaattatcaccacataacattacagaataactgtctagcatgtggcctgtaaggtccttgggagacccagcatggcgtat

SEQ ID NO: 438947 - DNA, 140 bp, Artificial Sequence
  Synthetic
aggccctggctgctgatatgatcaactggtactcaatcagtttctgtcgatcgtgagtcaacttcaactcatgatacccctaccgaacatgttactagtgtgaatctttttgacgttggtgaccttttgggacagcggtg

SEQ ID NO: 438948 - DNA, 140 bp, Artificial Sequence
  Synthetic
caccgctgtcccaaaaggtcaccaacgtcaaaaagattcacactagtaacatgttcggtaggggtatcatgagttgaagttgactcacgatcgacagaaactgattgagtaccagttgatcatatcagcagccagggcct

SEQ ID NO: 438949 - DNA, 140 bp, Artificial Sequence
  Synthetic
atacgccatgctgggtctccagttcacctaccactttgcaggcagtaggttcatgtgttgtatgccactcacaaacgtcattacgttgtgggacatgcatccgtagaccatttctttgttcgtacttgggagtcggccat

SEQ ID NO: 438950 - DNA, 140 bp, Artificial Sequence
  Synthetic
atggccgactcccaagtacgaacaaagaaatggtctacggatgcatgtcccacaacgtaatgacgtttgtgagtggcatacaacacatgaacctactgcctgcaaagtggtaggtgaactggagacccagcatggcgtat

SEQ ID NO: 438951 - DNA, 140 bp, Artificial Sequence
  Synthetic
atacgccatgctgggtctccgtaaatgctgctacgaccatgttatagcaactcctcataaaatggttctgtctgtttcgccatatgtctgcaatgcaccaggctgtgacgttgcagatgtcgtacttgggagtcggccat

SEQ ID NO: 438952 - DNA, 140 bp, Artificial Sequence
  Synthetic
atggccgactcccaagtacgacatctgcaacgtcacagcctggtgcattgcagacatatggcgaaacagacagaaccattttatgaggagttgctataacatggtcgtagcagcatttacggagacccagcatggcgtat

SEQ ID NO: 438953 - DNA, 140 bp, Artificial Sequence
  Synthetic
atacgccatgctgggtctcctactaagctatatttgggtggtatgagctacttttgtgtagatcatagacctgtatgtagttttcctctttgtactaatggtcttgtgtttggtttataccgtacttgggagtcggccat

SEQ ID NO: 438954 - DNA, 140 bp, Artificial Sequence
  Synthetic
atggccgactcccaagtacggtataaaccaaacacaagaccattagtacaaagaggaaaactacatacaggtctatgatctacacaaaagtagctcataccacccaaatatagcttagtaggagacccagcatggcgtat

SEQ ID NO: 438955 - DNA, 140 bp, Artificial Sequence
  Synthetic
atacgccatgctgggtctcctccagcaaacttgcgtgttgttggtcatgccatgcaaggcactcttttgaagttgactgtcgatgttgctaaccctagcactccagcctacacttttacacgtacttgggagtcggccat

SEQ ID NO: 438956 - DNA, 140 bp, Artificial Sequence
  Synthetic
atggccgactcccaagtacgtgtaaaagtgtaggctggagtgctagggttagcaacatcgacagtcaacttcaaaagagtgccttgcatggcatgaccaacaacacgcaagtttgctggaggagacccagcatggcgtat

SEQ ID NO: 438957 - DNA, 140 bp, Artificial Sequence
  Synthetic
atacgccatgctgggtctccaagaatatgtgcacaggtagtccttctatagttgaatttaatagattggctacttgtgactggactgaaagtggtgattacacccttgctaatactactacgtacttgggagtcggccat

SEQ ID NO: 438958 - DNA, 140 bp, Artificial Sequence
  Synthetic
atggccgactcccaagtacgtagtagtattagcaagggtgtaatcaccactttcagtccagtcacaagtagccaatctattaaattcaactatagaaggactacctgtgcacatattcttggagacccagcatggcgtat

SEQ ID NO: 438959 - DNA, 140 bp, Artificial Sequence
  Synthetic
aggccctggctgctgatatgtgacgttggttactcagttaattaacgaactctatggattacgtgtctctgcttaatcaaatttggcagaagtaccttaattcaccgtatactacttgttgaccttttgggacagcggtg

SEQ ID NO: 438960 - DNA, 140 bp, Artificial Sequence
  Synthetic
caccgctgtcccaaaaggtcaacaagtagtatacggtgaattaaggtacttctgccaaatttgattaagcagagacacgtaatccatagagttcgttaattaactgagtaaccaacgtcacatatcagcagccagggcct

SEQ ID NO: 438961 - DNA, 140 bp, Artificial Sequence
  Synthetic
aggccctggctgctgatatggcatctaagcagtcctatgctatagccaccatcaaggaaattgttggtgagcgtcaattactacttgtgtgggaatctggtaaagccaaaccaccactcagaccttttgggacagcggtg

SEQ ID NO: 438962 - DNA, 140 bp, Artificial Sequence
  Synthetic
caccgctgtcccaaaaggtctgagtggtggtttggctttaccagattcccacacaagtagtaattgacgctcaccaacaatttccttgatggtggctatagcataggactgcttagatgccatatcagcagccagggcct

SEQ ID NO: 438963 - DNA, 140 bp, Artificial Sequence
  Synthetic
atacgccatgctgggtctcctaacaagcacgcttttcatacaccagcatatgatgtgagtgcattccgtgatctgaaacctttaccaggatattgattatgtacccctaaaatctgcagtcgtacttgggagtcggccat

SEQ ID NO: 438964 - DNA, 140 bp, Artificial Sequence
  Synthetic
atggccgactcccaagtacgactgcagattttaggggtacataatcaatatcctggtaaaggtttcagatcacggaatgcactcacatcatatgctggtgtatgaaaagcgtgcttgttaggagacccagcatggcgtat

SEQ ID NO: 438965 - DNA, 140 bp, Artificial Sequence
  Synthetic
atacgccatgctgggtctccctacaagtctagcacaacgtataagctgactgtaggtgacatctttgtacttacttctcattcggtggctaccctgacggcacccacaattgtgaatcaacgtacttgggagtcggccat

SEQ ID NO: 438966 - DNA, 140 bp, Artificial Sequence
  Synthetic
atggccgactcccaagtacgttgattcacaattgtgggtgccgtcagggtagccaccgaatgagaagtaagtacaaagatgtcacctacagtcagcttatacgttgtgctagacttgtagggagacccagcatggcgtat

SEQ ID NO: 438967 - DNA, 140 bp, Artificial Sequence
  Synthetic
atacgccatgctgggtctccgagaggtatgttaaaattactgggttgtacccaacaattactgtgcctgaggagtttgcaaaccatgttgctaactttcaaaaatcaggttatagtaagtcgtacttgggagtcggccat

SEQ ID NO: 438968 - DNA, 140 bp, Artificial Sequence
  Synthetic
atggccgactcccaagtacgacttactataacctgatttttgaaagttagcaacatggtttgcaaactcctcaggcacagtaattgttgggtacaacccagtaattttaacatacctctcggagacccagcatggcgtat

SEQ ID NO: 438969 - DNA, 140 bp, Artificial Sequence
  Synthetic
aggccctggctgctgatatggagagaatgttaaagactgtcacctctgcgtgattgcaagtgaacagtgccccccgggaagagctctacagtgtgaaatgtaaataaaaatagctattatgaccttttgggacagcggtg

SEQ ID NO: 438970 - DNA, 140 bp, Artificial Sequence
  Synthetic
caccgctgtcccaaaaggtcataatagctatttttatttacatttcacactgtagagctcttcccggggggcactgttcacttgcaatcacgcagaggtgacagtctttaacattctctccatatcagcagccagggcct

SEQ ID NO: 438971 - DNA, 140 bp, Artificial Sequence
  Synthetic
atacgccatgctgggtctccatgtcactgttcagggaccacctggcactggcaaaagtcactttgctatagggttggcgatttactaccctacagcacgtgttgtttatacagcctgttccgtacttgggagtcggccat

SEQ ID NO: 438972 - DNA, 140 bp, Artificial Sequence
  Synthetic
atggccgactcccaagtacggaacaggctgtataaacaacacgtgctgtagggtagtaaatcgccaaccctatagcaaagtgacttttgccagtgccaggtggtccctgaacagtgacatggagacccagcatggcgtat

SEQ ID NO: 438973 - DNA, 140 bp, Artificial Sequence
  Synthetic
aggccctggctgctgatatgggctatctcacttcccctcgttctcttgcagaactttgattttaacgaacttaaataaaagccctgttgtttagcgtattgttgcacttgtctggtgggagaccttttgggacagcggtg

SEQ ID NO: 438974 - DNA, 140 bp, Artificial Sequence
  Synthetic
caccgctgtcccaaaaggtctcccaccagacaagtgcaacaatacgctaaacaacagggcttttatttaagttcgttaaaatcaaagttctgcaagagaacgaggggaagtgagatagcccatatcagcagccagggcct

SEQ ID NO: 438975 - DNA, 140 bp, Artificial Sequence
  Synthetic
atacgccatgctgggtctccacatgcagctgtagatgcattgtgcgagaaggcttttaagtatttgaacattgcaaaatgttcccgtatcattcctgctaaggcgcgtgttgagtgctatcgtacttgggagtcggccat

SEQ ID NO: 438976 - DNA, 140 bp, Artificial Sequence
  Synthetic
atggccgactcccaagtacgatagcactcaacacgcgccttagcaggaatgatacgggaacattttgcaatgttcaaatacttaaaagccttctcgcacaatgcatctacagctgcatgtggagacccagcatggcgtat

SEQ ID NO: 438977 - DNA, 140 bp, Artificial Sequence
  Synthetic
atacgccatgctgggtctcccaaatctttcccagttaaggagaagaaacaaaaggctgatgataacaaacaggattccactgaagacagtggtgacctctttgccgaagccgttgcttctcgtacttgggagtcggccat

SEQ ID NO: 438978 - DNA, 140 bp, Artificial Sequence
  Synthetic
atggccgactcccaagtacgagaagcaacggcttcggcaaagaggtcaccactgtcttcagtggaatcctgtttgttatcatcagccttttgtttcttctccttaactgggaaagatttgggagacccagcatggcgtat

SEQ ID NO: 438979 - DNA, 140 bp, Artificial Sequence
  Synthetic
atacgccatgctgggtctccgacaggtttaaggttaatgaaacaaattctcaatatttgtttagtactattaatgcactaccagaaacgtcagctgacattttggtagttgatgaggttacgtacttgggagtcggccat

SEQ ID NO: 438980 - DNA, 140 bp, Artificial Sequence
  Synthetic
atggccgactcccaagtacgtaacctcatcaactaccaaaatgtcagctgacgtttctggtagtgcattaatagtactaaacaaatattgagaatttgtttcattaaccttaaacctgtcggagacccagcatggcgtat

SEQ ID NO: 438981 - DNA, 140 bp, Artificial Sequence
  Synthetic
atacgccatgctgggtctcctgtgcctagagctaagtctgttgtctcaaggattggagactccatctttacaggctgtactggctcttggaacaaggttactcaaattgctaacatgttccgtacttgggagtcggccat

SEQ ID NO: 438982 - DNA, 140 bp, Artificial Sequence
  Synthetic
atggccgactcccaagtacggaacatgttagcaatttgagtaaccttgttccaagagccagtacagcctgtaaagatggagtctccaatccttgagacaacagacttagctctaggcacaggagacccagcatggcgtat

SEQ ID NO: 438983 - DNA, 140 bp, Artificial Sequence
  Synthetic
atacgccatgctgggtctccgtatgtgcactaattatgatctttctattattaatgcacgtatcaaagctaagcacattgtttatgtaggagaccccgcacaattgccggctcctagaaccgtacttgggagtcggccat

SEQ ID NO: 438984 - DNA, 140 bp, Artificial Sequence
  Synthetic
atggccgactcccaagtacggttctaggagccggcaattgtgcggggtctcctacataaacaatgtgcttagctttgatacgtgcattaataatagaaagatcataattagtgcacatacggagacccagcatggcgtat

SEQ ID NO: 438985 - DNA, 140 bp, Artificial Sequence
  Synthetic
atacgccatgctgggtctcctttgttaactagaggcactttagagcctgaaaactttaatagtgtcactagacttatgtgtaacttaggtcctgacatatttttaagtatgtgttacaggcgtacttgggagtcggccat

SEQ ID NO: 438986 - DNA, 140 bp, Artificial Sequence
  Synthetic
atggccgactcccaagtacgcctgtaacacatacttaaaaatatgtcaggacctaagttacacataagtctagtgacactattaaagttttcaggctctaaagtgcctctagttaacaaaggagacccagcatggcgtat

SEQ ID NO: 438987 - DNA, 140 bp, Artificial Sequence
  Synthetic
atacgccatgctgggtctcctgtcctaaggaaatagtaagcactgttagcgctcttgtctacaataacaaattgttagccaagaaggagctttcaggccagtgctttaaaatactctatacgtacttgggagtcggccat

SEQ ID NO: 438988 - DNA, 140 bp, Artificial Sequence
  Synthetic
atggccgactcccaagtacgtatagagtattttaaagcactggcctgaaagctccttcttggctaacaatttgttattgtagacaagagcgctaacagtgcttactatttccttaggacaggagacccagcatggcgtat

SEQ ID NO: 438989 - DNA, 140 bp, Artificial Sequence
  Synthetic
aggccctggctgctgatatgccatcaaggagctcatgtggcttctaatgatgcaataatgactcgttgtttagctattcattcttgttttatagaacgtgtggattgggatatagagtatgaccttttgggacagcggtg

SEQ ID NO: 438990 - DNA, 140 bp, Artificial Sequence
  Synthetic
caccgctgtcccaaaaggtcatactctatatcccaatccacacgttctataaaacaagaatgaatagctaaacaacgagtcattattgcatcattagaagccacatgagctccttgatggcatatcagcagccagggcct

SEQ ID NO: 438991 - DNA, 140 bp, Artificial Sequence
  Synthetic
atacgccatgctgggtctccaaggcaatgttacacatgatgctagctctgccattaatagacctcaacttgcatttgttaagaattttattactgcaaaccctgcatggagtaaggcagtcgtacttgggagtcggccat

SEQ ID NO: 438992 - DNA, 140 bp, Artificial Sequence
  Synthetic
atggccgactcccaagtacgactgccttactccatgcagggtttgcagtaataaaattcttaacaaatgcaagttgaggtctattaatggcagagctagcatcatgtgtaacattgccttggagacccagcatggcgtat

SEQ ID NO: 438993 - DNA, 140 bp, Artificial Sequence
  Synthetic
atacgccatgctgggtctccatgccgattccagattttgatttagacgattttattgacgcaccatgctattgctttaacgctgagggtgatgcatcttggtcttctactatgatcttctcgtacttgggagtcggccat

SEQ ID NO: 438994 - DNA, 140 bp, Artificial Sequence
  Synthetic
atggccgactcccaagtacgagaagatcatagtagaagaccaagatgcatcaccctcagcgttaaagcaatagcatggtgcgtcaataaaatcgtctaaatcaaaatctggaatcggcatggagacccagcatggcgtat

SEQ ID NO: 438995 - DNA, 140 bp, Artificial Sequence
  Synthetic
atacgccatgctgggtctccctttatttcaccttataattcacagaatgctgtggctcgttcaatgctgggtcttaccacccagactgttgattcttcacagggttcagaataccagtatcgtacttgggagtcggccat

SEQ ID NO: 438996 - DNA, 140 bp, Artificial Sequence
  Synthetic
atggccgactcccaagtacgatactggtattctgaaccctgtgaagaatcaacagtctgggtggtaagacccagcattgaacgagccacagcattctgtgaattataaggtgaaataaagggagacccagcatggcgtat

SEQ ID NO: 438997 - DNA, 140 bp, Artificial Sequence
  Synthetic
atacgccatgctgggtctccgcaatggcctcacaatctctaccacagcgagcgcctaagggttctatcacccagcgctctcgtgctcccagagctcctgtgagtcagatggaagacgtgacgtacttgggagtcggccat

SEQ ID NO: 438998 - DNA, 140 bp, Artificial Sequence
  Synthetic
atggccgactcccaagtacgtcacgtcttccatctgactcacaggagctctgggagcacgagagcgctgggtgatagaacccttaggcgctcgctgtggtagagattgtgaggccattgcggagacccagcatggcgtat

SEQ ID NO: 438999 - DNA, 140 bp, Artificial Sequence
  Synthetic
atacgccatgctgggtctccgtcatcttctgtcagacagcagatactgcacatgctaacaacattaatagatttaatgttgctatcactcgtgcacaaaaaggtattctttgtgttatgacgtacttgggagtcggccat

SEQ ID NO: 439000 - DNA, 140 bp, Artificial Sequence
  Synthetic
atggccgactcccaagtacgtcataacacaaagaatacctttttgtgcacgagtgatagcaacattaaatctattaatgttgttagcatgtgcagtatctgctgtctgacagaagatgacggagacccagcatggcgtat

SEQ ID NO: 439001 - DNA, 140 bp, Artificial Sequence
  Synthetic
atacgccatgctgggtctcccatctcaggcgctctttgattctttagagtttactgagttgtcttttactaattataaactccagtctcagattgtaactggactttttaaggattgttccgtacttgggagtcggccat

SEQ ID NO: 439002 - DNA, 140 bp, Artificial Sequence
  Synthetic
atggccgactcccaagtacggaacaatccttaaaaagtccagttacaatctgagactggagtttataattagtaaaagacaactcagtaaactctaaagaatcaaagagcgcctgagatgggagacccagcatggcgtat

SEQ ID NO: 439003 - DNA, 140 bp, Artificial Sequence
  Synthetic
atacgccatgctgggtctcccagagagacatctggcctttctcctgcttatgcaccaacatatgttagtgttgatgataagtataagacgagtgatgagctttgcgtgaatctaaatttacgtacttgggagtcggccat

SEQ ID NO: 439004 - DNA, 140 bp, Artificial Sequence
  Synthetic
atggccgactcccaagtacgtaaatttagattcacgcaaagctcatcactcgtcttatacttatcatcaacactaacatatgttggtgcataagcaggagaaaggccagatgtctctctgggagacccagcatggcgtat

SEQ ID NO: 439005 - DNA, 140 bp, Artificial Sequence
  Synthetic
atacgccatgctgggtctcccccgcaaatgttccatactctcgtgttatatccagaatgggctttaaattagatgctaatgtccctggttatcctaagctcttcataactcgtgaagaggcgtacttgggagtcggccat

SEQ ID NO: 439006 - DNA, 140 bp, Artificial Sequence
  Synthetic
atggccgactcccaagtacgcctcttcacgagttatgaagagcttaggataaccagggacattagcatctaatttaaagcccattctggatataacacgagagtatggaacatttgcgggggagacccagcatggcgtat

SEQ ID NO: 439007 - DNA, 140 bp, Artificial Sequence
  Synthetic
atacgccatgctgggtctccaacattcattgatgctgctcgtggacccgctggtgtggagtctgatgttgagaccaatgaaattgttgactctgttcagtatgctcataaacatgacatacgtacttgggagtcggccat

SEQ ID NO: 439008 - DNA, 140 bp, Artificial Sequence
  Synthetic
atggccgactcccaagtacgtatgtcatgtttatgagcatactgaacagagtcaacaatttcattggtctcaacatcagactccacaccagcgggtccacgagcagcatcaatgaatgttggagacccagcatggcgtat

SEQ ID NO: 439009 - DNA, 140 bp, Artificial Sequence
  Synthetic
atacgccatgctgggtctccctgtaaggcaagttcgtagctggataggcttcgatgttgaaggtgcacatgcttcacgtaatgcatgtggaaccaacgtgcctctacaattgggcttttccgtacttgggagtcggccat

SEQ ID NO: 439010 - DNA, 140 bp, Artificial Sequence
  Synthetic
atggccgactcccaagtacggaaaagcccaattgtagaggcacgttggttccacatgcattacgtgaagcatgtgcaccttcaacatcgaagcctatccagctacgaacttgccttacagggagacccagcatggcgtat

SEQ ID NO: 439011 - DNA, 140 bp, Artificial Sequence
  Synthetic
aggccctggctgctgatatgtcccatcgggaacctattactgtgtcaccactaaggctaagtccgttcaacaagatcttgacgttattttgcctggtgagttttccaagaagcagttagggaccttttgggacagcggtg

SEQ ID NO: 439012 - DNA, 140 bp, Artificial Sequence
  Synthetic
caccgctgtcccaaaaggtccctaactgcttcttggaaaactcaccaggcaaaataacgtcaagatcttgttgaacggacttagccttagtggtgacacagtaataggttcccgatgggacatatcagcagccagggcct

SEQ ID NO: 439013 - DNA, 140 bp, Artificial Sequence
  Synthetic
atacgccatgctgggtctccatcagaccgatgaccgtcagtaaacgtaacaagagtaaggcaaccgctagtgattggtaaccccaatgcacgatgctgttgtctactcttgcacagaatgcgtacttgggagtcggccat

SEQ ID NO: 439014 - DNA, 140 bp, Artificial Sequence
  Synthetic
atggccgactcccaagtacgcattctgtgcaagagtagacaacagcatcgtgcattggggttaccaatcactagcggttgccttactcttgttacgtttactgacggtcatcggtctgatggagacccagcatggcgtat

SEQ ID NO: 439015 - DNA, 140 bp, Artificial Sequence
  Synthetic
atacgccatgctgggtctcctttaagcaccttgttcctctaatgcataaaggggcagcatggcctatcgttagacgacgtatagttcaaatgttgtcagacactttagataaattgtctgcgtacttgggagtcggccat

SEQ ID NO: 439016 - DNA, 140 bp, Artificial Sequence
  Synthetic
atggccgactcccaagtacgcagacaatttatctaaagtgtctgacaacatttgaactatacgtcgtctaacgataggccatgctgcccctttatgcattagaggaacaaggtgcttaaaggagacccagcatggcgtat

SEQ ID NO: 439017 - DNA, 140 bp, Artificial Sequence
  Synthetic
atacgccatgctgggtctccattactgtacgtttgtttgttgggctcatggctttgaattaacatctgcatcttatttttgcaagataggtaaagagcagaagtgttgtatgtgtaatagcgtacttgggagtcggccat

SEQ ID NO: 439018 - DNA, 140 bp, Artificial Sequence
  Synthetic
atggccgactcccaagtacgctattacacatacaacacttctgctctttacctatcttgcaaaaataagatgcagatgttaattcaaagccatgagcccaacaaacaaacgtacagtaatggagacccagcatggcgtat

SEQ ID NO: 439019 - DNA, 140 bp, Artificial Sequence
  Synthetic
atacgccatgctgggtctccacgcgctgcagcgtactcttcacctctgcaatcatatgcctgctggactcattcctgtggttatgattatgtctacaaccccttctttgttgacgttcagcgtacttgggagtcggccat

SEQ ID NO: 439020 - DNA, 140 bp, Artificial Sequence
  Synthetic
atggccgactcccaagtacgctgaacgtcaacaaagaaggggttgtagacataatcataaccacaggaatgagtccagcaggcatatgattgcagaggtgaagagtacgctgcagcgcgtggagacccagcatggcgtat

SEQ ID NO: 439021 - DNA, 140 bp, Artificial Sequence
  Synthetic
atacgccatgctgggtctccgtcccaccgcaagtggtggaacttccgtctgaacctcagactatccagcctgaggtaaaagaagttgcacctgtctatgaggctgacaccgaacagacaccgtacttgggagtcggccat

SEQ ID NO: 439022 - DNA, 140 bp, Artificial Sequence
  Synthetic
atggccgactcccaagtacggtgtctgttcggtgtcagcctcatagacaggtgcaacttcttttacctcaggctggatagtctgaggttcagacggaagttccaccacttgcggtgggacggagacccagcatggcgtat

SEQ ID NO: 439023 - DNA, 140 bp, Artificial Sequence
  Synthetic
atacgccatgctgggtctccgaatttgctacccgcactttcactgctaccactgctgtaggtagttgtataaagagtgtagtgcggcatctaggtgttactaaaggcatattgacaggctcgtacttgggagtcggccat

SEQ ID NO: 439024 - DNA, 140 bp, Artificial Sequence
  Synthetic
atggccgactcccaagtacgagcctgtcaatatgcctttagtaacacctagatgccgcactacactctttatacaactacctacagcagtggtagcagtgaaagtgcgggtagcaaattcggagacccagcatggcgtat

SEQ ID NO: 439025 - DNA, 140 bp, Artificial Sequence
  Synthetic
atacgccatgctgggtctcccgggtttgttaccattgagttgcaacctccttgcaagtttttgattgcgggtcctaagggtcctgagatccgatatctctattttgttaaaaatctcaaccgtacttgggagtcggccat

SEQ ID NO: 439026 - DNA, 140 bp, Artificial Sequence
  Synthetic
atggccgactcccaagtacggttgagatttttaacaaaatagagatatcggatctcaggacccttaggacccgcaatcaaaaacttgcaaggaggttgcaactcaatggtaacaaacccgggagacccagcatggcgtat

SEQ ID NO: 439027 - DNA, 140 bp, Artificial Sequence
  Synthetic
atacgccatgctgggtctccgtttagctattcactcttgttttattgaacgtgtggattgggatatagaatatccttatatatcacatgaaaagaagttgaattcctgttgtcgcattgtcgtacttgggagtcggccat

SEQ ID NO: 439028 - DNA, 140 bp, Artificial Sequence
  Synthetic
atggccgactcccaagtacgacaatgcgacaacaggaattcaacttcttttcatgtgatatataaggatattctatatcccaatccacacgttcaataaaacaagagtgaatagctaaacggagacccagcatggcgtat

SEQ ID NO: 439029 - DNA, 140 bp, Artificial Sequence
  Synthetic
aggccctggctgctgatatgtcccatctgcagaatcaactggtactcaatcagtttctgtcgatcgtgagtcaactttaactcattatggtcttaccgaacatgttactagtgtgaatctgaccttttgggacagcggtg

SEQ ID NO: 439030 - DNA, 140 bp, Artificial Sequence
  Synthetic
caccgctgtcccaaaaggtcagattcacactagtaacatgttcggtaagaccataatgagttaaagttgactcacgatcgacagaaactgattgagtaccagttgattctgcagatgggacatatcagcagccagggcct

SEQ ID NO: 439031 - DNA, 140 bp, Artificial Sequence
  Synthetic
atacgccatgctgggtctcccgaacgcaatgtcgtacgtgctgctctcttagcaggttcttttgatagaatttacgacattggtaatcctaaaggaattcctattgttgatgaccctgtgcgtacttgggagtcggccat

SEQ ID NO: 439032 - DNA, 140 bp, Artificial Sequence
  Synthetic
atggccgactcccaagtacgcacagggtcatcaacaataggaattcctttaggattaccaatgtcgtaaattctatcaaaagaacctgctaagagagcagcacgtacgacattgcgttcgggagacccagcatggcgtat

SEQ ID NO: 439033 - DNA, 140 bp, Artificial Sequence
  Synthetic
atacgccatgctgggtctccgaatcatgttgtaattacagtgcaagaaggtaattataacccatttaattgatagctatgattagtaaaatgtgtagctgtagagagtatgttaaagactcgtacttgggagtcggccat

SEQ ID NO: 439034 - DNA, 140 bp, Artificial Sequence
  Synthetic
atggccgactcccaagtacgagtctttaacatactctctacagctacacattttactaatcatagctatcaattaaatgggttataattaccttcttgcactgtaattacaacatgattcggagacccagcatggcgtat

SEQ ID NO: 439035 - DNA, 140 bp, Artificial Sequence
  Synthetic
atacgccatgctgggtctccgttgattggcattattttgacgcacagcccttgaataagaaggtacaacagcttttctacactgaggatttagcctcaagatttgctgatgggctttgctcgtacttgggagtcggccat

SEQ ID NO: 439036 - DNA, 140 bp, Artificial Sequence
  Synthetic
atggccgactcccaagtacgagcaaagcccatcagcaaatcttgaggctaaatcctcagtgtagaaaagctgttgtaccttcttattcaagggctgtgcgtcaaaataatgccaatcaacggagacccagcatggcgtat

SEQ ID NO: 439037 - DNA, 140 bp, Artificial Sequence
  Synthetic
aggccctggctgctgatatgcaactgaacaagttgacgtttctcatgagatttctgacgacgagtgggctgctgcagttgatgaagcgttccccctcgatgaagcagaagatgttactgagaccttttgggacagcggtg

SEQ ID NO: 439038 - DNA, 140 bp, Artificial Sequence
  Synthetic
caccgctgtcccaaaaggtctcagtaacatcttctgcttcatcgagggggaacgcttcatcaactgcagcagcccactcgtcgtcagaaatctcatgagaaacgtcaacttgttcagttgcatatcagcagccagggcct

SEQ ID NO: 439039 - DNA, 140 bp, Artificial Sequence
  Synthetic
atacgccatgctgggtctcctgttttggaactgtaatgttccaaaatatcctaataatgcaattgtgtgtaggtttgacacacgtgtgcactctgagttcaatttgccaggttgtgatggcgtacttgggagtcggccat

SEQ ID NO: 439040 - DNA, 140 bp, Artificial Sequence
  Synthetic
atggccgactcccaagtacgccatcacaacctggcaaattgaactcagagtgcacacgtgtgtcaaacctacacacaattgcattattaggatattttggaacattacagttccaaaacaggagacccagcatggcgtat

SEQ ID NO: 439041 - DNA, 140 bp, Artificial Sequence
  Synthetic
aggccctggctgctgatatgaatggtcttgtattcggcttatacaagaatatgtgcacaggtagtccttctatagttgaatttaataggttggctacctgtgactggactgaaagtggtggaccttttgggacagcggtg

SEQ ID NO: 439042 - DNA, 140 bp, Artificial Sequence
  Synthetic
caccgctgtcccaaaaggtccaccactttcagtccagtcacaggtagccaacctattaaattcaactatagaaggactacctgtgcacatattcttgtataagccgaatacaagaccattcatatcagcagccagggcct

SEQ ID NO: 439043 - DNA, 140 bp, Artificial Sequence
  Synthetic
atacgccatgctgggtctcctggtagcttgtatgtcaacaagcatgcttttcacacaccagcatatgacgtgagtgcatttcgtgatctgaaacctttacctttcttttattattctactcgtacttgggagtcggccat

SEQ ID NO: 439044 - DNA, 140 bp, Artificial Sequence
  Synthetic
atggccgactcccaagtacgagtagaataataaaagaaaggtaaaggtttcagatcacgaaatgcactcacgtcatatgctggtgtgtgaaaagcatgcttgttgacatacaagctaccaggagacccagcatggcgtat

SEQ ID NO: 439045 - DNA, 140 bp, Artificial Sequence
  Synthetic
aggccctggctgctgatatgctaccctcgactccaggcttctgcagattggaaacctggtcatgcaatgccatccctctttaaagttcaaaatgtaaaccttgaacgttgtgagcttgctgaccttttgggacagcggtg

SEQ ID NO: 439046 - DNA, 140 bp, Artificial Sequence
  Synthetic
caccgctgtcccaaaaggtcagcaagctcacaacgttcaaggtttacattttgaactttaaagagggatggcattgcatgaccaggtttccaatctgcagaagcctggagtcgagggtagcatatcagcagccagggcct

SEQ ID NO: 439047 - DNA, 140 bp, Artificial Sequence
  Synthetic
atacgccatgctgggtctccactagtgattatacgattacagtctttgttactgttaaccttgcaaaagtttgcacttatgccatctttgcttactcgccacagcttacacttgtgtttccgtacttgggagtcggccat

SEQ ID NO: 439048 - DNA, 140 bp, Artificial Sequence
  Synthetic
atggccgactcccaagtacggaaacacaagtgtaagctgtggcgagtaagcaaagatggcataagtgcaaacttttgcaaggttaacagtaacaaagactgtaatcgtataatcactagtggagacccagcatggcgtat

SEQ ID NO: 439049 - DNA, 140 bp, Artificial Sequence
  Synthetic
atacgccatgctgggtctccaaccttcatagaggtcagcttttaggtcatattgctgccactgttaaattgcaggctggttctaatactgagtttgcttctaattcatcagtgttgtctccgtacttgggagtcggccat

SEQ ID NO: 439050 - DNA, 140 bp, Artificial Sequence
  Synthetic
atggccgactcccaagtacggagacaacactgatgaattagaagcaaactcagtattagaaccagcctgcaatttaacagtggcagcaatatgacctaaaagctgacctctatgaaggttggagacccagcatggcgtat

SEQ ID NO: 439051 - DNA, 140 bp, Artificial Sequence
  Synthetic
atacgccatgctgggtctcctactgccaatccggcatggagtaaggcagtctttatttcgccttataattcacagaatgctgtggctcgttcaatgctgggtcttactactcagactgttcgtacttgggagtcggccat

SEQ ID NO: 439052 - DNA, 140 bp, Artificial Sequence
  Synthetic
atggccgactcccaagtacgaacagtctgagtagtaagacccagcattgaacgagccacagcattctgtgaattataaggcgaaataaagactgccttactccatgccggattggcagtaggagacccagcatggcgtat

SEQ ID NO: 439053 - DNA, 140 bp, Artificial Sequence
  Synthetic
aggccctggctgctgatatgtcaactctgaaaaacatcaagaccatgtgtctctaactgtgccactctgtggttcaggaaacctggttgaaaaactttcaccatggttcatggatggcgagaccttttgggacagcggtg

SEQ ID NO: 439054 - DNA, 140 bp, Artificial Sequence
  Synthetic
caccgctgtcccaaaaggtctcgccatccatgaaccatggtgaaagtttttcaaccaggtttcctgaaccacagagtggcacagttagagacacatggtcttgatgtttttcagagttgacatatcagcagccagggcct

SEQ ID NO: 439055 - DNA, 140 bp, Artificial Sequence
  Synthetic
atacgccatgctgggtctcccatttacaacctttggtcaacatttacaaaagttcaaggtttagagaacattgcttttaacgttgttaaacaaggccactttactggtgttgaaggtgaacgtacttgggagtcggccat

SEQ ID NO: 439056 - DNA, 140 bp, Artificial Sequence
  Synthetic
atggccgactcccaagtacgttcaccttcaacaccagtaaagtggccttgtttaacaacgttaaaagcaatgttctctaaaccttgaacttttgtaaatgttgaccaaaggttgtaaatgggagacccagcatggcgtat

SEQ ID NO: 439057 - DNA, 140 bp, Artificial Sequence
  Synthetic
atacgccatgctgggtctccagaaagtccaagatgctgtgaatacaaatgctcaggctttagctaaattagctagtgaactatctaatacttttggtgctatttcttcctccattggtgacgtacttgggagtcggccat

SEQ ID NO: 439058 - DNA, 140 bp, Artificial Sequence
  Synthetic
atggccgactcccaagtacgtcaccaatggaggaagaaatagcaccaaaagtattagatagttcactagctaatttagctaaagcctgagcatttgtattcacagcatcttggactttctggagacccagcatggcgtat

SEQ ID NO: 439059 - DNA, 140 bp, Artificial Sequence
  Synthetic
atacgccatgctgggtctccctacctgtagctgtagtcaatgataaaatcttcactaagagtggtactaatgacatttgtttgtttgaaaataaaaccactttgcctactaatatagcatcgtacttgggagtcggccat

SEQ ID NO: 439060 - DNA, 140 bp, Artificial Sequence
  Synthetic
atggccgactcccaagtacgatgctatattagtaggcaaagtggttttattttcaaacaaacaaatgtcattagtaccactcttagtgaagattttatcattgactacagctacaggtagggagacccagcatggcgtat

SEQ ID NO: 439061 - DNA, 140 bp, Artificial Sequence
  Synthetic
aggccctggctgctgatatgattgctgcccgtcctccaccaggtgaacagtttaagcacctcgtgcctcttatgcataagggggctgcgtggcctattgttagacgacgtatagtgcaaagaccttttgggacagcggtg

SEQ ID NO: 439062 - DNA, 140 bp, Artificial Sequence
  Synthetic
caccgctgtcccaaaaggtctttgcactatacgtcgtctaacaataggccacgcagcccccttatgcataagaggcacgaggtgcttaaactgttcacctggtggaggacgggcagcaatcatatcagcagccagggcct

SEQ ID NO: 439063 - DNA, 140 bp, Artificial Sequence
  Synthetic
atacgccatgctgggtctcctgaacgtagcaatatctatggtactgctactattggtgtatgtaagtacactgatattgatgtcaactcagctttgaatatatgttttgacattcgtgatcgtacttgggagtcggccat

SEQ ID NO: 439064 - DNA, 140 bp, Artificial Sequence
  Synthetic
atggccgactcccaagtacgatcacgaatgtcaaaacatatattcaaagctgagttgacatcaatatcagtgtacttacatacaccaatagtagcagtaccatagatattgctacgttcaggagacccagcatggcgtat

SEQ ID NO: 439065 - DNA, 140 bp, Artificial Sequence
  Synthetic
aggccctggctgctgatatggaacagtgccccctgggaagagctctacagtgtgaagtgtaaataaaaatagctgttattcaattagattagctaattagatgattaacaaaaaaaaaaagaccttttgggacagcggtg

SEQ ID NO: 439066 - DNA, 140 bp, Artificial Sequence
  Synthetic
caccgctgtcccaaaaggtctttttttttttgttaatcatctaattagctaatctaattgaataacagctatttttatttacacttcacactgtagagctcttcccagggggcactgttccatatcagcagccagggcct

SEQ ID NO: 439067 - DNA, 140 bp, Artificial Sequence
  Synthetic
atacgccatgctgggtctccaatggtgcattagagcagttcatgtcaactcctaatgccattcttatttctgacagaaaaatcaagaaatacccttgtatggtaggtcctgattatgcttcgtacttgggagtcggccat

SEQ ID NO: 439068 - DNA, 140 bp, Artificial Sequence
  Synthetic
atggccgactcccaagtacgaagcataatcaggacctaccatacaagggtatttcttgatttttctgtcagaaataagaatggcattaggagttgacatgaactgctctaatgcaccattggagacccagcatggcgtat

SEQ ID NO: 439069 - DNA, 140 bp, Artificial Sequence
  Synthetic
atacgccatgctgggtctccttgttaccttcactgttgaccctaagaaagcttacatggattttgttaacgctggcggtgccccgttaactaactgtgtaaagatgcttactcctaagaccgtacttgggagtcggccat

SEQ ID NO: 439070 - DNA, 140 bp, Artificial Sequence
  Synthetic
atggccgactcccaagtacggtcttaggagtaagcatctttacacagttagttaacggggcaccgccagcgttaacaaaatccatgtaagctttcttagggtcaacagtgaaggtaacaaggagacccagcatggcgtat

SEQ ID NO: 439071 - DNA, 140 bp, Artificial Sequence
  Synthetic
atacgccatgctgggtctccatttcaatggtgctatcatccgtaatagtgatgttgttaagcaaccagtgaaattttacatgtacaagaaagtcaataatgagtttgttgattttactgacgtacttgggagtcggccat

SEQ ID NO: 439072 - DNA, 140 bp, Artificial Sequence
  Synthetic
atggccgactcccaagtacgtcagtaaaatcaacaaactcattattgactttcttgtacatgtaaaatttcactggttgcttaacaacatcactattacggatgatagcaccattgaaatggagacccagcatggcgtat

SEQ ID NO: 439073 - DNA, 140 bp, Artificial Sequence
  Synthetic
atacgccatgctgggtctccgtgtgtctacactcagggtcgctcttgtagtgactttgaacccatgtctgacatggagaatgactttctaaattttgatagtgatgttttcattaagaagcgtacttgggagtcggccat

SEQ ID NO: 439074 - DNA, 140 bp, Artificial Sequence
  Synthetic
atggccgactcccaagtacgcttcttaatgaaaacatcactatcaaaatttagaaagtcattctccatgtcagacatgggttcaaagtcactacaagagcgaccctgagtgtagacacacggagacccagcatggcgtat

SEQ ID NO: 439075 - DNA, 140 bp, Artificial Sequence
  Synthetic
aggccctggctgctgatatgatcgcttggttgctacataaggatggaggaatccctgatggatgttccctctacctccggcactcaagtttattcgcgcaaagcgaggaagaggagtcatgaccttttgggacagcggtg

SEQ ID NO: 439076 - DNA, 140 bp, Artificial Sequence
  Synthetic
caccgctgtcccaaaaggtcatgactcctcttcctcgctttgcgcgaataaacttgagtgccggaggtagagggaacatccatcagggattcctccatccttatgtagcaaccaagcgatcatatcagcagccagggcct

SEQ ID NO: 439077 - DNA, 140 bp, Artificial Sequence
  Synthetic
atacgccatgctgggtctcctatggtttggaaaactatgcttttgagcacgtagtgtatggagacttttctcatactacgttaggcggccttcatctacttataggtttgtataagaagccgtacttgggagtcggccat

SEQ ID NO: 439078 - DNA, 140 bp, Artificial Sequence
  Synthetic
atggccgactcccaagtacggcttcttatacaaacctataagtagatgaaggccgcctaacgtagtatgagaaaagtctccatacactacgtgctcaaaagcatagttttccaaaccataggagacccagcatggcgtat

SEQ ID NO: 439079 - DNA, 140 bp, Artificial Sequence
  Synthetic
atacgccatgctgggtctccaaaaggaaggtcatattattatggaagagatgctaaaaggtagttcaaccatccataactattttatcactgaaactaacacagcatcatttaaggcggtcgtacttgggagtcggccat

SEQ ID NO: 439080 - DNA, 140 bp, Artificial Sequence
  Synthetic
atggccgactcccaagtacgaccgccttaaatgatgctgtgttagtttcagtgataaaatagttatggatggttgaactaccttttagcatctcttccataataatatgaccttccttttggagacccagcatggcgtat

SEQ ID NO: 439081 - DNA, 140 bp, Artificial Sequence
  Synthetic
aggccctggctgctgatatgaaacccgtccagctagtcccagtttctcctgcatttcatcgcattgagtctactgactctattgttttcacatacattcctgctagcggctatgtagctggaccttttgggacagcggtg

SEQ ID NO: 439082 - DNA, 140 bp, Artificial Sequence
  Synthetic
caccgctgtcccaaaaggtccagctacatagccgctagcaggaatgtatgtgaaaacaatagagtcagtagactcaatgcgatgaaatgcaggagaaactgggactagctggacgggtttcatatcagcagccagggcct

SEQ ID NO: 439083 - DNA, 140 bp, Artificial Sequence
  Synthetic
atacgccatgctgggtctccgtgttcagttattgatttaaagcttgacgactttgtaatgatattaaaaagtcaagaccttggcgttgtatccaaggtagtcaaagttcctattgacttacgtacttgggagtcggccat

SEQ ID NO: 439084 - DNA, 140 bp, Artificial Sequence
  Synthetic
atggccgactcccaagtacgtaagtcaataggaactttgactaccttggatacaacgccaaggtcttgactttttaatatcattacaaagtcgtcaagctttaaatcaataactgaacacggagacccagcatggcgtat

SEQ ID NO: 439085 - DNA, 140 bp, Artificial Sequence
  Synthetic
aggccctggctgctgatatggtgaacagtgccccccgggaagagctctacagtgtgaaatgtaaataaaaatagctattattcaattagattaggctaattagatgatttgcaaaaaaaagaccttttgggacagcggtg

SEQ ID NO: 439086 - DNA, 140 bp, Artificial Sequence
  Synthetic
caccgctgtcccaaaaggtcttttttttgcaaatcatctaattagcctaatctaattgaataatagctatttttatttacatttcacactgtagagctcttcccggggggcactgttcaccatatcagcagccagggcct

SEQ ID NO: 439087 - DNA, 140 bp, Artificial Sequence
  Synthetic
atacgccatgctgggtctccacaatgattgagtttatgttatggtgtaaggatggacgggttcaaaccttctatccaagacttcaggcttctgcagattggaaatctggtcaagctatgccgtacttgggagtcggccat

SEQ ID NO: 439088 - DNA, 140 bp, Artificial Sequence
  Synthetic
atggccgactcccaagtacggcatagcttgaccagatttccaatctgcagaagcctgaagtcttggatagaaggtttgaacccgtccatccttacaccataacataaactcaatcattgtggagacccagcatggcgtat

SEQ ID NO: 439089 - DNA, 140 bp, Artificial Sequence
  Synthetic
atacgccatgctgggtctcctagcaactgttattcttcactgattttggattatttttcatacccacttagtatgaaatccgatctcagtgttagttctgctggtccaatatcccagtttcgtacttgggagtcggccat

SEQ ID NO: 439090 - DNA, 140 bp, Artificial Sequence
  Synthetic
atggccgactcccaagtacgaaactgggatattggaccagcagaactaacactgagatcggatttcatactaagtgggtatgaaaaataatccaaaatcagtgaagaataacagttgctaggagacccagcatggcgtat

SEQ ID NO: 439091 - DNA, 140 bp, Artificial Sequence
  Synthetic
aggccctggctgctgatatgtgcgtgcttgtgttagtgttcctgtttctgtcatctatgataaagaaactaaaacccacgctactctatttggtagtgttgcatgtgaacacatttcctcgaccttttgggacagcggtg

SEQ ID NO: 439092 - DNA, 140 bp, Artificial Sequence
  Synthetic
caccgctgtcccaaaaggtcgaggaaatgtgttcacatgcaacactaccaaatagagtagcgtgggttttagtttctttatcatagatgacagaaacaggaacactaacacaagcacgcacatatcagcagccagggcct

SEQ ID NO: 439093 - DNA, 140 bp, Artificial Sequence
  Synthetic
aggccctggctgctgatatgtaccatgtctcaatactcccgttctacgcgatcaatgcttaaacggcgagattctacatatggtccccttcagacacctgttggttgtgtcctaggacttgaccttttgggacagcggtg

SEQ ID NO: 439094 - DNA, 140 bp, Artificial Sequence
  Synthetic
caccgctgtcccaaaaggtcaagtcctaggacacaaccaacaggtgtctgaaggggaccatatgtagaatctcgccgtttaagcattgatcgcgtagaacgggagtattgagacatggtacatatcagcagccagggcct

SEQ ID NO: 439095 - DNA, 140 bp, Artificial Sequence
  Synthetic
atacgccatgctgggtctccggggctgtttgtagaaaacatgctgcagaatatagggattatatggaagcatataaccttgtatctgcgtctggtttccgcttatggtgttataagacctcgtacttgggagtcggccat

SEQ ID NO: 439096 - DNA, 140 bp, Artificial Sequence
  Synthetic
atggccgactcccaagtacgaggtcttataacaccataagcggaaaccagacgcagatacaaggttatatgcttccatataatccctatattctgcagcatgttttctacaaacagccccggagacccagcatggcgtat

SEQ ID NO: 439097 - DNA, 140 bp, Artificial Sequence
  Synthetic
atacgccatgctgggtctccaatagataatgacttaaatgagtttgtgtcagatgctgacataactttatttggagactgtgtaactgtacgtgttggacaacaagtggatcttgttatacgtacttgggagtcggccat

SEQ ID NO: 439098 - DNA, 140 bp, Artificial Sequence
  Synthetic
atggccgactcccaagtacgtataacaagatccacttgttgtccaacacgtacagttacacagtctccaaataaagttatgtcagcatctgacacaaactcatttaagtcattatctattggagacccagcatggcgtat

SEQ ID NO: 439099 - DNA, 140 bp, Artificial Sequence
  Synthetic
atacgccatgctgggtctccctcttgcagaactttgattttaacgaacttaaattaaagccctgttgtttagcgtattgtcgcacttgtctggtgggattgtggcattaatttgcctgctcgtacttgggagtcggccat

SEQ ID NO: 439100 - DNA, 140 bp, Artificial Sequence
  Synthetic
atggccgactcccaagtacgagcaggcaaattaatgccacaatcccaccagacaagtgcgacaatacgctaaacaacagggctttaatttaagttcgttaaaatcaaagttctgcaagagggagacccagcatggcgtat

SEQ ID NO: 439101 - DNA, 140 bp, Artificial Sequence
  Synthetic
atacgccatgctgggtctcctccgacatgtatgatcctactactaagaatttaacaggtagtaatgagtcaaaagctttattctttacttacctgtgtaacttcattaataataatcttgcgtacttgggagtcggccat

SEQ ID NO: 439102 - DNA, 140 bp, Artificial Sequence
  Synthetic
atggccgactcccaagtacgcaagattattattaatgaagttacacaggtaagtaaagaataaagcttttgactcattactacctgttaaattcttagtagtaggatcatacatgtcggaggagacccagcatggcgtat

SEQ ID NO: 439103 - DNA, 140 bp, Artificial Sequence
  Synthetic
atacgccatgctgggtctccctcttggtggttctgttgctataaaaataacagaacactcttggagcgttgaactttatgaactcatgggaaaatttgcgtggtggactgtgttctgcaccgtacttgggagtcggccat

SEQ ID NO: 439104 - DNA, 140 bp, Artificial Sequence
  Synthetic
atggccgactcccaagtacggtgcagaacacagtccaccacgcaaattttcccatgagttcataaagttcaacgctccaagagtgttctgttatttttatagcaacagaaccaccaagagggagacccagcatggcgtat

SEQ ID NO: 439105 - DNA, 140 bp, Artificial Sequence
  Synthetic
atacgccatgctgggtctccatttttgtttacctacattctccatggcgtcagttgaattttatgatgaccgcattctagaatttaaaattctagacaatggtatcattagggatattaacgtacttgggagtcggccat

SEQ ID NO: 439106 - DNA, 140 bp, Artificial Sequence
  Synthetic
atggccgactcccaagtacgttaatatccctaatgataccattgtctagaattttaaattctagaatgcggtcatcataaaattcaactgacgccatggagaatgtaggtaaacaaaaatggagacccagcatggcgtat

SEQ ID NO: 439107 - DNA, 140 bp, Artificial Sequence
  Synthetic
aggccctggctgctgatatgctttgattttaacgaacttaaataaaagccctgttgtttagcgtattgttgcacttgtctggtgggattgtggcattaatttgcctgctcatctaggcaggaccttttgggacagcggtg

SEQ ID NO: 439108 - DNA, 140 bp, Artificial Sequence
  Synthetic
caccgctgtcccaaaaggtcctgcctagatgagcaggcaaattaatgccacaatcccaccagacaagtgcaacaatacgctaaacaacagggcttttatttaagttcgttaaaatcaaagcatatcagcagccagggcct

SEQ ID NO: 439109 - DNA, 140 bp, Artificial Sequence
  Synthetic
atacgccatgctgggtctccatattctggagaaattcaactcctatgaatttgagcacttactcactttttgatttatccaagtttcaattaaaattaaaaggaacacctgttcttcaatcgtacttgggagtcggccat

SEQ ID NO: 439110 - DNA, 140 bp, Artificial Sequence
  Synthetic
atggccgactcccaagtacgattgaagaacaggtgttccttttaattttaattgaaacttggataaatcaaaaagtgagtaagtgctcaaattcataggagttgaatttctccagaatatggagacccagcatggcgtat

SEQ ID NO: 439111 - DNA, 140 bp, Artificial Sequence
  Synthetic
aggccctggctgctgatatggttaaagactgtcacctctgcgtgattgcaagtgaacagtgccccccgggaagagctctacagtgtgaaatgtaaataaaaatagctattattcaattaggaccttttgggacagcggtg

SEQ ID NO: 439112 - DNA, 140 bp, Artificial Sequence
  Synthetic
caccgctgtcccaaaaggtcctaattgaataatagctatttttatttacatttcacactgtagagctcttcccggggggcactgttcacttgcaatcacgcagaggtgacagtctttaaccatatcagcagccagggcct

SEQ ID NO: 439113 - DNA, 140 bp, Artificial Sequence
  Synthetic
atacgccatgctgggtctcctaaaggagagtcagattaacgaacttgtaatatctctcctgtcacagggtaaattacttatccgtgacaatgacgtactcagtgtttccactgatgtgctcgtacttgggagtcggccat

SEQ ID NO: 439114 - DNA, 140 bp, Artificial Sequence
  Synthetic
atggccgactcccaagtacgagcacatcagtggaaacactgagtacgtcattgtcacggataagtaatttaccctgtgacaggagagatattacaagttcgttaatctgactctcctttaggagacccagcatggcgtat

SEQ ID NO: 439115 - DNA, 140 bp, Artificial Sequence
  Synthetic
aggccctggctgctgatatgtctactacactggaactggacccgaagcagcactcccattccgggctgttaaggatggcatcgtttgggtccatgaacatggcgccactgatgctccttcgaccttttgggacagcggtg

SEQ ID NO: 439116 - DNA, 140 bp, Artificial Sequence
  Synthetic
caccgctgtcccaaaaggtcgaaggagcatcagtggcgccatgttcatggacccaaacgatgccatccttaacagcccggaatgggagtgctgcttcgggtccagttccagtgtagtagacatatcagcagccagggcct

SEQ ID NO: 439117 - DNA, 140 bp, Artificial Sequence
  Synthetic
atacgccatgctgggtctccatcgtaattatgtttttactggttatcatataaccaaaaatagtaaagtgcagctcggtgagtacatcttcgagcgcattgattatagtgatgctgtatccgtacttgggagtcggccat

SEQ ID NO: 439118 - DNA, 140 bp, Artificial Sequence
  Synthetic
atggccgactcccaagtacggatacagcatcactataatcaatgcgctcgaagatgtactcaccgagctgcactttactatttttggttatatgataaccagtaaaaacataattacgatggagacccagcatggcgtat

SEQ ID NO: 439119 - DNA, 140 bp, Artificial Sequence
  Synthetic
aggccctggctgctgatatgactcttgcacagaatggaatcatgttgtaattacagtgcaataaggtaattataacccatttaattgatagctatgctttattaaagtgtgtagctgtaggaccttttgggacagcggtg

SEQ ID NO: 439120 - DNA, 140 bp, Artificial Sequence
  Synthetic
caccgctgtcccaaaaggtcctacagctacacactttaataaagcatagctatcaattaaatgggttataattaccttattgcactgtaattacaacatgattccattctgtgcaagagtcatatcagcagccagggcct

SEQ ID NO: 439121 - DNA, 140 bp, Artificial Sequence
  Synthetic
atacgccatgctgggtctccacaacataactggcctgaaccaattgatatgaataaagcagacggtgtcatttatccaaacggccgtacttattctaatattacattacagacaacaaatcgtacttgggagtcggccat

SEQ ID NO: 439122 - DNA, 140 bp, Artificial Sequence
  Synthetic
atggccgactcccaagtacgatttgttgtctgtaatgtaatattagaataagtacggccgtttggataaatgacaccgtctgctttattcatatcaattggttcaggccagttatgttgtggagacccagcatggcgtat

SEQ ID NO: 439123 - DNA, 140 bp, Artificial Sequence
  Synthetic
atacgccatgctgggtctccctgtttcctaagaacggtgatttaggcactcaatatgtctattcagcgtccaatcataaaagcactgctaatgatgcttttattagtaattattcatactcgtacttgggagtcggccat

SEQ ID NO: 439124 - DNA, 140 bp, Artificial Sequence
  Synthetic
atggccgactcccaagtacgagtatgaataattactaataaaagcatcattagcagtgcttttatgattggacgctgaatagacatattgagtgcctaaatcaccgttcttaggaaacagggagacccagcatggcgtat

SEQ ID NO: 439125 - DNA, 140 bp, Artificial Sequence
  Synthetic
atacgccatgctgggtctccatggcaatccatttggtgatggaattgtcatacgtattggtcaaaatgctaataagactggcagtgtaattgtaggacaagcacagactactatgaaaaacgtacttgggagtcggccat

SEQ ID NO: 439126 - DNA, 140 bp, Artificial Sequence
  Synthetic
atggccgactcccaagtacgtttttcatagtagtctgtgcttgtcctacaattacactgccagtcttattagcattttgaccaatacgtatgacaattccatcaccaaatggattgccatggagacccagcatggcgtat

SEQ ID NO: 439127 - DNA, 140 bp, Artificial Sequence
  Synthetic
aggccctggctgctgatatgactcctttggccgtagatgttgtctccatacggtcttccaatcagggtaataaacaaattgttcattcttaccccattttacatcatccaggattttaacgaccttttgggacagcggtg

SEQ ID NO: 439128 - DNA, 140 bp, Artificial Sequence
  Synthetic
caccgctgtcccaaaaggtcgttaaaatcctggatgatgtaaaatggggtaagaatgaacaatttgtttattaccctgattggaagaccgtatggagacaacatctacggccaaaggagtcatatcagcagccagggcct

SEQ ID NO: 439129 - DNA, 140 bp, Artificial Sequence
  Synthetic
aggccctggctgctgatatgtttattactgccaatccggcatggagtaaggcagtctttatttcgccttacaattcacagaatgctgtgtctcgttcaatgctgggtcttaccactcagagaccttttgggacagcggtg

SEQ ID NO: 439130 - DNA, 140 bp, Artificial Sequence
  Synthetic
caccgctgtcccaaaaggtctctgagtggtaagacccagcattgaacgagacacagcattctgtgaattgtaaggcgaaataaagactgccttactccatgccggattggcagtaataaacatatcagcagccagggcct

SEQ ID NO: 439131 - DNA, 140 bp, Artificial Sequence
  Synthetic
atacgccatgctgggtctccaagtgtggaactgtcttccaagttgcctattgtttacttcagcctcgcactgagtctaagtgtccaggcaatagtaactatgttagttactttttagccgcgtacttgggagtcggccat

SEQ ID NO: 439132 - DNA, 140 bp, Artificial Sequence
  Synthetic
atggccgactcccaagtacgcggctaaaaagtaactaacatagttactattgcctggacacttagactcagtgcgaggctgaagtaaacaataggcaacttggaagacagttccacacttggagacccagcatggcgtat

SEQ ID NO: 439133 - DNA, 140 bp, Artificial Sequence
  Synthetic
aggccctggctgctgatatgttacgtgtctctgcttaatcaaatttggcagaagtaccttaattcaccgtatactacttgtttgtatatccctaaacccacagctaagtatacacctttagaccttttgggacagcggtg

SEQ ID NO: 439134 - DNA, 140 bp, Artificial Sequence
  Synthetic
caccgctgtcccaaaaggtctaaaggtgtatacttagctgtgggtttagggatatacaaacaagtagtatacggtgaattaaggtacttctgccaaatttgattaagcagagacacgtaacatatcagcagccagggcct

SEQ ID NO: 439135 - DNA, 140 bp, Artificial Sequence
  Synthetic
atacgccatgctgggtctccagagtttaatgtcacagcagacgaaagggcagagtggtttggcatcgtgcaggatgctcaaggtgtccacctgtacacttcgcgtaaaaatggtttcaatcgtacttgggagtcggccat

SEQ ID NO: 439136 - DNA, 140 bp, Artificial Sequence
  Synthetic
atggccgactcccaagtacgattgaaaccatttttacgcgaagtgtacaggtggacaccttgagcatcctgcacgatgccaaaccactctgccctttcgtctgctgtgacattaaactctggagacccagcatggcgtat

SEQ ID NO: 439137 - DNA, 140 bp, Artificial Sequence
  Synthetic
atacgccatgctgggtctccggaagaggagccattctccaactaagaaactgcgctacgttaagcgtagattttctcttctgcgccctgaagaccttagtgttattgtccaaccaacacacgtacttgggagtcggccat

SEQ ID NO: 439138 - DNA, 140 bp, Artificial Sequence
  Synthetic
atggccgactcccaagtacgtgtgttggttggacaataacactaaggtcttcagggcgcagaagagaaaatctacgcttaacgtagcgcagtttcttagttggagaatggctcctcttccggagacccagcatggcgtat

SEQ ID NO: 439139 - DNA, 140 bp, Artificial Sequence
  Synthetic
atacgccatgctgggtctcctcaaacaatttatttttgtttgccactgtacccatatatgataagcttaattactacacggtaatacctcgttccgttattacaccgtctaaccaacgtgcgtacttgggagtcggccat

SEQ ID NO: 439140 - DNA, 140 bp, Artificial Sequence
  Synthetic
atggccgactcccaagtacgcacgttggttagacggtgtaataacggaacgaggtattaccgtgtagtaattaagcttatcatatatgggtacagtggcaaacaaaaataaattgtttgaggagacccagcatggcgtat

SEQ ID NO: 439141 - DNA, 140 bp, Artificial Sequence
  Synthetic
atacgccatgctgggtctccatgcttgggcggcgttttacatatatccactacatcaacttagctacttgctaaactttgacgtcaatggttatattacccaggctgcagattgtgggtacgtacttgggagtcggccat

SEQ ID NO: 439142 - DNA, 140 bp, Artificial Sequence
  Synthetic
atggccgactcccaagtacgtacccacaatctgcagcctgggtaatataaccattgacgtcaaagtttagcaagtagctaagttgatgtagtggatatatgtaaaacgccgcccaagcatggagacccagcatggcgtat

SEQ ID NO: 439143 - DNA, 140 bp, Artificial Sequence
  Synthetic
atacgccatgctgggtctcctaatgattacacccagcttatctgttcgtatggtgattttaatatgaagtctggtgtatactcaacctcatactattcggctaaacctgtaggcgcatatcgtacttgggagtcggccat

SEQ ID NO: 439144 - DNA, 140 bp, Artificial Sequence
  Synthetic
atggccgactcccaagtacgatatgcgcctacaggtttagccgaatagtatgaggttgagtatacaccagacttcatattaaaatcaccatacgaacagataagctgggtgtaatcattaggagacccagcatggcgtat

SEQ ID NO: 439145 - DNA, 140 bp, Artificial Sequence
  Synthetic
atacgccatgctgggtctcctatgaggctcatgtgtaccccgattgcaattttactgaattgtttagggaaagagcccctacaatcatgcagtataagcgtgaagtttttacgcgttgtacgtacttgggagtcggccat

SEQ ID NO: 439146 - DNA, 140 bp, Artificial Sequence
  Synthetic
atggccgactcccaagtacgtacaacgcgtaaaaacttcacgcttatactgcatgattgtaggggctctttccctaaacaattcagtaaaattgcaatcggggtacacatgagcctcataggagacccagcatggcgtat

SEQ ID NO: 439147 - DNA, 140 bp, Artificial Sequence
  Synthetic
aggccctggctgctgatatgcatctcaggcactctttgagtccttagagtttactgaattgtcttttactaattacaagctccagtctcagattgtaactggcctttttaaagattgctcgaccttttgggacagcggtg

SEQ ID NO: 439148 - DNA, 140 bp, Artificial Sequence
  Synthetic
caccgctgtcccaaaaggtcgagcaatctttaaaaaggccagttacaatctgagactggagcttgtaattagtaaaagacaattcagtaaactctaaggactcaaagagtgcctgagatgcatatcagcagccagggcct

SEQ ID NO: 439149 - DNA, 140 bp, Artificial Sequence
  Synthetic
atacgccatgctgggtctccaacagtcgattggtttgcttttccttatgcttggaaatcttaccttgctataggttctgctgaccgtatcgtacgttttaattataaccaggactatagtcgtacttgggagtcggccat

SEQ ID NO: 439150 - DNA, 140 bp, Artificial Sequence
  Synthetic
atggccgactcccaagtacgactatagtcctggttataattaaaacgtacgatacggtcagcagaacctatagcaaggtaagatttccaagcataaggaaaagcaaaccaatcgactgttggagacccagcatggcgtat

SEQ ID NO: 439151 - DNA, 140 bp, Artificial Sequence
  Synthetic
atacgccatgctgggtctccaatccctcttgtcgaattcattctaaagtgaattcttcgataggaatttcatatgctggtgcatacagttatataactaactgcaattatggagccacaacgtacttgggagtcggccat

SEQ ID NO: 439152 - DNA, 140 bp, Artificial Sequence
  Synthetic
atggccgactcccaagtacgttgtggctccataattgcagttagttatataactgtatgcaccagcatatgaaattcctatcgaagaattcactttagaatgaattcgacaagagggattggagacccagcatggcgtat

SEQ ID NO: 439153 - DNA, 140 bp, Artificial Sequence
  Synthetic
atacgccatgctgggtctccataaagacgatgttgttaaaccgggagggcgcgccagtcaacaatgtattactggtgctcttaactctcctacaactggtcaactttgggcttataatttcgtacttgggagtcggccat

SEQ ID NO: 439154 - DNA, 140 bp, Artificial Sequence
  Synthetic
atggccgactcccaagtacgaaattataagcccaaagttgaccagttgtaggagagttaagagcaccagtaatacattgttgactggcgcgccctcccggtttaacaacatcgtctttatggagacccagcatggcgtat

SEQ ID NO: 439155 - DNA, 140 bp, Artificial Sequence
  Synthetic
atacgccatgctgggtctcctgggggcgttccttacagagtgtcacgccttacttatacggaccatcttagtgatccactagatatggtctatgttattacagttaaatatgaaccaggacgtacttgggagtcggccat

SEQ ID NO: 439156 - DNA, 140 bp, Artificial Sequence
  Synthetic
atggccgactcccaagtacgtcctggttcatatttaactgtaataacatagaccatatctagtggatcactaagatggtccgtataagtaaggcgtgacactctgtaaggaacgcccccaggagacccagcatggcgtat

SEQ ID NO: 439157 - DNA, 140 bp, Artificial Sequence
  Synthetic
atacgccatgctgggtctccgcagaaactgtttgtcccaaacagatacgccctgattatagtaccaacattactcatttgttaggttcatgtattagctatgacatttatggcataacagcgtacttgggagtcggccat

SEQ ID NO: 439158 - DNA, 140 bp, Artificial Sequence
  Synthetic
atggccgactcccaagtacgctgttatgccataaatgtcatagctaatacatgaacctaacaaatgagtaatgttggtactataatcagggcgtatctgtttgggacaaacagtttctgcggagacccagcatggcgtat

SEQ ID NO: 439159 - DNA, 140 bp, Artificial Sequence
  Synthetic
atacgccatgctgggtctccgcacgggtgtttttcagctatgcaatgcaactggaatacgccagcaaaaatttgtctatgacaaatttgataatataattggttttcactctgatgacggcgtacttgggagtcggccat

SEQ ID NO: 439160 - DNA, 140 bp, Artificial Sequence
  Synthetic
atggccgactcccaagtacgccgtcatcagagtgaaaaccaattatattatcaaatttgtcatagacaaatttttgctggcgtattccagttgcattgcatagctgaaaaacacccgtgcggagacccagcatggcgtat

SEQ ID NO: 439161 - DNA, 140 bp, Artificial Sequence
  Synthetic
atacgccatgctgggtctcccaattactactgtgtagcaccctgtgttagtgtgcctgtttcagtgatatatgatgacaaaactaatcaatatgctaccttgtttggtagtgttgcttgtcgtacttgggagtcggccat

SEQ ID NO: 439162 - DNA, 140 bp, Artificial Sequence
  Synthetic
atggccgactcccaagtacgacaagcaacactaccaaacaaggtagcatattgattagttttgtcatcatatatcactgaaacaggcacactaacacagggtgctacacagtagtaattgggagacccagcatggcgtat

SEQ ID NO: 439163 - DNA, 140 bp, Artificial Sequence
  Synthetic
aggccctggctgctgatatgatttaagtgaatagcttggctatctcacttcccctcgttctcttgcagaactttgattttaacgaacttaaataaaagccctgttgtttagcgtattgttgaccttttgggacagcggtg

SEQ ID NO: 439164 - DNA, 140 bp, Artificial Sequence
  Synthetic
caccgctgtcccaaaaggtcaacaatacgctaaacaacagggcttttatttaagttcgttaaaatcaaagttctgcaagagaacgaggggaagtgagatagccaagctattcacttaaatcatatcagcagccagggcct

SEQ ID NO: 439165 - DNA, 140 bp, Artificial Sequence
  Synthetic
atacgccatgctgggtctcccaacatatatctacaatggctgctcagttttctcgtgaaactagagcttctcttgtttcaagaaacatgcaaaatcttcttcaaacttcggttggttgtgcgtacttgggagtcggccat

SEQ ID NO: 439166 - DNA, 140 bp, Artificial Sequence
  Synthetic
atggccgactcccaagtacgcacaaccaaccgaagtttgaagaagattttgcatgtttcttgaaacaagagaagctctagtttcacgagaaaactgagcagccattgtagatatatgttgggagacccagcatggcgtat

SEQ ID NO: 439167 - DNA, 140 bp, Artificial Sequence
  Synthetic
aggccctggctgctgatatggcacttgtctggtgggattgtggcattaatttgcctgctcatctaggcagtggacatatgctcaacactgggtataattctaattgaatactatttttcagaccttttgggacagcggtg

SEQ ID NO: 439168 - DNA, 140 bp, Artificial Sequence
  Synthetic
caccgctgtcccaaaaggtctgaaaaatagtattcaattagaattatacccagtgttgagcatatgtccactgcctagatgagcaggcaaattaatgccacaatcccaccagacaagtgccatatcagcagccagggcct

SEQ ID NO: 439169 - DNA, 140 bp, Artificial Sequence
  Synthetic
atacgccatgctgggtctccgtttcgggatgctgaaggccgtatgacaccatactgccatgatcctactgttttacctggggctttcgcgtatagtcagatgaagccccatgtccgctatcgtacttgggagtcggccat

SEQ ID NO: 439170 - DNA, 140 bp, Artificial Sequence
  Synthetic
atggccgactcccaagtacgatagcggacatggggcttcatctgactatacgcgaaagccccaggtaaaacagtaggatcatggcagtatggtgtcatacggccttcagcatcccgaaacggagacccagcatggcgtat

SEQ ID NO: 439171 - DNA, 140 bp, Artificial Sequence
  Synthetic
atacgccatgctgggtctccacgttccacctttggactaggttctctagcttataatagtcctttgcgtgttgatgcccttaactcctcggagtttaaggtgtccttgccgcttaattttcgtacttgggagtcggccat

SEQ ID NO: 439172 - DNA, 140 bp, Artificial Sequence
  Synthetic
atggccgactcccaagtacgaaaattaagcggcaaggacaccttaaactccgaggagttaagggcatcaacacgcaaaggactattataagctagagaacctagtccaaaggtggaacgtggagacccagcatggcgtat

SEQ ID NO: 439173 - DNA, 140 bp, Artificial Sequence
  Synthetic
atacgccatgctgggtctccacatttggtgttacacaagaatatattgagactagcatacagaagattacagttgactgtaagcagtatgtatgtaatggttttgctaagtgtgagaaaccgtacttgggagtcggccat

SEQ ID NO: 439174 - DNA, 140 bp, Artificial Sequence
  Synthetic
atggccgactcccaagtacggtttctcacacttagcaaaaccattacatacatactgcttacagtcaactgtaatcttctgtatgctagtctcaatatattcttgtgtaacaccaaatgtggagacccagcatggcgtat

SEQ ID NO: 439175 - DNA, 140 bp, Artificial Sequence
  Synthetic
aggccctggctgctgatatgtattttggaactgtaatgtaccaaaatatcctaataatgcaattgtatgcaggtttgacacacgtgtgcattctgagttcaatttgccaggttgtgatgggaccttttgggacagcggtg

SEQ ID NO: 439176 - DNA, 140 bp, Artificial Sequence
  Synthetic
caccgctgtcccaaaaggtcccatcacaacctggcaaattgaactcagaatgcacacgtgtgtcaaacctgcatacaattgcattattaggatattttggtacattacagttccaaaatacatatcagcagccagggcct

SEQ ID NO: 439177 - DNA, 140 bp, Artificial Sequence
  Synthetic
atacgccatgctgggtctccgtgcttctgggctcttacccaaacctagtaattatgtttggttgtctgagtgttaccagaacagtttcactgggaaaaattttcagtatgttaaggctggcgtacttgggagtcggccat

SEQ ID NO: 439178 - DNA, 140 bp, Artificial Sequence
  Synthetic
atggccgactcccaagtacgccagccttaacatactgaaaatttttcccagtgaaactgttctggtaacactcagacaaccaaacataattactaggtttgggtaagagcccagaagcacggagacccagcatggcgtat

SEQ ID NO: 439179 - DNA, 140 bp, Artificial Sequence
  Synthetic
atacgccatgctgggtctcctaaaacacctcagacagttcctcttactacgggctttggtggtgaattcaacctcaccctccttgagccgctttctgtttctactggttcttctaatgcacgtacttgggagtcggccat

SEQ ID NO: 439180 - DNA, 140 bp, Artificial Sequence
  Synthetic
atggccgactcccaagtacgtgcattagaagaaccagtagaaacagaaagcggctcaaggagggtgaggttgaattcaccaccaaagcccgtagtaagaggaactgtctgaggtgttttaggagacccagcatggcgtat

SEQ ID NO: 439181 - DNA, 140 bp, Artificial Sequence
  Synthetic
atacgccatgctgggtctcccggagcgctttggaggaattattatttgatagtgtcacaatagctgacccaggttacatgcaaggttatgacgactgcatgcaacaagggcctgcgtctgcgtacttgggagtcggccat

SEQ ID NO: 439182 - DNA, 140 bp, Artificial Sequence
  Synthetic
atggccgactcccaagtacgcagacgcaggcccttgttgcatgcagtcgtcataaccttgcatgtaacctgggtcagctattgtgacactatcaaataataattcctccaaagcgctccgggagacccagcatggcgtat

SEQ ID NO: 439183 - DNA, 140 bp, Artificial Sequence
  Synthetic
aggccctggctgctgatatggccccccgggaagagctctacagtgtgaaatgtaaataaaaatagctattattcaattagattaggctaattagatgatttgcaaaaaaaaaaaaaaaaagaccttttgggacagcggtg

SEQ ID NO: 439184 - DNA, 140 bp, Artificial Sequence
  Synthetic
caccgctgtcccaaaaggtctttttttttttttttttgcaaatcatctaattagcctaatctaattgaataatagctatttttatttacatttcacactgtagagctcttcccggggggccatatcagcagccagggcct

SEQ ID NO: 439185 - DNA, 140 bp, Artificial Sequence
  Synthetic
atacgccatgctgggtctccctagagatcttatctgtgctcagtatgtagctggttataaagtgttacctcctcttatggatgttaacatggaggctgcatacacatcttctttgcttggcgtacttgggagtcggccat

SEQ ID NO: 439186 - DNA, 140 bp, Artificial Sequence
  Synthetic
atggccgactcccaagtacgccaagcaaagaagatgtgtatgcagcctccatgttaacatccataagaggaggtaacactttataaccagctacatactgagcacagataagatctctagggagacccagcatggcgtat

SEQ ID NO: 439187 - DNA, 140 bp, Artificial Sequence
  Synthetic
atacgccatgctgggtctcctagtattgcaggtgcgggctggacagctggcctttcatcgtttgctgccattccttttgcacagagtatattttacaggttgaatggtgttggcataacacgtacttgggagtcggccat

SEQ ID NO: 439188 - DNA, 140 bp, Artificial Sequence
  Synthetic
atggccgactcccaagtacgtgttatgccaacaccattcaacctgtaaaatatactctgtgcaaaaggaatggcagcaaacgatgaaaggccagctgtccagcccgcacctgcaatactaggagacccagcatggcgtat

SEQ ID NO: 439189 - DNA, 140 bp, Artificial Sequence
  Synthetic
aggccctggctgctgatatgtcggatgcacttaaacgacagattcgcattgcatgccgtaagtgtaatttagctttccggttaacctccatgaccatgcctaagacttgtttcggacccagaccttttgggacagcggtg

SEQ ID NO: 439190 - DNA, 140 bp, Artificial Sequence
  Synthetic
caccgctgtcccaaaaggtctgggtccgaaacaagtcttaggcatggtcatggaggttaaccggaaagctaaattacacttacggcatgcaatgcgaatctgtcgtttaagtgcatccgacatatcagcagccagggcct

SEQ ID NO: 439191 - DNA, 140 bp, Artificial Sequence
  Synthetic
aggccctggctgctgatatgaaaatgggccgcttcttcaatcatactctagttcttttgcccgatggatgtggcactttacttagagctttttattgtattctagagcctcgctctggaagaccttttgggacagcggtg

SEQ ID NO: 439192 - DNA, 140 bp, Artificial Sequence
  Synthetic
caccgctgtcccaaaaggtcttccagagcgaggctctagaatacaataaaaagctctaagtaaagtgccacatccatcgggcaaaagaactagagtatgattgaagaagcggcccattttcatatcagcagccagggcct

SEQ ID NO: 439193 - DNA, 140 bp, Artificial Sequence
  Synthetic
aggccctggctgctgatatgtctttacaggctgtactggctcttggaacaaggttactcaaattgctaacatgttcttggaacagactcagcattcccttaactttgtgggagagttcgtgaccttttgggacagcggtg

SEQ ID NO: 439194 - DNA, 140 bp, Artificial Sequence
  Synthetic
caccgctgtcccaaaaggtcacgaactctcccacaaagttaagggaatgctgagtctgttccaagaacatgttagcaatttgagtaaccttgttccaagagccagtacagcctgtaaagacatatcagcagccagggcct

SEQ ID NO: 439195 - DNA, 140 bp, Artificial Sequence
  Synthetic
atacgccatgctgggtctcccatcattcaacgtcttgatgttctcgaacaggaggttcaaatagacagacttattaatggccggttaacaacccttaatgccttcgttgctcagcagcttcgtacttgggagtcggccat

SEQ ID NO: 439196 - DNA, 140 bp, Artificial Sequence
  Synthetic
atggccgactcccaagtacgaagctgctgagcaacgaaggcattaagggttgttaaccggccattaataagtctgtctatttgaacctcctgttcgagaacatcaagacgttgaatgatgggagacccagcatggcgtat

SEQ ID NO: 439197 - DNA, 140 bp, Artificial Sequence
  Synthetic
atacgccatgctgggtctccccgtgtactttcttagatacagtggagccataaaacttgatcccaagaaccccaactaccagaagtggatggagctgcttgaggcaaacattgatgcctacgtacttgggagtcggccat

SEQ ID NO: 439198 - DNA, 140 bp, Artificial Sequence
  Synthetic
atggccgactcccaagtacgtaggcatcaatgtttgcctcaagcagctccatccacttctggtagttggggttcttgggatcaagttttatggctccactgtatctaagaaagtacacggggagacccagcatggcgtat

SEQ ID NO: 439199 - DNA, 140 bp, Artificial Sequence
  Synthetic
atacgccatgctgggtctccgttcgttctgaatctgctgctcgctcggcacagttggctaaggataaagtcaacgagtgcgttaaatcccagtccactaggtctggcttttgtggtcaagcgtacttgggagtcggccat

SEQ ID NO: 439200 - DNA, 140 bp, Artificial Sequence
  Synthetic
atggccgactcccaagtacgcttgaccacaaaagccagacctagtggactgggatttaacgcactcgttgactttatccttagccaactgtgccgagcgagcagcagattcagaacgaacggagacccagcatggcgtat

SEQ ID NO: 439201 - DNA, 140 bp, Artificial Sequence
  Synthetic
atacgccatgctgggtctccgtagttgtgagtatgcgcaagagggtgtttgtattactacaaatggctcatgggctatttttaatgagtaccacattaatagacctggtgtctattgtggcgtacttgggagtcggccat

SEQ ID NO: 439202 - DNA, 140 bp, Artificial Sequence
  Synthetic
atggccgactcccaagtacgccacaatagacaccaggtctattaatgtggtactcattaaaaatagcccatgagccatttgtagtaatacaaacaccctcttgcgcatactcacaactacggagacccagcatggcgtat

SEQ ID NO: 439203 - DNA, 140 bp, Artificial Sequence
  Synthetic
atacgccatgctgggtctccaagttctacttgtataagaaagtcaataatgagtttattgatcctactgagtgtatttacactcagagtcgctcttgtagtgacttcctacccctgtctgcgtacttgggagtcggccat

SEQ ID NO: 439204 - DNA, 140 bp, Artificial Sequence
  Synthetic
atggccgactcccaagtacgcagacaggggtaggaagtcactacaagagcgactctgagtgtaaatacactcagtaggatcaataaactcattattgactttcttatacaagtagaacttggagacccagcatggcgtat

SEQ ID NO: 439205 - DNA, 140 bp, Artificial Sequence
  Synthetic
atacgccatgctgggtctcctggtctttgtgactcagccaaccctactaattgtatagccccagttaacggctactttattaaaaatcaaactactaggagtgctgatgaatggtcttaccgtacttgggagtcggccat

SEQ ID NO: 439206 - DNA, 140 bp, Artificial Sequence
  Synthetic
atggccgactcccaagtacggtaagaccattcatcagcactcctagtagtttgatttttaataaagtagccgttaactggggctatacaattagtagggttggctgagtcacaaagaccaggagacccagcatggcgtat

SEQ ID NO: 439207 - DNA, 140 bp, Artificial Sequence
  Synthetic
atacgccatgctgggtctccggcagtcccccatattaaggagtggcttaaaattcatgggtacaccatttataatagtcaccttcctctacatctttctgtttctaagctgcacgacctacgtacttgggagtcggccat

SEQ ID NO: 439208 - DNA, 140 bp, Artificial Sequence
  Synthetic
atggccgactcccaagtacgtaggtcgtgcagcttagaaacagaaagatgtagaggaaggtgactattataaatggtgtacccatgaattttaagccactccttaatatgggggactgccggagacccagcatggcgtat

SEQ ID NO: 439209 - DNA, 140 bp, Artificial Sequence
  Synthetic
atacgccatgctgggtctccacaggttcttctttttatgcacctgagcccatcaccactcttaatacaaggtatgttgcacctcaagtaacattccagaacatctctaataacctccctccgtacttgggagtcggccat

SEQ ID NO: 439210 - DNA, 140 bp, Artificial Sequence
  Synthetic
atggccgactcccaagtacggagggaggttattagagatgttctggaatgttacttgaggtgcaacataccttgtattaagagtggtgatgggctcaggtgcataaaaagaagaacctgtggagacccagcatggcgtat

SEQ ID NO: 439211 - DNA, 140 bp, Artificial Sequence
  Synthetic
aggccctggctgctgatatgctatccaagacttcaggcttctgcagattggaaatctggtcaagctatgccatccttgtttaaggtacagaatgtaaaccttgaacgttgtgagcttgctgaccttttgggacagcggtg

SEQ ID NO: 439212 - DNA, 140 bp, Artificial Sequence
  Synthetic
caccgctgtcccaaaaggtcagcaagctcacaacgttcaaggtttacattctgtaccttaaacaaggatggcatagcttgaccagatttccaatctgcagaagcctgaagtcttggatagcatatcagcagccagggcct

SEQ ID NO: 439213 - DNA, 140 bp, Artificial Sequence
  Synthetic
atacgccatgctgggtctccctcctttgcttagtaattctactggcacagatttcaaggatgagttggacgagtttttcaaaaatgttagcaccaatataccaaattttggtgctttaaccgtacttgggagtcggccat

SEQ ID NO: 439214 - DNA, 140 bp, Artificial Sequence
  Synthetic
atggccgactcccaagtacggttaaagcaccaaaatttggtatattggtgctaacatttttgaaaaactcgtccaactcatccttgaaatctgtgccagtagaattactaagcaaaggagggagacccagcatggcgtat

SEQ ID NO: 439215 - DNA, 140 bp, Artificial Sequence
  Synthetic
atacgccatgctgggtctccacagattaatactaccctacttgatcttagtggtgagatgttagctcttcaggaggttgttaaagctcttaatgagtcttacatagaccttaaagagcttcgtacttgggagtcggccat

SEQ ID NO: 439216 - DNA, 140 bp, Artificial Sequence
  Synthetic
atggccgactcccaagtacgaagctctttaaggtctatgtaagactcattaagagctttaacaacctcctgaagagctaacatctcaccactaagatcaagtagggtagtattaatctgtggagacccagcatggcgtat

SEQ ID NO: 439217 - DNA, 140 bp, Artificial Sequence
  Synthetic
atacgccatgctgggtctccggcaactatacttattacaacaaatggccgtggtacatttggcttggttttattgctggactcttagctctagctttatgtgttttcttcatactgtgttcgtacttgggagtcggccat

SEQ ID NO: 439218 - DNA, 140 bp, Artificial Sequence
  Synthetic
atggccgactcccaagtacgaacacagtatgaagaaaacacataaagctagagctaagagtccagcaataaaaccaagccaaatgtaccacggccatttgttgtaataagtatagttgccggagacccagcatggcgtat

SEQ ID NO: 439219 - DNA, 140 bp, Artificial Sequence
  Synthetic
atacgccatgctgggtctccttcatgggccatttttaatgatttccatgccaataggccgggtgtctattgtggatttgattatcttgacattgtcaggaggcttgcattgggtgtattccgtacttgggagtcggccat

SEQ ID NO: 439220 - DNA, 140 bp, Artificial Sequence
  Synthetic
atggccgactcccaagtacggaatacacccaatgcaagcctcctgacaatgtcaagataatcaaatccacaatagacacccggcctattggcatggaaatcattaaaaatggcccatgaaggagacccagcatggcgtat

SEQ ID NO: 439221 - DNA, 140 bp, Artificial Sequence
  Synthetic
atacgccatgctgggtctccgcacaggttgtggcacaagttgcttgggaaaacttaaatgtaaccgttgttgtgataaatatgaagaatacgacctcgagccgcataagattcatgttcacgtacttgggagtcggccat

SEQ ID NO: 439222 - DNA, 140 bp, Artificial Sequence
  Synthetic
atggccgactcccaagtacgtgaacatgaatcttatgcggctcgaggtcgtattcttcatatttatcacaacaacggttacatttaagttttcccaagcaacttgtgccacaacctgtgcggagacccagcatggcgtat

SEQ ID NO: 439223 - DNA, 140 bp, Artificial Sequence
  Synthetic
atacgccatgctgggtctccctaattaacgaacttccaatgagagtccaaagaccacctactcttttgttagtggtaacactctcgcttttggccaatgctttttcaaaacccttttatgcgtacttgggagtcggccat

SEQ ID NO: 439224 - DNA, 140 bp, Artificial Sequence
  Synthetic
atggccgactcccaagtacgcataaaagggttttgaaaaagcattggccaaaagcgagagtgttaccactaacaaaagagtaggtggtctttggactctcattggaagttcgttaattagggagacccagcatggcgtat

SEQ ID NO: 439225 - DNA, 140 bp, Artificial Sequence
  Synthetic
atacgccatgctgggtctcctacctgaacattgccagaattattctggtcgtatgctcagagcttgtattaggactgcccaaactgatactgttggtttgtacacaaatcttagaattgacgtacttgggagtcggccat

SEQ ID NO: 439226 - DNA, 140 bp, Artificial Sequence
  Synthetic
atggccgactcccaagtacgtcaattctaagatttgtgtacaaaccaacagtatcagtttgggcagtcctaatacaagctctgagcatacgaccagaataattctggcaatgttcaggtaggagacccagcatggcgtat

SEQ ID NO: 439227 - DNA, 140 bp, Artificial Sequence
  Synthetic
aggccctggctgctgatatgtggcggtggtatcgctggtgctattaatgcggcttcaaaggggctgtccaaaaagagtcagatgagtatattctggctaaagggccgttacaagtaggaggaccttttgggacagcggtg

SEQ ID NO: 439228 - DNA, 140 bp, Artificial Sequence
  Synthetic
caccgctgtcccaaaaggtcctcctacttgtaacggccctttagccagaatatactcatctgactctttttggacagcccctttgaagccgcattaatagcaccagcgataccaccgccacatatcagcagccagggcct

SEQ ID NO: 439229 - DNA, 140 bp, Artificial Sequence
  Synthetic
atacgccatgctgggtctcctttcccatctacagaatctactgacacagagtcagttactgttgatcgtggatcattttcaactcatgatgacattagtgagtttgtcactagtgtgaatcgtacttgggagtcggccat

SEQ ID NO: 439230 - DNA, 140 bp, Artificial Sequence
  Synthetic
atggccgactcccaagtacgattcacactagtgacaaactcactaatgtcatcatgagttgaaaatgatccacgatcaacagtaactgactctgtgtcagtagattctgtagatgggaaaggagacccagcatggcgtat

SEQ ID NO: 439231 - DNA, 140 bp, Artificial Sequence
  Synthetic
aggccctggctgctgatatgtccgacatgtatgatcctactactaagaatgtaacaggtagtaatgagtcaaaggctttattctttacttacctgtgtaacctcattaataataatcttggaccttttgggacagcggtg

SEQ ID NO: 439232 - DNA, 140 bp, Artificial Sequence
  Synthetic
caccgctgtcccaaaaggtccaagattattattaatgaggttacacaggtaagtaaagaataaagcctttgactcattactacctgttacattcttagtagtaggatcatacatgtcggacatatcagcagccagggcct

SEQ ID NO: 439233 - DNA, 140 bp, Artificial Sequence
  Synthetic
atacgccatgctgggtctccctttttgacgttggttacacagttaattaacgaactctatggattacgtgtctctgctcaatcagatttggcagaagtaccttaatcttccggatactaccgtacttgggagtcggccat

SEQ ID NO: 439234 - DNA, 140 bp, Artificial Sequence
  Synthetic
atggccgactcccaagtacggtagtatccggaagattaaggtacttctgccaaatctgattgagcagagacacgtaatccatagagttcgttaattaactgtgtaaccaacgtcaaaaagggagacccagcatggcgtat

SEQ ID NO: 439235 - DNA, 140 bp, Artificial Sequence
  Synthetic
aggccctggctgctgatatgctcttggtgggtctgttgctattaaaataacagaacactcttggagcgttgaactttatgaacttatgggaaaatttgcttggtggactgttttctgcacgaccttttgggacagcggtg

SEQ ID NO: 439236 - DNA, 140 bp, Artificial Sequence
  Synthetic
caccgctgtcccaaaaggtcgtgcagaaaacagtccaccaagcaaattttcccataagttcataaagttcaacgctccaagagtgttctgttattttaatagcaacagacccaccaagagcatatcagcagccagggcct

SEQ ID NO: 439237 - DNA, 140 bp, Artificial Sequence
  Synthetic
atacgccatgctgggtctccccactctcttgttagtgttttcactctctcttttggtcactgcatcctcaaaacctctctatgtacctgagcattgtcagaattattctggttgcatgctcgtacttgggagtcggccat

SEQ ID NO: 439238 - DNA, 140 bp, Artificial Sequence
  Synthetic
atggccgactcccaagtacgagcatgcaaccagaataattctgacaatgctcaggtacatagagaggttttgaggatgcagtgaccaaaagagagagtgaaaacactaacaagagagtggggagacccagcatggcgtat

SEQ ID NO: 439239 - DNA, 140 bp, Artificial Sequence
  Synthetic
atacgccatgctgggtctccactgaatccgctgttaattctactaaagctttggccaaacaggatgcagcacagcgaatcgcctggctgctccatagagatggaggaatacccgatggatcgtacttgggagtcggccat

SEQ ID NO: 439240 - DNA, 140 bp, Artificial Sequence
  Synthetic
atggccgactcccaagtacgatccatcgggtattcctccatctctatggagcagccaggcgattcgctgtgctgcatcctgtttggccaaagctttagtagaattaacagcggattcagtggagacccagcatggcgtat

SEQ ID NO: 439241 - DNA, 140 bp, Artificial Sequence
  Synthetic
atacgccatgctgggtctccgttccctctacttacggcactcaagcctactccctacttgcgaggaagaggcgccattcaccaggtaaaaaccttcgatacgttaaacgtaggttttcttcgtacttgggagtcggccat

SEQ ID NO: 439242 - DNA, 140 bp, Artificial Sequence
  Synthetic
atggccgactcccaagtacgaagaaaacctacgtttaacgtatcgaaggtttttacctggtgaatggcgcctcttcctcgcaagtagggagtaggcttgagtgccgtaagtagagggaacggagacccagcatggcgtat

SEQ ID NO: 439243 - DNA, 140 bp, Artificial Sequence
  Synthetic
atacgccatgctgggtctccctttacgccctgaagatattagtgtggttacacaacccacacattatatcagggttacattttctgacccgaacatgtggtatctacgttctggtcatcacgtacttgggagtcggccat

SEQ ID NO: 439244 - DNA, 140 bp, Artificial Sequence
  Synthetic
atggccgactcccaagtacgtgatgaccagaacgtagataccacatgttcgggtcagaaaatgtaaccctgatataatgtgtgggttgtgtaaccacactaatatcttcagggcgtaaagggagacccagcatggcgtat

SEQ ID NO: 439245 - DNA, 140 bp, Artificial Sequence
  Synthetic
atacgccatgctgggtctcccttacactcagttcataattggcttaaaccttatggtggtcaaccagtttctgagtaccatataaccttagctttgttaaatcttacatctgaagatttacgtacttgggagtcggccat

SEQ ID NO: 439246 - DNA, 140 bp, Artificial Sequence
  Synthetic
atggccgactcccaagtacgtaaatcttcagatgtaagatttaacaaagctaaggttatatggtactcagaaactggttgaccaccataaggtttaagccaattatgaactgagtgtaagggagacccagcatggcgtat

SEQ ID NO: 439247 - DNA, 140 bp, Artificial Sequence
  Synthetic
aggccctggctgctgatatgatgctttagaacttaccctcaacaaatgtttgttactcctttggccgtagatgttgtctccatacggtcttccaatcagggtaataaacaaattgttcatgaccttttgggacagcggtg

SEQ ID NO: 439248 - DNA, 140 bp, Artificial Sequence
  Synthetic
caccgctgtcccaaaaggtcatgaacaatttgtttattaccctgattggaagaccgtatggagacaacatctacggccaaaggagtaacaaacatttgttgagggtaagttctaaagcatcatatcagcagccagggcct

SEQ ID NO: 439249 - DNA, 140 bp, Artificial Sequence
  Synthetic
atacgccatgctgggtctccgctagggatatttctcccattgctgtatttttgcgtaatgtcagatttgagttacatgaatttgcactactacgcaaaactcttgttctcaatgtttcagcgtacttgggagtcggccat

SEQ ID NO: 439250 - DNA, 140 bp, Artificial Sequence
  Synthetic
atggccgactcccaagtacgctgaaacattgagaacaagagttttgcgtagtagtgcaaattcatgtaactcaaatctgacattacgcaaaaatacagcaatgggagaaatatccctagcggagacccagcatggcgtat

SEQ ID NO: 439251 - DNA, 140 bp, Artificial Sequence
  Synthetic
atacgccatgctgggtctccagatgtactgtgctaacatacacagatttaaacctgtgtatagagttaacatggcagttcctactattagggaatggcttcgtgtacagggtttttctctcgtacttgggagtcggccat

SEQ ID NO: 439252 - DNA, 140 bp, Artificial Sequence
  Synthetic
atggccgactcccaagtacgagagaaaaaccctgtacacgaagccattccctaatagtaggaactgccatgttaactctatacacaggtttaaatctgtgtatgttagcacagtacatctggagacccagcatggcgtat

SEQ ID NO: 439253 - DNA, 140 bp, Artificial Sequence
  Synthetic
atacgccatgctgggtctccattcattgacgcagcacgaggccccgcaggtgtggagtctgatgttgagaccaatgaaattgttgactctgtgcagtatgctcataaacatgacatacaacgtacttgggagtcggccat

SEQ ID NO: 439254 - DNA, 140 bp, Artificial Sequence
  Synthetic
atggccgactcccaagtacgttgtatgtcatgtttatgagcatactgcacagagtcaacaatttcattggtctcaacatcagactccacacctgcggggcctcgtgctgcgtcaatgaatggagacccagcatggcgtat

SEQ ID NO: 439255 - DNA, 140 bp, Artificial Sequence
  Synthetic
aggccctggctgctgatatgtatgcataagggggctgcatggcctattgttagacgacgtatagtgcaaatgttgtcagacactttagacaaattgtctgattactgtacgtttgtttgtgaccttttgggacagcggtg

SEQ ID NO: 439256 - DNA, 140 bp, Artificial Sequence
  Synthetic
caccgctgtcccaaaaggtcacaaacaaacgtacagtaatcagacaatttgtctaaagtgtctgacaacatttgcactatacgtcgtctaacaataggccatgcagcccccttatgcatacatatcagcagccagggcct

SEQ ID NO: 439257 - DNA, 140 bp, Artificial Sequence
  Synthetic
atacgccatgctgggtctcctaccctcaacaaatgtttgtcacacctatggctgtggaactcgtttctatacgatctgcagctgaaggtaccaaacaaattattcagtcacaccccatttcgtacttgggagtcggccat

SEQ ID NO: 439258 - DNA, 140 bp, Artificial Sequence
  Synthetic
atggccgactcccaagtacgaaatggggtgtgactgaataatttgtttggtaccttcagctgcagatcgtatagaaacgagttccacagccataggtgtgacaaacatttgttgagggtaggagacccagcatggcgtat

SEQ ID NO: 439259 - DNA, 140 bp, Artificial Sequence
  Synthetic
atacgccatgctgggtctccttacaacagccaccttcctttacatatgtctatttctaaattgcatgcgttggatgatgttacacgtaattacattatcacaatgccttgctttagaacacgtacttgggagtcggccat

SEQ ID NO: 439260 - DNA, 140 bp, Artificial Sequence
  Synthetic
atggccgactcccaagtacgtgttctaaagcaaggcattgtgataatgtaattacgtgtaacatcatccaacgcatgcaatttagaaatagacatatgtaaaggaaggtggctgttgtaaggagacccagcatggcgtat

SEQ ID NO: 439261 - DNA, 140 bp, Artificial Sequence
  Synthetic
atacgccatgctgggtctcctaatgattctgttgtttttacatacattccagctggcggttatgtagctgctttagctgtcaatgtttgtctcatacctttattattactgctacgtcagcgtacttgggagtcggccat

SEQ ID NO: 439262 - DNA, 140 bp, Artificial Sequence
  Synthetic
atggccgactcccaagtacgctgacgtagcagtaataataaaggtatgagacaaacattgacagctaaagcagctacataaccgccagctggaatgtatgtaaaaacaacagaatcattaggagacccagcatggcgtat

SEQ ID NO: 439263 - DNA, 140 bp, Artificial Sequence
  Synthetic
atacgccatgctgggtctcccattaccgaagatgagattttagagtggtttggcattacacaaactgctcaaggtgttcacctcttctcatctcggtatgttgatttgtacggcggcaatcgtacttgggagtcggccat

SEQ ID NO: 439264 - DNA, 140 bp, Artificial Sequence
  Synthetic
atggccgactcccaagtacgattgccgccgtacaaatcaacataccgagatgagaagaggtgaacaccttgagcagtttgtgtaatgccaaaccactctaaaatctcatcttcggtaatgggagacccagcatggcgtat

SEQ ID NO: 439265 - DNA, 140 bp, Artificial Sequence
  Synthetic
aggccctggctgctgatatgcagtgccccccgggaagagctctacagtgtgaaatgtaaataaaaaatagctattattcaattagattaggctaattagatgatttgcaaaaaaaaaaaagaccttttgggacagcggtg

SEQ ID NO: 439266 - DNA, 140 bp, Artificial Sequence
  Synthetic
caccgctgtcccaaaaggtcttttttttttttgcaaatcatctaattagcctaatctaattgaataatagctattttttatttacatttcacactgtagagctcttcccggggggcactgcatatcagcagccagggcct

SEQ ID NO: 439267 - DNA, 140 bp, Artificial Sequence
  Synthetic
aggccctggctgctgatatgtgccaataagtttaatcaggctctgggagctatgcaaacaggcttcactacaactaatgaagcttttcggaaggttcaggatgctgtgaacaacaatgcagaccttttgggacagcggtg

SEQ ID NO: 439268 - DNA, 140 bp, Artificial Sequence
  Synthetic
caccgctgtcccaaaaggtctgcattgttgttcacagcatcctgaaccttccgaaaagcttcattagttgtagtgaagcctgtttgcatagctcccagagcctgattaaacttattggcacatatcagcagccagggcct

SEQ ID NO: 439269 - DNA, 140 bp, Artificial Sequence
  Synthetic
atacgccatgctgggtctcccaactggaggctttcttatagccttcttagttattcttataatactctggtttgcagacagaattcgcttctgcctcatgctgagttcttatattccactcgtacttgggagtcggccat

SEQ ID NO: 439270 - DNA, 140 bp, Artificial Sequence
  Synthetic
atggccgactcccaagtacgagtggaatataagaactcagcatgaggcagaagcgaattctgtctgcaaaccagagtattataagaataactaagaaggctataagaaagcctccagttgggagacccagcatggcgtat

SEQ ID NO: 439271 - DNA, 140 bp, Artificial Sequence
  Synthetic
atacgccatgctgggtctccgtttgacatgcgttctcattttattcgcgtcagtacagtctcttctcacggtatggtccctgtcactcaaaccaaaccagtgtttattagaaactttgaccgtacttgggagtcggccat

SEQ ID NO: 439272 - DNA, 140 bp, Artificial Sequence
  Synthetic
atggccgactcccaagtacggtcaaagtttctaataaacactggtttggtttgagtgacagggaccataccgtgagaagagactgtactgacgcgaataaaatgagaacgcatgtcaaacggagacccagcatggcgtat

SEQ ID NO: 439273 - DNA, 140 bp, Artificial Sequence
  Synthetic
atacgccatgctgggtctcccagcgttgccgctgtgctcgttgtttttatttgcattcttcaacttatatagagtgcacttatattaaccgttttagtaagattagcctcgtgtctgtggcgtacttgggagtcggccat

SEQ ID NO: 439274 - DNA, 140 bp, Artificial Sequence
  Synthetic
atggccgactcccaagtacgccacagacacgaggctaatcttactaaaacggttaatataagtgcactctatataagttgaagaatgcaaataaaaacaacgagcacagcggcaacgctgggagacccagcatggcgtat

SEQ ID NO: 439275 - DNA, 140 bp, Artificial Sequence
  Synthetic
aggccctggctgctgatatgcagaactttgattttaacgaacttaaataaaagccctgttgtttagcgtattgtcgcacttgtctggtgggattgtggcattaatttgcctgctcatctagaccttttgggacagcggtg

SEQ ID NO: 439276 - DNA, 140 bp, Artificial Sequence
  Synthetic
caccgctgtcccaaaaggtctagatgagcaggcaaattaatgccacaatcccaccagacaagtgcgacaatacgctaaacaacagggcttttatttaagttcgttaaaatcaaagttctgcatatcagcagccagggcct

SEQ ID NO: 439277 - DNA, 140 bp, Artificial Sequence
  Synthetic
atacgccatgctgggtctccctgacttttcattaaacggcaatgtttcgactgttttcgtgcctgcaacgcgcgattcagttcctcttcacataatcgcaccgagcgtgcttagtgtttacgtacttgggagtcggccat

SEQ ID NO: 439278 - DNA, 140 bp, Artificial Sequence
  Synthetic
atggccgactcccaagtacgtaaacactaagcacgctcggtgcgattatgtgaagaggaactgaatcgcgcgttgcaggcacgaaaacagtcgaaacattgccgtttaatgaaaagtcagggagacccagcatggcgtat

SEQ ID NO: 439279 - DNA, 140 bp, Artificial Sequence
  Synthetic
atacgccatgctgggtctccagcagctcagcgcaactatgggtcccgtgtagaggctattccattagtctctctttggacatatggaaaacgaactatgttaccctttgtccaacaacaacgtacttgggagtcggccat

SEQ ID NO: 439280 - DNA, 140 bp, Artificial Sequence
  Synthetic
atggccgactcccaagtacgttgttgttggacaaagggtaacatagttcgttttccatatgtccaaagagagactaatggaatagcctctacacgggacccatagttgcgctgagctgctggagacccagcatggcgtat

SEQ ID NO: 439281 - DNA, 140 bp, Artificial Sequence
  Synthetic
atacgccatgctgggtctccattgggtcattcatagtaaactttttcatctttaccgtagtatgtgctattaccctcttggtgtgtatggctttccttacggctactagattatgtgtgccgtacttgggagtcggccat

SEQ ID NO: 439282 - DNA, 140 bp, Artificial Sequence
  Synthetic
atggccgactcccaagtacggcacacataatctagtagccgtaaggaaagccatacacaccaagagggtaatagcacatactacggtaaagatgaaaaagtttactatgaatgacccaatggagacccagcatggcgtat

SEQ ID NO: 439283 - DNA, 140 bp, Artificial Sequence
  Synthetic
aggccctggctgctgatatgatactgggttccagggaaagcaaatccttggcagtactatgttggaagatgaattcacacctgaggatgttaatatgcagattatgggtgtggttatgcagaccttttgggacagcggtg

SEQ ID NO: 439284 - DNA, 140 bp, Artificial Sequence
  Synthetic
caccgctgtcccaaaaggtctgcataaccacacccataatctgcatattaacatcctcaggtgtgaattcatcttccaacatagtactgccaaggatttgctttccctggaacccagtatcatatcagcagccagggcct

SEQ ID NO: 439285 - DNA, 140 bp, Artificial Sequence
  Synthetic
atacgccatgctgggtctccaatgcataacaggtgttaacaccctgttagttcagcccgcagtttatatgtataatactggacgttcagtctatgtaaaattccaggagagtaaaccccccgtacttgggagtcggccat

SEQ ID NO: 439286 - DNA, 140 bp, Artificial Sequence
  Synthetic
atggccgactcccaagtacggggggtttactctcctggaattttacatagactgaacgtccagtattatacatataaactgcgggctgaactaacagggtgttaacacctgttatgcattggagacccagcatggcgtat

SEQ ID NO: 439287 - DNA, 140 bp, Artificial Sequence
  Synthetic
atacgccatgctgggtctcctacgcaggcctattaacgctacggatagatcacattattatgtggattccgttacagttaaagagactgttgttcagtttaattatcgtagagacggtcacgtacttgggagtcggccat

SEQ ID NO: 439288 - DNA, 140 bp, Artificial Sequence
  Synthetic
atggccgactcccaagtacgtgaccgtctctacgataattaaactgaacaacagtctctttaactgtaacggaatccacataataatgtgatctatccgtagcgttaataggcctgcgtaggagacccagcatggcgtat

SEQ ID NO: 439289 - DNA, 140 bp, Artificial Sequence
  Synthetic
atacgccatgctgggtctccttgcatggtccattgtctttcttttaattactatcgtactacagtatggctatccatctcgtagtatgactgtctatgtctttaaaatgtttgttttgtgcgtacttgggagtcggccat

SEQ ID NO: 439290 - DNA, 140 bp, Artificial Sequence
  Synthetic
atggccgactcccaagtacgcacaaaacaaacattttaaagacatagacagtcatactacgagatggatagccatactgtagtacgatagtaattaaaagaaagacaatggaccatgcaaggagacccagcatggcgtat

SEQ ID NO: 439291 - DNA, 140 bp, Artificial Sequence
  Synthetic
atacgccatgctgggtctcctgagagttcaaagaccacccactctcttgttagtgttctcactctctcttttggtcactgcattttcaaaacctctctatgtacctgagcattgtcagaacgtacttgggagtcggccat

SEQ ID NO: 439292 - DNA, 140 bp, Artificial Sequence
  Synthetic
atggccgactcccaagtacgttctgacaatgctcaggtacatagagaggttttgaaaatgcagtgaccaaaagagagagtgagaacactaacaagagagtgggtggtctttgaactctcaggagacccagcatggcgtat

SEQ ID NO: 439293 - DNA, 140 bp, Artificial Sequence
  Synthetic
aggccctggctgctgatatgacatgttttgaagctacagaagcaacatttaacttcttgttagatttggcaggattgttcagaatctttctccgcaatgcctatgtgtacacttcacaaggaccttttgggacagcggtg

SEQ ID NO: 439294 - DNA, 140 bp, Artificial Sequence
  Synthetic
caccgctgtcccaaaaggtccttgtgaagtgtacacataggcattgcggagaaagattctgaacaatcctgccaaatctaacaagaagttaaatgttgcttctgtagcttcaaaacatgtcatatcagcagccagggcct

SEQ ID NO: 439295 - DNA, 140 bp, Artificial Sequence
  Synthetic
atacgccatgctgggtctccggaatgatgtggatttcctactttgttcagagtattcggttgtttatgagaactggctcttggtggtcatttaacccagagacaaactgcctcttgaatgcgtacttgggagtcggccat

SEQ ID NO: 439296 - DNA, 140 bp, Artificial Sequence
  Synthetic
atggccgactcccaagtacgcattcaagaggcagtttgtctctgggttaaatgaccaccaagagccagttctcataaacaaccgaatactctgaacaaagtaggaaatccacatcattccggagacccagcatggcgtat

SEQ ID NO: 439297 - DNA, 140 bp, Artificial Sequence
  Synthetic
aggccctggctgctgatatgattgtggcattaatttgcctgctcatctaggcagtggacatatgctcaacactgggtataattctaattgaatactatttttcagttagagcgtcgtgtcgaccttttgggacagcggtg

SEQ ID NO: 439298 - DNA, 140 bp, Artificial Sequence
  Synthetic
caccgctgtcccaaaaggtcgacacgacgctctaactgaaaaatagtattcaattagaattatacccagtgttgagcatatgtccactgcctagatgagcaggcaaattaatgccacaatcatatcagcagccagggcct

SEQ ID NO: 439299 - DNA, 140 bp, Artificial Sequence
  Synthetic
atacgccatgctgggtctcctgccacttggtggaacaacagttgtgcgcccacttgtagaggattctactagtgttactgctgttgtaaccaacggttacctcaaagtggctggtatgcacgtacttgggagtcggccat

SEQ ID NO: 439300 - DNA, 140 bp, Artificial Sequence
  Synthetic
atggccgactcccaagtacgtgcataccagccactttgaggtaaccgttggttacaacagcagtaacactagtagaatcctctacaagtgggcgcacaactgttgttccaccaagtggcaggagacccagcatggcgtat

SEQ ID NO: 439301 - DNA, 140 bp, Artificial Sequence
  Synthetic
aggccctggctgctgatatggcttaataagggtatgcaacttttgcatacaaaggtctcctgggctggttttaatatcagtgctgttatctacagcggcagggagtctctaagagtgtgggaccttttgggacagcggtg

SEQ ID NO: 439302 - DNA, 140 bp, Artificial Sequence
  Synthetic
caccgctgtcccaaaaggtcccacactcttagagactccctgccgctgtagataacagcactgatattaaaaccagcccaggagacctttgtatgcaaaagttgcatacccttattaagccatatcagcagccagggcct

SEQ ID NO: 439303 - DNA, 140 bp, Artificial Sequence
  Synthetic
atacgccatgctgggtctcctttcggtgcatgtgactacgatagacttcctaatgaaatcaccgtagccaaacccaatgtgctgattgctttaaaaatggtgaaaagacaaagctatggacgtacttgggagtcggccat

SEQ ID NO: 439304 - DNA, 140 bp, Artificial Sequence
  Synthetic
atggccgactcccaagtacgtccatagctttgtcttttcaccatttttaaagcaatcagcacattgggtttggctacggtgatttcattaggaagtctatcgtagtcacatgcaccgaaaggagacccagcatggcgtat

SEQ ID NO: 439305 - DNA, 140 bp, Artificial Sequence
  Synthetic
atacgccatgctgggtctccttggttgtgtcctaggacttgttaattcctctttgttcgtagaggactgcaagttgcctctcggtcaatctctctgtgctcttcctgacacacctagtaccgtacttgggagtcggccat

SEQ ID NO: 439306 - DNA, 140 bp, Artificial Sequence
  Synthetic
atggccgactcccaagtacggtactaggtgtgtcaggaagagcacagagagattgaccgagaggcaacttgcagtcctctacgaacaaagaggaattaacaagtcctaggacacaaccaaggagacccagcatggcgtat

SEQ ID NO: 439307 - DNA, 140 bp, Artificial Sequence
  Synthetic
atacgccatgctgggtctccttaacaaggatacttatgctgctctcagaaattctataactaatgatgcgtattctcgatacttaggtctgtttaataaatacaagtacttctctggtgccgtacttgggagtcggccat

SEQ ID NO: 439308 - DNA, 140 bp, Artificial Sequence
  Synthetic
atggccgactcccaagtacggcaccagagaagtacttgtatttattaaacagacctaagtatcgagaatacgcatcattagttatagaatttctgagagcagcataagtatccttgttaaggagacccagcatggcgtat

SEQ ID NO: 439309 - DNA, 140 bp, Artificial Sequence
  Synthetic
aggccctggctgctgatatgcatgcactggatgatgttactcgcaattacatcattacaatgccatgctttagaacttatcctcaacaaatgtttgttactcctttggccgtagatgttggaccttttgggacagcggtg

SEQ ID NO: 439310 - DNA, 140 bp, Artificial Sequence
  Synthetic
caccgctgtcccaaaaggtccaacatctacggccaaaggagtaacaaacatttgttgaggataagttctaaagcatggcattgtaatgatgtaattgcgagtaacatcatccagtgcatgcatatcagcagccagggcct

SEQ ID NO: 439311 - DNA, 140 bp, Artificial Sequence
  Synthetic
atacgccatgctgggtctccctcattagtaagagtattatcttaattgatcttaacgaatcttaattttcattgttatggcaactccagcagcacctcgtgccgtctcttttgcagataacgtacttgggagtcggccat

SEQ ID NO: 439312 - DNA, 140 bp, Artificial Sequence
  Synthetic
atggccgactcccaagtacgttatctgcaaaagagacggcacgaggtgctgctggagttgccataacaatgaaaattaagattcgttaagatcaattaagataatactcttactaatgagggagacccagcatggcgtat

SEQ ID NO: 439313 - DNA, 140 bp, Artificial Sequence
  Synthetic
aggccctggctgctgatatgcattcagacaaccattcagaaagttactgttgattgtaaacagtacgtttgcaatggtttccagaagtgtgagcaattactgcgcgagtatggccagtttgaccttttgggacagcggtg

SEQ ID NO: 439314 - DNA, 140 bp, Artificial Sequence
  Synthetic
caccgctgtcccaaaaggtcaaactggccatactcgcgcagtaattgctcacacttctggaaaccattgcaaacgtactgtttacaatcaacagtaactttctgaatggttgtctgaatgcatatcagcagccagggcct

SEQ ID NO: 439315 - DNA, 140 bp, Artificial Sequence
  Synthetic
atacgccatgctgggtctccggccaaacaggacgcagctcagcgaatcgcttggttgctacataaggatggaggaatccctgatggatgttccctctacctccggcactcaagttattcgcgtacttgggagtcggccat

SEQ ID NO: 439316 - DNA, 140 bp, Artificial Sequence
  Synthetic
atggccgactcccaagtacgcgaataacttgagtgccggaggtagagggaacatccatcagggattcctccatccttatgtagcaaccaagcgattcgctgagctgcgtcctgtttggccggagacccagcatggcgtat

SEQ ID NO: 439317 - DNA, 140 bp, Artificial Sequence
  Synthetic
atacgccatgctgggtctcccacggtaaagtccctctttccttcccacctggacagggtgtacctcttaatgccaattctacccctgcgcaaaatgctgggtattggcggagacaggacacgtacttgggagtcggccat

SEQ ID NO: 439318 - DNA, 140 bp, Artificial Sequence
  Synthetic
atggccgactcccaagtacgtgtcctgtctccgccaatacccagcattttgcgcaggggtagaattggcattaagaggtacaccctgtccaggtgggaaggaaagagggactttaccgtgggagacccagcatggcgtat

SEQ ID NO: 439319 - DNA, 140 bp, Artificial Sequence
  Synthetic
atacgccatgctgggtctccccacattgagggcactggaggcaacagtcagtcatcttcaagagcatctagcgccagcagaggctcttcaagatctagctcaagaggtgctcgttccggacgtacttgggagtcggccat

SEQ ID NO: 439320 - DNA, 140 bp, Artificial Sequence
  Synthetic
atggccgactcccaagtacgtccggaacgagcacctcttgagctagatcttgaagagcctctgctggcgctagatgctcttgaagatgactgactgttgcctccagtgccctcaatgtggggagacccagcatggcgtat

SEQ ID NO: 439321 - DNA, 140 bp, Artificial Sequence
  Synthetic
atacgccatgctgggtctccgaaaggttaacacaggaaatggagttaagcaactggctcccagatggtatttctactatactggaaccggacctgaagctgcactccccttccgtgctgtcgtacttgggagtcggccat

SEQ ID NO: 439322 - DNA, 140 bp, Artificial Sequence
  Synthetic
atggccgactcccaagtacgacagcacggaaggggagtgcagcttcaggtccggttccagtatagtagaaataccatctgggagccagttgcttaactccatttcctgtgttaacctttcggagacccagcatggcgtat

SEQ ID NO: 439323 - DNA, 140 bp, Artificial Sequence
  Synthetic
aggccctggctgctgatatgttctactatactggaaccggacctgaagctgcactccccttccgtgctgtcaaagaaggcatcatttgggtccatgaagagggcgccactgatgctccttgaccttttgggacagcggtg

SEQ ID NO: 439324 - DNA, 140 bp, Artificial Sequence
  Synthetic
caccgctgtcccaaaaggtcaaggagcatcagtggcgccctcttcatggacccaaatgatgccttctttgacagcacggaaggggagtgcagcttcaggtccggttccagtatagtagaacatatcagcagccagggcct

SEQ ID NO: 439325 - DNA, 140 bp, Artificial Sequence
  Synthetic
atacgccatgctgggtctcctgcagcagatcctgctatgcacattgcctcctctaatgctttattagatttgaggacatcatgttttagtgtcgctgccttgactactggactaaccttccgtacttgggagtcggccat

SEQ ID NO: 439326 - DNA, 140 bp, Artificial Sequence
  Synthetic
atggccgactcccaagtacggaaggttagtccagtagtcaaggcagcgacactaaaacatgatgtcctcaaatctaataaagcattagaggaggcaatgtgcatagcaggatctgctgcaggagacccagcatggcgtat

SEQ ID NO: 439327 - DNA, 140 bp, Artificial Sequence
  Synthetic
atacgccatgctgggtctccaggcaatagtcagtcatcttcaagagcctctagcgcaagcagaaactcttctagatccagttcacgaggttcaagatcaggtaactcctcccgcggtgctcgtacttgggagtcggccat

SEQ ID NO: 439328 - DNA, 140 bp, Artificial Sequence
  Synthetic
atggccgactcccaagtacgagcaccgcgggaggagttacctgatcttgaacctcgtgaactggatctagaagagtttctgcttgcgctagaggctcttgaagatgactgactattgcctggagacccagcatggcgtat

SEQ ID NO: 439329 - DNA, 140 bp, Artificial Sequence
  Synthetic
atacgccatgctgggtctcctccccaggtccatctggagtcggagctcccggaggagacttgctctacctagatttgctgaacagacttcaagctttggagtctggcaaaacaaagcagtcgtacttgggagtcggccat

SEQ ID NO: 439330 - DNA, 140 bp, Artificial Sequence
  Synthetic
atggccgactcccaagtacgactgctttgttttgccagactccaaagcttgaagtctgttcagcaaatctaggtagagcaagtctcctccgggagctccgactccagatggacctggggaggagacccagcatggcgtat

SEQ ID NO: 439331 - DNA, 140 bp, Artificial Sequence
  Synthetic
atacgccatgctgggtctccgatacttgtcgtcgcagtatttgtaggacaatggtcttgtacctgttagttctttataatctcttattagccattatactagttaatggcatacattatccgtacttgggagtcggccat

SEQ ID NO: 439332 - DNA, 140 bp, Artificial Sequence
  Synthetic
atggccgactcccaagtacggataatgtatgccattaactagtataatggctaataagagattataaagaactaacaggtacaagaccattgtcctacaaatactgcgacgacaagtatcggagacccagcatggcgtat

SEQ ID NO: 439333 - DNA, 140 bp, Artificial Sequence
  Synthetic
atacgccatgctgggtctcccacagcctaaagtcattactaaaaaggatgctgctgctgctaaaaataagatgcgccataagcgtgtcgccaccaaaagtttcaacatggttcaagccttcgtacttgggagtcggccat

SEQ ID NO: 439334 - DNA, 140 bp, Artificial Sequence
  Synthetic
atggccgactcccaagtacgaaggcttgaaccatgttgaaacttttggtggcgacacgcttatggcgcatcttatttttagcagcagcagcatcctttttagtaatgactttaggctgtgggagacccagcatggcgtat

SEQ ID NO: 439335 - DNA, 140 bp, Artificial Sequence
  Synthetic
aggccctggctgctgatatgaacaatgcacaggctctatccaaattagctagcgagctatctaatacttttggtgctatttccgcctctattggagacatcatacaacgtcttgatgttcgaccttttgggacagcggtg

SEQ ID NO: 439336 - DNA, 140 bp, Artificial Sequence
  Synthetic
caccgctgtcccaaaaggtcgaacatcaagacgttgtatgatgtctccaatagaggcggaaatagcaccaaaagtattagatagctcgctagctaatttggatagagcctgtgcattgttcatatcagcagccagggcct

SEQ ID NO: 439337 - DNA, 140 bp, Artificial Sequence
  Synthetic
aggccctggctgctgatatgcagtttctcctgcatttcatcgcattgagtctactgactctattgttttcacatacattcctgctagcggctatgtagctgctttagctgtcaatgtgtggaccttttgggacagcggtg

SEQ ID NO: 439338 - DNA, 140 bp, Artificial Sequence
  Synthetic
caccgctgtcccaaaaggtccacacattgacagctaaagcagctacatagccgctagcaggaatgtatgtgaaaacaatagagtcagtagactcaatgcgatgaaatgcaggagaaactgcatatcagcagccagggcct

SEQ ID NO: 439339 - DNA, 140 bp, Artificial Sequence
  Synthetic
aggccctggctgctgatatgtgagtggtcatatactggctcgtccttctatgcacctgagcccatcacctctcttaatactaagtatgttgcaccacaggtgacataccaaaacatttctgaccttttgggacagcggtg

SEQ ID NO: 439340 - DNA, 140 bp, Artificial Sequence
  Synthetic
caccgctgtcccaaaaggtcagaaatgttttggtatgtcacctgtggtgcaacatacttagtattaagagaggtgatgggctcaggtgcatagaaggacgagccagtatatgaccactcacatatcagcagccagggcct

SEQ ID NO: 439341 - DNA, 140 bp, Artificial Sequence
  Synthetic
atacgccatgctgggtctccgctccctctgccagtgcttttatgggtatgtctcaatttaaacttacccatcagaacaatgatgatgctggcaacccagtgtactttcttcggtacagtgcgtacttgggagtcggccat

SEQ ID NO: 439342 - DNA, 140 bp, Artificial Sequence
  Synthetic
atggccgactcccaagtacgcactgtaccgaagaaagtacactgggttgccagcatcatcattgttctgatgggtaagtttaaattgagacatacccataaaagcactggcagagggagcggagacccagcatggcgtat

SEQ ID NO: 439343 - DNA, 140 bp, Artificial Sequence
  Synthetic
atacgccatgctgggtctccgtgctattaaacttgacccaaagaatcccaactacaacaaatggttggaactccttgagcagaatattgatgcctacaagaattttcctaagaaggaaaacgtacttgggagtcggccat

SEQ ID NO: 439344 - DNA, 140 bp, Artificial Sequence
  Synthetic
atggccgactcccaagtacgttttccttcttaggaaaattcttgtaggcatcaatattctgctcaaggagttccaaccatttgttgtagttgggattctttgggtcaagtttaatagcacggagacccagcatggcgtat

SEQ ID NO: 439345 - DNA, 140 bp, Artificial Sequence
  Synthetic
atacgccatgctgggtctcccagactgtgcggcccggcaactttaatcaagacttctatgactttgtagtgtcaaagggcttctttaaggagggttcatctgtgactcttaaacatttttcgtacttgggagtcggccat

SEQ ID NO: 439346 - DNA, 140 bp, Artificial Sequence
  Synthetic
atggccgactcccaagtacgaaaaatgtttaagagtcacagatgaaccctccttaaagaagccctttgacactacaaagtcatagaagtcttgattaaagttgccgggccgcacagtctgggagacccagcatggcgtat

SEQ ID NO: 439347 - DNA, 140 bp, Artificial Sequence
  Synthetic
atacgccatgctgggtctccgaaacaaaaggcacctaaagaagaatcaaatgaccaggaaatggcaacacctccgccaaaagagcagcgtgtgcagggtagtattacccagcgctccaaacgtacttgggagtcggccat

SEQ ID NO: 439348 - DNA, 140 bp, Artificial Sequence
  Synthetic
atggccgactcccaagtacgtttggagcgctgggtaatactaccctgcacacgctgctcttttggcggaggtgttgccatttcctggtcatttgattcttctttaggtgccttttgtttcggagacccagcatggcgtat

SEQ ID NO: 439349 - DNA, 140 bp, Artificial Sequence
  Synthetic
atacgccatgctgggtctccctactaattgtatagcccctgttaatggctactttattaaaactaataacactaggattgttgatgagtggtcatatactggctcgtccttctatgcacccgtacttgggagtcggccat

SEQ ID NO: 439350 - DNA, 140 bp, Artificial Sequence
  Synthetic
atggccgactcccaagtacgggtgcatagaaggacgagccagtatatgaccactcatcaacaatcctagtgttattagttttaataaagtagccattaacaggggctatacaattagtagggagacccagcatggcgtat

SEQ ID NO: 439351 - DNA, 140 bp, Artificial Sequence
  Synthetic
atacgccatgctgggtctcctctcggcctagtgtggcacctggtccaatgactgatgttaacactgagtagtgttattcaaagtaacaagagcgaggcaaccgttgatgtttggtaaccccgtacttgggagtcggccat

SEQ ID NO: 439352 - DNA, 140 bp, Artificial Sequence
  Synthetic
atggccgactcccaagtacggggttaccaaacatcaacggttgcctcgctcttgttactttgaataacactactcagtgttaacatcagtcattggaccaggtgccacactaggccgagaggagacccagcatggcgtat

SEQ ID NO: 439353 - DNA, 140 bp, Artificial Sequence
  Synthetic
atacgccatgctgggtctcccatctcaccatcgtttgtccactcttgcacagaatggaatcatgttgtaattacagtgcaagaaggtaattataacccatttaattgatagctatgctttcgtacttgggagtcggccat

SEQ ID NO: 439354 - DNA, 140 bp, Artificial Sequence
  Synthetic
atggccgactcccaagtacgaaagcatagctatcaattaaatgggttataattaccttcttgcactgtaattacaacatgattccattctgtgcaagagtggacaaacgatggtgagatgggagacccagcatggcgtat

SEQ ID NO: 439355 - DNA, 140 bp, Artificial Sequence
  Synthetic
aggccctggctgctgatatgttacagtgcaagaaggtaattataacccatttaattgatagctatgctttagtaaagtgtgtagctgtagagagaatgttaaagactgtcacctctgagagaccttttgggacagcggtg

SEQ ID NO: 439356 - DNA, 140 bp, Artificial Sequence
  Synthetic
caccgctgtcccaaaaggtctctcagaggtgacagtctttaacattctctctacagctacacactttactaaagcatagctatcaattaaatgggttataattaccttcttgcactgtaacatatcagcagccagggcct

SEQ ID NO: 439357 - DNA, 140 bp, Artificial Sequence
  Synthetic
aggccctggctgctgatatggttgtacagagtttttccttatgacatggattctggtgtgtcatcctttagtgaactactttttgattgcgttgatctttcagtagcttctacctattttgaccttttgggacagcggtg

SEQ ID NO: 439358 - DNA, 140 bp, Artificial Sequence
  Synthetic
caccgctgtcccaaaaggtcaaaataggtagaagctactgaaagatcaacgcaatcaaaaagtagttcactaaaggatgacacaccagaatccatgtcataaggaaaaactctgtacaaccatatcagcagccagggcct

SEQ ID NO: 439359 - DNA, 140 bp, Artificial Sequence
  Synthetic
aggccctggctgctgatatgatggccgtggtacatttggcttggtttcattgctgggcttgttgccttagctctatgcgtcttcttcatactgtgctgcactggttgtggcacaaactgtgaccttttgggacagcggtg

SEQ ID NO: 439360 - DNA, 140 bp, Artificial Sequence
  Synthetic
caccgctgtcccaaaaggtcacagtttgtgccacaaccagtgcagcacagtatgaagaagacgcatagagctaaggcaacaagcccagcaatgaaaccaagccaaatgtaccacggccatcatatcagcagccagggcct

SEQ ID NO: 439361 - DNA, 140 bp, Artificial Sequence
  Synthetic
aggccctggctgctgatatgcactcctatgaatctgagtacttactcactttttgatttatccaagtttcaattaaaattaaaaggaacaccagttcttcaattaaaggagagtcaaattgaccttttgggacagcggtg

SEQ ID NO: 439362 - DNA, 140 bp, Artificial Sequence
  Synthetic
caccgctgtcccaaaaggtcaatttgactctcctttaattgaagaactggtgttccttttaattttaattgaaacttggataaatcaaaaagtgagtaagtactcagattcataggagtgcatatcagcagccagggcct

SEQ ID NO: 439363 - DNA, 140 bp, Artificial Sequence
  Synthetic
atacgccatgctgggtctccgcatttgaactctatgcgaagcgcgctgttcgctcgcatcctgatttcaaattgctccataatttacaagctgacatatgttacaagttcgtcctttgggcgtacttgggagtcggccat

SEQ ID NO: 439364 - DNA, 140 bp, Artificial Sequence
  Synthetic
atggccgactcccaagtacgcccaaaggacgaacttgtaacatatgtcagcttgtaaattatggagcaatttgaaatcaggatgcgagcgaacagcgcgcttcgcatagagttcaaatgcggagacccagcatggcgtat

SEQ ID NO: 439365 - DNA, 140 bp, Artificial Sequence
  Synthetic
aggccctggctgctgatatgattgctggagttgctggtgctcgcattccagacgtacctactacattggcttgggtgaacaatcagataatttctttgtttctcgagtctttgctaatacgaccttttgggacagcggtg

SEQ ID NO: 439366 - DNA, 140 bp, Artificial Sequence
  Synthetic
caccgctgtcccaaaaggtcgtattagcaaagactcgagaaacaaagaaattatctgattgttcacccaagccaatgtagtaggtacgtctggaatgcgagcaccagcaactccagcaatcatatcagcagccagggcct

SEQ ID NO: 439367 - DNA, 140 bp, Artificial Sequence
  Synthetic
aggccctggctgctgatatgtggtctttatacaaattttcgaattgacgtcccatctgcagaatcaactggtactcaatcagtttctgtcgatcgtgagtcaacttcaactcatgatggtgaccttttgggacagcggtg

SEQ ID NO: 439368 - DNA, 140 bp, Artificial Sequence
  Synthetic
caccgctgtcccaaaaggtcaccatcatgagttgaagttgactcacgatcgacagaaactgattgagtaccagttgattctgcagatgggacgtcaattcgaaaatttgtataaagaccacatatcagcagccagggcct

SEQ ID NO: 439369 - DNA, 140 bp, Artificial Sequence
  Synthetic
atacgccatgctgggtctcctctgtctgtttctccatatgtctgcaacgctcctggttgtgacgtttcagatgttactaagctgtacctgggtggtatgagctacttttgtgtagatcatcgtacttgggagtcggccat

SEQ ID NO: 439370 - DNA, 140 bp, Artificial Sequence
  Synthetic
atggccgactcccaagtacgatgatctacacaaaagtagctcataccacccaggtacagcttagtaacatctgaaacgtcacaaccaggagcgttgcagacatatggagaaacagacagaggagacccagcatggcgtat

SEQ ID NO: 439371 - DNA, 140 bp, Artificial Sequence
  Synthetic
aggccctggctgctgatatgataaaccactcattgagtggccacttactgagtatgattttactgattataaggtacaactctttgagaagtactttaaatattgggatcagtgtactgagaccttttgggacagcggtg

SEQ ID NO: 439372 - DNA, 140 bp, Artificial Sequence
  Synthetic
caccgctgtcccaaaaggtctcagtacactgatcccaatatttaaagtacttctcaaagagttgtaccttataatcagtaaaatcatactcagtaagtggccactcaatgagtggtttatcatatcagcagccagggcct

SEQ ID NO: 439373 - DNA, 140 bp, Artificial Sequence
  Synthetic
aggccctggctgctgatatgcctattttttagtccgcctcttgcaagataagactggcgactttatgtctacaatcgcactaatggtggttacaattcttggcatttagtcgagggtgaagaccttttgggacagcggtg

SEQ ID NO: 439374 - DNA, 140 bp, Artificial Sequence
  Synthetic
caccgctgtcccaaaaggtcttcaccctcgactaaatgccaagaattgtaaccaccattagtgcgattgtagacataaagtcgccagtcttatcttgcaagaggcggactaaaaaataggcatatcagcagccagggcct

SEQ ID NO: 439375 - DNA, 140 bp, Artificial Sequence
  Synthetic
atacgccatgctgggtctccttgctaaatctcactgatgaagatttagctagagatttttcacccattgcgctctttttgcgcaatgtcagatttgagctacatgagttcgccttgctgccgtacttgggagtcggccat

SEQ ID NO: 439376 - DNA, 140 bp, Artificial Sequence
  Synthetic
atggccgactcccaagtacggcagcaaggcgaactcatgtagctcaaatctgacattgcgcaaaaagagcgcaatgggtgaaaaatctctagctaaatcttcatcagtgagatttagcaaggagacccagcatggcgtat

SEQ ID NO: 439377 - DNA, 140 bp, Artificial Sequence
  Synthetic
aggccctggctgctgatatgctgttaatatagctaaaaacgcctatgagaaggataaggcagtggcccgtaagttagaacgtatggctgatcaggctatgacttctatgtataagcaagcgaccttttgggacagcggtg

SEQ ID NO: 439378 - DNA, 140 bp, Artificial Sequence
  Synthetic
caccgctgtcccaaaaggtcgcttgcttatacatagaagtcatagcctgatcagccatacgttctaacttacgggccactgccttatccttctcataggcgtttttagctatattaacagcatatcagcagccagggcct

SEQ ID NO: 439379 - DNA, 140 bp, Artificial Sequence
  Synthetic
aggccctggctgctgatatgccattcttttattattctactacaccatgtgaagtgcatggtaatggtagtatgatagaggatattgattatgtacccctaaaatctgcagtctgtattagaccttttgggacagcggtg

SEQ ID NO: 439380 - DNA, 140 bp, Artificial Sequence
  Synthetic
caccgctgtcccaaaaggtctaatacagactgcagattttaggggtacataatcaatatcctctatcatactaccattaccatgcacttcacatggtgtagtagaataataaaagaatggcatatcagcagccagggcct

SEQ ID NO: 439381 - DNA, 140 bp, Artificial Sequence
  Synthetic
atacgccatgctgggtctccgagagttacaataattatgtaccctcatatgttaaacctgatagtgtgtctaccagtgatttaggtagtctcattgattgtaatgcggcttcagttaacccgtacttgggagtcggccat

SEQ ID NO: 439382 - DNA, 140 bp, Artificial Sequence
  Synthetic
atggccgactcccaagtacgggttaactgaagccgcattacaatcaatgagactacctaaatcactggtagacacactatcaggtttaacatatgagggtacataattattgtaactctcggagacccagcatggcgtat

SEQ ID NO: 439383 - DNA, 140 bp, Artificial Sequence
  Synthetic
atacgccatgctgggtctccagtacaacgtataaactgactgtaggtgacatcttcgtacttacctctcactcggtggctaccttgacggcgcccacaattgtgaatcaagagaggtatgcgtacttgggagtcggccat

SEQ ID NO: 439384 - DNA, 140 bp, Artificial Sequence
  Synthetic
atggccgactcccaagtacgcatacctctcttgattcacaattgtgggcgccgtcaaggtagccaccgagtgagaggtaagtacgaagatgtcacctacagtcagtttatacgttgtactggagacccagcatggcgtat

SEQ ID NO: 439385 - DNA, 140 bp, Artificial Sequence
  Synthetic
atacgccatgctgggtctccgattttggtgacttcgtaatcactcaacctggttcaggagtagctatagttgatagctactattcttatttgatgcctgtggcctggcaattttaaccaacgtacttgggagtcggccat

SEQ ID NO: 439386 - DNA, 140 bp, Artificial Sequence
  Synthetic
atggccgactcccaagtacgttggttaaaattgccaggccacaggcatcaaataagaatagtagctatcaactatagctactcctgaaccaggttgagtgattacgaagtcaccaaaatcggagacccagcatggcgtat

SEQ ID NO: 439387 - DNA, 140 bp, Artificial Sequence
  Synthetic
atacgccatgctgggtctccttcgtgttagtacagtttcttctcatggtatggtccctgtcatacacaccaaaccattatttattagaaacttcgatcagcgttgcagctgttctcgttgcgtacttgggagtcggccat

SEQ ID NO: 439388 - DNA, 140 bp, Artificial Sequence
  Synthetic
atggccgactcccaagtacgcaacgagaacagctgcaacgctgatcgaagtttctaataaataatggtttggtgtgtatgacagggaccataccatgagaagaaactgtactaacacgaaggagacccagcatggcgtat

SEQ ID NO: 439389 - DNA, 140 bp, Artificial Sequence
  Synthetic
atacgccatgctgggtctcctttttatttgcactcttccacttatatagagtgcacttatattagccgttttagtaagattagcctagtttctgtaactgacttctccttaaacggcaatcgtacttgggagtcggccat

SEQ ID NO: 439390 - DNA, 140 bp, Artificial Sequence
  Synthetic
atggccgactcccaagtacgattgccgtttaaggagaagtcagttacagaaactaggctaatcttactaaaacggctaatataagtgcactctatataagtggaagagtgcaaataaaaaggagacccagcatggcgtat

SEQ ID NO: 439391 - DNA, 140 bp, Artificial Sequence
  Synthetic
atacgccatgctgggtctcctcttaatgccaattccacccctgcgcaaaatgctgggtattggcggagacaggacagaaaaattaataccgggaatggaattaagcaactggctcccaggcgtacttgggagtcggccat

SEQ ID NO: 439392 - DNA, 140 bp, Artificial Sequence
  Synthetic
atggccgactcccaagtacgcctgggagccagttgcttaattccattcccggtattaatttttctgtcctgtctccgccaatacccagcattttgcgcaggggtggaattggcattaagaggagacccagcatggcgtat

SEQ ID NO: 439393 - DNA, 140 bp, Artificial Sequence
  Synthetic
atacgccatgctgggtctccctgcacttacaactggtttgacttttcaaactgtgcggcctggcaattttaaccaagacttctatgatttcgtggtatctaaaggtttctttaaggagggcgtacttgggagtcggccat

SEQ ID NO: 439394 - DNA, 140 bp, Artificial Sequence
  Synthetic
atggccgactcccaagtacgccctccttaaagaaacctttagataccacgaaatcatagaagtcttggttaaaattgccaggccgcacagtttgaaaagtcaaaccagttgtaagtgcagggagacccagcatggcgtat

SEQ ID NO: 439395 - DNA, 140 bp, Artificial Sequence
  Synthetic
aggccctggctgctgatatgataacccatttaattgatagctatgctttattaaagtgtgtagctgtagagagaatgttaaagactgtcacctctgcctgattgcaagtgaacagtgcccgaccttttgggacagcggtg

SEQ ID NO: 439396 - DNA, 140 bp, Artificial Sequence
  Synthetic
caccgctgtcccaaaaggtcgggcactgttcacttgcaatcaggcagaggtgacagtctttaacattctctctacagctacacactttaataaagcatagctatcaattaaatgggttatcatatcagcagccagggcct

SEQ ID NO: 439397 - DNA, 140 bp, Artificial Sequence
  Synthetic
aggccctggctgctgatatgagtcttatgctattgccaccatcaaagaaattgttggtgagcgccaactattacttgtgtgggaggctggcaagtccaaaccaccactcaatcgtaattagaccttttgggacagcggtg

SEQ ID NO: 439398 - DNA, 140 bp, Artificial Sequence
  Synthetic
caccgctgtcccaaaaggtctaattacgattgagtggtggtttggacttgccagcctcccacacaagtaatagttggcgctcaccaacaatttctttgatggtggcaatagcataagactcatatcagcagccagggcct

SEQ ID NO: 439399 - DNA, 140 bp, Artificial Sequence
  Synthetic
aggccctggctgctgatatggttatctacagcggcagggagtctctaatattcccatcgggaacctattactgtgtcaccactaaggctaagtccgttcaacaagattttaacgttatttgaccttttgggacagcggtg

SEQ ID NO: 439400 - DNA, 140 bp, Artificial Sequence
  Synthetic
caccgctgtcccaaaaggtcaaataacgttaaaatcttgttgaacggacttagccttagtggtgacacagtaataggttcccgatgggaatattagagactccctgccgctgtagataaccatatcagcagccagggcct

SEQ ID NO: 439401 - DNA, 140 bp, Artificial Sequence
  Synthetic
atacgccatgctgggtctccgatgctcaagtctatggctgccactcgtggcgccacttgtgtcatagggactactaagttctatggtggttgggattttatgttaaggacattgtacaaacgtacttgggagtcggccat

SEQ ID NO: 439402 - DNA, 140 bp, Artificial Sequence
  Synthetic
atggccgactcccaagtacgtttgtacaatgtccttaacataaaatcccaaccaccatagaacttagtagtccctatgacacaagtggcgccacgagtggcagccatagacttgagcatcggagacccagcatggcgtat

SEQ ID NO: 439403 - DNA, 140 bp, Artificial Sequence
  Synthetic
atacgccatgctgggtctccaccttgaggccggtaaatctaaatcagcacctaaggttgtcaccaagaaggatgctgctgctgctaaaaacaagatgcgccacaagcgcgtcgccaccaacgtacttgggagtcggccat

SEQ ID NO: 439404 - DNA, 140 bp, Artificial Sequence
  Synthetic
atggccgactcccaagtacgttggtggcgacgcgcttgtggcgcatcttgtttttagcagcagcagcatccttcttggtgacaaccttaggtgctgatttagatttaccggcctcaaggtggagacccagcatggcgtat

SEQ ID NO: 439405 - DNA, 140 bp, Artificial Sequence
  Synthetic
atacgccatgctgggtctcctgattacacccttgccaatactaccacagcaccactcaaactttttgctgctgagactttacgtgccactgaagaggcgtctaagcagtcttatgctattcgtacttgggagtcggccat

SEQ ID NO: 439406 - DNA, 140 bp, Artificial Sequence
  Synthetic
atggccgactcccaagtacgaatagcataagactgcttagacgcctcttcagtggcacgtaaagtctcagcagcaaaaagtttgagtggtgctgtggtagtattggcaagggtgtaatcaggagacccagcatggcgtat

SEQ ID NO: 439407 - DNA, 140 bp, Artificial Sequence
  Synthetic
aggccctggctgctgatatgctgtctatgtctttaaaatgtttgttttatggctcctatggccatcttccatggcgctatcaatatttagcgccatttatccaattgatctagcttcccagaccttttgggacagcggtg

SEQ ID NO: 439408 - DNA, 140 bp, Artificial Sequence
  Synthetic
caccgctgtcccaaaaggtctgggaagctagatcaattggataaatggcgctaaatattgatagcgccatggaagatggccataggagccataaaacaaacattttaaagacatagacagcatatcagcagccagggcct

SEQ ID NO: 439409 - DNA, 140 bp, Artificial Sequence
  Synthetic
aggccctggctgctgatatgaggccatgttacttaaaaaggagccacttctctatgtgcccatccggctggctggacacactagacacctcccaggtcctcgtgtatacctggttgagaggaccttttgggacagcggtg

SEQ ID NO: 439410 - DNA, 140 bp, Artificial Sequence
  Synthetic
caccgctgtcccaaaaggtcctctcaaccaggtatacacgaggacctgggaggtgtctagtgtgtccagccagccggatgggcacatagagaagtggctcctttttaagtaacatggcctcatatcagcagccagggcct

SEQ ID NO: 439411 - DNA, 140 bp, Artificial Sequence
  Synthetic
aggccctggctgctgatatgtttgacacttttcttgttgcctgtggctatttgtttgacttatgcaaacatagtctacgagcccactaaggtttgcagaaggctgttaatatagctaaaagaccttttgggacagcggtg

SEQ ID NO: 439412 - DNA, 140 bp, Artificial Sequence
  Synthetic
caccgctgtcccaaaaggtcttttagctatattaacagccttctgcaaaccttagtgggctcgtagactatgtttgcataagtcaaacaaatagccacaggcaacaagaaaagtgtcaaacatatcagcagccagggcct

SEQ ID NO: 439413 - DNA, 140 bp, Artificial Sequence
  Synthetic
aggccctggctgctgatatgccagtgatttaggtagtctcattgattgtaatgcggcttcagttaaccaaattgtcttgcgtaattctaatggtgcttgtatttggaacgctgctgcatagaccttttgggacagcggtg

SEQ ID NO: 439414 - DNA, 140 bp, Artificial Sequence
  Synthetic
caccgctgtcccaaaaggtctatgcagcagcgttccaaatacaagcaccattagaattacgcaagacaatttggttaactgaagccgcattacaatcaatgagactacctaaatcactggcatatcagcagccagggcct

SEQ ID NO: 439415 - DNA, 140 bp, Artificial Sequence
  Synthetic
aggccctggctgctgatatggaaattgttgactctgtgcagtatgctcataaacatgacatacaaattactaatgagagttacaataattatgtaccctcatatgttaagcctgatagtggaccttttgggacagcggtg

SEQ ID NO: 439416 - DNA, 140 bp, Artificial Sequence
  Synthetic
caccgctgtcccaaaaggtccactatcaggcttaacatatgagggtacataattattgtaactctcattagtaatttgtatgtcatgtttatgagcatactgcacagagtcaacaatttccatatcagcagccagggcct

SEQ ID NO: 439417 - DNA, 140 bp, Artificial Sequence
  Synthetic
aggccctggctgctgatatgccatagatataaggcaggtaattacaggagtccgcctattacggcggatattgaacttgcattgcttcgagcttaggctctttagtaagagtatcttaatgaccttttgggacagcggtg

SEQ ID NO: 439418 - DNA, 140 bp, Artificial Sequence
  Synthetic
caccgctgtcccaaaaggtcattaagatactcttactaaagagcctaagctcgaagcaatgcaagttcaatatccgccgtaataggcggactcctgtaattacctgccttatatctatggcatatcagcagccagggcct

SEQ ID NO: 439419 - DNA, 140 bp, Artificial Sequence
  Synthetic
atacgccatgctgggtctcccgttgtttagctattcatgcttgttttatcgagcgtgttgattgggatgtagagtacccttacatctcccatgaaaagaaattgaattcctgttgtaggacgtacttgggagtcggccat

SEQ ID NO: 439420 - DNA, 140 bp, Artificial Sequence
  Synthetic
atggccgactcccaagtacgtcctacaacaggaattcaatttcttttcatgggagatgtaagggtactctacatcccaatcaacacgctcgataaaacaagcatgaatagctaaacaacgggagacccagcatggcgtat

SEQ ID NO: 439421 - DNA, 140 bp, Artificial Sequence
  Synthetic
aggccctggctgctgatatgggaaaactatgcttttgagcacgtagtctatggagacttctctcatactacgttaggcggtcttcacttgcttattggtttatacaagaagcaacaggaagaccttttgggacagcggtg

SEQ ID NO: 439422 - DNA, 140 bp, Artificial Sequence
  Synthetic
caccgctgtcccaaaaggtcttcctgttgcttcttgtataaaccaataagcaagtgaagaccgcctaacgtagtatgagagaagtctccatagactacgtgctcaaaagcatagttttcccatatcagcagccagggcct

SEQ ID NO: 439423 - DNA, 140 bp, Artificial Sequence
  Synthetic
aggccctggctgctgatatgcaccttacaggaaactcctgttgtgcctgatactgttgaagtcccaccgcaagtggtgaaacttccgtctgaacctcagactatccagcccgaggtaaaagaccttttgggacagcggtg

SEQ ID NO: 439424 - DNA, 140 bp, Artificial Sequence
  Synthetic
caccgctgtcccaaaaggtcttttacctcgggctggatagtctgaggttcagacggaagtttcaccacttgcggtgggacttcaacagtatcaggcacaacaggagtttcctgtaaggtgcatatcagcagccagggcct

SEQ ID NO: 439425 - DNA, 140 bp, Artificial Sequence
  Synthetic
aggccctggctgctgatatgaagtattacctcctcttatggatgttaatatggaagccgcgtatacttcatctttgcttggcagcatagcaggtgttggctggactgctggcttatcctcgaccttttgggacagcggtg

SEQ ID NO: 439426 - DNA, 140 bp, Artificial Sequence
  Synthetic
caccgctgtcccaaaaggtcgaggataagccagcagtccagccaacacctgctatgctgccaagcaaagatgaagtatacgcggcttccatattaacatccataagaggaggtaatacttcatatcagcagccagggcct

SEQ ID NO: 439427 - DNA, 140 bp, Artificial Sequence
  Synthetic
aggccctggctgctgatatgctggcagtcgtagtgcacgtagtgctattgaggatttgctatttgacaaagtcactatagctgatcctggttatatgcaaggttacgatgattgcatgcagaccttttgggacagcggtg

SEQ ID NO: 439428 - DNA, 140 bp, Artificial Sequence
  Synthetic
caccgctgtcccaaaaggtctgcatgcaatcatcgtaaccttgcatataaccaggatcagctatagtgactttgtcaaatagcaaatcctcaatagcactacgtgcactacgactgccagcatatcagcagccagggcct

SEQ ID NO: 439429 - DNA, 140 bp, Artificial Sequence
  Synthetic
aggccctggctgctgatatggcaatcactcgtgcccaaaaaggtattctttgtgttatgacatctcaggcactctttgagtccttagagtttactgaattgtcttttactaattacaagcgaccttttgggacagcggtg

SEQ ID NO: 439430 - DNA, 140 bp, Artificial Sequence
  Synthetic
caccgctgtcccaaaaggtcgcttgtaattagtaaaagacaattcagtaaactctaaggactcaaagagtgcctgagatgtcataacacaaagaatacctttttgggcacgagtgattgccatatcagcagccagggcct

SEQ ID NO: 439431 - DNA, 140 bp, Artificial Sequence
  Synthetic
atacgccatgctgggtctccgtagaaactggtgaaatagtggatgctgttcagtatgcacacaaacatgacatccagttgactaatgaggggtacaataattatgtaccatcttatgttacgtacttgggagtcggccat

SEQ ID NO: 439432 - DNA, 140 bp, Artificial Sequence
  Synthetic
atggccgactcccaagtacgtaacataagatggtacataattattgtacccctcattagtcaactggatgtcatgtttgtgtgcatactgaacagcatccactatttcaccagtttctacggagacccagcatggcgtat

SEQ ID NO: 439433 - DNA, 140 bp, Artificial Sequence
  Synthetic
atacgccatgctgggtctcctctacctcccgaagagtgggtttaacgaactcctttattatgtcaaacatgacgcagctcagtgagcagcagattattgccattattaaagactggaactcgtacttgggagtcggccat

SEQ ID NO: 439434 - DNA, 140 bp, Artificial Sequence
  Synthetic
atggccgactcccaagtacgagttccagtctttaataatggcaataatctgctgctcactgagctgcgtcatgtttgacataataaaggagttcgttaaacccactcttcgggaggtagaggagacccagcatggcgtat

SEQ ID NO: 439435 - DNA, 140 bp, Artificial Sequence
  Synthetic
aggccctggctgctgatatgaagatgctgctgctgctaaaaataagatgcgccacaagcgcacttccaccaaaagtttcaacatggtgcaagcttttggtcttcgcggaccaggagacctgaccttttgggacagcggtg

SEQ ID NO: 439436 - DNA, 140 bp, Artificial Sequence
  Synthetic
caccgctgtcccaaaaggtcaggtctcctggtccgcgaagaccaaaagcttgcaccatgttgaaacttttggtggaagtgcgcttgtggcgcatcttatttttagcagcagcagcatcttcatatcagcagccagggcct

SEQ ID NO: 439437 - DNA, 140 bp, Artificial Sequence
  Synthetic
atacgccatgctgggtctccggtgtacattatccaactggaagttgcctgatagccttcttagttatcctcataatactttggtttgtagatagaattcgtttctgtctcatgctgaattcgtacttgggagtcggccat

SEQ ID NO: 439438 - DNA, 140 bp, Artificial Sequence
  Synthetic
atggccgactcccaagtacgaattcagcatgagacagaaacgaattctatctacaaaccaaagtattatgaggataactaagaaggctatcaggcaacttccagttggataatgtacaccggagacccagcatggcgtat

SEQ ID NO: 439439 - DNA, 140 bp, Artificial Sequence
  Synthetic
aggccctggctgctgatatggcatcactcagcgcactcgcacccgtccaagtgttcagcctggtccaatgattgatgttaacactgattagtgtcactcaaagtaacaagatcgcggcaagaccttttgggacagcggtg

SEQ ID NO: 439440 - DNA, 140 bp, Artificial Sequence
  Synthetic
caccgctgtcccaaaaggtcttgccgcgatcttgttactttgagtgacactaatcagtgttaacatcaatcattggaccaggctgaacacttggacgggtgcgagtgcgctgagtgatgccatatcagcagccagggcct

SEQ ID NO: 439441 - DNA, 140 bp, Artificial Sequence
  Synthetic
atacgccatgctgggtctcctcgtttgtgtttggcaaccccatctcaccatcgcttgtccactcttgcacagaatggaatcatgttgtaattacagtgcaataaggtaattataacccatcgtacttgggagtcggccat

SEQ ID NO: 439442 - DNA, 140 bp, Artificial Sequence
  Synthetic
atggccgactcccaagtacgatgggttataattaccttattgcactgtaattacaacatgattccattctgtgcaagagtggacaagcgatggtgagatggggttgccaaacacaaacgaggagacccagcatggcgtat

SEQ ID NO: 439443 - DNA, 140 bp, Artificial Sequence
  Synthetic
aggccctggctgctgatatgagcggcagggagtctctaatattcccatcgggaacctattactgtgtcaccactaaggctaagtccgttcaacaagatcttgacgttattttgcctggtggaccttttgggacagcggtg

SEQ ID NO: 439444 - DNA, 140 bp, Artificial Sequence
  Synthetic
caccgctgtcccaaaaggtccaccaggcaaaataacgtcaagatcttgttgaacggacttagccttagtggtgacacagtaataggttcccgatgggaatattagagactccctgccgctcatatcagcagccagggcct

SEQ ID NO: 439445 - DNA, 140 bp, Artificial Sequence
  Synthetic
aggccctggctgctgatatgttgcacagaatggaatcatgttgtaattacagtgcaataaggtaattataacccatttaattgatagctatgctttattaaagtgtgtagctgtagagaggaccttttgggacagcggtg

SEQ ID NO: 439446 - DNA, 140 bp, Artificial Sequence
  Synthetic
caccgctgtcccaaaaggtcctctctacagctacacactttaataaagcatagctatcaattaaatgggttataattaccttattgcactgtaattacaacatgattccattctgtgcaacatatcagcagccagggcct

SEQ ID NO: 439447 - DNA, 140 bp, Artificial Sequence
  Synthetic
aggccctggctgctgatatgtctatgtataagcaagcacgtgctgaagataagaaagcaaaaattgtcagtggacttctatgatttcgtggtatctaaaggtttctttaaggagggctctgaccttttgggacagcggtg

SEQ ID NO: 439448 - DNA, 140 bp, Artificial Sequence
  Synthetic
caccgctgtcccaaaaggtcagagccctccttaaagaaacctttagataccacgaaatcatagaagtccactgacaatttttgctttcttatcttcagcacgtgcttgcttatacatagacatatcagcagccagggcct

SEQ ID NO: 439449 - DNA, 140 bp, Artificial Sequence
  Synthetic
aggccctggctgctgatatgaattacagtgcaataaggtaattataacccatttaattgatagctatgctttattaaagtgtgtagctgtagagagaatgttaaagactgtcacctctgcgaccttttgggacagcggtg

SEQ ID NO: 439450 - DNA, 140 bp, Artificial Sequence
  Synthetic
caccgctgtcccaaaaggtcgcagaggtgacagtctttaacattctctctacagctacacactttaataaagcatagctatcaattaaatgggttataattaccttattgcactgtaattcatatcagcagccagggcct

SEQ ID NO: 439451 - DNA, 140 bp, Artificial Sequence
  Synthetic
atacgccatgctgggtctccgatttaagtgaatagcttggctatctcacttcccctcgttctcttgcagaactttgattttaacgaacttaaataaaagccctgttgtttagcgtattgtcgtacttgggagtcggccat

SEQ ID NO: 439452 - DNA, 140 bp, Artificial Sequence
  Synthetic
atggccgactcccaagtacgacaatacgctaaacaacagggcttttatttaagttcgttaaaatcaaagttctgcaagagaacgaggggaagtgagatagccaagctattcacttaaatcggagacccagcatggcgtat

SEQ ID NO: 439453 - DNA, 140 bp, Artificial Sequence
  Synthetic
atacgccatgctgggtctccacctgtgtaacctcattaataataatcttgctcttggtgggtctgttgctattaaaataacagaacactcttggagcgttgaactttatgaacttatgggcgtacttgggagtcggccat

SEQ ID NO: 439454 - DNA, 140 bp, Artificial Sequence
  Synthetic
atggccgactcccaagtacgcccataagttcataaagttcaacgctccaagagtgttctgttattttaatagcaacagacccaccaagagcaagattattattaatgaggttacacaggtggagacccagcatggcgtat

SEQ ID NO: 439455 - DNA, 140 bp, Artificial Sequence
  Synthetic
aggccctggctgctgatatgttacacaaactgctcaaggtgttcacctcttctcatctcggtatgttgatttgtacggcggcaatatgtttcaatttgccaccttgcctgtttatgatacgaccttttgggacagcggtg

SEQ ID NO: 439456 - DNA, 140 bp, Artificial Sequence
  Synthetic
caccgctgtcccaaaaggtcgtatcataaacaggcaaggtggcaaattgaaacatattgccgccgtacaaatcaacataccgagatgagaagaggtgaacaccttgagcagtttgtgtaacatatcagcagccagggcct

SEQ ID NO: 439457 - DNA, 140 bp, Artificial Sequence
  Synthetic
atacgccatgctgggtctccgcttctctggccatcatccatggcactatccatttttagtgctgtctatccaatagacctagcttcccagattatttctggtattatagcagccatctcacgtacttgggagtcggccat

SEQ ID NO: 439458 - DNA, 140 bp, Artificial Sequence
  Synthetic
atggccgactcccaagtacgtgagatggctgctataataccagaaataatctgggaagctaggtctattggatagacagcactaaaaatggatagtgccatggatgatggccagagaagcggagacccagcatggcgtat

SEQ ID NO: 439459 - DNA, 140 bp, Artificial Sequence
  Synthetic
atacgccatgctgggtctccacttatggaaattgtacatttggtgctccagacgatgcttctcggttacttcataccgtgcttgccaaggctgagttatgctgttcggcacgcatggtttcgtacttgggagtcggccat

SEQ ID NO: 439460 - DNA, 140 bp, Artificial Sequence
  Synthetic
atggccgactcccaagtacgaaaccatgcgtgccgaacagcataactcagccttggcaagcacggtatgaagtaaccgagaagcatcgtctggagcaccaaatgtacaatttccataagtggagacccagcatggcgtat

SEQ ID NO: 439461 - DNA, 140 bp, Artificial Sequence
  Synthetic
aggccctggctgctgatatgcacctcttctcatctcggtatgttgatttgtacggcggcaatatgtttcaatttgccaccttgcctgtttatgatactattaagtattattctatcattcgaccttttgggacagcggtg

SEQ ID NO: 439462 - DNA, 140 bp, Artificial Sequence
  Synthetic
caccgctgtcccaaaaggtcgaatgatagaataatacttaatagtatcataaacaggcaaggtggcaaattgaaacatattgccgccgtacaaatcaacataccgagatgagaagaggtgcatatcagcagccagggcct

SEQ ID NO: 439463 - DNA, 140 bp, Artificial Sequence
  Synthetic
aggccctggctgctgatatgatcactcagcgcactcgcacccgtccaagtgttcagcctggtccaatgattgatgttaacactgattagtgtcactcaaagtaacaagatcgcggcaatcgaccttttgggacagcggtg

SEQ ID NO: 439464 - DNA, 140 bp, Artificial Sequence
  Synthetic
caccgctgtcccaaaaggtcgattgccgcgatcttgttactttgagtgacactaatcagtgttaacatcaatcattggaccaggctgaacacttggacgggtgcgagtgcgctgagtgatcatatcagcagccagggcct

SEQ ID NO: 439465 - DNA, 140 bp, Artificial Sequence
  Synthetic
atacgccatgctgggtctccttcctattgacttaacaatgattgagtttatgttatggtgtaaggatggacaggttcaaaccttctaccctcgactccaggcttctgcagattggaaacccgtacttgggagtcggccat

SEQ ID NO: 439466 - DNA, 140 bp, Artificial Sequence
  Synthetic
atggccgactcccaagtacgggtttccaatctgcagaagcctggagtcgagggtagaaggtttgaacctgtccatccttacaccataacataaactcaatcattgttaagtcaataggaaggagacccagcatggcgtat

SEQ ID NO: 439467 - DNA, 140 bp, Artificial Sequence
  Synthetic
atacgccatgctgggtctccttgcgctaacttatgtgatattcttgcagactactaaacttactttgtggaactacttgtttgaaactatacctacacagttgtttccacttttatttgtcgtacttgggagtcggccat

SEQ ID NO: 439468 - DNA, 140 bp, Artificial Sequence
  Synthetic
atggccgactcccaagtacgacaaataaaagtggaaacaactgtgtaggtatagtttcaaacaagtagttccacaaagtaagtttagtagtctgcaagaatatcacataagttagcgcaaggagacccagcatggcgtat

SEQ ID NO: 439469 - DNA, 140 bp, Artificial Sequence
  Synthetic
aggccctggctgctgatatgtgttaattcagctttgaatatatgttttgacatacgcgataatggttcattggagaagttcatgtctactcccaatgccatctttatttctgatagaaaagaccttttgggacagcggtg

SEQ ID NO: 439470 - DNA, 140 bp, Artificial Sequence
  Synthetic
caccgctgtcccaaaaggtcttttctatcagaaataaagatggcattgggagtagacatgaacttctccaatgaaccattatcgcgtatgtcaaaacatatattcaaagctgaattaacacatatcagcagccagggcct

SEQ ID NO: 439471 - DNA, 140 bp, Artificial Sequence
  Synthetic
aggccctggctgctgatatgtgatgacaagtataagacgagtgatgagctttgcgtgaatcttaatttacccgcaaatgtcccatactctcgtgttatttccaggatgggctttaaactcgaccttttgggacagcggtg

SEQ ID NO: 439472 - DNA, 140 bp, Artificial Sequence
  Synthetic
caccgctgtcccaaaaggtcgagtttaaagcccatcctggaaataacacgagagtatgggacatttgcgggtaaattaagattcacgcaaagctcatcactcgtcttatacttgtcatcacatatcagcagccagggcct

SEQ ID NO: 439473 - DNA, 140 bp, Artificial Sequence
  Synthetic
aggccctggctgctgatatgacgtctaaggacactttagatgatatcttacaacaggctaataagtctgttggtattatatctatgcctttgggatatgtgtctcatggtttagacttaagaccttttgggacagcggtg

SEQ ID NO: 439474 - DNA, 140 bp, Artificial Sequence
  Synthetic
caccgctgtcccaaaaggtcttaagtctaaaccatgagacacatatcccaaaggcatagatataataccaacagacttattagcctgttgtaagatatcatctaaagtgtccttagacgtcatatcagcagccagggcct

SEQ ID NO: 439475 - DNA, 140 bp, Artificial Sequence
  Synthetic
atacgccatgctgggtctcccggctgttggccattatgttcatgctcgcctgaagggtggtcttattttaaagtttgactctggcaccgttagcaagacttcagactggaagtgcaaggtcgtacttgggagtcggccat

SEQ ID NO: 439476 - DNA, 140 bp, Artificial Sequence
  Synthetic
atggccgactcccaagtacgaccttgcacttccagtctgaagtcttgctaacggtgccagagtcaaactttaaaataagaccacccttcaggcgagcatgaacataatggccaacagccgggagacccagcatggcgtat

SEQ ID NO: 439477 - DNA, 140 bp, Artificial Sequence
  Synthetic
atacgccatgctgggtctccgcagcgctttgtttatgatagttttgacaacttagttggttaccatgctgataatggtaactactattgtgtccgcccctgtgtgagtgtgcctgtttctcgtacttgggagtcggccat

SEQ ID NO: 439478 - DNA, 140 bp, Artificial Sequence
  Synthetic
atggccgactcccaagtacgagaaacaggcacactcacacaggggcggacacaatagtagttaccattatcagcatggtaaccaactaagttgtcaaaactatcataaacaaagcgctgcggagacccagcatggcgtat

SEQ ID NO: 439479 - DNA, 140 bp, Artificial Sequence
  Synthetic
aggccctggctgctgatatgaaaactatgcttttgagcacgtagtctatggagacttctctcatactacgttaggcggtcttcacttgcttattggtttatacaagaagcaacaggaagggaccttttgggacagcggtg

SEQ ID NO: 439480 - DNA, 140 bp, Artificial Sequence
  Synthetic
caccgctgtcccaaaaggtcccttcctgttgcttcttgtataaaccaataagcaagtgaagaccgcctaacgtagtatgagagaagtctccatagactacgtgctcaaaagcatagttttcatatcagcagccagggcct

SEQ ID NO: 439481 - DNA, 140 bp, Artificial Sequence
  Synthetic
atacgccatgctgggtctccatacgttgctagtatacagaatttcaaggaaactctgtactaccagaacaacgtatttatgtctgaagctaaatgctgggtggagccggatttgaaaaagcgtacttgggagtcggccat

SEQ ID NO: 439482 - DNA, 140 bp, Artificial Sequence
  Synthetic
atggccgactcccaagtacgctttttcaaatccggctccacccagcatttagcttcagacataaatacgttgttctggtagtacagagtttccttgaaattctgtatactagcaacgtatggagacccagcatggcgtat

SEQ ID NO: 439483 - DNA, 140 bp, Artificial Sequence
  Synthetic
atacgccatgctgggtctccctgtttgaaaattcagcagttttacaggctactcttaatgagttctcccacttagcaagttttgctgagttggaggcagcccaacgttcttatcaagaagcgtacttgggagtcggccat

SEQ ID NO: 439484 - DNA, 140 bp, Artificial Sequence
  Synthetic
atggccgactcccaagtacgcttcttgataagaacgttgggctgcctccaactcagcaaaacttgctaagtgggagaactcattaagagtagcctgtaaaactgctgaattttcaaacagggagacccagcatggcgtat

SEQ ID NO: 439485 - DNA, 140 bp, Artificial Sequence
  Synthetic
atacgccatgctgggtctcctttgttgggctcatggctttgaattaacgtctgcatcatacttttgcaagataggtaaggaacagaagtgtggaaaactatgcttttgagcacgtagtctcgtacttgggagtcggccat

SEQ ID NO: 439486 - DNA, 140 bp, Artificial Sequence
  Synthetic
atggccgactcccaagtacgagactacgtgctcaaaagcatagttttccacacttctgttccttacctatcttgcaaaagtatgatgcagacgttaattcaaagccatgagcccaacaaaggagacccagcatggcgtat

SEQ ID NO: 439487 - DNA, 140 bp, Artificial Sequence
  Synthetic
aggccctggctgctgatatgatctttggtggcgtagcttacgcctactttggatgtgaggaaggtactatgtactttgtgcctagagctaagtctgttgtctcaaggattggagactccagaccttttgggacagcggtg

SEQ ID NO: 439488 - DNA, 140 bp, Artificial Sequence
  Synthetic
caccgctgtcccaaaaggtctggagtctccaatccttgagacaacagacttagctctaggcacaaagtacatagtaccttcctcacatccaaagtaggcgtaagctacgccaccaaagatcatatcagcagccagggcct

SEQ ID NO: 439489 - DNA, 140 bp, Artificial Sequence
  Synthetic
aggccctggctgctgatatgtaataagtctgttggtattatatctatgcctttgggatatgtgtctcatggtttagacttaattcaagcaggtagtgtcgtgcacatctttgagtgtagagaccttttgggacagcggtg

SEQ ID NO: 439490 - DNA, 140 bp, Artificial Sequence
  Synthetic
caccgctgtcccaaaaggtctctacactcaaagatgtgcacgacactacctgcttgaattaagtctaaaccatgagacacatatcccaaaggcatagatataataccaacagacttattacatatcagcagccagggcct

SEQ ID NO: 439491 - DNA, 140 bp, Artificial Sequence
  Synthetic
atacgccatgctgggtctccggcccccatgaattttgttctcagcatacgctttttattaaggatggtgacgacggttacttcctgccttatccagacccttctagaattttgtctgccgcgtacttgggagtcggccat

SEQ ID NO: 439492 - DNA, 140 bp, Artificial Sequence
  Synthetic
atggccgactcccaagtacgcggcagacaaaattctagaagggtctggataaggcaggaagtaaccgtcgtcaccatccttaataaaaagcgtatgctgagaacaaaattcatgggggccggagacccagcatggcgtat

SEQ ID NO: 439493 - DNA, 140 bp, Artificial Sequence
  Synthetic
aggccctggctgctgatatgcagtttctgtcgatcgtgagtcaacttcaactcatgatggtcctaccgaacatgttactagtgtgaatctttttgacgttggttactcagttaatatggagaccttttgggacagcggtg

SEQ ID NO: 439494 - DNA, 140 bp, Artificial Sequence
  Synthetic
caccgctgtcccaaaaggtctccatattaactgagtaaccaacgtcaaaaagattcacactagtaacatgttcggtaggaccatcatgagttgaagttgactcacgatcgacagaaactgcatatcagcagccagggcct

SEQ ID NO: 439495 - DNA, 140 bp, Artificial Sequence
  Synthetic
aggccctggctgctgatatgatcaatgcttaaacggcgagattctacatatggcccccttcagacacctgttggttgtgtcctaggacttgttaattcctctttgttcgtagaggactgcgaccttttgggacagcggtg

SEQ ID NO: 439496 - DNA, 140 bp, Artificial Sequence
  Synthetic
caccgctgtcccaaaaggtcgcagtcctctacgaacaaagaggaattaacaagtcctaggacacaaccaacaggtgtctgaagggggccatatgtagaatctcgccgtttaagcattgatcatatcagcagccagggcct

SEQ ID NO: 439497 - DNA, 140 bp, Artificial Sequence
  Synthetic
aggccctggctgctgatatggcaaatgttgtcagacactttagacaaattgtctgattactgtacgtttgtttgtttcattggagaagttcatgtctactcccaatgccatctttatttcgaccttttgggacagcggtg

SEQ ID NO: 439498 - DNA, 140 bp, Artificial Sequence
  Synthetic
caccgctgtcccaaaaggtcgaaataaagatggcattgggagtagacatgaacttctccaatgaaacaaacaaacgtacagtaatcagacaatttgtctaaagtgtctgacaacatttgccatatcagcagccagggcct

SEQ ID NO: 439499 - DNA, 140 bp, Artificial Sequence
  Synthetic
atacgccatgctgggtctcctgtggcgataattctgctaagttttgggaagagagcttctatagagaactctatgaagctcctacaactttgcaagccgttggttcttgtgtggtgtgtccgtacttgggagtcggccat

SEQ ID NO: 439500 - DNA, 140 bp, Artificial Sequence
  Synthetic
atggccgactcccaagtacggacacaccacacaagaaccaacggcttgcaaagttgtaggagcttcatagagttctctatagaagctctcttcccaaaacttagcagaattatcgccacaggagacccagcatggcgtat

SEQ ID NO: 439501 - DNA, 140 bp, Artificial Sequence
  Synthetic
atacgccatgctgggtctccgttgctttgtagatgatatcgtcaagactgacggtacactcatggttgagcggtttgtgtcgttagctatagatgcttaccctctcacaaagcatgaagacgtacttgggagtcggccat

SEQ ID NO: 439502 - DNA, 140 bp, Artificial Sequence
  Synthetic
atggccgactcccaagtacgtcttcatgctttgtgagagggtaagcatctatagctaacgacacaaaccgctcaaccatgagtgtaccgtcagtcttgacgatatcatctacaaagcaacggagacccagcatggcgtat

SEQ ID NO: 439503 - DNA, 140 bp, Artificial Sequence
  Synthetic
atacgccatgctgggtctccactaattcaggcgttgcaatttatcatagatataaggcaggtaattacagaagtccgcctatcacggcggatagtgaacttgcattgcttcgagcttaggcgtacttgggagtcggccat

SEQ ID NO: 439504 - DNA, 140 bp, Artificial Sequence
  Synthetic
atggccgactcccaagtacgcctaagctcgaagcaatgcaagttcactatccgccgtgataggcggacttctgtaattacctgccttatatctatgataaattgcaacgcctgaattagtggagacccagcatggcgtat

SEQ ID NO: 439505 - DNA, 140 bp, Artificial Sequence
  Synthetic
atacgccatgctgggtctccagaccgcactctggaatataaagttctggacaatggtgtcattagagatataacctctggtgataagtgctttgctaataagtaccggtcttttgctcaacgtacttgggagtcggccat

SEQ ID NO: 439506 - DNA, 140 bp, Artificial Sequence
  Synthetic
atggccgactcccaagtacgttgagcaaaagaccggtacttattagcaaagcacttatcaccagaggttatatctctaatgacaccattgtccagaactttatattccagagtgcggtctggagacccagcatggcgtat

SEQ ID NO: 439507 - DNA, 140 bp, Artificial Sequence
  Synthetic
atacgccatgctgggtctcctttagaataccaaaatgtattctgggtctatttacagtatatagaaaaactgtataaggaccttacagggcacatgctagacagttactctgtcatgctacgtacttgggagtcggccat

SEQ ID NO: 439508 - DNA, 140 bp, Artificial Sequence
  Synthetic
atggccgactcccaagtacgtagcatgacagagtaactgtctagcatgtgccctgtaaggtccttatacagtttttctatatactgtaaatagacccagaatacattttggtattctaaaggagacccagcatggcgtat

SEQ ID NO: 439509 - DNA, 140 bp, Artificial Sequence
  Synthetic
aggccctggctgctgatatgaagatgtctataagagtcttaccatagttgacattccacagagtttgactttttcatatgatgggttacgtggcgcaatacgtaaagctaaagattatgggaccttttgggacagcggtg

SEQ ID NO: 439510 - DNA, 140 bp, Artificial Sequence
  Synthetic
caccgctgtcccaaaaggtcccataatctttagctttacgtattgcgccacgtaacccatcatatgaaaaagtcaaactctgtggaatgtcaactatggtaagactcttatagacatcttcatatcagcagccagggcct

SEQ ID NO: 439511 - DNA, 140 bp, Artificial Sequence
  Synthetic
aggccctggctgctgatatgtagcaactgttattcttcactgattttggattacttttcatacccacttagtatgaaatccgatctcagtgttagttctgctggtccaatatcccagtttgaccttttgggacagcggtg

SEQ ID NO: 439512 - DNA, 140 bp, Artificial Sequence
  Synthetic
caccgctgtcccaaaaggtcaaactgggatattggaccagcagaactaacactgagatcggatttcatactaagtgggtatgaaaagtaatccaaaatcagtgaagaataacagttgctacatatcagcagccagggcct

SEQ ID NO: 439513 - DNA, 140 bp, Artificial Sequence
  Synthetic
aggccctggctgctgatatggcgcactcgcacccgtccaagtgttcagcctggtccaatgattgatgttaacactgattagtgttactcaaagtaacaagatcgcggcaatcgtttgtgtgaccttttgggacagcggtg

SEQ ID NO: 439514 - DNA, 140 bp, Artificial Sequence
  Synthetic
caccgctgtcccaaaaggtcacacaaacgattgccgcgatcttgttactttgagtaacactaatcagtgttaacatcaatcattggaccaggctgaacacttggacgggtgcgagtgcgccatatcagcagccagggcct

SEQ ID NO: 439515 - DNA, 140 bp, Artificial Sequence
  Synthetic
aggccctggctgctgatatgactgttgattcctcacagggttcagaataccagtacgttatcttctgtcaaacagcagatacggcacatgctaacaacattaacagatttaatgttgcaagaccttttgggacagcggtg

SEQ ID NO: 439516 - DNA, 140 bp, Artificial Sequence
  Synthetic
caccgctgtcccaaaaggtcttgcaacattaaatctgttaatgttgttagcatgtgccgtatctgctgtttgacagaagataacgtactggtattctgaaccctgtgaggaatcaacagtcatatcagcagccagggcct

SEQ ID NO: 439517 - DNA, 140 bp, Artificial Sequence
  Synthetic
aggccctggctgctgatatgagagaatgttaaagactgtcacctctgcgtgattgcaagtgaacagtgccccccgggaagagctctacagtgtgaaatgtaaataaaaatagctattattgaccttttgggacagcggtg

SEQ ID NO: 439518 - DNA, 140 bp, Artificial Sequence
  Synthetic
caccgctgtcccaaaaggtcaataatagctatttttatttacatttcacactgtagagctcttcccggggggcactgttcacttgcaatcacgcagaggtgacagtctttaacattctctcatatcagcagccagggcct

SEQ ID NO: 439519 - DNA, 140 bp, Artificial Sequence
  Synthetic
atacgccatgctgggtctccgttaatcttgcaaaaatgtgcacttatatcatctttgcttatgctccacaactaactcttgtgcttccagaagtgaagatggttcttttattatacacatcgtacttgggagtcggccat

SEQ ID NO: 439520 - DNA, 140 bp, Artificial Sequence
  Synthetic
atggccgactcccaagtacgatgtgtataataaaagaaccatcttcacttctggaagcacaagagttagttgtggagcataagcaaagatgatataagtgcacatttttgcaagattaacggagacccagcatggcgtat

SEQ ID NO: 439521 - DNA, 140 bp, Artificial Sequence
  Synthetic
atacgccatgctgggtctcctattcaacttgtgtctgcttttcctcacattgatgaggatacagatgcagtaggacggcaagctgaggagcctcaagtcatattatcatgcattcccactcgtacttgggagtcggccat

SEQ ID NO: 439522 - DNA, 140 bp, Artificial Sequence
  Synthetic
atggccgactcccaagtacgagtgggaatgcatgataatatgacttgaggctcctcagcttgccgtcctactgcatctgtatcctcatcaatgtgaggaaaagcagacacaagttgaataggagacccagcatggcgtat

SEQ ID NO: 439523 - DNA, 140 bp, Artificial Sequence
  Synthetic
aggccctggctgctgatatgctaatggtgcttgtatttggaacgctgctgcatatatgaaactctcggatgcacttaaacgacagattcgcattgcatgccgtaagtgtaatttagctttgaccttttgggacagcggtg

SEQ ID NO: 439524 - DNA, 140 bp, Artificial Sequence
  Synthetic
caccgctgtcccaaaaggtcaaagctaaattacacttacggcatgcaatgcgaatctgtcgtttaagtgcatccgagagtttcatatatgcagcagcgttccaaatacaagcaccattagcatatcagcagccagggcct

SEQ ID NO: 439525 - DNA, 140 bp, Artificial Sequence
  Synthetic
atacgccatgctgggtctcccaatgacacaacaacaaaccagcctagaggtagaggacgtaatccgaaacccagagctgcaccaaataccactgtctcatggtacactgggcttacccaacgtacttgggagtcggccat

SEQ ID NO: 439526 - DNA, 140 bp, Artificial Sequence
  Synthetic
atggccgactcccaagtacgttgggtaagcccagtgtaccatgagacagtggtatttggtgcagctctgggtttcggattacgtcctctacctctaggctggtttgttgttgtgtcattgggagacccagcatggcgtat

SEQ ID NO: 439527 - DNA, 140 bp, Artificial Sequence
  Synthetic
aggccctggctgctgatatgggcactgttattattagcccatctaccagcgctactatacgaaaaatttaccctgcttttatgctgggttcttcagttggtaatttctcagatggtaaaagaccttttgggacagcggtg

SEQ ID NO: 439528 - DNA, 140 bp, Artificial Sequence
  Synthetic
caccgctgtcccaaaaggtcttttaccatctgagaaattaccaactgaagaacccagcataaaagcagggtaaatttttcgtatagtagcgctggtagatgggctaataataacagtgcccatatcagcagccagggcct

SEQ ID NO: 439529 - DNA, 140 bp, Artificial Sequence
  Synthetic
atacgccatgctgggtctccgttttggtttcatgtgtacctgttattttggtgtcttttctttactgaacctcaaacttagagctccaatgggtgtctatgattttaaggtttcgacacacgtacttgggagtcggccat

SEQ ID NO: 439530 - DNA, 140 bp, Artificial Sequence
  Synthetic
atggccgactcccaagtacgtgtgtcgaaaccttaaaatcatagacacccattggagctctaagtttgaggttcagtaaagaaaagacaccaaaataacaggtacacatgaaaccaaaacggagacccagcatggcgtat

SEQ ID NO: 439531 - DNA, 140 bp, Artificial Sequence
  Synthetic
aggccctggctgctgatatgcgcgcaaagcgaggaagaggagtcattctccaactaagaaactgcgctacgttaagcgtagattttctcttctgcgccctgaagaccttagtgttattgtgaccttttgggacagcggtg

SEQ ID NO: 439532 - DNA, 140 bp, Artificial Sequence
  Synthetic
caccgctgtcccaaaaggtcacaataacactaaggtcttcagggcgcagaagagaaaatctacgcttaacgtagcgcagtttcttagttggagaatgactcctcttcctcgctttgcgcgcatatcagcagccagggcct

SEQ ID NO: 439533 - DNA, 140 bp, Artificial Sequence
  Synthetic
aggccctggctgctgatatgtaagaaggaaaagaaacaaaaggcaccaaaagaagaatcaacagaccaaatgtctgaacctcctaaggagcatcgtgtgcaaggtactcagcgcactcgcgaccttttgggacagcggtg

SEQ ID NO: 439534 - DNA, 140 bp, Artificial Sequence
  Synthetic
caccgctgtcccaaaaggtcgcgagtgcgctgagtaccttgcacacgatgctccttaggaggttcagacatttggtctgttgattcttcttttggtgccttttgtttcttttccttcttacatatcagcagccagggcct

SEQ ID NO: 439535 - DNA, 140 bp, Artificial Sequence
  Synthetic
aggccctggctgctgatatggtatacccactaatttttcctttggtgtgactcaggagtacattcagacaaccattcagaaagttactgttgattgtaaacagtacgtttgcaatggtttgaccttttgggacagcggtg

SEQ ID NO: 439536 - DNA, 140 bp, Artificial Sequence
  Synthetic
caccgctgtcccaaaaggtcaaaccattgcaaacgtactgtttacaatcaacagtaactttctgaatggttgtctgaatgtactcctgagtcacaccaaaggaaaaattagtgggtataccatatcagcagccagggcct

SEQ ID NO: 439537 - DNA, 140 bp, Artificial Sequence
  Synthetic
aggccctggctgctgatatggctcgtgatcttatttgtgctcaatatgtggctggttataaagtattacctcctcttatggatgttaatatggaagccgcgtatacttcatctttgcttggaccttttgggacagcggtg

SEQ ID NO: 439538 - DNA, 140 bp, Artificial Sequence
  Synthetic
caccgctgtcccaaaaggtccaagcaaagatgaagtatacgcggcttccatattaacatccataagaggaggtaatactttataaccagccacatattgagcacaaataagatcacgagccatatcagcagccagggcct

SEQ ID NO: 439539 - DNA, 140 bp, Artificial Sequence
  Synthetic
atacgccatgctgggtctcccaacaggttttatctgaaaaccaaaagattattgccaacaagtttaatcaggctttaggtgccatgcagactggcttcacaacaactaatgaggctttcccgtacttgggagtcggccat

SEQ ID NO: 439540 - DNA, 140 bp, Artificial Sequence
  Synthetic
atggccgactcccaagtacgggaaagcctcattagttgttgtgaagccagtctgcatggcacctaaagcctgattaaacttgttggcaataatcttttggttttcagataaaacctgttgggagacccagcatggcgtat

SEQ ID NO: 439541 - DNA, 140 bp, Artificial Sequence
  Synthetic
atacgccatgctgggtctccttcttcgcaatgcctatgtgtacacttcacaagggtttgtggtggtcaatggcaaagtttctacacttgtcaaacaagtgttagacttgcttaataagggcgtacttgggagtcggccat

SEQ ID NO: 439542 - DNA, 140 bp, Artificial Sequence
  Synthetic
atggccgactcccaagtacgcccttattaagcaagtctaacacttgtttgacaagtgtagaaactttgccattgaccaccacaaacccttgtgaagtgtacacataggcattgcgaagaaggagacccagcatggcgtat

SEQ ID NO: 439543 - DNA, 140 bp, Artificial Sequence
  Synthetic
aggccctggctgctgatatgttattacttcctgccaaactgctgttagtaagcttctagatacatgttttgaagctacagaagcaacatttaacttcttgttagatttggcaggattgttgaccttttgggacagcggtg

SEQ ID NO: 439544 - DNA, 140 bp, Artificial Sequence
  Synthetic
caccgctgtcccaaaaggtcaacaatcctgccaaatctaacaagaagttaaatgttgcttctgtagcttcaaaacatgtatctagaagcttactaacagcagtttggcaggaagtaataacatatcagcagccagggcct

SEQ ID NO: 439545 - DNA, 140 bp, Artificial Sequence
  Synthetic
atacgccatgctgggtctcccatcctgatgtttctggcgtttgtaagtttaagggtagatttgtacagatcccgtcgcaatgtactcgcgaccctgttggtttctgtttgacaaatgacccgtacttgggagtcggccat

SEQ ID NO: 439546 - DNA, 140 bp, Artificial Sequence
  Synthetic
atggccgactcccaagtacgggtcatttgtcaaacagaaaccaacagggtcgcgagtacattgcgacgggatctgtacaaatctacccttaaacttacaaacgccagaaacatcaggatgggagacccagcatggcgtat

SEQ ID NO: 439547 - DNA, 140 bp, Artificial Sequence
  Synthetic
aggccctggctgctgatatgggtttggaaaacattgcttttaattttgttaaacaaggccattttattggtgttgagggtgaactacctgtagctgtagtcaatgataagatcttcaccagaccttttgggacagcggtg

SEQ ID NO: 439548 - DNA, 140 bp, Artificial Sequence
  Synthetic
caccgctgtcccaaaaggtctggtgaagatcttatcattgactacagctacaggtagttcaccctcaacaccaataaaatggccttgtttaacaaaattaaaagcaatgttttccaaacccatatcagcagccagggcct

SEQ ID NO: 439549 - DNA, 140 bp, Artificial Sequence
  Synthetic
aggccctggctgctgatatgacttcatctttgcttggcagcatagcaggtgttggctggactgctggcttatcctcctttgctgctattccatttgcacagagtatcttttataggttaagaccttttgggacagcggtg

SEQ ID NO: 439550 - DNA, 140 bp, Artificial Sequence
  Synthetic
caccgctgtcccaaaaggtcttaacctataaaagatactctgtgcaaatggaatagcagcaaaggaggataagccagcagtccagccaacacctgctatgctgccaagcaaagatgaagtcatatcagcagccagggcct

SEQ ID NO: 439551 - DNA, 140 bp, Artificial Sequence
  Synthetic
aggccctggctgctgatatgtggtttttgtcactacactcactagtgattatacgattacagtctttgttactgtcaaccttgcaaaagtttgcacttatgccatctttgcttactcaccgaccttttgggacagcggtg

SEQ ID NO: 439552 - DNA, 140 bp, Artificial Sequence
  Synthetic
caccgctgtcccaaaaggtcggtgagtaagcaaagatggcataagtgcaaacttttgcaaggttgacagtaacaaagactgtaatcgtataatcactagtgagtgtagtgacaaaaaccacatatcagcagccagggcct

SEQ ID NO: 439553 - DNA, 140 bp, Artificial Sequence
  Synthetic
atacgccatgctgggtctccagacctgtgtgtagctttccgttatgcgccaatggcttagtctttggtctttataagaatatgtgcactggtagcccatctgtagtcgagtttaacaggtcgtacttgggagtcggccat

SEQ ID NO: 439554 - DNA, 140 bp, Artificial Sequence
  Synthetic
atggccgactcccaagtacgacctgttaaactcgactacagatgggctaccagtgcacatattcttataaagaccaaagactaagccattggcgcataacggaaagctacacacaggtctggagacccagcatggcgtat

SEQ ID NO: 439555 - DNA, 140 bp, Artificial Sequence
  Synthetic
aggccctggctgctgatatgcttgattttaacgaacttaaataaaagccctgttgtttagcgtattgttgcacttgtctggtgggattgtggcattaatttgcctgctcatctaggcagtgaccttttgggacagcggtg

SEQ ID NO: 439556 - DNA, 140 bp, Artificial Sequence
  Synthetic
caccgctgtcccaaaaggtcactgcctagatgagcaggcaaattaatgccacaatcccaccagacaagtgcaacaatacgctaaacaacagggcttttatttaagttcgttaaaatcaagcatatcagcagccagggcct

SEQ ID NO: 439557 - DNA, 140 bp, Artificial Sequence
  Synthetic
aggccctggctgctgatatgagcggcttttaaggcggtgtgttctgttatagatttaaagcttgacgactttgttatgattttaaagagtcaagaccttggcgtagtatccaaggttgtcgaccttttgggacagcggtg

SEQ ID NO: 439558 - DNA, 140 bp, Artificial Sequence
  Synthetic
caccgctgtcccaaaaggtcgacaaccttggatactacgccaaggtcttgactctttaaaatcataacaaagtcgtcaagctttaaatctataacagaacacaccgccttaaaagccgctcatatcagcagccagggcct

SEQ ID NO: 439559 - DNA, 140 bp, Artificial Sequence
  Synthetic
aggccctggctgctgatatggcaaatgttgtcagacactttagacaaattgtctgattactgtacgtttgtttgttgggctcatgcgtactcttcacctctgcaatcttatgcctgctgggaccttttgggacagcggtg

SEQ ID NO: 439560 - DNA, 140 bp, Artificial Sequence
  Synthetic
caccgctgtcccaaaaggtcccagcaggcataagattgcagaggtgaagagtacgcatgagcccaacaaacaaacgtacagtaatcagacaatttgtctaaagtgtctgacaacatttgccatatcagcagccagggcct

SEQ ID NO: 439561 - DNA, 140 bp, Artificial Sequence
  Synthetic
atacgccatgctgggtctccactgctacagagcaacaaattactgtacaggtgtttgaggctaaagcctttgaaacaccggcagtcaatttttgtaatgctgttagtgtagtcattgacacgtacttgggagtcggccat

SEQ ID NO: 439562 - DNA, 140 bp, Artificial Sequence
  Synthetic
atggccgactcccaagtacgtgtcaatgactacactaacagcattacaaaaattgactgccggtgtttcaaaggctttagcctcaaacacctgtacagtaatttgttgctctgtagcagtggagacccagcatggcgtat

SEQ ID NO: 439563 - DNA, 140 bp, Artificial Sequence
  Synthetic
atacgccatgctgggtctcctaatcaattcacagagtttattggtactcatgcgcttgatatgttagctgttaagaccggtgttagtgttgaacagctcctttctgctatccagcaacttcgtacttgggagtcggccat

SEQ ID NO: 439564 - DNA, 140 bp, Artificial Sequence
  Synthetic
atggccgactcccaagtacgaagttgctggatagcagaaaggagctgttcaacactaacaccggtcttaacagctaacatatcaagcgcatgagtaccaataaactctgtgaattgattaggagacccagcatggcgtat

SEQ ID NO: 439565 - DNA, 140 bp, Artificial Sequence
  Synthetic
aggccctggctgctgatatggagtacttactcactttttgatttatccaagtttcaattaaaattaaaaggaacaccagttcttcaattaaaggagagtcaaattaacgaactcgtaatagaccttttgggacagcggtg

SEQ ID NO: 439566 - DNA, 140 bp, Artificial Sequence
  Synthetic
caccgctgtcccaaaaggtctattacgagttcgttaatttgactctcctttaattgaagaactggtgttccttttaattttaattgaaacttggataaatcaaaaagtgagtaagtactccatatcagcagccagggcct

SEQ ID NO: 439567 - DNA, 140 bp, Artificial Sequence
  Synthetic
atacgccatgctgggtctcctggctacttgtgactggactgagagcggcgactacacgcttgctaatactacaacagaaccccttaaactatttgctgctgaaactttacgtgccactgacgtacttgggagtcggccat

SEQ ID NO: 439568 - DNA, 140 bp, Artificial Sequence
  Synthetic
atggccgactcccaagtacgtcagtggcacgtaaagtttcagcagcaaatagtttaaggggttctgttgtagtattagcaagcgtgtagtcgccgctctcagtccagtcacaagtagccaggagacccagcatggcgtat

SEQ ID NO: 439569 - DNA, 140 bp, Artificial Sequence
  Synthetic
aggccctggctgctgatatgcaagccactaaatttactttgtggaactacttgtttgagactattcccacacagttgttcccactcttatttgtgactatggccttcgttatgttgttgggaccttttgggacagcggtg

SEQ ID NO: 439570 - DNA, 140 bp, Artificial Sequence
  Synthetic
caccgctgtcccaaaaggtcccaacaacataacgaaggccatagtcacaaataagagtgggaacaactgtgtgggaatagtctcaaacaagtagttccacaaagtaaatttagtggcttgcatatcagcagccagggcct

SEQ ID NO: 439571 - DNA, 140 bp, Artificial Sequence
  Synthetic
atacgccatgctgggtctccgctggtaactacagacgtccggcaattgtgcctgacgccgaacttgcactgctgcgagcgtaagctcattagtaagagtatgatttaaaatcattaacgacgtacttgggagtcggccat

SEQ ID NO: 439572 - DNA, 140 bp, Artificial Sequence
  Synthetic
atggccgactcccaagtacgtcgttaatgattttaaatcatactcttactaatgagcttacgctcgcagcagtgcaagttcggcgtcaggcacaattgccggacgtctgtagttaccagcggagacccagcatggcgtat

SEQ ID NO: 439573 - DNA, 140 bp, Artificial Sequence
  Synthetic
atacgccatgctgggtctccttgtatgacttatacatgccaatgtggtagtgagcgttatcgtcaattagtcgaacacacaaccccttggctgttactctcaggcacaccaaaggagaaacgtacttgggagtcggccat

SEQ ID NO: 439574 - DNA, 140 bp, Artificial Sequence
  Synthetic
atggccgactcccaagtacgtttctcctttggtgtgcctgagagtaacagccaaggggttgtgtgttcgactaattgacgataacgctcactaccacattggcatgtataagtcatacaaggagacccagcatggcgtat

SEQ ID NO: 439575 - DNA, 140 bp, Artificial Sequence
  Synthetic
atacgccatgctgggtctccggaggcgtctaagcagtcttatgcaatcgccacgatcaaagagattgttggtgaacgtgaacttattcttgtgtgggaggctggtaaatccaaacccccacgtacttgggagtcggccat

SEQ ID NO: 439576 - DNA, 140 bp, Artificial Sequence
  Synthetic
atggccgactcccaagtacgtgggggtttggatttaccagcctcccacacaagaataagttcacgttcaccaacaatctctttgatcgtggcgattgcataagactgcttagacgcctccggagacccagcatggcgtat

SEQ ID NO: 439577 - DNA, 140 bp, Artificial Sequence
  Synthetic
aggccctggctgctgatatgccatctcaccatcgcttgtccactcttgcacagaatggaatcatgttgtaattacagtgcaataaggtaattataacccatttaattgatagctatgcttgaccttttgggacagcggtg

SEQ ID NO: 439578 - DNA, 140 bp, Artificial Sequence
  Synthetic
caccgctgtcccaaaaggtcaagcatagctatcaattaaatgggttataattaccttattgcactgtaattacaacatgattccattctgtgcaagagtggacaagcgatggtgagatggcatatcagcagccagggcct

SEQ ID NO: 439579 - DNA, 140 bp, Artificial Sequence
  Synthetic
aggccctggctgctgatatgatctaactgcacctagaaattcttgggaggctatggctctgaactttaagttaataggtgttggcggtgcaccttgtataaaggttgctgctatgcagtcgaccttttgggacagcggtg

SEQ ID NO: 439580 - DNA, 140 bp, Artificial Sequence
  Synthetic
caccgctgtcccaaaaggtcgactgcatagcagcaacctttatacaaggtgcaccgccaacacctattaacttaaagttcagagccatagcctcccaagaatttctaggtgcagttagatcatatcagcagccagggcct

SEQ ID NO: 439581 - DNA, 140 bp, Artificial Sequence
  Synthetic
atacgccatgctgggtctccgtatacttactcagtcctaccagatgaaaatggtgatatccttatggctgagtatagcacatatgaccccatttacaagaatggtgccatgcttaatggtcgtacttgggagtcggccat

SEQ ID NO: 439582 - DNA, 140 bp, Artificial Sequence
  Synthetic
atggccgactcccaagtacgaccattaagcatggcaccattcttgtaaatggggtcatatgtgctatactcagccataaggatatcaccattttcatctggtaggactgagtaagtatacggagacccagcatggcgtat

SEQ ID NO: 439583 - DNA, 140 bp, Artificial Sequence
  Synthetic
atacgccatgctgggtctcccctcttatgcataagggggctgcgtggcctattgttagacgacgtatagtgcaaatgttgtcagacactttagacaaattgtctgattactgtacgtttgcgtacttgggagtcggccat

SEQ ID NO: 439584 - DNA, 140 bp, Artificial Sequence
  Synthetic
atggccgactcccaagtacgcaaacgtacagtaatcagacaatttgtctaaagtgtctgacaacatttgcactatacgtcgtctaacaataggccacgcagcccccttatgcataagaggggagacccagcatggcgtat

SEQ ID NO: 439585 - DNA, 140 bp, Artificial Sequence
  Synthetic
aggccctggctgctgatatggcacgtagtctatggagacttctctcatactacgttaggcggtcttcacttgcttattggtttatacaagaagcaacaggaaggtcatattattatggaagaccttttgggacagcggtg

SEQ ID NO: 439586 - DNA, 140 bp, Artificial Sequence
  Synthetic
caccgctgtcccaaaaggtcttccataataatatgaccttcctgttgcttcttgtataaaccaataagcaagtgaagaccgcctaacgtagtatgagagaagtctccatagactacgtgccatatcagcagccagggcct

SEQ ID NO: 439587 - DNA, 140 bp, Artificial Sequence
  Synthetic
atacgccatgctgggtctccctcaaccgtaattatgtctttactggttatcatataaccaaaaatagtaaagtgcagctcggtgagtacatcttcgagcgcattgattatagtgatgctgcgtacttgggagtcggccat

SEQ ID NO: 439588 - DNA, 140 bp, Artificial Sequence
  Synthetic
atggccgactcccaagtacgcagcatcactataatcaatgcgctcgaagatgtactcaccgagctgcactttactatttttggttatatgataaccagtaaagacataattacggttgagggagacccagcatggcgtat

SEQ ID NO: 439589 - DNA, 140 bp, Artificial Sequence
  Synthetic
aggccctggctgctgatatgttcttaaggctttgcagaaggctgttaatatagctaaaaacgcctatgagaaggataaggcagtggcccgtaagttagaacgtatggctgatcaggctatgaccttttgggacagcggtg

SEQ ID NO: 439590 - DNA, 140 bp, Artificial Sequence
  Synthetic
caccgctgtcccaaaaggtcatagcctgatcagccatacgttctaacttacgggccactgccttatccttctcataggcgtttttagctatattaacagccttctgcaaagccttaagaacatatcagcagccagggcct

SEQ ID NO: 439591 - DNA, 140 bp, Artificial Sequence
  Synthetic
aggccctggctgctgatatgaggtaattataacccatttaattgatagctatgctttattaaagtgtgtagctgtagagagaatgttaaagactgtcacctctgcgtgattgcaagtgaagaccttttgggacagcggtg

SEQ ID NO: 439592 - DNA, 140 bp, Artificial Sequence
  Synthetic
caccgctgtcccaaaaggtcttcacttgcaatcacgcagaggtgacagtctttaacattctctctacagctacacactttaataaagcatagctatcaattaaatgggttataattacctcatatcagcagccagggcct

SEQ ID NO: 439593 - DNA, 140 bp, Artificial Sequence
  Synthetic
aggccctggctgctgatatgatgacatggattctggtgtgtcatcctttagtgaactactttttgattgcgttgatctttcagtagcttctacctattttttagtccgcctcttgcaagagaccttttgggacagcggtg

SEQ ID NO: 439594 - DNA, 140 bp, Artificial Sequence
  Synthetic
caccgctgtcccaaaaggtctcttgcaagaggcggactaaaaaataggtagaagctactgaaagatcaacgcaatcaaaaagtagttcactaaaggatgacacaccagaatccatgtcatcatatcagcagccagggcct

SEQ ID NO: 439595 - DNA, 140 bp, Artificial Sequence
  Synthetic
atacgccatgctgggtctcctacatcatccaggattttaacttaaacttgacccaaagaatcccaactacaataagtggttggagcttcttgagcaaaatattgatgcctacaaaaccttcgtacttgggagtcggccat

SEQ ID NO: 439596 - DNA, 140 bp, Artificial Sequence
  Synthetic
atggccgactcccaagtacgaaggttttgtaggcatcaatattttgctcaagaagctccaaccacttattgtagttgggattctttgggtcaagtttaagttaaaatcctggatgatgtaggagacccagcatggcgtat

SEQ ID NO: 439597 - DNA, 140 bp, Artificial Sequence
  Synthetic
atacgccatgctgggtctccttgtttgtatatccctaaacctacagctaagtatacacctgcacctggcacttcattgcaccctgtgcagtggaactgtcagctgtcttttgctggttatcgtacttgggagtcggccat

SEQ ID NO: 439598 - DNA, 140 bp, Artificial Sequence
  Synthetic
atggccgactcccaagtacgataaccagcaaaagacagctgacagttccactgcacagggtgcaatgaagtgccaggtgcaggtgtatacttagctgtaggtttagggatatacaaacaaggagacccagcatggcgtat

SEQ ID NO: 439599 - DNA, 140 bp, Artificial Sequence
  Synthetic
atacgccatgctgggtctccgatttaagtgaatagcctagctatctcacgcccccctctcgttctcttgaagaactttgattttaacgaacttaaataaaagccctgttgcaaagtgtaccgtacttgggagtcggccat

SEQ ID NO: 439600 - DNA, 140 bp, Artificial Sequence
  Synthetic
atggccgactcccaagtacggtacactttgcaacagggcttttatttaagttcgttaaaatcaaagttcttcaagagaacgagaggggggcgtgagatagctaggctattcacttaaatcggagacccagcatggcgtat

SEQ ID NO: 439601 - DNA, 140 bp, Artificial Sequence
  Synthetic
aggccctggctgctgatatgacccgtccaagtgttcagcctggtccaatgattgatgttaacactgattagtgtcactcaaagtaacaagatcgcggcaatcgtttgtgtttggcaacccgaccttttgggacagcggtg

SEQ ID NO: 439602 - DNA, 140 bp, Artificial Sequence
  Synthetic
caccgctgtcccaaaaggtcgggttgccaaacacaaacgattgccgcgatcttgttactttgagtgacactaatcagtgttaacatcaatcattggaccaggctgaacacttggacgggtcatatcagcagccagggcct

SEQ ID NO: 439603 - DNA, 140 bp, Artificial Sequence
  Synthetic
atacgccatgctgggtctcctgcggtcgactggcattattatgatgctcagcccttgcgtaagaatgtacaacagcttttctacacagaggacatggcctctagatttgctgatgggcttcgtacttgggagtcggccat

SEQ ID NO: 439604 - DNA, 140 bp, Artificial Sequence
  Synthetic
atggccgactcccaagtacgaagcccatcagcaaatctagaggccatgtcctctgtgtagaaaagctgttgtacattcttacgcaagggctgagcatcataataatgccagtcgaccgcaggagacccagcatggcgtat

SEQ ID NO: 439605 - DNA, 140 bp, Artificial Sequence
  Synthetic
atacgccatgctgggtctccttaacgttgctaaaaatgcttatgaaaaagataaagctgtagcacgtaagttagagcgtatggctgaacaggccatgacgtctatgtataagcaagcacgcgtacttgggagtcggccat

SEQ ID NO: 439606 - DNA, 140 bp, Artificial Sequence
  Synthetic
atggccgactcccaagtacgcgtgcttgcttatacatagacgtcatggcctgttcagccatacgctctaacttacgtgctacagctttatctttttcataagcatttttagcaacgttaaggagacccagcatggcgtat

SEQ ID NO: 439607 - DNA, 140 bp, Artificial Sequence
  Synthetic
atacgccatgctgggtctcccatgcccactttgtcaatattggaaaggatatggttgcaactgcgattctcttagagaagcagcgctcccacaatccaaggattccaattttttaaacgacgtacttgggagtcggccat

SEQ ID NO: 439608 - DNA, 140 bp, Artificial Sequence
  Synthetic
atggccgactcccaagtacgtcgtttaaaaaattggaatccttggattgtgggagcgctgcttctctaagagaatcgcagttgcaaccatatcctttccaatattgacaaagtgggcatgggagacccagcatggcgtat

SEQ ID NO: 439609 - DNA, 140 bp, Artificial Sequence
  Synthetic
aggccctggctgctgatatgtggcgtaaggcgaggcgataacttccatagtgtcttaacaacattcattgacgcagcacgaggccccgcaggtgtggagtctgatgttgagaccaatgaagaccttttgggacagcggtg

SEQ ID NO: 439610 - DNA, 140 bp, Artificial Sequence
  Synthetic
caccgctgtcccaaaaggtcttcattggtctcaacatcagactccacacctgcggggcctcgtgctgcgtcaatgaatgttgttaagacactatggaagttatcgcctcgccttacgccacatatcagcagccagggcct

SEQ ID NO: 439611 - DNA, 140 bp, Artificial Sequence
  Synthetic
aggccctggctgctgatatggaccttggcgtagtatccaaggttgtcaaggttcctattgacttaacaatgattgagtttatgttatggtgtaaggatggacaggttcaaaccttctaccgaccttttgggacagcggtg

SEQ ID NO: 439612 - DNA, 140 bp, Artificial Sequence
  Synthetic
caccgctgtcccaaaaggtcggtagaaggtttgaacctgtccatccttacaccataacataaactcaatcattgttaagtcaataggaaccttgacaaccttggatactacgccaaggtccatatcagcagccagggcct

SEQ ID NO: 439613 - DNA, 140 bp, Artificial Sequence
  Synthetic
atacgccatgctgggtctcctgtcgtggttcgccagacatatgcgctgcattgggtacaatactaattaaatactatttttcattctgagcggcgtgtctcttgtacatcccggtcacaacgtacttgggagtcggccat

SEQ ID NO: 439614 - DNA, 140 bp, Artificial Sequence
  Synthetic
atggccgactcccaagtacgttgtgaccgggatgtacaagagacacgccgctcagaatgaaaaatagtatttaattagtattgtacccaatgcagcgcatatgtctggcgaaccacgacaggagacccagcatggcgtat

SEQ ID NO: 439615 - DNA, 140 bp, Artificial Sequence
  Synthetic
atacgccatgctgggtctcccggtctccgtggcgcaggtgaccttcagggaaactttggtgacttacaacttaacaaactcggcacagaggaccctcgttggcctcagatagctgagcttcgtacttgggagtcggccat

SEQ ID NO: 439616 - DNA, 140 bp, Artificial Sequence
  Synthetic
atggccgactcccaagtacgaagctcagctatctgaggccaacgagggtcctctgtgccgagtttgttaagttgtaagtcaccaaagtttccctgaaggtcacctgcgccacggagaccgggagacccagcatggcgtat

SEQ ID NO: 439617 - DNA, 140 bp, Artificial Sequence
  Synthetic
aggccctggctgctgatatggttgtcatagctgacaccttacaggaaactcctgttgtgcctgatactgttgaagtcccaccgcaagtggtggaacttccgtttgaacctcagactatccgaccttttgggacagcggtg

SEQ ID NO: 439618 - DNA, 140 bp, Artificial Sequence
  Synthetic
caccgctgtcccaaaaggtcggatagtctgaggttcaaacggaagttccaccacttgcggtgggacttcaacagtatcaggcacaacaggagtttcctgtaaggtgtcagctatgacaaccatatcagcagccagggcct

SEQ ID NO: 439619 - DNA, 140 bp, Artificial Sequence
  Synthetic
atacgccatgctgggtctcctttgctgctattccatttgcacagagtatcttttataggttaaacggtgttggcattactcaacaggttctttcagagaaccaaaagcttattgccaatacgtacttgggagtcggccat

SEQ ID NO: 439620 - DNA, 140 bp, Artificial Sequence
  Synthetic
atggccgactcccaagtacgtattggcaataagcttttggttctctgaaagaacctgttgagtaatgccaacaccgtttaacctataaaagatactctgtgcaaatggaatagcagcaaaggagacccagcatggcgtat

SEQ ID NO: 439621 - DNA, 140 bp, Artificial Sequence
  Synthetic
atacgccatgctgggtctcccaggtgccctagagaaattgttaacactgttagtgcccttgtctacaacaataaattgttggcaaagaaggagccttcaggtcagtgttttaaaatactccgtacttgggagtcggccat

SEQ ID NO: 439622 - DNA, 140 bp, Artificial Sequence
  Synthetic
atggccgactcccaagtacggagtattttaaaacactgacctgaaggctccttctttgccaacaatttattgttgtagacaagggcactaacagtgttaacaatttctctagggcacctgggagacccagcatggcgtat

SEQ ID NO: 439623 - DNA, 140 bp, Artificial Sequence
  Synthetic
aggccctggctgctgatatgtgtatacctcttagtgtcattccactgtgtgcttcaaataaacttcgcgttgtaattctgtactgatgaccgttgtgtgttacattgtgctaatttcaatgaccttttgggacagcggtg

SEQ ID NO: 439624 - DNA, 140 bp, Artificial Sequence
  Synthetic
caccgctgtcccaaaaggtcattgaaattagcacaatgtaacacacaacggtcatcagtacagaattacaacgcgaagtttatttgaagcacacagtggaatgacactaagaggtatacacatatcagcagccagggcct

SEQ ID NO: 439625 - DNA, 140 bp, Artificial Sequence
  Synthetic
atacgccatgctgggtctcccacatactgccgatgttatagttcgggatgtaaaaattgcacctgagccaccaaagctggaacaaccgcaagtgtcagctgtgcaggttgagggcgacgccgtacttgggagtcggccat

SEQ ID NO: 439626 - DNA, 140 bp, Artificial Sequence
  Synthetic
atggccgactcccaagtacggcgtcgccctcaacctgcacagctgacacttgcggttgttccagctttggtggctcaggtgcaatttttacatcccgaactataacatcggcagtatgtgggagacccagcatggcgtat

SEQ ID NO: 439627 - DNA, 140 bp, Artificial Sequence
  Synthetic
atacgccatgctgggtctccaactcatccagaagtgcttccccaggtccagctggaatcggagctgtaggtggcgacgcttccagtattctctacctgagtttgctgaagaggctcgaagcgtacttgggagtcggccat

SEQ ID NO: 439628 - DNA, 140 bp, Artificial Sequence
  Synthetic
atggccgactcccaagtacgcttcgagcctcttcagcaaactcaggtagagaatactggaagcgtcgccacctacagctccgattccagctggacctggggaagcacttctggatgagttggagacccagcatggcgtat

SEQ ID NO: 439629 - DNA, 140 bp, Artificial Sequence
  Synthetic
atacgccatgctgggtctcccaattgatctagcttcccagataatctctggcattgtagcagctgtttcagctatgatgtggatttcctactttgtgcagagtatccggctgtttatgagcgtacttgggagtcggccat

SEQ ID NO: 439630 - DNA, 140 bp, Artificial Sequence
  Synthetic
atggccgactcccaagtacgctcataaacagccggatactctgcacaaagtaggaaatccacatcatagctgaaacagctgctacaatgccagagattatctgggaagctagatcaattgggagacccagcatggcgtat

SEQ ID NO: 439631 - DNA, 140 bp, Artificial Sequence
  Synthetic
aggccctggctgctgatatgttggagaaattccactcctatgaatctgagtacttactcactttttgatttatccaagtttcaattaaaattaaaaggaacaccagttcttcaattaaaggaccttttgggacagcggtg

SEQ ID NO: 439632 - DNA, 140 bp, Artificial Sequence
  Synthetic
caccgctgtcccaaaaggtcctttaattgaagaactggtgttccttttaattttaattgaaacttggataaatcaaaaagtgagtaagtactcagattcataggagtggaatttctccaacatatcagcagccagggcct

SEQ ID NO: 439633 - DNA, 140 bp, Artificial Sequence
  Synthetic
atacgccatgctgggtctccaagtatgttaccgtgcagggaccacctggcactggtaagagtcactttgctatagggttggcgatatactaccctacagcccgtattgtttacactgcttcgtacttgggagtcggccat

SEQ ID NO: 439634 - DNA, 140 bp, Artificial Sequence
  Synthetic
atggccgactcccaagtacgaagcagtgtaaacaatacgggctgtagggtagtatatcgccaaccctatagcaaagtgactcttaccagtgccaggtggtccctgcacggtaacatacttggagacccagcatggcgtat

SEQ ID NO: 439635 - DNA, 140 bp, Artificial Sequence
  Synthetic
aggccctggctgctgatatgacaatccaagcgttctggattttgcggtcaaggcacacatatagtgtcctttgttgtaaatgcccctaatggcctttacttcatgcatgttggttattacgaccttttgggacagcggtg

SEQ ID NO: 439636 - DNA, 140 bp, Artificial Sequence
  Synthetic
caccgctgtcccaaaaggtcgtaataaccaacatgcatgaagtaaaggccattaggggcatttacaacaaaggacactatatgtgtgccttgaccgcaaaatccagaacgcttggattgtcatatcagcagccagggcct

SEQ ID NO: 439637 - DNA, 140 bp, Artificial Sequence
  Synthetic
atacgccatgctgggtctccacaacagtggggctatgtaggtaatcttactaccaaccatgatcgttattgttcggtacaccagggagcccatgttgcatctggtgacgcaataatgactcgtacttgggagtcggccat

SEQ ID NO: 439638 - DNA, 140 bp, Artificial Sequence
  Synthetic
atggccgactcccaagtacgagtcattattgcgtcaccagatgcaacatgggctccctggtgtaccgaacaataacgatcatggttggtagtaagattacctacatagccccactgttgtggagacccagcatggcgtat

SEQ ID NO: 439639 - DNA, 140 bp, Artificial Sequence
  Synthetic
atacgccatgctgggtctcctgatgcctgtgttgtcgatgactgactgtttagcagctgaaacacacagggattgtgatcttaataaaccgctcattgagtggcctcttactgagtatgacgtacttgggagtcggccat

SEQ ID NO: 439640 - DNA, 140 bp, Artificial Sequence
  Synthetic
atggccgactcccaagtacgtcatactcagtaagaggccactcaatgagcggtttattaagatcacaatccctgtgtgtttcagctgctaaacagtcagtcatcgacaacacaggcatcaggagacccagcatggcgtat

SEQ ID NO: 439641 - DNA, 140 bp, Artificial Sequence
  Synthetic
aggccctggctgctgatatgtttgccaccttgcctgtttatgatactattaagtattattctatcattcctcacagtattcgttctatccaaagtgatagaaaagcttgggctgccttctgaccttttgggacagcggtg

SEQ ID NO: 439642 - DNA, 140 bp, Artificial Sequence
  Synthetic
caccgctgtcccaaaaggtcagaaggcagcccaagcttttctatcactttggatagaacgaatactgtgaggaatgatagaataatacttaatagtatcataaacaggcaaggtggcaaacatatcagcagccagggcct

SEQ ID NO: 439643 - DNA, 140 bp, Artificial Sequence
  Synthetic
atacgccatgctgggtctcctattttactcttggatgcaaaattttaacgctcaccccacgcaacaagtggagtggcgtttctgacttgtccctcaaacaaaaactcctttacaccttctcgtacttgggagtcggccat

SEQ ID NO: 439644 - DNA, 140 bp, Artificial Sequence
  Synthetic
atggccgactcccaagtacgagaaggtgtaaaggagtttttgtttgagggacaagtcagaaacgccactccacttgttgcgtggggtgagcgttaaaattttgcatccaagagtaaaataggagacccagcatggcgtat

SEQ ID NO: 439645 - DNA, 140 bp, Artificial Sequence
  Synthetic
atacgccatgctgggtctccgtttagtcatgaatatggatgttagtctccatagacataggctctctcttaaggagttgatgatgtatgccgctgatccagccatgcacattgcctcctccgtacttgggagtcggccat

SEQ ID NO: 439646 - DNA, 140 bp, Artificial Sequence
  Synthetic
atggccgactcccaagtacggaggaggcaatgtgcatggctggatcagcggcatacatcatcaactccttaagagagagcctatgtctatggagactaacatccatattcatgactaaacggagacccagcatggcgtat

SEQ ID NO: 439647 - DNA, 140 bp, Artificial Sequence
  Synthetic
atacgccatgctgggtctccttctttatggtcttatgctttataattttatcctatcggccattttggtcagtgggactcatatgccactaggtagctgcctgctaaccttcgttgtggtcgtacttgggagtcggccat

SEQ ID NO: 439648 - DNA, 140 bp, Artificial Sequence
  Synthetic
atggccgactcccaagtacgaccacaacgaaggttagcaggcagctacctagtggcatatgagtcccactgaccaaaatggccgataggataaaattataaagcataagaccataaagaaggagacccagcatggcgtat

SEQ ID NO: 439649 - DNA, 140 bp, Artificial Sequence
  Synthetic
atacgccatgctgggtctccttgtcgacttcctcttggtcaatcgctctgtgctgtcccctctcctaatatacgtgttgtgagtggtgacccacaacctatgcaacttgctactatcaatcgtacttgggagtcggccat

SEQ ID NO: 439650 - DNA, 140 bp, Artificial Sequence
  Synthetic
atggccgactcccaagtacgattgatagtagcaagttgcataggttgtgggtcaccactcacaacacgtatattaggagaggggacagcacagagcgattgaccaagaggaagtcgacaaggagacccagcatggcgtat

SEQ ID NO: 439651 - DNA, 140 bp, Artificial Sequence
  Synthetic
atacgccatgctgggtctccttcgagcttactgttgaccgtgacacacaaactggccatggtgatttttatgatcagtctgttgccacgactctggtgaacgttgatcctgaccgggattcgtacttgggagtcggccat

SEQ ID NO: 439652 - DNA, 140 bp, Artificial Sequence
  Synthetic
atggccgactcccaagtacgaatcccggtcaggatcaacgttcaccagagtcgtggcaacagactgatcataaaaatcaccatggccagtttgtgtgtcacggtcaacagtaagctcgaaggagacccagcatggcgtat

SEQ ID NO: 439653 - DNA, 140 bp, Artificial Sequence
  Synthetic
aggccctggctgctgatatgcgcaatgtcagatttgagctacatgagttcgccttgctgcgcaaaactcttgttcttaatgcatcagagatctactgtgctaacatacatagatttaagcgaccttttgggacagcggtg

SEQ ID NO: 439654 - DNA, 140 bp, Artificial Sequence
  Synthetic
caccgctgtcccaaaaggtcgcttaaatctatgtatgttagcacagtagatctctgatgcattaagaacaagagttttgcgcagcaaggcgaactcatgtagctcaaatctgacattgcgcatatcagcagccagggcct

SEQ ID NO: 439655 - DNA, 140 bp, Artificial Sequence
  Synthetic
atacgccatgctgggtctcctatcctataagtctagcactacgtataagctggctgtaggtgacatctttgttcttacctctcactcagtggcaaccctgacggcgccaacaatagtgaacgtacttgggagtcggccat

SEQ ID NO: 439656 - DNA, 140 bp, Artificial Sequence
  Synthetic
atggccgactcccaagtacgttcactattgttggcgccgtcagggttgccactgagtgagaggtaagaacaaagatgtcacctacagccagcttatacgtagtgctagacttataggataggagacccagcatggcgtat

SEQ ID NO: 439657 - DNA, 140 bp, Artificial Sequence
  Synthetic
atacgccatgctgggtctccggatttgttagtgtagagctacaacctccttgcaaattcttgattgcgggaccaaaaggacctgaaatccgatatctctattttgttaaaaatcttaacacgtacttgggagtcggccat

SEQ ID NO: 439658 - DNA, 140 bp, Artificial Sequence
  Synthetic
atggccgactcccaagtacgtgttaagatttttaacaaaatagagatatcggatttcaggtccttttggtcccgcaatcaagaatttgcaaggaggttgtagctctacactaacaaatccggagacccagcatggcgtat

SEQ ID NO: 439659 - DNA, 140 bp, Artificial Sequence
  Synthetic
atacgccatgctgggtctccgaggctgtaaggcaagttcgaagctggattggctttgatgttgagggtgcacatgcgtcgcgtaacgcatgcggtaccaatgtgcctttgcagttgggatcgtacttgggagtcggccat

SEQ ID NO: 439660 - DNA, 140 bp, Artificial Sequence
  Synthetic
atggccgactcccaagtacgatcccaactgcaaaggcacattggtaccgcatgcgttacgcgacgcatgtgcaccctcaacatcaaagccaatccagcttcgaacttgccttacagcctcggagacccagcatggcgtat

SEQ ID NO: 439661 - DNA, 140 bp, Artificial Sequence
  Synthetic
aggccctggctgctgatatgagtgaacagtgccccccgggaagagctctacagtgtgaaatgtaaataaaaatagctattattcaattagattaggctaattagatgatttgcaaaaaaagaccttttgggacagcggtg

SEQ ID NO: 439662 - DNA, 140 bp, Artificial Sequence
  Synthetic
caccgctgtcccaaaaggtctttttttgcaaatcatctaattagcctaatctaattgaataatagctatttttatttacatttcacactgtagagctcttcccggggggcactgttcactcatatcagcagccagggcct

SEQ ID NO: 439663 - DNA, 140 bp, Artificial Sequence
  Synthetic
aggccctggctgctgatatggagtatatggaagcatataatcttgtctctgcatcaggtttccgcctttggtgttataagacctttgatatttataatctctggtctacttttacaaaaggaccttttgggacagcggtg

SEQ ID NO: 439664 - DNA, 140 bp, Artificial Sequence
  Synthetic
caccgctgtcccaaaaggtccttttgtaaaagtagaccagagattataaatatcaaaggtcttataacaccaaaggcggaaacctgatgcagagacaagattatatgcttccatatactccatatcagcagccagggcct

SEQ ID NO: 439665 - DNA, 140 bp, Artificial Sequence
  Synthetic
atacgccatgctgggtctccgtccggggttctattgtaaatgcccgaatagaaccctgtgctagtggactttccactgatgtcgtttttagggcatttgacatctgcaactacaaggctacgtacttgggagtcggccat

SEQ ID NO: 439666 - DNA, 140 bp, Artificial Sequence
  Synthetic
atggccgactcccaagtacgtagccttgtagttgcagatgtcaaatgccctaaaaacgacatcagtggaaagtccactagcacagggttctattcgggcatttacaatagaaccccggacggagacccagcatggcgtat

SEQ ID NO: 439667 - DNA, 140 bp, Artificial Sequence
  Synthetic
atacgccatgctgggtctccgtacgtacgggttcaggctaagtctgaacctggacaggccgctctacctgagcctgttatggttgaggatggtgttacagcagttactaagcctaaagagcgtacttgggagtcggccat

SEQ ID NO: 439668 - DNA, 140 bp, Artificial Sequence
  Synthetic
atggccgactcccaagtacgctctttaggcttagtaactgctgtaacaccatcctcaaccataacaggctcaggtagagcggcctgtccaggttcagacttagcctgaacccgtacgtacggagacccagcatggcgtat

SEQ ID NO: 439669 - DNA, 140 bp, Artificial Sequence
  Synthetic
aggccctggctgctgatatggcgcactcgcacccgtccaagtgttcagcctggtccaatgattgatgttaacactgattagtgtcactcaaagtaacaagatcgcggcaatcgtttgtgtgaccttttgggacagcggtg

SEQ ID NO: 439670 - DNA, 140 bp, Artificial Sequence
  Synthetic
caccgctgtcccaaaaggtcacacaaacgattgccgcgatcttgttactttgagtgacactaatcagtgttaacatcaatcattggaccaggctgaacacttggacgggtgcgagtgcgccatatcagcagccagggcct

SEQ ID NO: 439671 - DNA, 140 bp, Artificial Sequence
  Synthetic
aggccctggctgctgatatgcaaagtgatagaaaagcttgggctgccttcggactgctggcttatcctcctttgctgctattccatttgcacagagtatcttttataggttaaacggtgtgaccttttgggacagcggtg

SEQ ID NO: 439672 - DNA, 140 bp, Artificial Sequence
  Synthetic
caccgctgtcccaaaaggtcacaccgtttaacctataaaagatactctgtgcaaatggaatagcagcaaaggaggataagccagcagtccgaaggcagcccaagcttttctatcactttgcatatcagcagccagggcct

SEQ ID NO: 439673 - DNA, 140 bp, Artificial Sequence
  Synthetic
aggccctggctgctgatatggacttcaactgaacaagttgacgtttctcatgagatttctgacgacgagtgggctgctgcagttgatgaagcgttccctctcgatgaagcagaagatgttgaccttttgggacagcggtg

SEQ ID NO: 439674 - DNA, 140 bp, Artificial Sequence
  Synthetic
caccgctgtcccaaaaggtcaacatcttctgcttcatcgagagggaacgcttcatcaactgcagcagcccactcgtcgtcagaaatctcatgagaaacgtcaacttgttcagttgaagtccatatcagcagccagggcct

SEQ ID NO: 439675 - DNA, 140 bp, Artificial Sequence
  Synthetic
atacgccatgctgggtctcctctcagataatgcctatcttaaatgggcccgggttgaaggccaggatgggtttgttagtgttgagctgcaacctccttgcaagtttttgattgcaggacccgtacttgggagtcggccat

SEQ ID NO: 439676 - DNA, 140 bp, Artificial Sequence
  Synthetic
atggccgactcccaagtacgggtcctgcaatcaaaaacttgcaaggaggttgcagctcaacactaacaaacccatcctggccttcaacccgggcccatttaagataggcattatctgagaggagacccagcatggcgtat

SEQ ID NO: 439677 - DNA, 140 bp, Artificial Sequence
  Synthetic
atacgccatgctgggtctcctacccagttccgtctggtgcgtgacaatccggggcacaccatgtcttccgtggctggtgtggtcgcgcaaggtgcgcgcgacatgtatcgagcagcgctccgtacttgggagtcggccat

SEQ ID NO: 439678 - DNA, 140 bp, Artificial Sequence
  Synthetic
atggccgactcccaagtacggagcgctgctcgatacatgtcgcgcgcaccttgcgcgaccacaccagccacggaagacatggtgtgccccggattgtcacgcaccagacggaactgggtaggagacccagcatggcgtat

SEQ ID NO: 439679 - DNA, 140 bp, Artificial Sequence
  Synthetic
aggccctggctgctgatatgcataagggggctgcatggcctattgttagacgacgtatagtgcaaatgttgtcagacactttagacaaattgtctgattactgtacgtttgtttgttggggaccttttgggacagcggtg

SEQ ID NO: 439680 - DNA, 140 bp, Artificial Sequence
  Synthetic
caccgctgtcccaaaaggtccccaacaaacaaacgtacagtaatcagacaatttgtctaaagtgtctgacaacatttgcactatacgtcgtctaacaataggccatgcagcccccttatgcatatcagcagccagggcct

SEQ ID NO: 439681 - DNA, 140 bp, Artificial Sequence
  Synthetic
atacgccatgctgggtctccaacaatgaaaaacgtcaagaccacgtgtctcaaactgtgtcattctgtggcgcaggagacctggctatgaaactctcaccttggtttgcggatggcgaaacgtacttgggagtcggccat

SEQ ID NO: 439682 - DNA, 140 bp, Artificial Sequence
  Synthetic
atggccgactcccaagtacgtttcgccatccgcaaaccaaggtgagagtttcatagccaggtctcctgcgccacagaatgacacagtttgagacacgtggtcttgacgtttttcattgttggagacccagcatggcgtat

SEQ ID NO: 439683 - DNA, 140 bp, Artificial Sequence
  Synthetic
atacgccatgctgggtctcctttggtgattgtgtgactgtacgtgtcgggcaacaagtcgatcttgttatctctgacatgtatgatcctattactaagaatgtcaagggtactaatgaagcgtacttgggagtcggccat

SEQ ID NO: 439684 - DNA, 140 bp, Artificial Sequence
  Synthetic
atggccgactcccaagtacgcttcattagtacccttgacattcttagtaataggatcatacatgtcagagataacaagatcgacttgttgcccgacacgtacagtcacacaatcaccaaaggagacccagcatggcgtat

SEQ ID NO: 439685 - DNA, 140 bp, Artificial Sequence
  Synthetic
atacgccatgctgggtctcccagcctgcaatacggtgaaagcaactcttaagaacaaagggaaaattctctttgtgccggtcaaattggccagctttgttaagcatctcccaggccctcgcgtacttgggagtcggccat

SEQ ID NO: 439686 - DNA, 140 bp, Artificial Sequence
  Synthetic
atggccgactcccaagtacgcgagggcctgggagatgcttaacaaagctggccaatttgaccggcacaaagagaattttccctttgttcttaagagttgctttcaccgtattgcaggctgggagacccagcatggcgtat

SEQ ID NO: 439687 - DNA, 140 bp, Artificial Sequence
  Synthetic
aggccctggctgctgatatgatgcagcaaggtccagcatcagctcgtgatcttatttgtgctcaatatgtggctggttataaagtattacctcctcttatggatgttaatatggaagccggaccttttgggacagcggtg

SEQ ID NO: 439688 - DNA, 140 bp, Artificial Sequence
  Synthetic
caccgctgtcccaaaaggtccggcttccatattaacatccataagaggaggtaatactttataaccagccacatattgagcacaaataagatcacgagctgatgctggaccttgctgcatcatatcagcagccagggcct

SEQ ID NO: 439689 - DNA, 140 bp, Artificial Sequence
  Synthetic
atacgccatgctgggtctcctgtctacctggttgagaggctcacgggtgggaactattccgacccattcatggttagccaactggcgtatagctctagtgcacgcgatgccattgtcggccgtacttgggagtcggccat

SEQ ID NO: 439690 - DNA, 140 bp, Artificial Sequence
  Synthetic
atggccgactcccaagtacggccgacaatggcatcgcgtgcactagagctatacgccagttggctaaccatgaatgggtcggaatagttcccacccgtgagcctctcaaccaggtagacaggagacccagcatggcgtat

SEQ ID NO: 439691 - DNA, 140 bp, Artificial Sequence
  Synthetic
atacgccatgctgggtctccactaccctgcagggcaagccagttggttatttcttcccttatgaccctgcacttgagactggtgactacacctttctcctgcgcaaggatggattcggagcgtacttgggagtcggccat

SEQ ID NO: 439692 - DNA, 140 bp, Artificial Sequence
  Synthetic
atggccgactcccaagtacgctccgaatccatccttgcgcaggagaaaggtgtagtcaccagtctcaagtgcagggtcataagggaagaaataaccaactggcttgccctgcagggtagtggagacccagcatggcgtat

SEQ ID NO: 439693 - DNA, 140 bp, Artificial Sequence
  Synthetic
atacgccatgctgggtctccgtaattacttccgcaaacctcgtcctaacccggatgaggaaattccttttgaactcttggatgacctcgagggcaaccctaaggggaagtatgccaagggcgtacttgggagtcggccat

SEQ ID NO: 439694 - DNA, 140 bp, Artificial Sequence
  Synthetic
atggccgactcccaagtacgcccttggcatacttccccttagggttgccctcgaggtcatccaagagttcaaaaggaatttcctcatccgggttaggacgaggtttgcggaagtaattacggagacccagcatggcgtat

SEQ ID NO: 439695 - DNA, 140 bp, Artificial Sequence
  Synthetic
atacgccatgctgggtctccatacaagtaccctgcgatcaaggacttgaaaaagcccagtattaccctagggaaagcccccgatttgaataaggcatataagtcagttctatcaggtttgcgtacttgggagtcggccat

SEQ ID NO: 439696 - DNA, 140 bp, Artificial Sequence
  Synthetic
atggccgactcccaagtacgcaaacctgatagaactgacttatatgccttattcaaatcgggggctttccctagggtaatactgggctttttcaagtccttgatcgcagggtacttgtatggagacccagcatggcgtat

SEQ ID NO: 439697 - DNA, 140 bp, Artificial Sequence
  Synthetic
atacgccatgctgggtctcctaaacgacctgatggcatcaggaacacatccgttgcccccctcagcaatcatgagtggaggagatgacatcatatccagggtaattggatttgaatccatcgtacttgggagtcggccat

SEQ ID NO: 439698 - DNA, 140 bp, Artificial Sequence
  Synthetic
atggccgactcccaagtacgatggattcaaatccaattaccctggatatgatgtcatctcctccactcatgattgctgaggggggcaacggatgtgttcctgatgccatcaggtcgtttaggagacccagcatggcgtat

SEQ ID NO: 439699 - DNA, 140 bp, Artificial Sequence
  Synthetic
atacgccatgctgggtctcctcctgattgcaagaaaaggagacaagatcaccccggattctctcgtggagataaaacgtactgatgtagaagggaattgggctttgactggaggaatggacgtacttgggagtcggccat

SEQ ID NO: 439700 - DNA, 140 bp, Artificial Sequence
  Synthetic
atggccgactcccaagtacgtccattcctccagtcaaagcccaattcccttctacatcagtacgttttatctccacgagagaatccggggtgatcttgtctccttttcttgcaatcaggaggagacccagcatggcgtat

SEQ ID NO: 439701 - DNA, 140 bp, Artificial Sequence
  Synthetic
atacgccatgctgggtctcctataagacaaacattgcagataggatagagcaaattttcgagacagccccttttattaaaatcgtggaacatcacactctgatgacgactcacaagatgtcgtacttgggagtcggccat

SEQ ID NO: 439702 - DNA, 140 bp, Artificial Sequence
  Synthetic
atggccgactcccaagtacgacatcttgtgagtcgtcatcagagtgtgatgttccacgattttaataaaaggggctgtctcgaaaatttgctctatcctatctgcaatgtttgtcttataggagacccagcatggcgtat

SEQ ID NO: 439703 - DNA, 140 bp, Artificial Sequence
  Synthetic
atacgccatgctgggtctccctcatcagagctatacctcagattctctaagcgggggaagttctttcgggatgcagagtatttgacctcttccactcttcgagaaatgagcctggtattgcgtacttgggagtcggccat

SEQ ID NO: 439704 - DNA, 140 bp, Artificial Sequence
  Synthetic
atggccgactcccaagtacgcaataccaggctcatttctcgaagagtggaagaggtcaaatactctgcatcccgaaagaacttcccccgcttagagaatctgaggtatagctctgatgagggagacccagcatggcgtat

SEQ ID NO: 439705 - DNA, 140 bp, Artificial Sequence
  Synthetic
atacgccatgctgggtctcccacggtagtcactgcttatgaggattgctctgggctggtatcgtttactgggttcataaaacagataaatctcaccgcaagagaagcaatactatatttccgtacttgggagtcggccat

SEQ ID NO: 439706 - DNA, 140 bp, Artificial Sequence
  Synthetic
atggccgactcccaagtacggaaatatagtattgcttctcttgcggtgagatttatctgttttatgaacccagtaaacgataccagcccagagcaatcctcataagcagtgactaccgtgggagacccagcatggcgtat

SEQ ID NO: 439707 - DNA, 140 bp, Artificial Sequence
  Synthetic
aggccctggctgctgatatgggttcataaaacagataaatctcaccgcaagagaagcaatactatatttcttccacaaaaacttcgaggaagagataagaagaatgtttgagccagggcagaccttttgggacagcggtg

SEQ ID NO: 439708 - DNA, 140 bp, Artificial Sequence
  Synthetic
caccgctgtcccaaaaggtctgccctggctcaaacattcttcttatctcttcctcgaagtttttgtggaagaaatatagtattgcttctcttgcggtgagatttatctgttttatgaacccatatcagcagccagggcct

SEQ ID NO: 439709 - DNA, 140 bp, Artificial Sequence
  Synthetic
aggccctggctgctgatatgatcaaatctcgatcatctctactggactacagttgcttatgaactgaacattattaggggcttgtaaatactgaagctcttagacgatataccctgaaaagaccttttgggacagcggtg

SEQ ID NO: 439710 - DNA, 140 bp, Artificial Sequence
  Synthetic
caccgctgtcccaaaaggtcttttcagggtatatcgtctaagagcttcagtatttacaagcccctaataatgttcagttcataagcaactgtagtccagtagagatgatcgagatttgatcatatcagcagccagggcct

SEQ ID NO: 439711 - DNA, 140 bp, Artificial Sequence
  Synthetic
atacgccatgctgggtctccgggcattcccttcagtcacaggatttataacccagatgacttcgtccttttcatctgagctatacctccgattctccaagcgaggaaaatttttccgagacgtacttgggagtcggccat

SEQ ID NO: 439712 - DNA, 140 bp, Artificial Sequence
  Synthetic
atggccgactcccaagtacgtctcggaaaaattttcctcgcttggagaatcggaggtatagctcagatgaaaaggacgaagtcatctgggttataaatcctgtgactgaagggaatgcccggagacccagcatggcgtat

SEQ ID NO: 439713 - DNA, 140 bp, Artificial Sequence
  Synthetic
atacgccatgctgggtctccctcattcactttgtcggatgttatatggggcaagtaaggtctctgaatgcaacagtcattgctgcatgtgctccccatgagatgtctgttttagggggctcgtacttgggagtcggccat

SEQ ID NO: 439714 - DNA, 140 bp, Artificial Sequence
  Synthetic
atggccgactcccaagtacgagccccctaaaacagacatctcatggggagcacatgcagcaatgactgttgcattcagagaccttacttgccccatataacatccgacaaagtgaatgagggagacccagcatggcgtat

SEQ ID NO: 439715 - DNA, 140 bp, Artificial Sequence
  Synthetic
atacgccatgctgggtctccatctgggagaggagttcttcgggaaaggaacgttcgagagaagattcttcagagatgagaaagaacttcaagagtatgagacggctgaattgacaaagaccgtacttgggagtcggccat

SEQ ID NO: 439716 - DNA, 140 bp, Artificial Sequence
  Synthetic
atggccgactcccaagtacggtctttgtcaattcagccgtctcatactcttgaagttctttctcatctctgaagaatcttctctcgaacgttcctttcccgaagaactcctctcccagatggagacccagcatggcgtat

SEQ ID NO: 439717 - DNA, 140 bp, Artificial Sequence
  Synthetic
atacgccatgctgggtctcctatctgtcctggagttggtctgatgacacttcagtgtttaagagggtggcttgcaactctagcttgagtctctcatctcactggatcaggctgatttacacgtacttgggagtcggccat

SEQ ID NO: 439718 - DNA, 140 bp, Artificial Sequence
  Synthetic
atggccgactcccaagtacgtgtaaatcagcctgatccagtgagatgagagactcaagctagagttgcaagccaccctcttaaacactgaagtgtcatcagaccaactccaggacagataggagacccagcatggcgtat

SEQ ID NO: 439719 - DNA, 140 bp, Artificial Sequence
  Synthetic
aggccctggctgctgatatgcctctctcgtgtcagctcccccagatgatgatgacttgtggttaccccctccagaatatgttccgttgaaggagcttacgggcaagaggaacatgagaaagaccttttgggacagcggtg

SEQ ID NO: 439720 - DNA, 140 bp, Artificial Sequence
  Synthetic
caccgctgtcccaaaaggtctttctcatgttcctcttgcccgtaagctccttcaacggaacatattctggagggggtaaccacaagtcatcatcatctgggggagctgacacgagagaggcatatcagcagccagggcct

SEQ ID NO: 439721 - DNA, 140 bp, Artificial Sequence
  Synthetic
atacgccatgctgggtctcccattaggtccagatcatctcttttagattatagctgcttgtaaaactaggcgttcttgagggaatgtaccaactaagatttttggacggtgcaccctgaacgtacttgggagtcggccat

SEQ ID NO: 439722 - DNA, 140 bp, Artificial Sequence
  Synthetic
atggccgactcccaagtacgttcagggtgcaccgtccaaaaatcttagttggtacattccctcaagaacgcctagttttacaagcagctataatctaaaagagatgatctggacctaatgggagacccagcatggcgtat

SEQ ID NO: 439723 - DNA, 140 bp, Artificial Sequence
  Synthetic
aggccctggctgctgatatgcgttcttgagggaatgtaccaactaagatttttggacggtgcaccctgaaaaaaacaagatcacgattcataacctctgcttgcttgagtgtttttccatgaccttttgggacagcggtg

SEQ ID NO: 439724 - DNA, 140 bp, Artificial Sequence
  Synthetic
caccgctgtcccaaaaggtcatggaaaaacactcaagcaagcagaggttatgaatcgtgatcttgtttttttcagggtgcaccgtccaaaaatcttagttggtacattccctcaagaacgcatatcagcagccagggcct

SEQ ID NO: 439725 - DNA, 140 bp, Artificial Sequence
  Synthetic
aggccctggctgctgatatgaacggttattgccacatgtgccccccatgagatgtctgttctgggaggctacttgggagaggagttttttgggaaggggacgtttgaaagaagattcttcgaccttttgggacagcggtg

SEQ ID NO: 439726 - DNA, 140 bp, Artificial Sequence
  Synthetic
caccgctgtcccaaaaggtcgaagaatcttctttcaaacgtccccttcccaaaaaactcctctcccaagtagcctcccagaacagacatctcatggggggcacatgtggcaataaccgttcatatcagcagccagggcct

SEQ ID NO: 439727 - DNA, 140 bp, Artificial Sequence
  Synthetic
atacgccatgctgggtctccggacaatctccctgaggacatgaggcggctccagctggacgataaagaaccttctaaccttggcggggtgaccacagcgggggaaggcaagtatcgggaacgtacttgggagtcggccat

SEQ ID NO: 439728 - DNA, 140 bp, Artificial Sequence
  Synthetic
atggccgactcccaagtacgttcccgatacttgccttcccccgctgtggtcaccccgccaaggttagaaggttctttatcgtccagctggagccgcctcatgtcctcagggagattgtccggagacccagcatggcgtat

SEQ ID NO: 439729 - DNA, 140 bp, Artificial Sequence
  Synthetic
atacgccatgctgggtctccgatttcttaagatatggtcacaaaccgtggaggaaatcatatcttatgttgcggtcaactttcctaaccctccagggaggtcttcggaggacaaatcaaccgtacttgggagtcggccat

SEQ ID NO: 439730 - DNA, 140 bp, Artificial Sequence
  Synthetic
atggccgactcccaagtacggttgatttgtcctccgaagacctccctggagggttaggaaagttgaccgcaacataagatatgatttcctccacggtttgtgaccatatcttaagaaatcggagacccagcatggcgtat

SEQ ID NO: 439731 - DNA, 140 bp, Artificial Sequence
  Synthetic
aggccctggctgctgatatggcggtcaactttcctaaccctccagggaggtcttcggaggacaaatcaacccagactactggccgagaactcaagaaggagactacatccatttcttcccgaccttttgggacagcggtg

SEQ ID NO: 439732 - DNA, 140 bp, Artificial Sequence
  Synthetic
caccgctgtcccaaaaggtcgggaagaaatggatgtagtctccttcttgagttctcggccagtagtctgggttgatttgtcctccgaagacctccctggagggttaggaaagttgaccgccatatcagcagccagggcct

SEQ ID NO: 439733 - DNA, 140 bp, Artificial Sequence
  Synthetic
aggccctggctgctgatatgattgagtcagaggctgagcccagagggactcccactgtccctaacatcttgaggaactctgactataatctcaactctcctctaatagaggatcctgccagaccttttgggacagcggtg

SEQ ID NO: 439734 - DNA, 140 bp, Artificial Sequence
  Synthetic
caccgctgtcccaaaaggtctggcaggatcctctattagaggagagttgagattatagtcagagttcctcaagatgttagggacagtgggagtccctctgggctcagcctctgactcaatcatatcagcagccagggcct

SEQ ID NO: 439735 - DNA, 140 bp, Artificial Sequence
  Synthetic
atacgccatgctgggtctcctggggtgggttggtttggccaattccaaaaaattccagttgttagtcgagcctgacaagttaaataaaattatgcaagacgatctgaatcgctatgtatccgtacttgggagtcggccat

SEQ ID NO: 439736 - DNA, 140 bp, Artificial Sequence
  Synthetic
atggccgactcccaagtacggatacatagcgattcagatcgtcttgcataattttatttaacttgtcaggctcgactaacaactggaattttttggaattggccaaaccaacccaccccaggagacccagcatggcgtat

SEQ ID NO: 439737 - DNA, 140 bp, Artificial Sequence
  Synthetic
atacgccatgctgggtctccctttatacgcaagatagtgaaaaactgtagggatgagggcacccagaagccttcccctgtgtcggcccctccagatgacgatgatctatggcttcctcctcgtacttgggagtcggccat

SEQ ID NO: 439738 - DNA, 140 bp, Artificial Sequence
  Synthetic
atggccgactcccaagtacgaggaggaagccatagatcatcgtcatctggaggggccgacacaggggaaggcttctgggtgccctcatccctacagtttttcactatcttgcgtataaagggagacccagcatggcgtat

SEQ ID NO: 439739 - DNA, 140 bp, Artificial Sequence
  Synthetic
atacgccatgctgggtctccgaggttattacagcatctccagagaatgactggttgtggatcttctcggacttcagaagctccaagatgacgtacctaactctcattacctatcagtctccgtacttgggagtcggccat

SEQ ID NO: 439740 - DNA, 140 bp, Artificial Sequence
  Synthetic
atggccgactcccaagtacggagactgataggtaatgagagttaggtacgtcatcttggagcttctgaagtccgagaagatccacaaccagtcattctctggagatgctgtaataacctcggagacccagcatggcgtat

SEQ ID NO: 439741 - DNA, 140 bp, Artificial Sequence
  Synthetic
atacgccatgctgggtctccccggaatatgtcccgctgaaagaactcacaggcaagaagaacatgaggaacttttgcatcaacggagaagttaaagtgtgtagcccaaatggttactcgtcgtacttgggagtcggccat

SEQ ID NO: 439742 - DNA, 140 bp, Artificial Sequence
  Synthetic
atggccgactcccaagtacgacgagtaaccatttgggctacacactttaacttctccgttgatgcaaaagttcctcatgttcttcttgcctgtgagttctttcagcgggacatattccggggagacccagcatggcgtat

SEQ ID NO: 439743 - DNA, 140 bp, Artificial Sequence
  Synthetic
aggccctggctgctgatatgagaccaccccctgactccttatatcaaaactcagacatggccacccaaacatgtagtagatctggtaggagatgcatggcataagctcccaatcacacaggaccttttgggacagcggtg

SEQ ID NO: 439744 - DNA, 140 bp, Artificial Sequence
  Synthetic
caccgctgtcccaaaaggtcctgtgtgattgggagcttatgccatgcatctcctaccagatctactacatgtttgggtggccatgtctgagttttgatataaggagtcagggggtggtctcatatcagcagccagggcct

SEQ ID NO: 439745 - DNA, 140 bp, Artificial Sequence
  Synthetic
atacgccatgctgggtctccaggagcccccgtcccagagggcatgaactgggtatacaaattgaggagaacccttatcttccagtgggccgactccaggggccccctagagggagaggaacgtacttgggagtcggccat

SEQ ID NO: 439746 - DNA, 140 bp, Artificial Sequence
  Synthetic
atggccgactcccaagtacgttcctctccctctagggggcccctggagtcggcccactggaagataagggttctcctcaatttgtatacccagttcatgccctctgggacgggggctcctggagacccagcatggcgtat

SEQ ID NO: 439747 - DNA, 140 bp, Artificial Sequence
  Synthetic
atacgccatgctgggtctccctcaaaagactcaaggaaagatggttcctcaagctcttttgttcgtacctcttctggttttttcaatgtgtttcgggaaattccccatctacacgatacccgtacttgggagtcggccat

SEQ ID NO: 439748 - DNA, 140 bp, Artificial Sequence
  Synthetic
atggccgactcccaagtacgggtatcgtgtagatggggaatttcccgaaacacattgaaaaaaccagaagaggtacgaacaaaagagcttgaggaaccatctttccttgagtcttttgagggagacccagcatggcgtat

SEQ ID NO: 439749 - DNA, 140 bp, Artificial Sequence
  Synthetic
atacgccatgctgggtctccactgccttgggggatgtgcccagcttcgcgagacttcatgacctgtacaacagacccataacttattatttcaggaaacaagtcattcgggggaatatttcgtacttgggagtcggccat

SEQ ID NO: 439750 - DNA, 140 bp, Artificial Sequence
  Synthetic
atggccgactcccaagtacgaaatattcccccgaatgacttgtttcctgaaataataagttatgggtctgttgtacaggtcatgaagtctcgcgaagctgggcacatcccccaaggcagtggagacccagcatggcgtat

SEQ ID NO: 439751 - DNA, 140 bp, Artificial Sequence
  Synthetic
atacgccatgctgggtctcctcctacatggaacttaaagtgggatacatttcggccataaaagtgaacgggttcacgtgcacaggtgtggtgacagaggcagaaacttatactaactttgcgtacttgggagtcggccat

SEQ ID NO: 439752 - DNA, 140 bp, Artificial Sequence
  Synthetic
atggccgactcccaagtacgcaaagttagtataagtttctgcctctgtcaccacacctgtgcacgtgaacccgttcacttttatggccgaaatgtatcccactttaagttccatgtaggaggagacccagcatggcgtat

SEQ ID NO: 439753 - DNA, 140 bp, Artificial Sequence
  Synthetic
aggccctggctgctgatatggttcacgtgcacaggtgtggtgacagaggcagaaacttatactaactttgttggttatgtcaccactacgttcaaaagaaagcatttccgcccgacaccggaccttttgggacagcggtg

SEQ ID NO: 439754 - DNA, 140 bp, Artificial Sequence
  Synthetic
caccgctgtcccaaaaggtccggtgtcgggcggaaatgctttcttttgaacgtagtggtgacataaccaacaaagttagtataagtttctgcctctgtcaccacacctgtgcacgtgaaccatatcagcagccagggcct

SEQ ID NO: 439755 - DNA, 140 bp, Artificial Sequence
  Synthetic
atacgccatgctgggtctcctcaaaaccacgaaggaatccctagtcatcatatccccaagtgtagcggacctggacccatacgataaatcccttcactctagagtctttcctaacggaaacgtacttgggagtcggccat

SEQ ID NO: 439756 - DNA, 140 bp, Artificial Sequence
  Synthetic
atggccgactcccaagtacgtttccgttaggaaagactctagagtgaagggatttatcgtatgggtccaggtccgctacacttggggatatgatgactagggattccttcgtggttttgaggagacccagcatggcgtat

SEQ ID NO: 439757 - DNA, 140 bp, Artificial Sequence
  Synthetic
aggccctggctgctgatatgggtgtatcaacatgaattctagagcatgtcaattgtggtctgacatgtctcttcagacacaaaggtctgaggaggacaaggactcttctctgcttctagagaccttttgggacagcggtg

SEQ ID NO: 439758 - DNA, 140 bp, Artificial Sequence
  Synthetic
caccgctgtcccaaaaggtctctagaagcagagaagagtccttgtcctcctcagacctttgtgtctgaagagacatgtcagaccacaattgacatgctctagaattcatgttgatacacccatatcagcagccagggcct

SEQ ID NO: 439759 - DNA, 140 bp, Artificial Sequence
  Synthetic
atacgccatgctgggtctcctttaccaatagtagagggaagagagcttccaaagggagcaagacttgcgggtttgttgatgaaagaggtttgtataagtcattgaaaggggcatgcaaaccgtacttgggagtcggccat

SEQ ID NO: 439760 - DNA, 140 bp, Artificial Sequence
  Synthetic
atggccgactcccaagtacggtttgcatgcccctttcaatgacttatacaaacctctttcatcaacaaacccgcaagtcttgctccctttggaagctctcttccctctactattggtaaaggagacccagcatggcgtat

SEQ ID NO: 439761 - DNA, 140 bp, Artificial Sequence
  Synthetic
atacgccatgctgggtctccactctcgggagcctgtacatactgaaattcgtgtatgatgtatcttgaaaaaaacaagatcttgaatccgagcctctggctgtttgattgtttttttatccgtacttgggagtcggccat

SEQ ID NO: 439762 - DNA, 140 bp, Artificial Sequence
  Synthetic
atggccgactcccaagtacggataaaaaaacaatcaaacagccagaggctcggattcaagatcttgtttttttcaagatacatcatacacgaatttcagtatgtacaggctcccgagagtggagacccagcatggcgtat

SEQ ID NO: 439763 - DNA, 140 bp, Artificial Sequence
  Synthetic
atacgccatgctgggtctccaaatctacacgactttcgctcggacgagatcgaacatctcgttgtggaggagttggtcaagaagagagaagagtgtctggatgcactagagtccatcatgcgtacttgggagtcggccat

SEQ ID NO: 439764 - DNA, 140 bp, Artificial Sequence
  Synthetic
atggccgactcccaagtacgcatgatggactctagtgcatccagacactcttctctcttcttgaccaactcctccacaacgagatgttcgatctcgtccgagcgaaagtcgtgtagatttggagacccagcatggcgtat

SEQ ID NO: 439765 - DNA, 140 bp, Artificial Sequence
  Synthetic
aggccctggctgctgatatgcccgtacgataaatccctccactcgagagtttttcctggcggaaaatgctcaggaataaccgtgtcctccactcgctgctctaccaaccacgattacaccgaccttttgggacagcggtg

SEQ ID NO: 439766 - DNA, 140 bp, Artificial Sequence
  Synthetic
caccgctgtcccaaaaggtcggtgtaatcgtggttggtagagcagcgagtggaggacacggttattcctgagcattttccgccaggaaaaactctcgagtggagggatttatcgtacgggcatatcagcagccagggcct

SEQ ID NO: 439767 - DNA, 140 bp, Artificial Sequence
  Synthetic
aggccctggctgctgatatgagatgcaatcgtccctccttcagcaacatatggagttgttagaatcctcagttgtccccctgatgcaccctttagcagacccgtctacagttctcaaggagaccttttgggacagcggtg

SEQ ID NO: 439768 - DNA, 140 bp, Artificial Sequence
  Synthetic
caccgctgtcccaaaaggtctccttgagaactgtagacgggtctgctaaagggtgcatcagggggacaactgaggattctaacaactccatatgttgctgaaggagggacgattgcatctcatatcagcagccagggcct

SEQ ID NO: 439769 - DNA, 140 bp, Artificial Sequence
  Synthetic
atacgccatgctgggtctcctcggttcaactctctgatgattctcctctctcctccagagcccagatattcagatgacctgatatctcaactgtgccagctatacattgccggagatcagcgtacttgggagtcggccat

SEQ ID NO: 439770 - DNA, 140 bp, Artificial Sequence
  Synthetic
atggccgactcccaagtacgctgatctccggcaatgtatagctggcacagttgagatatcaggtcatctgaatatctgggctctggaggagagaggagaatcatcagagagttgaaccgaggagacccagcatggcgtat

SEQ ID NO: 439771 - DNA, 140 bp, Artificial Sequence
  Synthetic
atacgccatgctgggtctccttggtaagtgcaggggtcctgatcgccttgatgttgataatttttctaatgacatgttgcggaagagtcaatcgaccaaagtccacacaacacaatcttgcgtacttgggagtcggccat

SEQ ID NO: 439772 - DNA, 140 bp, Artificial Sequence
  Synthetic
atggccgactcccaagtacgcaagattgtgttgtgtggactttggtcgattgactcttccgcaacatgtcattagaaaaattatcaacatcaaggcgatcaggacccctgcacttaccaaggagacccagcatggcgtat

SEQ ID NO: 439773 - DNA, 140 bp, Artificial Sequence
  Synthetic
atacgccatgctgggtctccgatcattccctccaaactttaagtcctgaaggtcacctttccttggggttagggggaatctctgagttcgatagccctccttaaactccgtgcaacagggcgtacttgggagtcggccat

SEQ ID NO: 439774 - DNA, 140 bp, Artificial Sequence
  Synthetic
atggccgactcccaagtacgccctgttgcacggagtttaaggagggctatcgaactcagagattccccctaaccccaaggaaaggtgaccttcaggacttaaagtttggagggaatgatcggagacccagcatggcgtat

SEQ ID NO: 439775 - DNA, 140 bp, Artificial Sequence
  Synthetic
atacgccatgctgggtctccctaacggtgctttcatcctccagggatcgataccaaaggttgcggacgggtcaagggttacttcagatgactccgtgctagggtgtggagagaggttatacgtacttgggagtcggccat

SEQ ID NO: 439776 - DNA, 140 bp, Artificial Sequence
  Synthetic
atggccgactcccaagtacgtataacctctctccacaccctagcacggagtcatctgaagtaacccttgacccgtccgcaacctttggtatcgatccctggaggatgaaagcaccgttagggagacccagcatggcgtat

SEQ ID NO: 439777 - DNA, 140 bp, Artificial Sequence
  Synthetic
atacgccatgctgggtctccgcaaagtgtgcataattataaagggctgggtcatctaagcttttccgtcgagaaaaaaactgtgggccagaagtgcaactggcaacacttctcatccccacgtacttgggagtcggccat

SEQ ID NO: 439778 - DNA, 140 bp, Artificial Sequence
  Synthetic
atggccgactcccaagtacgtggggatgagaagtgttgccagttgcacttctggcccacagtttttttctcgacggaaaagcttagatgacccagccctttataattatgcacactttgcggagacccagcatggcgtat

SEQ ID NO: 439779 - DNA, 140 bp, Artificial Sequence
  Synthetic
atacgccatgctgggtctccatcttgaggaattctgactataatctcaattctcctttaatagaggatcctgccagactaatgttagagtggctaaaaacaggaaatagaccttaccggacgtacttgggagtcggccat

SEQ ID NO: 439780 - DNA, 140 bp, Artificial Sequence
  Synthetic
atggccgactcccaagtacgtccggtaaggtctatttcctgtttttagccactctaacattagtctggcaggatcctctattaaaggagaattgagattatagtcagaattcctcaagatggagacccagcatggcgtat

SEQ ID NO: 439781 - DNA, 140 bp, Artificial Sequence
  Synthetic
atacgccatgctgggtctccttcaagaaagtggatttgggttctctcaaagtgggtggaactgctgcacagtcaatgatttccctctggttatatggtgcccactctgagtcaaacagaacgtacttgggagtcggccat

SEQ ID NO: 439782 - DNA, 140 bp, Artificial Sequence
  Synthetic
atggccgactcccaagtacgttctgtttgactcagagtgggcaccatataaccagagggaaatcattgactgtgcagcagttccacccactttgagagaacccaaatccactttcttgaaggagacccagcatggcgtat

SEQ ID NO: 439783 - DNA, 140 bp, Artificial Sequence
  Synthetic
atacgccatgctgggtctccatgtctcgaagccgctgactgatcctttattctatccaccatctgatcccaaaatcttgagacacttcaacatatgctgcagtaccatgatgtatttgtccgtacttgggagtcggccat

SEQ ID NO: 439784 - DNA, 140 bp, Artificial Sequence
  Synthetic
atggccgactcccaagtacggacaaatacatcatggtactgcagcatatgttgaagtgtctcaagattttgggatcagatggtggatagaataaaggatcagtcagcggcttcgagacatggagacccagcatggcgtat

SEQ ID NO: 439785 - DNA, 140 bp, Artificial Sequence
  Synthetic
atacgccatgctgggtctcctgatctccctttggctgtacggtgcctactctgaatcgaacaggagccggaagtgtataaccgatttggctcagttctattccaagtcttcccccatagacgtacttgggagtcggccat

SEQ ID NO: 439786 - DNA, 140 bp, Artificial Sequence
  Synthetic
atggccgactcccaagtacgtctatgggggaagacttggaatagaactgagccaaatcggttatacacttccggctcctgttcgattcagagtaggcaccgtacagccaaagggagatcaggagacccagcatggcgtat

SEQ ID NO: 439787 - DNA, 140 bp, Artificial Sequence
  Synthetic
atacgccatgctgggtctcccccagagggagtattaagttgccttgatagggtcgactatgataaggcatttgggagatatctggccaacacgtattcctcttatttgtttttccacgttcgtacttgggagtcggccat

SEQ ID NO: 439788 - DNA, 140 bp, Artificial Sequence
  Synthetic
atggccgactcccaagtacgaacgtggaaaaacaaataagaggaatacgtgttggccagatatctcccaaatgccttatcatagtcgaccctatcaaggcaacttaatactccctctgggggagacccagcatggcgtat

SEQ ID NO: 439789 - DNA, 140 bp, Artificial Sequence
  Synthetic
atacgccatgctgggtctccagttcaaagatcaaatatggggactgctaatcgtgaccaaagactttgtttattctcagagttctaactgccttttcgacagaaactacacacttatgctcgtacttgggagtcggccat

SEQ ID NO: 439790 - DNA, 140 bp, Artificial Sequence
  Synthetic
atggccgactcccaagtacgagcataagtgtgtagtttctgtcgaaaaggcagttagaactctgagaataaacaaagtctttggtcacgattagcagtccccatatttgatctttgaactggagacccagcatggcgtat

SEQ ID NO: 439791 - DNA, 140 bp, Artificial Sequence
  Synthetic
atacgccatgctgggtctcctacatagctggagatcaagtcctgtccatgtgcggaaactctggttatgaagttattaagatattagagccatatgtcgtgaatagcctagtccagagggcgtacttgggagtcggccat

SEQ ID NO: 439792 - DNA, 140 bp, Artificial Sequence
  Synthetic
atggccgactcccaagtacgccctctggactaggctattcacgacatatggctctaatatcttaataacttcataaccagagtttccgcacatggacaggacttgatctccagctatgtaggagacccagcatggcgtat

SEQ ID NO: 439793 - DNA, 140 bp, Artificial Sequence
  Synthetic
atacgccatgctgggtctccgaggttttttggagttctggaccaattcgacaacatacatgatttggtttttgtgtatggctgttacaggcattggggccatccctatatagattacagacgtacttgggagtcggccat

SEQ ID NO: 439794 - DNA, 140 bp, Artificial Sequence
  Synthetic
atggccgactcccaagtacgtctgtaatctatatagggatggccccaatgcctgtaacagccatacacaaaaaccaaatcatgtatgttgtcgaattggtccagaactccaaaaaacctcggagacccagcatggcgtat

SEQ ID NO: 439795 - DNA, 140 bp, Artificial Sequence
  Synthetic
atacgccatgctgggtctccggtgggggttcgacaagtactctaaatggtatctcgattcgagatctctcagccgagatcaccccttgactccctatatcaaaactcaaacatggccgcccgtacttgggagtcggccat

SEQ ID NO: 439796 - DNA, 140 bp, Artificial Sequence
  Synthetic
atggccgactcccaagtacgggcggccatgtttgagttttgatatagggagtcaaggggtgatctcggctgagagatctcgaatcgagataccatttagagtacttgtcgaacccccaccggagacccagcatggcgtat

SEQ ID NO: 439797 - DNA, 140 bp, Artificial Sequence
  Synthetic
atacgccatgctgggtctcccagatcagaccttatcgggttatgggaggaccaaatatactgcttggacatgtccaatggcccaacctgctggaatggccaagacggcgggctggaaggccgtacttgggagtcggccat

SEQ ID NO: 439798 - DNA, 140 bp, Artificial Sequence
  Synthetic
atggccgactcccaagtacggccttccagcccgccgtcttggccattccagcaggttgggccattggacatgtccaagcagtatatttggtcctcccataacccgataaggtctgatctgggagacccagcatggcgtat

SEQ ID NO: 439799 - DNA, 140 bp, Artificial Sequence
  Synthetic
atacgccatgctgggtctccgataaatcacattcgttcaccagaacgagactagcctcttggttgtcagagaacagaggagggcctgttcccagcgagaaggttatcatcacggctttgtcgtacttgggagtcggccat

SEQ ID NO: 439800 - DNA, 140 bp, Artificial Sequence
  Synthetic
atggccgactcccaagtacgacaaagccgtgatgataaccttctcgctgggaacaggccctcctctgttctctgacaaccaagaggctagtctcgttctggtgaacgaatgtgatttatcggagacccagcatggcgtat

SEQ ID NO: 439801 - DNA, 140 bp, Artificial Sequence
  Synthetic
atacgccatgctgggtctccagttcctcacccctctgagatgttggggttgattcccaaatcctctatttcctgtacttgtggagtaacaggagggggaaaccctcgaatatcagtgtctcgtacttgggagtcggccat

SEQ ID NO: 439802 - DNA, 140 bp, Artificial Sequence
  Synthetic
atggccgactcccaagtacgagacactgatattcgagggtttccccctcctgttactccacaagtacaggaaatagaggatttgggaatcaaccccaacatctcagaggggtgaggaactggagacccagcatggcgtat

SEQ ID NO: 439803 - DNA, 140 bp, Artificial Sequence
  Synthetic
atacgccatgctgggtctccactaaaaattgagggtcgattttttgctctgatgtcatggaacctaagattgtattttgttatcaccgagaagcttttggccaactacatcctgccactccgtacttgggagtcggccat

SEQ ID NO: 439804 - DNA, 140 bp, Artificial Sequence
  Synthetic
atggccgactcccaagtacggagtggcaggatgtagttggccaaaagcttctcggtgataacaaaatacaatcttaggttccatgacatcagagcaaaaaatcgaccctcaatttttagtggagacccagcatggcgtat

SEQ ID NO: 439805 - DNA, 140 bp, Artificial Sequence
  Synthetic
atacgccatgctgggtctccacgcttttcaccttgactatgagaagtggaacaatcatcaaagattggagtcaacagaggatgtgttctctgtcttagatcaggtgtttggattaaaaagcgtacttgggagtcggccat

SEQ ID NO: 439806 - DNA, 140 bp, Artificial Sequence
  Synthetic
atggccgactcccaagtacgctttttaatccaaacacctgatctaagacagagaacacatcctctgttgactccaatctttgatgattgttccacttctcatagtcaaggtgaaaagcgtggagacccagcatggcgtat

SEQ ID NO: 439807 - DNA, 140 bp, Artificial Sequence
  Synthetic
atacgccatgctgggtctccgatatgtccaacggtccgacctgttggaatggtcaagatggtgggctagagggcttacggcaaaagggctggagtctggtcagcctattaatgatagatacgtacttgggagtcggccat

SEQ ID NO: 439808 - DNA, 140 bp, Artificial Sequence
  Synthetic
atggccgactcccaagtacgtatctatcattaataggctgaccagactccagcccttttgccgtaagccctctagcccaccatcttgaccattccaacaggtcggaccgttggacatatcggagacccagcatggcgtat

SEQ ID NO: 439809 - DNA, 140 bp, Artificial Sequence
  Synthetic
atacgccatgctgggtctccagggctcctctatgagttggagagtatatcaaggaatgctctttcaatatatcgggctatcgaggaaggagcatctaaactagggctgatcatcaagaaacgtacttgggagtcggccat

SEQ ID NO: 439810 - DNA, 140 bp, Artificial Sequence
  Synthetic
atggccgactcccaagtacgtttcttgatgatcagccctagtttagatgctccttcctcgatagcccgatatattgaaagagcattccttgatatactctccaactcatagaggagccctggagacccagcatggcgtat

SEQ ID NO: 439811 - DNA, 140 bp, Artificial Sequence
  Synthetic
atacgccatgctgggtctccgaaggggaaagttttcttttagctatgtcaagaataatctacttagatccttctttgggaggagtatctggaatgtctctcggaaggttccatatacgtccgtacttgggagtcggccat

SEQ ID NO: 439812 - DNA, 140 bp, Artificial Sequence
  Synthetic
atggccgactcccaagtacggacgtatatggaaccttccgagagacattccagatactcctcccaaagaaggatctaagtagattattcttgacatagctaaaagaaaactttccccttcggagacccagcatggcgtat

SEQ ID NO: 439813 - DNA, 140 bp, Artificial Sequence
  Synthetic
atacgccatgctgggtctcccccagacctcggagagagaacacttgagagcttcactcgccttctggaagatcccaccactttaaatattaaaggaggggctagtcccaccatcttactccgtacttgggagtcggccat

SEQ ID NO: 439814 - DNA, 140 bp, Artificial Sequence
  Synthetic
atggccgactcccaagtacggagtaagatggtgggactagcccctcctttaatatttaaagtggtgggatcttccagaaggcgagtgaagctctcaagtgttctctctccgaggtctgggggagacccagcatggcgtat

SEQ ID NO: 439815 - DNA, 140 bp, Artificial Sequence
  Synthetic
atacgccatgctgggtctccttatacttttcttgaaatccgttgagcctctgtttcccagatttctcagtgaacttttcagttcatctttcttggggatccctgagtctatcattggactcgtacttgggagtcggccat

SEQ ID NO: 439816 - DNA, 140 bp, Artificial Sequence
  Synthetic
atggccgactcccaagtacgagtccaatgatagactcagggatccccaagaaagatgaactgaaaagttcactgagaaatctgggaaacagaggctcaacggatttcaagaaaagtataaggagacccagcatggcgtat

SEQ ID NO: 439817 - DNA, 140 bp, Artificial Sequence
  Synthetic
atacgccatgctgggtctccaaaaatgtaacacccctacaatggatgccgacaagattgtgttcaaagtcaataatcaggtggtctctttgaagcctgagattatcgtggatcaatatgacgtacttgggagtcggccat

SEQ ID NO: 439818 - DNA, 140 bp, Artificial Sequence
  Synthetic
atggccgactcccaagtacgtcatattgatccacgataatctcaggcttcaaagagaccacctgattattgactttgaacacaatcttgtcggcatccattgtaggggtgttacatttttggagacccagcatggcgtat

SEQ ID NO: 439819 - DNA, 140 bp, Artificial Sequence
  Synthetic
atacgccatgctgggtctccaataatcaggtggtctctttgaagcctgagattatcgtggatcaatatgagtacaagtaccctgccatcaaggatttgaaaaagccttgtatcaccctagcgtacttgggagtcggccat

SEQ ID NO: 439820 - DNA, 140 bp, Artificial Sequence
  Synthetic
atggccgactcccaagtacgctagggtgatacaaggctttttcaaatccttgatggcagggtacttgtactcatattgatccacgataatctcaggcttcaaagagaccacctgattattggagacccagcatggcgtat

SEQ ID NO: 439821 - DNA, 140 bp, Artificial Sequence
  Synthetic
atacgccatgctgggtctccatgactcagacaccgcaaagggtcgggagggtgtggccctgctcctctgaaagggcagatctcctaagggaaatctcttggggaagaaaggtggtgggcacgtacttgggagtcggccat

SEQ ID NO: 439822 - DNA, 140 bp, Artificial Sequence
  Synthetic
atggccgactcccaagtacgtgcccaccacctttcttccccaagagatttcccttaggagatctgccctttcagaggagcagggccacaccctcccgaccctttgcggtgtctgagtcatggagacccagcatggcgtat

SEQ ID NO: 439823 - DNA, 140 bp, Artificial Sequence
  Synthetic
aggccctggctgctgatatgaagggcagatctcctaagggaaatctcttggggaagaaaggtggtgggcacaacagttcctcacccttctgagatgttggggttacttcccaagtcttccgaccttttgggacagcggtg

SEQ ID NO: 439824 - DNA, 140 bp, Artificial Sequence
  Synthetic
caccgctgtcccaaaaggtcggaagacttgggaagtaaccccaacatctcagaagggtgaggaactgttgtgcccaccacctttcttccccaagagatttcccttaggagatctgcccttcatatcagcagccagggcct

SEQ ID NO: 439825 - DNA, 140 bp, Artificial Sequence
  Synthetic
atacgccatgctgggtctccctatagactgtgtatatccttcatgaaaaaaactaacaccccttcttttgaaccatcccaaatatgagcaaaatctttgtcaatccgagcgcaatccgagcgtacttgggagtcggccat

SEQ ID NO: 439826 - DNA, 140 bp, Artificial Sequence
  Synthetic
atggccgactcccaagtacgctcggattgcgctcggattgacaaagattttgctcatatttgggatggttcaaaagaaggggtgttagtttttttcatgaaggatatacacagtctatagggagacccagcatggcgtat

SEQ ID NO: 439827 - DNA, 140 bp, Artificial Sequence
  Synthetic
aggccctggctgctgatatgtgaggaactctgactataacctcaactctcctctaatagaagatcctgccaaattgatgctggagtggttgaaaacagggaatagaccttaccggatggcgaccttttgggacagcggtg

SEQ ID NO: 439828 - DNA, 140 bp, Artificial Sequence
  Synthetic
caccgctgtcccaaaaggtcgccatccggtaaggtctattccctgttttcaaccactccagcatcaatttggcaggatcttctattagaggagagttgaggttatagtcagagttcctcacatatcagcagccagggcct

SEQ ID NO: 439829 - DNA, 140 bp, Artificial Sequence
  Synthetic
aggccctggctgctgatatgattgacaagggaccccactgtctctgaacatgcatctttagtcggtcttctcctgagtctgtacaggttgagcaaaatatcaggacagaacactggtaacgaccttttgggacagcggtg

SEQ ID NO: 439830 - DNA, 140 bp, Artificial Sequence
  Synthetic
caccgctgtcccaaaaggtcgttaccagtgttctgtcctgatattttgctcaacctgtacagactcaggagaagaccgactaaagatgcatgttcagagacagtggggtcccttgtcaatcatatcagcagccagggcct

SEQ ID NO: 439831 - DNA, 140 bp, Artificial Sequence
  Synthetic
aggccctggctgctgatatgttttttagagttctggatcagttcgacaacatacatgacctggtctttgtatatggctgttacaggcattggggacatccttatatagattatagaaagggaccttttgggacagcggtg

SEQ ID NO: 439832 - DNA, 140 bp, Artificial Sequence
  Synthetic
caccgctgtcccaaaaggtccctttctataatctatataaggatgtccccaatgcctgtaacagccatatacaaagaccaggtcatgtatgttgtcgaactgatccagaactctaaaaaacatatcagcagccagggcct

SEQ ID NO: 439833 - DNA, 140 bp, Artificial Sequence
  Synthetic
atacgccatgctgggtctcctatgatttcatgttccagccattgatgctttatgcgcagacatggacatcagagctggtacagagagacacaaggctgagggactctacgtttcattggccgtacttgggagtcggccat

SEQ ID NO: 439834 - DNA, 140 bp, Artificial Sequence
  Synthetic
atggccgactcccaagtacggccaatgaaacgtagagtccctcagccttgtgtctctctgtaccagctctgatgtccatgtctgcgcataaagcatcaatggctggaacatgaaatcataggagacccagcatggcgtat

SEQ ID NO: 439835 - DNA, 140 bp, Artificial Sequence
  Synthetic
aggccctggctgctgatatggtgctaattggagtactataccgaacttcagatttttggccggaacctacgacatgtttttctcacggattgagcatctgtattcggcaatcagagtggggaccttttgggacagcggtg

SEQ ID NO: 439836 - DNA, 140 bp, Artificial Sequence
  Synthetic
caccgctgtcccaaaaggtccccactctgattgccgaatacagatgctcaatccgtgagaaaaacatgtcgtaggttccggccaaaaatctgaagttcggtatagtactccaattagcaccatatcagcagccagggcct

SEQ ID NO: 439837 - DNA, 140 bp, Artificial Sequence
  Synthetic
atacgccatgctgggtctcccacagtcgtcaccgcttatgaagactgctcaggactggtatcgtttacagggttcataaagcagatcaatctcaccgcaagggaagcaatactatatttccgtacttgggagtcggccat

SEQ ID NO: 439838 - DNA, 140 bp, Artificial Sequence
  Synthetic
atggccgactcccaagtacggaaatatagtattgcttcccttgcggtgagattgatctgctttatgaaccctgtaaacgataccagtcctgagcagtcttcataagcggtgacgactgtgggagacccagcatggcgtat

SEQ ID NO: 439839 - DNA, 140 bp, Artificial Sequence
  Synthetic
aggccctggctgctgatatgcgaaccccggtattcagacgacctgatatctcaactttgccaactatacattgcaggagatcgagtattgtccatgtgtggaaactcgggttatgaagtcgaccttttgggacagcggtg

SEQ ID NO: 439840 - DNA, 140 bp, Artificial Sequence
  Synthetic
caccgctgtcccaaaaggtcgacttcataacccgagtttccacacatggacaatactcgatctcctgcaatgtatagttggcaaagttgagatatcaggtcgtctgaataccggggttcgcatatcagcagccagggcct

SEQ ID NO: 439841 - DNA, 140 bp, Artificial Sequence
  Synthetic
atacgccatgctgggtctccgagacttctcagatctttgagtttccggacgtgtcaaaaagaatatctagaatggtttctggagctgttccccactttcagaaacttcccgatatccgcccgtacttgggagtcggccat

SEQ ID NO: 439842 - DNA, 140 bp, Artificial Sequence
  Synthetic
atggccgactcccaagtacgggcggatatcgggaagtttctgaaagtggggaacagctccagaaaccattctagatattctttttgacacgtccggaaactcaaagatctgagaagtctcggagacccagcatggcgtat

SEQ ID NO: 439843 - DNA, 140 bp, Artificial Sequence
  Synthetic
aggccctggctgctgatatgctcagatcctgtttctgaggggttgtcattctggagggaaatttggctgagctcccatgaatcttggattcatgccctgtgtcaggaagcagggaacccagaccttttgggacagcggtg

SEQ ID NO: 439844 - DNA, 140 bp, Artificial Sequence
  Synthetic
caccgctgtcccaaaaggtctgggttccctgcttcctgacacagggcatgaatccaagattcatgggagctcagccaaatttccctccagaatgacaacccctcagaaacaggatctgagcatatcagcagccagggcct

SEQ ID NO: 439845 - DNA, 140 bp, Artificial Sequence
  Synthetic
atacgccatgctgggtctccctccggatacaatgatgggaccatcttccctgtcaacatatacggcaaagtctcccctagagactatttgagggggctcgcaagaggagtcctgatagggcgtacttgggagtcggccat

SEQ ID NO: 439846 - DNA, 140 bp, Artificial Sequence
  Synthetic
atggccgactcccaagtacgccctatcaggactcctcttgcgagccccctcaaatagtctctaggggagactttgccgtatatgttgacagggaagatggtcccatcattgtatccggagggagacccagcatggcgtat

SEQ ID NO: 439847 - DNA, 140 bp, Artificial Sequence
  Synthetic
atacgccatgctgggtctcctcttcgatttgcttcttgacaagaatgacaaatatcaacattaatagacctctcgaattgatctcaggggtaatctcatatatcctcctgagactagatacgtacttgggagtcggccat

SEQ ID NO: 439848 - DNA, 140 bp, Artificial Sequence
  Synthetic
atggccgactcccaagtacgtatctagtctcaggaggatatatgagattacccctgagatcaattcgagaggtctattaatgttgatatttgtcattcttgtcaagaagcaaatcgaagaggagacccagcatggcgtat

SEQ ID NO: 439849 - DNA, 140 bp, Artificial Sequence
  Synthetic
atacgccatgctgggtctccccggtctggccgatcttgagatggccgaagagactgttgatctgatcaacagaaacatagaagacaatcaggctcatctccagggagaacccatagaagtcgtacttgggagtcggccat

SEQ ID NO: 439850 - DNA, 140 bp, Artificial Sequence
  Synthetic
atggccgactcccaagtacgacttctatgggttctccctggagatgagcctgattgtcttctatgtttctgttgatcagatcaacagtctcttcggccatctcaagatcggccagaccggggagacccagcatggcgtat

SEQ ID NO: 439851 - DNA, 140 bp, Artificial Sequence
  Synthetic
atacgccatgctgggtctccgagctaacctacgacaaatgagttccttgatgaggcaggtgctgggggggcacggggaggataccttagaatcagacgatgacgttcaacgactgttaaacgtacttgggagtcggccat

SEQ ID NO: 439852 - DNA, 140 bp, Artificial Sequence
  Synthetic
atggccgactcccaagtacgtttaacagtcgttgaacgtcatcgtctgattctaaggtatcctccccgtgcccccccagcacctgcctcatcaaggaactcatttgtcgtaggttagctcggagacccagcatggcgtat

SEQ ID NO: 439853 - DNA, 140 bp, Artificial Sequence
  Synthetic
atacgccatgctgggtctccgcaggatgttctgaatgggtttgctctgcacaacaggttgccgtctccacctcagctaacccggcccctgtctcagagcttgacataagggccctttctacgtacttgggagtcggccat

SEQ ID NO: 439854 - DNA, 140 bp, Artificial Sequence
  Synthetic
atggccgactcccaagtacgtagaaagggcccttatgtcaagctctgagacaggggccgggttagctgaggtggagacggcaacctgttgtgcagagcaaacccattcagaacatcctgcggagacccagcatggcgtat

SEQ ID NO: 439855 - DNA, 140 bp, Artificial Sequence
  Synthetic
atacgccatgctgggtctcccccatccctatgtctggtagttggagatgggtcggggggaatatcaagggcagtacttaacatgtttccagatgccaagcttgtattcaacagcctgttacgtacttgggagtcggccat

SEQ ID NO: 439856 - DNA, 140 bp, Artificial Sequence
  Synthetic
atggccgactcccaagtacgtaacaggctgttgaatacaagcttggcatctggaaacatgttaagtactgcccttgatattccccccgacccatctccaactaccagacatagggatgggggagacccagcatggcgtat

SEQ ID NO: 439857 - DNA, 140 bp, Artificial Sequence
  Synthetic
atacgccatgctgggtctccggtcctccagcccttgaatggtcagccaccaatgaagaagatgatctatcagtagaggctgagatcgctcatcagattgctgaaagcttttccaagaagtcgtacttgggagtcggccat

SEQ ID NO: 439858 - DNA, 140 bp, Artificial Sequence
  Synthetic
atggccgactcccaagtacgacttcttggaaaagctttcagcaatctgatgagcgatctcagcctctactgatagatcatcttcttcattggtggctgaccattcaagggctggaggaccggagacccagcatggcgtat

SEQ ID NO: 439859 - DNA, 140 bp, Artificial Sequence
  Synthetic
aggccctggctgctgatatgacaagtttccctcccgatcttcaggaatattcttgtataattttgagcaactgaagatgaaccttgatgacatagttaaagaggcaaaaaatgtaccggggaccttttgggacagcggtg

SEQ ID NO: 439860 - DNA, 140 bp, Artificial Sequence
  Synthetic
caccgctgtcccaaaaggtccccggtacattttttgcctctttaactatgtcatcaaggttcatcttcagttgctcaaaattatacaagaatattcctgaagatcgggagggaaacttgtcatatcagcagccagggcct

SEQ ID NO: 439861 - DNA, 140 bp, Artificial Sequence
  Synthetic
atacgccatgctgggtctcccaatctgggagaaaccgtctgatctgagaaacttggcaacctggaaatactttcaatcagtccaaagacaggtaaacatgtcttacgacctcataatttgcgtacttgggagtcggccat

SEQ ID NO: 439862 - DNA, 140 bp, Artificial Sequence
  Synthetic
atggccgactcccaagtacgcaaattatgaggtcgtaagacatgtttacctgtctttggactgattgaaagtatttccaggttgccaagtttctcagatcagacggtttctcccagattgggagacccagcatggcgtat

SEQ ID NO: 439863 - DNA, 140 bp, Artificial Sequence
  Synthetic
atacgccatgctgggtctcctgacgcagaagttactgacatcgcatctatcaataggataaccctgttgatgtctgatttcgcattgtctatagacggaccactttatttggtcttcaagcgtacttgggagtcggccat

SEQ ID NO: 439864 - DNA, 140 bp, Artificial Sequence
  Synthetic
atggccgactcccaagtacgcttgaagaccaaataaagtggtccgtctatagacaatgcgaaatcagacatcaacagggttatcctattgatagatgcgatgtcagtaacttctgcgtcaggagacccagcatggcgtat

SEQ ID NO: 439865 - DNA, 140 bp, Artificial Sequence
  Synthetic
atacgccatgctgggtctccgctgacaagctaagcaaaatcatgcaagatgatttgaatcgctatacatcctgctaaccgagttttcgaactcagtccctccagataatgaaaactgagacgtacttgggagtcggccat

SEQ ID NO: 439866 - DNA, 140 bp, Artificial Sequence
  Synthetic
atggccgactcccaagtacgtctcagttttcattatctggagggactgagttcgaaaactcggttagcaggatgtatagcgattcaaatcatcttgcatgattttgcttagcttgtcagcggagacccagcatggcgtat

SEQ ID NO: 439867 - DNA, 140 bp, Artificial Sequence
  Synthetic
atacgccatgctgggtctcccattttcatctgagctatatcttcgcttttccaaacgagggaagttttttcgagatgctgagtacttgacctcttccacccttcgagagatgagccttgtcgtacttgggagtcggccat

SEQ ID NO: 439868 - DNA, 140 bp, Artificial Sequence
  Synthetic
atggccgactcccaagtacgacaaggctcatctctcgaagggtggaagaggtcaagtactcagcatctcgaaaaaacttccctcgtttggaaaagcgaagatatagctcagatgaaaatgggagacccagcatggcgtat

SEQ ID NO: 439869 - DNA, 140 bp, Artificial Sequence
  Synthetic
aggccctggctgctgatatgtcttgagtctgtatagattgagcaaaatatctgggcagaacaccggcaattacaagacaaacatcgcagacagaatagagcagatttttgagacagccccgaccttttgggacagcggtg

SEQ ID NO: 439870 - DNA, 140 bp, Artificial Sequence
  Synthetic
caccgctgtcccaaaaggtcggggctgtctcaaaaatctgctctattctgtctgcgatgtttgtcttgtaattgccggtgttctgcccagatattttgctcaatctatacagactcaagacatatcagcagccagggcct

SEQ ID NO: 439871 - DNA, 140 bp, Artificial Sequence
  Synthetic
aggccctggctgctgatatgaatcataggatgattgggttagtcaaagttgttgttggactagctttatcaggagctccagtacctgagggcatgaactgggtttacaaattgaggagaagaccttttgggacagcggtg

SEQ ID NO: 439872 - DNA, 140 bp, Artificial Sequence
  Synthetic
caccgctgtcccaaaaggtcttctcctcaatttgtaaacccagttcatgccctcaggtactggagctcctgataaagctagtccaacaacaactttgactaacccaatcatcctatgattcatatcagcagccagggcct

SEQ ID NO: 439873 - DNA, 140 bp, Artificial Sequence
  Synthetic
atacgccatgctgggtctccccccaagatcctgaggcacttcaacatatgttgcagtactatgatgtatctatccaccgctctaggcgatgtccccaactttgcaagacttcatgacctgcgtacttgggagtcggccat

SEQ ID NO: 439874 - DNA, 140 bp, Artificial Sequence
  Synthetic
atggccgactcccaagtacgcaggtcatgaagtcttgcaaagttggggacatcgcctagagcggtggatagatacatcatagtactgcaacatatgttgaagtgcctcaggatcttggggggagacccagcatggcgtat

SEQ ID NO: 439875 - DNA, 140 bp, Artificial Sequence
  Synthetic
aggccctggctgctgatatgggagactgcagttcctcactcctatttcatccattttcgttccttgggcttaagcgggaaatctccgtactcatcaaatgcagttggtcacgtgttcaacgaccttttgggacagcggtg

SEQ ID NO: 439876 - DNA, 140 bp, Artificial Sequence
  Synthetic
caccgctgtcccaaaaggtcgttgaacacgtgaccaactgcatttgatgagtacggagatttcccgcttaagcccaaggaacgaaaatggatgaaataggagtgaggaactgcagtctcccatatcagcagccagggcct

SEQ ID NO: 439877 - DNA, 140 bp, Artificial Sequence
  Synthetic
atacgccatgctgggtctcccttcagacacaaaggtctgaagaggacaaagactcttctctgcttctagaataatcagattatatcctgcaagtgtatcacttgtttacctctggaggagcgtacttgggagtcggccat

SEQ ID NO: 439878 - DNA, 140 bp, Artificial Sequence
  Synthetic
atggccgactcccaagtacgctcctccagaggtaaacaagtgatacacttgcaggatataatctgattattctagaagcagagaagagtctttgtcctcttcagacctttgtgtctgaagggagacccagcatggcgtat

SEQ ID NO: 439879 - DNA, 140 bp, Artificial Sequence
  Synthetic
aggccctggctgctgatatgatttgggggaagagttctttggaaaagggacttttgagagaagattcttcagggacgagagagaacttcaggaatatgaagcggctgaattgactaggacgaccttttgggacagcggtg

SEQ ID NO: 439880 - DNA, 140 bp, Artificial Sequence
  Synthetic
caccgctgtcccaaaaggtcgtcctagtcaattcagccgcttcatattcctgaagttctctctcgtccctgaagaatcttctctcaaaagtcccttttccaaagaactcttcccccaaatcatatcagcagccagggcct

SEQ ID NO: 439881 - DNA, 140 bp, Artificial Sequence
  Synthetic
atacgccatgctgggtctccaaacactctaagaggcttgcacaggtcaagactcttatacgatgtaccttgaaaaaaacaagatcttgacactgagcctctggttggttgattgttttttcgtacttgggagtcggccat

SEQ ID NO: 439882 - DNA, 140 bp, Artificial Sequence
  Synthetic
atggccgactcccaagtacgaaaaaacaatcaaccaaccagaggctcagtgtcaagatcttgtttttttcaaggtacatcgtataagagtcttgacctgtgcaagcctcttagagtgtttggagacccagcatggcgtat

SEQ ID NO: 439883 - DNA, 140 bp, Artificial Sequence
  Synthetic
aggccctggctgctgatatgatgaatggaggtagactgaaaagatcacatataaggaggtatgtctcagtcagctccaatcatcaagctcgacccaattcatttgctgagtttttaaacagaccttttgggacagcggtg

SEQ ID NO: 439884 - DNA, 140 bp, Artificial Sequence
  Synthetic
caccgctgtcccaaaaggtctgtttaaaaactcagcaaatgaattgggtcgagcttgatgattggagctgactgagacatacctccttatatgtgatcttttcagtctacctccattcatcatatcagcagccagggcct

SEQ ID NO: 439885 - DNA, 140 bp, Artificial Sequence
  Synthetic
aggccctggctgctgatatgaaaatgtaacacccctacaatggatgccgacaagattgtattcaaagtcaataataaggtggtctctctgaagcctgaaattatcgtggaccaatatgaggaccttttgggacagcggtg

SEQ ID NO: 439886 - DNA, 140 bp, Artificial Sequence
  Synthetic
caccgctgtcccaaaaggtcctcatattggtccacgataatttcaggcttcagagagaccaccttattattgactttgaatacaatcttgtcggcatccattgtaggggtgttacattttcatatcagcagccagggcct

SEQ ID NO: 439887 - DNA, 140 bp, Artificial Sequence
  Synthetic
atacgccatgctgggtctccataataaggtggtctctctgaagcctgaaattatcgtggaccaatatgagtacaagtacccggctatcaaggacttaaagaagcccagtataaccttaggcgtacttgggagtcggccat

SEQ ID NO: 439888 - DNA, 140 bp, Artificial Sequence
  Synthetic
atggccgactcccaagtacgcctaaggttatactgggcttctttaagtccttgatagccgggtacttgtactcatattggtccacgataatttcaggcttcagagagaccaccttattatggagacccagcatggcgtat

SEQ ID NO: 439889 - DNA, 140 bp, Artificial Sequence
  Synthetic
aggccctggctgctgatatgaccatctcagacatgagcaagatttttgtcaacccgagtgcaatcagggcgggccttgcagatctagagatggcagaggaaacagtagacctaattgctagaccttttgggacagcggtg

SEQ ID NO: 439890 - DNA, 140 bp, Artificial Sequence
  Synthetic
caccgctgtcccaaaaggtctagcaattaggtctactgtttcctctgccatctctagatctgcaaggcccgccctgattgcactcgggttgacaaaaatcttgctcatgtctgagatggtcatatcagcagccagggcct

SEQ ID NO: 439891 - DNA, 140 bp, Artificial Sequence
  Synthetic
atacgccatgctgggtctccgggccttgcagatctagagatggcagaggaaacagtagacctaattgctagaaacattgaggacaatcaggctcatctccaaggagagcccatagaggtacgtacttgggagtcggccat

SEQ ID NO: 439892 - DNA, 140 bp, Artificial Sequence
  Synthetic
atggccgactcccaagtacgtacctctatgggctctccttggagatgagcctgattgtcctcaatgtttctagcaattaggtctactgtttcctctgccatctctagatctgcaaggcccggagacccagcatggcgtat

SEQ ID NO: 439893 - DNA, 140 bp, Artificial Sequence
  Synthetic
aggccctggctgctgatatgaagaaccaccaaagagtccctcattatcatatccccaagtgtgacagatttggacccatatgacaaatcccttcactcaagggtcttccctggcggaaaggaccttttgggacagcggtg

SEQ ID NO: 439894 - DNA, 140 bp, Artificial Sequence
  Synthetic
caccgctgtcccaaaaggtcctttccgccagggaagacccttgagtgaagggatttgtcatatgggtccaaatctgtcacacttggggatatgataatgagggactctttggtggttcttcatatcagcagccagggcct

SEQ ID NO: 439895 - DNA, 140 bp, Artificial Sequence
  Synthetic
atacgccatgctgggtctcctggacccatatgacaaatcccttcactcaagggtcttccctggcggaaagtgctcaggaataacggtgtcctctacctactgctcaactaaccatgattacgtacttgggagtcggccat

SEQ ID NO: 439896 - DNA, 140 bp, Artificial Sequence
  Synthetic
atggccgactcccaagtacgtaatcatggttagttgagcagtaggtagaggacaccgttattcctgagcactttccgccagggaagacccttgagtgaagggatttgtcatatgggtccaggagacccagcatggcgtat

SEQ ID NO: 439897 - DNA, 140 bp, Artificial Sequence
  Synthetic
aggccctggctgctgatatgacaagacaaacatcgcagacaggatagagcagattttcgaaacagccccttttgtaaagatcgtagaacatcatactttgatgacaacccacaaaatgtggaccttttgggacagcggtg

SEQ ID NO: 439898 - DNA, 140 bp, Artificial Sequence
  Synthetic
caccgctgtcccaaaaggtccacattttgtgggttgtcatcaaagtatgatgttctacgatctttacaaaaggggctgtttcgaaaatctgctctatcctgtctgcgatgtttgtcttgtcatatcagcagccagggcct

SEQ ID NO: 439899 - DNA, 140 bp, Artificial Sequence
  Synthetic
aggccctggctgctgatatgcagactgcaagccgggaactcaagaaggaggtagtgtccgatccctctcagcgagaaagtcagtcttctaaagccaaaatggcggcccaaactgcctctggaccttttgggacagcggtg

SEQ ID NO: 439900 - DNA, 140 bp, Artificial Sequence
  Synthetic
caccgctgtcccaaaaggtccagaggcagtttgggccgccattttggctttagaagactgactttctcgctgagagggatcggacactacctccttcttgagttcccggcttgcagtctgcatatcagcagccagggcct

SEQ ID NO: 439901 - DNA, 140 bp, Artificial Sequence
  Synthetic
aggccctggctgctgatatggtcctcctgctatagagtggtcctccgccaacgaagaggatgacccatccgtagaagctgaaattgctcatcaaattgctgaaagcttctccaagaagtagaccttttgggacagcggtg

SEQ ID NO: 439902 - DNA, 140 bp, Artificial Sequence
  Synthetic
caccgctgtcccaaaaggtctacttcttggagaagctttcagcaatttgatgagcaatttcagcttctacggatgggtcatcctcttcgttggcggaggaccactctatagcaggaggaccatatcagcagccagggcct

SEQ ID NO: 439903 - DNA, 140 bp, Artificial Sequence
  Synthetic
atacgccatgctgggtctccgtttataaaacaaataaatctcactgcgagagaagcactactatatttcttccacaagaactttgaagaagagataagaagaatgtttgagccggggcaacgtacttgggagtcggccat

SEQ ID NO: 439904 - DNA, 140 bp, Artificial Sequence
  Synthetic
atggccgactcccaagtacgttgccccggctcaaacattcttcttatctcttcttcaaagttcttgtggaagaaatatagtagtgcttctctcgcagtgagatttatttgttttataaacggagacccagcatggcgtat

SEQ ID NO: 439905 - DNA, 140 bp, Artificial Sequence
  Synthetic
aggccctggctgctgatatggtgactcgcctggctcaagacggatcaaaactccctctgagatgtgtgctggggtgggttgctctagccaactctaaaaagttccagctgttagttgagcgaccttttgggacagcggtg

SEQ ID NO: 439906 - DNA, 140 bp, Artificial Sequence
  Synthetic
caccgctgtcccaaaaggtcgctcaactaacagctggaactttttagagttggctagagcaacccaccccagcacacatctcagagggagttttgatccgtcttgagccaggcgagtcaccatatcagcagccagggcct

SEQ ID NO: 439907 - DNA, 140 bp, Artificial Sequence
  Synthetic
atacgccatgctgggtctccgaaaatgtaacacctctacaatggataccgacaaaattgtattcaaagtcaataatcaggttgtctctctaaaacctgaaattattgtagatcaatatgacgtacttgggagtcggccat

SEQ ID NO: 439908 - DNA, 140 bp, Artificial Sequence
  Synthetic
atggccgactcccaagtacgtcatattgatctacaataatttcaggttttagagagacaacctgattattgactttgaatacaattttgtcggtatccattgtagaggtgttacattttcggagacccagcatggcgtat

SEQ ID NO: 439909 - DNA, 140 bp, Artificial Sequence
  Synthetic
aggccctggctgctgatatgtcagacgtcagatgagatcaaatggtgctctcctgatcagctagtgaatctacacgatcttcattcggatgagattgaacatcttgttgtggaggagttggaccttttgggacagcggtg

SEQ ID NO: 439910 - DNA, 140 bp, Artificial Sequence
  Synthetic
caccgctgtcccaaaaggtccaactcctccacaacaagatgttcaatctcatccgaatgaagatcgtgtagattcactagctgatcaggagagcaccatttgatctcatctgacgtctgacatatcagcagccagggcct

SEQ ID NO: 439911 - DNA, 140 bp, Artificial Sequence
  Synthetic
aggccctggctgctgatatggctctaaatcaagcatgaaaaaaacaggcaacaccactgataagatgaactttctgcgtaagatagtgaagaactgtagggatgaggacactcagaagccgaccttttgggacagcggtg

SEQ ID NO: 439912 - DNA, 140 bp, Artificial Sequence
  Synthetic
caccgctgtcccaaaaggtcggcttctgagtgtcctcatccctacagttcttcactatcttacgcagaaagttcatcttatcagtggtgttgcctgtttttttcatgcttgatttagagccatatcagcagccagggcct

SEQ ID NO: 439913 - DNA, 140 bp, Artificial Sequence
  Synthetic
aggccctggctgctgatatggaagtagccttggctgatgacggaaccgtcaattctgatgacgaggactacttctctagtgagaccaggagtccggaggcagtctacactcgaatcatgagaccttttgggacagcggtg

SEQ ID NO: 439914 - DNA, 140 bp, Artificial Sequence
  Synthetic
caccgctgtcccaaaaggtctcatgattcgagtgtagactgcctccggactcctggtctcactagagaagtagtcctcgtcatcagaattgacggttccgtcatcagccaaggctacttccatatcagcagccagggcct

SEQ ID NO: 439915 - DNA, 140 bp, Artificial Sequence
  Synthetic
atacgccatgctgggtctccaatgcagctaagctcgaccctgatgatgtgtgctcttacttggcagctgcaatgcaattctttgaaggaacatgtccagaagactggactagctatggaacgtacttgggagtcggccat

SEQ ID NO: 439916 - DNA, 140 bp, Artificial Sequence
  Synthetic
atggccgactcccaagtacgttccatagctagtccagtcttctggacatgttccttcaaagaattgcattgcagctgccaagtaagagcacacatcatcagggtcgagcttagctgcattggagacccagcatggcgtat

SEQ ID NO: 439917 - DNA, 140 bp, Artificial Sequence
  Synthetic
atacgccatgctgggtctcctgatgactgcaggggccatgattggcctggtgttgatattttccctaatgacatggtgcagaagagccaatcgaccagaatcgaaacaacgcagttttggcgtacttgggagtcggccat

SEQ ID NO: 439918 - DNA, 140 bp, Artificial Sequence
  Synthetic
atggccgactcccaagtacgccaaaactgcgttgtttcgattctggtcgattggctcttctgcaccatgtcattagggaaaatatcaacaccaggccaatcatggcccctgcagtcatcaggagacccagcatggcgtat

SEQ ID NO: 439919 - DNA, 140 bp, Artificial Sequence
  Synthetic
aggccctggctgctgatatgacatggtgcagaagagccaatcgaccagaatcgaaacaacgcagttttggagggacaggggggaatgtgtcagtcacttcccaaagcggaaaagtcatacgaccttttgggacagcggtg

SEQ ID NO: 439920 - DNA, 140 bp, Artificial Sequence
  Synthetic
caccgctgtcccaaaaggtcgtatgacttttccgctttgggaagtgactgacacattcccccctgtccctccaaaactgcgttgtttcgattctggtcgattggctcttctgcaccatgtcatatcagcagccagggcct

SEQ ID NO: 439921 - DNA, 140 bp, Artificial Sequence
  Synthetic
atacgccatgctgggtctccgttgactagggatcccaccattccagaacatgcatctttggttggtcttctcttgagtttgtatcgattgagcaaaatatccggacagaacacaggcaatcgtacttgggagtcggccat

SEQ ID NO: 439922 - DNA, 140 bp, Artificial Sequence
  Synthetic
atggccgactcccaagtacgattgcctgtgttctgtccggatattttgctcaatcgatacaaactcaagagaagaccaaccaaagatgcatgttctggaatggtgggatccctagtcaacggagacccagcatggcgtat

SEQ ID NO: 439923 - DNA, 140 bp, Artificial Sequence
  Synthetic
atacgccatgctgggtctcccttcatgggaatcatataagagtggaggtgagatcagactgtgaaggccggtcatccttttgacgattccagtcccgaggataacctcctctcgggattgcgtacttgggagtcggccat

SEQ ID NO: 439924 - DNA, 140 bp, Artificial Sequence
  Synthetic
atggccgactcccaagtacgcaatcccgagaggaggttatcctcgggactggaatcgtcaaaaggatgaccggccttcacagtctgatctcacctccactcttatatgattcccatgaagggagacccagcatggcgtat

SEQ ID NO: 439925 - DNA, 140 bp, Artificial Sequence
  Synthetic
aggccctggctgctgatatgggaacatcgaagataatcaggctcatctccaaggagatcccatagaggtggacaatctccccgaagacatgagaaggcttcaattagacgatgaaaaaccgaccttttgggacagcggtg

SEQ ID NO: 439926 - DNA, 140 bp, Artificial Sequence
  Synthetic
caccgctgtcccaaaaggtcggtttttcatcgtctaattgaagccttctcatgtcttcggggagattgtccacctctatgggatctccttggagatgagcctgattatcttcgatgttcccatatcagcagccagggcct

SEQ ID NO: 439927 - DNA, 140 bp, Artificial Sequence
  Synthetic
atacgccatgctgggtctccgcgctaactggagcaccataccgaactttagattcctggccggaacttatgacatgtttttctctcggattgaacatttatattcagcaatcagagtgggcgtacttgggagtcggccat

SEQ ID NO: 439928 - DNA, 140 bp, Artificial Sequence
  Synthetic
atggccgactcccaagtacgcccactctgattgctgaatataaatgttcaatccgagagaaaaacatgtcataagttccggccaggaatctaaagttcggtatggtgctccagttagcgcggagacccagcatggcgtat

SEQ ID NO: 439929 - DNA, 140 bp, Artificial Sequence
  Synthetic
atacgccatgctgggtctccggtcgtgtagattctcttaatacgggagatcttctagcagtttcagtgaccaacggtgctttcattctccaggaactgataccaaaggttgtggacaggccgtacttgggagtcggccat

SEQ ID NO: 439930 - DNA, 140 bp, Artificial Sequence
  Synthetic
atggccgactcccaagtacggcctgtccacaacctttggtatcagttcctggagaatgaaagcaccgttggtcactgaaactgctagaagatctcccgtattaagagaatctacacgaccggagacccagcatggcgtat

SEQ ID NO: 439931 - DNA, 140 bp, Artificial Sequence
  Synthetic
atacgccatgctgggtctccttccacaagaattttgagggagagataagaagaatgtttgagccgggacaggaaactgcagtccctcactcctatttcatccatttccggtctttaggcccgtacttgggagtcggccat

SEQ ID NO: 439932 - DNA, 140 bp, Artificial Sequence
  Synthetic
atggccgactcccaagtacgggcctaaagaccggaaatggatgaaataggagtgagggactgcagtttcctgtcccggctcaaacattcttcttatctctccctcaaaattcttgtggaaggagacccagcatggcgtat

SEQ ID NO: 439933 - DNA, 140 bp, Artificial Sequence
  Synthetic
atacgccatgctgggtctcccagactgccaaccgggaactcaagaaggagacagtgtctgcttcttctcagcgagaaagtcaatcatctaaagccaaaatggcggctcaaaccgcctccgcgtacttgggagtcggccat

SEQ ID NO: 439934 - DNA, 140 bp, Artificial Sequence
  Synthetic
atggccgactcccaagtacgcggaggcggtttgagccgccattttggctttagatgattgactttctcgctgagaagaagcagacactgtctccttcttgagttcccggttggcagtctgggagacccagcatggcgtat

SEQ ID NO: 439935 - DNA, 140 bp, Artificial Sequence
  Synthetic
aggccctggctgctgatatggcgagaaagtcaatcatctaaagccaaaatggcggctcaaaccgcctccggtccttctgctctagagtggtccgctgccaacgaagaggatgacccatctgaccttttgggacagcggtg

SEQ ID NO: 439936 - DNA, 140 bp, Artificial Sequence
  Synthetic
caccgctgtcccaaaaggtcagatgggtcatcctcttcgttggcagcggaccactctagagcagaaggaccggaggcggtttgagccgccattttggctttagatgattgactttctcgccatatcagcagccagggcct

SEQ ID NO: 439937 - DNA, 140 bp, Artificial Sequence
  Synthetic
atacgccatgctgggtctccaacggttattgccacatgtgctccacatgagatgtctgttctcgggggttatttgggggaggagttctttggcaaggggacttttgagagaagattcttccgtacttgggagtcggccat

SEQ ID NO: 439938 - DNA, 140 bp, Artificial Sequence
  Synthetic
atggccgactcccaagtacggaagaatcttctctcaaaagtccccttgccaaagaactcctcccccaaataacccccgagaacagacatctcatgtggagcacatgtggcaataaccgttggagacccagcatggcgtat

SEQ ID NO: 439939 - DNA, 140 bp, Artificial Sequence
  Synthetic
aggccctggctgctgatatgaagctcggcccttggagtcctattgacatacatcatctcagctgtcctaataacttggttgtagaggacgaggggtgcactagcttgtcagggttttcttgaccttttgggacagcggtg

SEQ ID NO: 439940 - DNA, 140 bp, Artificial Sequence
  Synthetic
caccgctgtcccaaaaggtcaagaaaaccctgacaagctagtgcacccctcgtcctctacaaccaagttattaggacagctgagatgatgtatgtcaataggactccaagggccgagcttcatatcagcagccagggcct

SEQ ID NO: 439941 - DNA, 140 bp, Artificial Sequence
  Synthetic
atacgccatgctgggtctcccaaagtggctatcattatagccattatgatagtcttttccaatagagtatttaacatttccaaaccgttgactgaccccttgttctatccgccatctgatcgtacttgggagtcggccat

SEQ ID NO: 439942 - DNA, 140 bp, Artificial Sequence
  Synthetic
atggccgactcccaagtacgatcagatggcggatagaacaaggggtcagtcaacggtttggaaatgttaaatactctattggaaaagactatcataatggctataatgatagccactttgggagacccagcatggcgtat

SEQ ID NO: 439943 - DNA, 140 bp, Artificial Sequence
  Synthetic
atacgccatgctgggtctccacttctctggtgaaaccaggagtccagaggcggtctatactcggatcatgatcaatgggggccgactcaaaagatcacatataagaaggtatgtatcagtcgtacttgggagtcggccat

SEQ ID NO: 439944 - DNA, 140 bp, Artificial Sequence
  Synthetic
atggccgactcccaagtacgactgatacataccttcttatatgtgatcttttgagtcggcccccattgatcatgatccgagtatagaccgcctctggactcctggtttcaccagagaagtggagacccagcatggcgtat

SEQ ID NO: 439945 - DNA, 140 bp, Artificial Sequence
  Synthetic
atacgccatgctgggtctcctaataaattgtttaattcctccacgaaaaaaactaacacccctccttttgaaccatcccaagcatgagcaagatttttgtcaacccaagtgcgatcagggcgtacttgggagtcggccat

SEQ ID NO: 439946 - DNA, 140 bp, Artificial Sequence
  Synthetic
atggccgactcccaagtacgccctgatcgcacttgggttgacaaaaatcttgctcatgcttgggatggttcaaaaggaggggtgttagtttttttcgtggaggaattaaacaatttattaggagacccagcatggcgtat

SEQ ID NO: 439947 - DNA, 140 bp, Artificial Sequence
  Synthetic
aggccctggctgctgatatgcatctggatgcccgaggaagcgagacttgggacatcttgtgacatttttaccaacagcaaagggaagagagcatctaaggggggcaagatttgcggattcgaccttttgggacagcggtg

SEQ ID NO: 439948 - DNA, 140 bp, Artificial Sequence
  Synthetic
caccgctgtcccaaaaggtcgaatccgcaaatcttgccccccttagatgctctcttccctttgctgttggtaaaaatgtcacaagatgtcccaagtctcgcttcctcgggcatccagatgcatatcagcagccagggcct

SEQ ID NO: 439949 - DNA, 140 bp, Artificial Sequence
  Synthetic
atacgccatgctgggtctccagatagtctgcccgatgacatgagacggctccacttggatgatgaaaaaccgtctggttttgacaaggtgacaaaagaaggggagagcaaatgtcatgaacgtacttgggagtcggccat

SEQ ID NO: 439950 - DNA, 140 bp, Artificial Sequence
  Synthetic
atggccgactcccaagtacgttcatgacatttgctctccccttcttttgtcaccttgtcaaaaccagacggtttttcatcatccaagtggagccgtctcatgtcatcgggcagactatctggagacccagcatggcgtat

SEQ ID NO: 439951 - DNA, 140 bp, Artificial Sequence
  Synthetic
aggccctggctgctgatatgtccaaacatcggatgagaccaaatggtgtcctcctgatcaattggtgaatgtacatgactttcactcagacgagatagaacatctcattgtggaggagctgaccttttgggacagcggtg

SEQ ID NO: 439952 - DNA, 140 bp, Artificial Sequence
  Synthetic
caccgctgtcccaaaaggtcagctcctccacaatgagatgttctatctcgtctgagtgaaagtcatgtacattcaccaattgatcaggaggacaccatttggtctcatccgatgtttggacatatcagcagccagggcct

SEQ ID NO: 439953 - DNA, 140 bp, Artificial Sequence
  Synthetic
atacgccatgctgggtctccgattccttaaaatatggtctcagactgtagaggagatcatatcctatgtcacgatcaatttccccggctctttggggaggccttctgaagacaaggccaccgtacttgggagtcggccat

SEQ ID NO: 439954 - DNA, 140 bp, Artificial Sequence
  Synthetic
atggccgactcccaagtacggtggccttgtcttcagaaggcctccccaaagagccggggaaattgatcgtgacataggatatgatctcctctacagtctgagaccatattttaaggaatcggagacccagcatggcgtat

SEQ ID NO: 439955 - DNA, 140 bp, Artificial Sequence
  Synthetic
aggccctggctgctgatatgctaaatccgtgagtttcagacgtctcagccacttaaggaaacttgttcctgggtttggaaaggcatatactatattcaacaaaaccttaatggaagctgagaccttttgggacagcggtg

SEQ ID NO: 439956 - DNA, 140 bp, Artificial Sequence
  Synthetic
caccgctgtcccaaaaggtctcagcttccattaaggttttgttgaatatagtatatgcctttccaaacccaggaacaagtttccttaagtggctgagacgtctgaaactcacggatttagcatatcagcagccagggcct

SEQ ID NO: 439957 - DNA, 140 bp, Artificial Sequence
  Synthetic
atacgccatgctgggtctccggtccacctgccctagaatggtctgccaccaacgaagaagacgatttgtctgtggaggcagagatagctcatcaaattgccgagagcttctctaagaagtcgtacttgggagtcggccat

SEQ ID NO: 439958 - DNA, 140 bp, Artificial Sequence
  Synthetic
atggccgactcccaagtacgacttcttagagaagctctcggcaatttgatgagctatctctgcctccacagacaaatcgtcttcttcgttggtggcagaccattctagggcaggtggaccggagacccagcatggcgtat

SEQ ID NO: 439959 - DNA, 140 bp, Artificial Sequence
  Synthetic
aggccctggctgctgatatgtttaatggtataattctaggtccagacgggactgtcttgatccctgaaatgcaatcgtccttgctccaacaacatatggagctgttggagtcctctgtgagaccttttgggacagcggtg

SEQ ID NO: 439960 - DNA, 140 bp, Artificial Sequence
  Synthetic
caccgctgtcccaaaaggtctcacagaggactccaacagctccatatgttgttggagcaaggacgattgcatttcagggatcaagacagtcccgtctggacctagaattataccattaaacatatcagcagccagggcct

SEQ ID NO: 439961 - DNA, 140 bp, Artificial Sequence
  Synthetic
atacgccatgctgggtctcctgttacccgcttggcccacgaagggtctaaactccctctaagatgtgtacttggatgggttgctctagccaactccagaaaattccagctgctggtcgagcgtacttgggagtcggccat

SEQ ID NO: 439962 - DNA, 140 bp, Artificial Sequence
  Synthetic
atggccgactcccaagtacgctcgaccagcagctggaattttctggagttggctagagcaacccatccaagtacacatcttagagggagtttagacccttcgtgggccaagcgggtaacaggagacccagcatggcgtat

SEQ ID NO: 439963 - DNA, 140 bp, Artificial Sequence
  Synthetic
aggccctggctgctgatatgaatctcaggggttgaccttggtctccctagctgggggaagtatctgttgataagtgcaggtgctctggcaacactgattctgacaatcttcttaataacagaccttttgggacagcggtg

SEQ ID NO: 439964 - DNA, 140 bp, Artificial Sequence
  Synthetic
caccgctgtcccaaaaggtctgttattaagaagattgtcagaatcagtgttgccagagcacctgcacttatcaacagatacttcccccagctagggagaccaaggtcaacccctgagattcatatcagcagccagggcct

SEQ ID NO: 439965 - DNA, 140 bp, Artificial Sequence
  Synthetic
atacgccatgctgggtctccccgtcaactaaatttgtagcctcattcccattatgcaatcaaatccagtctgacccaaagtcaacgtgaaaaaaacaggcaacaccactaatacaatgaacgtacttgggagtcggccat

SEQ ID NO: 439966 - DNA, 140 bp, Artificial Sequence
  Synthetic
atggccgactcccaagtacgttcattgtattagtggtgttgcctgtttttttcacgttgactttgggtcagactggatttgattgcataatgggaatgaggctacaaatttagttgacggggagacccagcatggcgtat

SEQ ID NO: 439967 - DNA, 140 bp, Artificial Sequence
  Synthetic
aggccctggctgctgatatgtacggctgttataggcattgggggcatccttatatagattatagaaagggtctgtcaaagctatatgatcaggttcatatcaagaaggtgatagataagtgaccttttgggacagcggtg

SEQ ID NO: 439968 - DNA, 140 bp, Artificial Sequence
  Synthetic
caccgctgtcccaaaaggtcacttatctatcaccttcttgatatgaacctgatcatatagctttgacagaccctttctataatctatataaggatgcccccaatgcctataacagccgtacatatcagcagccagggcct

SEQ ID NO: 439969 - DNA, 140 bp, Artificial Sequence
  Synthetic
atacgccatgctgggtctccaaccgaggggggcctgttcctagcgagaaggtcattatcacggccctgtctaagccacctgtcaatccccgagagtttttgaaatctatagacctcgtagcgtacttgggagtcggccat

SEQ ID NO: 439970 - DNA, 140 bp, Artificial Sequence
  Synthetic
atggccgactcccaagtacgctacgaggtctatagatttcaaaaactctcggggattgacaggtggcttagacagggccgtgataatgaccttctcgctaggaacaggcccccctcggttggagacccagcatggcgtat

SEQ ID NO: 439971 - DNA, 140 bp, Artificial Sequence
  Synthetic
aggccctggctgctgatatgctctagagtcagaaaacgttcatcaatcatctcaactgatcagacatagtcatatagatttcgataatgtatgatgtcttctgacggtatcttcgaccaagaccttttgggacagcggtg

SEQ ID NO: 439972 - DNA, 140 bp, Artificial Sequence
  Synthetic
caccgctgtcccaaaaggtcttggtcgaagataccgtcagaagacatcatacattatcgaaatctatatgactatgtctgatcagttgagatgattgatgaacgttttctgactctagagcatatcagcagccagggcct

SEQ ID NO: 439973 - DNA, 140 bp, Artificial Sequence
  Synthetic
atacgccatgctgggtctccccaccaaagagtctcttattatcatatctccaagtgtagcggatttggacccatacgacaaatcccttcattcaagagttttccctggtgggaagtgtttcgtacttgggagtcggccat

SEQ ID NO: 439974 - DNA, 140 bp, Artificial Sequence
  Synthetic
atggccgactcccaagtacgaaacacttcccaccagggaaaactcttgaatgaagggatttgtcgtatgggtccaaatccgctacacttggagatatgataataagagactctttggtggggagacccagcatggcgtat

SEQ ID NO: 439975 - DNA, 140 bp, Artificial Sequence
  Synthetic
aggccctggctgctgatatgttttcccaccgtagaccaaataggggttagctgagagaagcgacttgcctcctatgaaggacactagcaataggttacaatcatcttacatccagataatgaccttttgggacagcggtg

SEQ ID NO: 439976 - DNA, 140 bp, Artificial Sequence
  Synthetic
caccgctgtcccaaaaggtcattatctggatgtaagatgattgtaacctattgctagtgtccttcataggaggcaagtcgcttctctcagctaacccctatttggtctacggtgggaaaacatatcagcagccagggcct

SEQ ID NO: 439977 - DNA, 140 bp, Artificial Sequence
  Synthetic
atacgccatgctgggtctccaacagcagagggaagagagcatccaaggggggcaagacctgcggattcgtggacgaaaggggcttgtacaagtctctaaaaggagcatgtaaacttaagccgtacttgggagtcggccat

SEQ ID NO: 439978 - DNA, 140 bp, Artificial Sequence
  Synthetic
atggccgactcccaagtacggcttaagtttacatgctccttttagagacttgtacaagcccctttcgtccacgaatccgcaggtcttgccccccttggatgctctcttccctctgctgttggagacccagcatggcgtat

SEQ ID NO: 439979 - DNA, 140 bp, Artificial Sequence
  Synthetic
aggccctggctgctgatatgggtgcattaacatgaactctagagcatgtcaattgtggtctgatatgtcccttcaaactcatagatctgaagaggacaaagactcttcagtccttctagagaccttttgggacagcggtg

SEQ ID NO: 439980 - DNA, 140 bp, Artificial Sequence
  Synthetic
caccgctgtcccaaaaggtctctagaaggactgaagagtctttgtcctcttcagatctatgagtttgaagggacatatcagaccacaattgacatgctctagagttcatgttaatgcacccatatcagcagccagggcct

SEQ ID NO: 439981 - DNA, 140 bp, Artificial Sequence
  Synthetic
aggccctggctgctgatatgaaaactgaggaatggaggagtaattgacaacacttctcatcctgagaacaccaccatgatgattgatccaggggaagtttatgatgaccccattgatccggaccttttgggacagcggtg

SEQ ID NO: 439982 - DNA, 140 bp, Artificial Sequence
  Synthetic
caccgctgtcccaaaaggtccggatcaatggggtcatcataaacttcccctggatcaatcatcatggtggtgttctcaggatgagaagtgttgtcaattactcctccattcctcagttttcatatcagcagccagggcct

SEQ ID NO: 439983 - DNA, 140 bp, Artificial Sequence
  Synthetic
aggccctggctgctgatatggttatggtgccgttgaatcgctgcattttatcagagtcaaatcaattacaattgcactttaagcctcttggatgtgaaaaaaactattaacatccctcaagaccttttgggacagcggtg

SEQ ID NO: 439984 - DNA, 140 bp, Artificial Sequence
  Synthetic
caccgctgtcccaaaaggtcttgagggatgttaatagtttttttcacatccaagaggcttaaagtgcaattgtaattgatttgactctgataaaatgcagcgattcaacggcaccataaccatatcagcagccagggcct

SEQ ID NO: 439985 - DNA, 140 bp, Artificial Sequence
  Synthetic
aggccctggctgctgatatgaattaatgctggaatggctgagaacagggaataggcctctcaggatgactttgacggacaattgctctaggtcttataaagttttgaaagattacttcaagaccttttgggacagcggtg

SEQ ID NO: 439986 - DNA, 140 bp, Artificial Sequence
  Synthetic
caccgctgtcccaaaaggtcttgaagtaatctttcaaaactttataagacctagagcaattgtccgtcaaagtcatcctgagaggcctattccctgttctcagccattccagcattaattcatatcagcagccagggcct

SEQ ID NO: 439987 - DNA, 140 bp, Artificial Sequence
  Synthetic
atacgccatgctgggtctcccagttcctcacccttctgagatgttgggactgcttcccaaatcctccatttcttgcacttgtggagcaacggggggaggcaatcctagagtttctgtatccgtacttgggagtcggccat

SEQ ID NO: 439988 - DNA, 140 bp, Artificial Sequence
  Synthetic
atggccgactcccaagtacggatacagaaactctaggattgcctccccccgttgctccacaagtgcaagaaatggaggatttgggaagcagtcccaacatctcagaagggtgaggaactgggagacccagcatggcgtat

SEQ ID NO: 439989 - DNA, 140 bp, Artificial Sequence
  Synthetic
atacgccatgctgggtctccagctaggtccttggagtcctatcgacatacatcatctcagttgtcccaataatcttgttgtggaagacgaggggtgtaatagtctgtcggggttttcttacgtacttgggagtcggccat

SEQ ID NO: 439990 - DNA, 140 bp, Artificial Sequence
  Synthetic
atggccgactcccaagtacgtaagaaaaccccgacagactattacacccctcgtcttccacaacaagattattgggacaactgagatgatgtatgtcgataggactccaaggacctagctggagacccagcatggcgtat

SEQ ID NO: 439991 - DNA, 140 bp, Artificial Sequence
  Synthetic
atacgccatgctgggtctccaatcgtccctacttcaacaacatgtggagctgttggagtcctctgtaatccctctaatgcatcccttggcagacccatcaacagtctttaaggacggtgacgtacttgggagtcggccat

SEQ ID NO: 439992 - DNA, 140 bp, Artificial Sequence
  Synthetic
atggccgactcccaagtacgtcaccgtccttaaagactgttgatgggtctgccaagggatgcattagagggattacagaggactccaacagctccacatgttgttgaagtagggacgattggagacccagcatggcgtat

SEQ ID NO: 439993 - DNA, 140 bp, Artificial Sequence
  Synthetic
aggccctggctgctgatatgcggtatctagctaacatatactcctcttatttattctttcatgtgatcaccctttacatgaacgccctggactgggacgaggagaagaccatcctagcacgaccttttgggacagcggtg

SEQ ID NO: 439994 - DNA, 140 bp, Artificial Sequence
  Synthetic
caccgctgtcccaaaaggtcgtgctaggatggtcttctcctcgtcccagtccagggcgttcatgtaaagggtgatcacatgaaagaataaataagaggagtatatgttagctagataccgcatatcagcagccagggcct

SEQ ID NO: 439995 - DNA, 140 bp, Artificial Sequence
  Synthetic
atacgccatgctgggtctccaaggggagagctttctcctagccatgtcgcggataatctacctagatccttctttgggaggggtgtctggaatgtctctcgggaggttccatatacgtcacgtacttgggagtcggccat

SEQ ID NO: 439996 - DNA, 140 bp, Artificial Sequence
  Synthetic
atggccgactcccaagtacgtgacgtatatggaacctcccgagagacattccagacacccctcccaaagaaggatctaggtagattatccgcgacatggctaggagaaagctctccccttggagacccagcatggcgtat

SEQ ID NO: 439997 - DNA, 140 bp, Artificial Sequence
  Synthetic
atacgccatgctgggtctcccccgtatgacaaatcccttcattcaaggattttccctggggggaaatgcacgggtctaacagtctcttccacctactgctcgaccaaccatgactacacccgtacttgggagtcggccat

SEQ ID NO: 439998 - DNA, 140 bp, Artificial Sequence
  Synthetic
atggccgactcccaagtacgggtgtagtcatggttggtcgagcagtaggtggaagagactgttagacccgtgcatttccccccagggaaaatccttgaatgaagggatttgtcatacgggggagacccagcatggcgtat

SEQ ID NO: 439999 - DNA, 140 bp, Artificial Sequence
  Synthetic
aggccctggctgctgatatgtgggagttgtacaagagtggaggcgagaccaggctgtgagggcaggtcatcccctccataccttgcgttcagaaagttgactctctttgagacctgaggggaccttttgggacagcggtg

SEQ ID NO: 440000 - DNA, 140 bp, Artificial Sequence
  Synthetic
caccgctgtcccaaaaggtcccctcaggtctcaaagagagtcaactttctgaacgcaaggtatggaggggatgacctgccctcacagcctggtctcgcctccactcttgtacaactcccacatatcagcagccagggcct

SEQ ID NO: 440001 - DNA, 140 bp, Artificial Sequence
  Synthetic
aggccctggctgctgatatgcgctggagatcatgtcttatccatgtgcgggaactctggttatgaagtcatcaagatactggaaccatatgttgtaaatagcttagtccagagagccgaagaccttttgggacagcggtg

SEQ ID NO: 440002 - DNA, 140 bp, Artificial Sequence
  Synthetic
caccgctgtcccaaaaggtcttcggctctctggactaagctatttacaacatatggttccagtatcttgatgacttcataaccagagttcccgcacatggataagacatgatctccagcgcatatcagcagccagggcct

SEQ ID NO: 440003 - DNA, 140 bp, Artificial Sequence
  Synthetic
atacgccatgctgggtctcctggacgagagaggtttgtataagtccttgaaaggagcatgtaagctcaagctgtgcggggtttctgggcttagacttatggatggaacttgggttgcgatcgtacttgggagtcggccat

SEQ ID NO: 440004 - DNA, 140 bp, Artificial Sequence
  Synthetic
atggccgactcccaagtacgatcgcaacccaagttccatccataagtctaagcccagaaaccccgcacagcttgagcttacatgctcctttcaaggacttatacaaacctctctcgtccaggagacccagcatggcgtat

SEQ ID NO: 440005 - DNA, 140 bp, Artificial Sequence
  Synthetic
aggccctggctgctgatatgaaatttaggcctctcattcattccctgggagatttccctgcatttataagagataaggtgggtcaacttgaggggaccttcggtcctagtgcaaaaaggtgaccttttgggacagcggtg

SEQ ID NO: 440006 - DNA, 140 bp, Artificial Sequence
  Synthetic
caccgctgtcccaaaaggtcacctttttgcactaggaccgaaggtcccctcaagttgacccaccttatctcttataaatgcagggaaatctcccagggaatgaatgagaggcctaaatttcatatcagcagccagggcct

SEQ ID NO: 440007 - DNA, 140 bp, Artificial Sequence
  Synthetic
atacgccatgctgggtctccgttagaaagagggaggaatgtctggatgcattagaatccatcatgaccactaaatcagtaagcttcagacgtctaagccacttgagaaaactagttcctgcgtacttgggagtcggccat

SEQ ID NO: 440008 - DNA, 140 bp, Artificial Sequence
  Synthetic
atggccgactcccaagtacgcaggaactagttttctcaagtggcttagacgtctgaagcttactgatttagtggtcatgatggattctaatgcatccagacattcctccctctttctaacggagacccagcatggcgtat

SEQ ID NO: 440009 - DNA, 140 bp, Artificial Sequence
  Synthetic
aggccctggctgctgatatgtttatcgaagctatatgatcaagtccatatcaagaaggtgatagataagtcctatcaggagtgtctggcaagcgacctggccagaaggatcctccggtgggaccttttgggacagcggtg

SEQ ID NO: 440010 - DNA, 140 bp, Artificial Sequence
  Synthetic
caccgctgtcccaaaaggtcccaccggaggatccttctggccaggtcgcttgccagacactcctgataggacttatctatcaccttcttgatatggacttgatcatatagcttcgataaacatatcagcagccagggcct

SEQ ID NO: 440011 - DNA, 140 bp, Artificial Sequence
  Synthetic
atacgccatgctgggtctcccctatcaggagtgtctggcaagcgacctggccagaaggatcctccggtggggatttgataagtactccaaatggtatcttgagttgcgacttctttcaaacgtacttgggagtcggccat

SEQ ID NO: 440012 - DNA, 140 bp, Artificial Sequence
  Synthetic
atggccgactcccaagtacgtttgaaagaagtcgcaactcaagataccatttggagtacttatcaaatccccaccggaggatccttctggccaggtcgcttgccagacactcctgataggggagacccagcatggcgtat

SEQ ID NO: 440013 - DNA, 140 bp, Artificial Sequence
  Synthetic
atacgccatgctgggtctcctcaacggtatcattctaggtccggacgggcatgtgttgatcccagaaatgcagtcatcccttctccaacaacatgtggaactgttggagtcctctgtgatcgtacttgggagtcggccat

SEQ ID NO: 440014 - DNA, 140 bp, Artificial Sequence
  Synthetic
atggccgactcccaagtacgatcacagaggactccaacagttccacatgttgttggagaagggatgactgcatttctgggatcaacacatgcccgtccggacctagaatgataccgttgaggagacccagcatggcgtat

SEQ ID NO: 440015 - DNA, 140 bp, Artificial Sequence
  Synthetic
atacgccatgctgggtctccattaatgttagaatggttgaaaacaggaaataggcctctccgaatgactctgacagacaactgctctaggtcttacaaagttttgagagattacttcaagcgtacttgggagtcggccat

SEQ ID NO: 440016 - DNA, 140 bp, Artificial Sequence
  Synthetic
atggccgactcccaagtacgcttgaagtaatctctcaaaactttgtaagacctagagcagttgtctgtcagagtcattcggagaggcctatttcctgttttcaaccattctaacattaatggagacccagcatggcgtat

SEQ ID NO: 440017 - DNA, 140 bp, Artificial Sequence
  Synthetic
atacgccatgctgggtctccatctcaggggtggacctgggcctcccaagctggggaaagtatatgctgatgattgcaggtgctctaatgactctaatgttgttcatcttcttgatgacatcgtacttgggagtcggccat

SEQ ID NO: 440018 - DNA, 140 bp, Artificial Sequence
  Synthetic
atggccgactcccaagtacgatgtcatcaagaagatgaacaacattagagtcattagagcacctgcaatcatcagcatatactttccccagcttgggaggcccaggtccacccctgagatggagacccagcatggcgtat

SEQ ID NO: 440019 - DNA, 140 bp, Artificial Sequence
  Synthetic
aggccctggctgctgatatgtgcactgactatgacagacaatttgaacaaagtgtttaaaaagttgatcgacagggttactggacaggggcttttagactattcaagggtcacatatgctgaccttttgggacagcggtg

SEQ ID NO: 440020 - DNA, 140 bp, Artificial Sequence
  Synthetic
caccgctgtcccaaaaggtcagcatatgtgacccttgaatagtctaaaagcccctgtccagtaaccctgtcgatcaactttttaaacactttgttcaaattgtctgtcatagtcagtgcacatatcagcagccagggcct

SEQ ID NO: 440021 - DNA, 140 bp, Artificial Sequence
  Synthetic
aggccctggctgctgatatgtctccagaactcatgagttttttcagaagtcttggatctactattcagacaggtcagacctcatcgggctgtgggatgatcaaatatactgtttggacatgaccttttgggacagcggtg

SEQ ID NO: 440022 - DNA, 140 bp, Artificial Sequence
  Synthetic
caccgctgtcccaaaaggtcatgtccaaacagtatatttgatcatcccacagcccgatgaggtctgacctgtctgaatagtagatccaagacttctgaaaaaactcatgagttctggagacatatcagcagccagggcct

SEQ ID NO: 440023 - DNA, 140 bp, Artificial Sequence
  Synthetic
aggccctggctgctgatatggtcaaacggaccgacatgctggaacggccaagatggcggactggagggtctgcgacagaagggctggagtctggttagtctattaatgatagatcgtgaagaccttttgggacagcggtg

SEQ ID NO: 440024 - DNA, 140 bp, Artificial Sequence
  Synthetic
caccgctgtcccaaaaggtcttcacgatctatcattaatagactaaccagactccagcccttctgtcgcagaccctccagtccgccatcttggccgttccagcatgtcggtccgtttgaccatatcagcagccagggcct

SEQ ID NO: 440025 - DNA, 140 bp, Artificial Sequence
  Synthetic
atacgccatgctgggtctcccctatgaaggacacaagcaatagatcacaatcatctcacatcccaataagttgtgcataactaccaagggctgggccatctaatctcctcaatcaagaaacgtacttgggagtcggccat

SEQ ID NO: 440026 - DNA, 140 bp, Artificial Sequence
  Synthetic
atggccgactcccaagtacgtttcttgattgaggagattagatggcccagcccttggtagttatgcacaacttattgggatgtgagatgattgtgatctattgcttgtgtccttcataggggagacccagcatggcgtat

SEQ ID NO: 440027 - DNA, 140 bp, Artificial Sequence
  Synthetic
atacgccatgctgggtctcccaaaatattggagccatacgttgtgaacagcttggtccagagggcagaaaagtttaggcctctcattcattccctaggggatttccctgtgtttataagacgtacttgggagtcggccat

SEQ ID NO: 440028 - DNA, 140 bp, Artificial Sequence
  Synthetic
atggccgactcccaagtacgtcttataaacacagggaaatcccctagggaatgaatgagaggcctaaacttttctgccctctggaccaagctgttcacaacgtatggctccaatattttgggagacccagcatggcgtat

SEQ ID NO: 440029 - DNA, 140 bp, Artificial Sequence
  Synthetic
aggccctggctgctgatatgttctctatgaattggagagtatatcaagaaatgcgctttcaatataccgtgctattgaggagggggcatccaaactggggctcatcataaaaaaggaagagaccttttgggacagcggtg

SEQ ID NO: 440030 - DNA, 140 bp, Artificial Sequence
  Synthetic
caccgctgtcccaaaaggtctcttccttttttatgatgagccccagtttggatgccccctcctcaatagcacggtatattgaaagcgcatttcttgatatactctccaattcatagagaacatatcagcagccagggcct

SEQ ID NO: 440031 - DNA, 140 bp, Artificial Sequence
  Synthetic
atacgccatgctgggtctccgcaccatgatgattgatccaggggaggtttatgatgaccccattgatccagtcgagtcagagattgagccaagaggaaactccaatatccctaacatcttcgtacttgggagtcggccat

SEQ ID NO: 440032 - DNA, 140 bp, Artificial Sequence
  Synthetic
atggccgactcccaagtacgaagatgttagggatattggagtttcctcttggctcaatctctgactcgactggatcaatggggtcatcataaacctcccctggatcaatcatcatggtgcggagacccagcatggcgtat

SEQ ID NO: 440033 - DNA, 140 bp, Artificial Sequence
  Synthetic
aggccctggctgctgatatggttcagcccgatcctaaaaggcagagtttacaagattttaagtgctgaaggtgacaatttccttttagctatgtcaagaataatctatttagacccatccgaccttttgggacagcggtg

SEQ ID NO: 440034 - DNA, 140 bp, Artificial Sequence
  Synthetic
caccgctgtcccaaaaggtcggatgggtctaaatagattattcttgacatagctaaaaggaaattgtcaccttcagcacttaaaatcttgtaaactctgccttttaggatcgggctgaaccatatcagcagccagggcct

SEQ ID NO: 440035 - DNA, 140 bp, Artificial Sequence
  Synthetic
aggccctggctgctgatatgatctccaatgaccaaatagtcaaccttgccaatataatgtcaactgtgtccaccaatgcattgactgtcgcacaacactctcagtctttgattaagccgagaccttttgggacagcggtg

SEQ ID NO: 440036 - DNA, 140 bp, Artificial Sequence
  Synthetic
caccgctgtcccaaaaggtctcggcttaatcaaagactgagagtgttgtgcgacagtcaatgcattggtggacacagttgacattatattggcaaggttgactatttggtcattggagatcatatcagcagccagggcct

SEQ ID NO: 440037 - DNA, 140 bp, Artificial Sequence
  Synthetic
atacgccatgctgggtctccctgaccgacaattgttctcggtcttacaaagttctgaaagattatttcaagaaagtggatctaggatctctcaaagtgggcggagctgcagcacaatctacgtacttgggagtcggccat

SEQ ID NO: 440038 - DNA, 140 bp, Artificial Sequence
  Synthetic
atggccgactcccaagtacgtagattgtgctgcagctccgcccactttgagagatcctagatccactttcttgaaataatctttcagaactttgtaagaccgagaacaattgtcggtcagggagacccagcatggcgtat

SEQ ID NO: 440039 - DNA, 140 bp, Artificial Sequence
  Synthetic
aggccctggctgctgatatgtctcacctcctactccagagggttgagagaaacttgtctaagagtatgagagctactctgcgacaaatgagttccttaatgaggcaagtgctgggtgggcgaccttttgggacagcggtg

SEQ ID NO: 440040 - DNA, 140 bp, Artificial Sequence
  Synthetic
caccgctgtcccaaaaggtcgcccacccagcacttgcctcattaaggaactcatttgtcgcagagtagctctcatactcttagacaagtttctctcaaccctctggagtaggaggtgagacatatcagcagccagggcct

SEQ ID NO: 440041 - DNA, 140 bp, Artificial Sequence
  Synthetic
aggccctggctgctgatatgggacaattttcttctagctatgtccagaatcatctatttggatccctctctggggggagtttctggaatgtctctaggaaggttccacatacgtcagttcgaccttttgggacagcggtg

SEQ ID NO: 440042 - DNA, 140 bp, Artificial Sequence
  Synthetic
caccgctgtcccaaaaggtcgaactgacgtatgtggaaccttcctagagacattccagaaactccccccagagagggatccaaatagatgattctggacatagctagaagaaaattgtcccatatcagcagccagggcct

SEQ ID NO: 440043 - DNA, 140 bp, Artificial Sequence
  Synthetic
atacgccatgctgggtctccgaagctgttaaacttcacactcgggaacagagggttgagaatccccccagagggagtcttaagctgtcttgagagggtggattacgataaagcatttgggcgtacttgggagtcggccat

SEQ ID NO: 440044 - DNA, 140 bp, Artificial Sequence
  Synthetic
atggccgactcccaagtacgcccaaatgctttatcgtaatccaccctctcaagacagcttaagactccctctggggggattctcaaccctctgttcccgagtgtgaagtttaacagcttcggagacccagcatggcgtat

SEQ ID NO: 440045 - DNA, 140 bp, Artificial Sequence
  Synthetic
aggccctggctgctgatatgtcacactctttcactagaacaagactagcgtcatggctatcagagaacagaggaggaccggtccccagcgagaaggtcattattacggctctttccaaacgaccttttgggacagcggtg

SEQ ID NO: 440046 - DNA, 140 bp, Artificial Sequence
  Synthetic
caccgctgtcccaaaaggtcgtttggaaagagccgtaataatgaccttctcgctggggaccggtcctcctctgttctctgatagccatgacgctagtcttgttctagtgaaagagtgtgacatatcagcagccagggcct

SEQ ID NO: 440047 - DNA, 140 bp, Artificial Sequence
  Synthetic
aggccctggctgctgatatgaccacccttaatatcaaggggggagccagtcctaccattcttctcaaagatgcaattagaagagccctatatgatgaggtggacaaagtggagaactcaggaccttttgggacagcggtg

SEQ ID NO: 440048 - DNA, 140 bp, Artificial Sequence
  Synthetic
caccgctgtcccaaaaggtcctgagttctccactttgtccacctcatcatatagggctcttctaattgcatctttgagaagaatggtaggactggctccccccttgatattaagggtggtcatatcagcagccagggcct

SEQ ID NO: 440049 - DNA, 140 bp, Artificial Sequence
  Synthetic
atacgccatgctgggtctccgaacctagatattcagatgacttgatatctcagctgtgtcagctgtacatagcaggagatcaagtgttgtccatgtgcggaaactctggttatgaagtcacgtacttgggagtcggccat

SEQ ID NO: 440050 - DNA, 140 bp, Artificial Sequence
  Synthetic
atggccgactcccaagtacgtgacttcataaccagagtttccgcacatggacaacacttgatctcctgctatgtacagctgacacagctgagatatcaagtcatctgaatatctaggttcggagacccagcatggcgtat

SEQ ID NO: 440051 - DNA, 140 bp, Artificial Sequence
  Synthetic
aggccctggctgctgatatgaggtgaatgatctgatggcttccggaacacatccactgcctccttcagcaatcatgagtggaggagatgacatcatctccagagtgatagactttgactcgaccttttgggacagcggtg

SEQ ID NO: 440052 - DNA, 140 bp, Artificial Sequence
  Synthetic
caccgctgtcccaaaaggtcgagtcaaagtctatcactctggagatgatgtcatctcctccactcatgattgctgaaggaggcagtggatgtgttccggaagccatcagatcattcacctcatatcagcagccagggcct

SEQ ID NO: 440053 - DNA, 140 bp, Artificial Sequence
  Synthetic
aggccctggctgctgatatgttagaagagtccttttataactccgagatccatgggatcaaccggatgatccagactccccaaagggtcggaagggtttggccctgttcctctgagaggggaccttttgggacagcggtg

SEQ ID NO: 440054 - DNA, 140 bp, Artificial Sequence
  Synthetic
caccgctgtcccaaaaggtcccctctcagaggaacagggccaaacccttccgaccctttggggagtctggatcatccggttgatcccatggatctcggagttataaaaggactcttctaacatatcagcagccagggcct

SEQ ID NO: 440055 - DNA, 140 bp, Artificial Sequence
  Synthetic
atacgccatgctgggtctccgatccgacctcatcgggttgtgggaggatcaaatatactgtttggacatgtcaaacggcccgacatgctggaacggccaagatggcgggctagagggtttcgtacttgggagtcggccat

SEQ ID NO: 440056 - DNA, 140 bp, Artificial Sequence
  Synthetic
atggccgactcccaagtacgaaaccctctagcccgccatcttggccgttccagcatgtcgggccgtttgacatgtccaaacagtatatttgatcctcccacaacccgatgaggtcggatcggagacccagcatggcgtat

SEQ ID NO: 440057 - DNA, 140 bp, Artificial Sequence
  Synthetic
aggccctggctgctgatatgctgcacttgtggagtaacaggagagggaaatccccggatatcagtgtctgtgcttccatcttttgatcagtcattcttctcgagaggtcctttgaagggagaccttttgggacagcggtg

SEQ ID NO: 440058 - DNA, 140 bp, Artificial Sequence
  Synthetic
caccgctgtcccaaaaggtctcccttcaaaggacctctcgagaagaatgactgatcaaaagatggaagcacagacactgatatccggggatttccctctcctgttactccacaagtgcagcatatcagcagccagggcct

SEQ ID NO: 440059 - DNA, 140 bp, Artificial Sequence
  Synthetic
atacgccatgctgggtctcccctatcaggagtgtttagcgagtgacctggccaaaagaatcctcaggtgggggttcgacaaatactccaaatggtatctagatccacgacttcttgcgagcgtacttgggagtcggccat

SEQ ID NO: 440060 - DNA, 140 bp, Artificial Sequence
  Synthetic
atggccgactcccaagtacgctcgcaagaagtcgtggatctagataccatttggagtatttgtcgaacccccacctgaggattcttttggccaggtcactcgctaaacactcctgataggggagacccagcatggcgtat

SEQ ID NO: 440061 - DNA, 140 bp, Artificial Sequence
  Synthetic
aggccctggctgctgatatggggttcgacaaatactccaaatggtatctagatccacgacttcttgcgagggatcaccccctgactccttatatcaagacccagacatggcctcctaagcgaccttttgggacagcggtg

SEQ ID NO: 440062 - DNA, 140 bp, Artificial Sequence
  Synthetic
caccgctgtcccaaaaggtcgcttaggaggccatgtctgggtcttgatataaggagtcagggggtgatccctcgcaagaagtcgtggatctagataccatttggagtatttgtcgaaccccatatcagcagccagggcct

SEQ ID NO: 440063 - DNA, 140 bp, Artificial Sequence
  Synthetic
aggccctggctgctgatatggtccccaggtactagactgagtaagagtggattgagaaaggagactttcattatatgaagaacataagcaatagatcaccatcatcttgcatctcagcaagaccttttgggacagcggtg

SEQ ID NO: 440064 - DNA, 140 bp, Artificial Sequence
  Synthetic
caccgctgtcccaaaaggtcttgctgagatgcaagatgatggtgatctattgcttatgttcttcatataatgaaagtctcctttctcaatccactcttactcagtctagtacctggggaccatatcagcagccagggcct

SEQ ID NO: 440065 - DNA, 140 bp, Artificial Sequence
  Synthetic
aggccctggctgctgatatgtgtcttcaagaggacagggtctgctctgcataggttcaagtcagccaggtacagtgaagggggttactcttctgtctgtccaaatctcctctctcacatcgaccttttgggacagcggtg

SEQ ID NO: 440066 - DNA, 140 bp, Artificial Sequence
  Synthetic
caccgctgtcccaaaaggtcgatgtgagagaggagatttggacagacagaagagtaacccccttcactgtacctggctgacttgaacctatgcagagcagaccctgtcctcttgaagacacatatcagcagccagggcct

SEQ ID NO: 440067 - DNA, 140 bp, Artificial Sequence
  Synthetic
atacgccatgctgggtctcctttccaacgaccaaatagtcaatcttgccaatataatgtcaacggtatccacaaatgcattgactgtagcacaacactctcagtctttgattaaaccgatcgtacttgggagtcggccat

SEQ ID NO: 440068 - DNA, 140 bp, Artificial Sequence
  Synthetic
atggccgactcccaagtacgatcggtttaatcaaagactgagagtgttgtgctacagtcaatgcatttgtggataccgttgacattatattggcaagattgactatttggtcgttggaaaggagacccagcatggcgtat

SEQ ID NO: 440069 - DNA, 140 bp, Artificial Sequence
  Synthetic
aggccctggctgctgatatgaactggtgcaaaaggacactcggctgaaggactccacctttcattggcatcttcgatgtaacaagtgtataaggcccattgacgatattaccctcgagacgaccttttgggacagcggtg

SEQ ID NO: 440070 - DNA, 140 bp, Artificial Sequence
  Synthetic
caccgctgtcccaaaaggtcgtctcgagggtaatatcgtcaatgggccttatacacttgttacatcgaagatgccaatgaaaggtggagtccttcagccgagtgtccttttgcaccagttcatatcagcagccagggcct

SEQ ID NO: 440071 - DNA, 140 bp, Artificial Sequence
  Synthetic
atacgccatgctgggtctccgacaattttcttctagctatgtctagaatcatctatttagacccctcattggggggagtatctggaatgtctcttggaaggttccacatacgtcagttctcgtacttgggagtcggccat

SEQ ID NO: 440072 - DNA, 140 bp, Artificial Sequence
  Synthetic
atggccgactcccaagtacgagaactgacgtatgtggaaccttccaagagacattccagatactccccccaatgaggggtctaaatagatgattctagacatagctagaagaaaattgtcggagacccagcatggcgtat

SEQ ID NO: 440073 - DNA, 140 bp, Artificial Sequence
  Synthetic
aggccctggctgctgatatgttcgttattacagagaagctcctggccaattatatattaccactctttgatgcattgaccatgaccgacaatctgaacaaggtgttcaaaaagttgattggaccttttgggacagcggtg

SEQ ID NO: 440074 - DNA, 140 bp, Artificial Sequence
  Synthetic
caccgctgtcccaaaaggtccaatcaactttttgaacaccttgttcagattgtcggtcatggtcaatgcatcaaagagtggtaatatataattggccaggagcttctctgtaataacgaacatatcagcagccagggcct

SEQ ID NO: 440075 - DNA, 140 bp, Artificial Sequence
  Synthetic
atacgccatgctgggtctcctgaggatgtattctccgtccttgatcaagtatttggattaaaaagggtgttctccagaactcatgagttcttccagaagtcttggatatattactcagatcgtacttgggagtcggccat

SEQ ID NO: 440076 - DNA, 140 bp, Artificial Sequence
  Synthetic
atggccgactcccaagtacgatctgagtaatatatccaagacttctggaagaactcatgagttctggagaacaccctttttaatccaaatacttgatcaaggacggagaatacatcctcaggagacccagcatggcgtat

SEQ ID NO: 440077 - DNA, 140 bp, Artificial Sequence
  Synthetic
atacgccatgctgggtctccggatatccgatctagatcatccctactagattacagtcgtttgtaagccggatattaccgaaagcctgtgcatgctaaaattcttgtatgatgcatcttgcgtacttgggagtcggccat

SEQ ID NO: 440078 - DNA, 140 bp, Artificial Sequence
  Synthetic
atggccgactcccaagtacgcaagatgcatcatacaagaattttagcatgcacaggctttcggtaatatccggcttacaaacgactgtaatctagtagggatgatctagatcggatatccggagacccagcatggcgtat

SEQ ID NO: 440079 - DNA, 140 bp, Artificial Sequence
  Synthetic
aggccctggctgctgatatggatattaccgaaagcctgtgcatgctaaaattcttgtatgatgcatcttgaaaaaaacaagatcttgaatccggacctctggttgtttgattgttttttcgaccttttgggacagcggtg

SEQ ID NO: 440080 - DNA, 140 bp, Artificial Sequence
  Synthetic
caccgctgtcccaaaaggtcgaaaaaacaatcaaacaaccagaggtccggattcaagatcttgtttttttcaagatgcatcatacaagaattttagcatgcacaggctttcggtaatatccatatcagcagccagggcct

SEQ ID NO: 440081 - DNA, 140 bp, Artificial Sequence
  Synthetic
atacgccatgctgggtctcctacgacagaagggctggagtctggtcagcctactgatgatagatcgagagtctcagaccaggaacacaagaactaagatactagcccagggagacaaccacgtacttgggagtcggccat

SEQ ID NO: 440082 - DNA, 140 bp, Artificial Sequence
  Synthetic
atggccgactcccaagtacgtggttgtctccctgggctagtatcttagttcttgtgttcctggtctgagactctcgatctatcatcagtaggctgaccagactccagcccttctgtcgtaggagacccagcatggcgtat

SEQ ID NO: 440083 - DNA, 140 bp, Artificial Sequence
  Synthetic
aggccctggctgctgatatgaaaaactgtagaactgaggaacaactagcaacacatctcatctcgagactttcgccatgatgattgatccaggagatgtttatgatgacccggttgatccgaccttttgggacagcggtg

SEQ ID NO: 440084 - DNA, 140 bp, Artificial Sequence
  Synthetic
caccgctgtcccaaaaggtcggatcaaccgggtcatcataaacatctcctggatcaatcatcatggcgaaagtctcgagatgagatgtgttgctagttgttcctcagttctacagtttttcatatcagcagccagggcct

SEQ ID NO: 440085 - DNA, 140 bp, Artificial Sequence
  Synthetic
atacgccatgctgggtctccgccattgaggaaggagcatctaaactggggctcattataaagaaggaggaaacaatgtgtagctatgactttctcatttatggaaaaactcccttatttccgtacttgggagtcggccat

SEQ ID NO: 440086 - DNA, 140 bp, Artificial Sequence
  Synthetic
atggccgactcccaagtacggaaataagggagtttttccataaatgagaaagtcatagctacacattgtttcctccttctttataatgagccccagtttagatgctccttcctcaatggcggagacccagcatggcgtat

SEQ ID NO: 440087 - DNA, 140 bp, Artificial Sequence
  Synthetic
aggccctggctgctgatatgtccctcacccctctgagatgttggggctacttccaaagtcctcgatctcatgcacttgtggagtagcaggagggggaaatcctcgaatatcagtgtctgtgaccttttgggacagcggtg

SEQ ID NO: 440088 - DNA, 140 bp, Artificial Sequence
  Synthetic
caccgctgtcccaaaaggtcacagacactgatattcgaggatttccccctcctgctactccacaagtgcatgagatcgaggactttggaagtagccccaacatctcagaggggtgagggacatatcagcagccagggcct

SEQ ID NO: 440089 - DNA, 140 bp, Artificial Sequence
  Synthetic
aggccctggctgctgatatgtgaggataccttggagtcagacgaagacattcagaggctgttaaaagactctttgcacaggactaggtgggtggatcaagaagtgcgccatgcagcaagagaccttttgggacagcggtg

SEQ ID NO: 440090 - DNA, 140 bp, Artificial Sequence
  Synthetic
caccgctgtcccaaaaggtctcttgctgcatggcgcacttcttgatccacccacctagtcctgtgcaaagagtcttttaacagcctctgaatgtcttcgtctgactccaaggtatcctcacatatcagcagccagggcct

SEQ ID NO: 440091 - DNA, 140 bp, Artificial Sequence
  Synthetic
aggccctggctgctgatatgacctgggctcatccacttccatgtcgacccagctattccacgcctgggagaaagtcactaatgttcatgtggtgaaaagagccctgtcactcaaggaatcgaccttttgggacagcggtg

SEQ ID NO: 440092 - DNA, 140 bp, Artificial Sequence
  Synthetic
caccgctgtcccaaaaggtcgattccttgagtgacagggctcttttcaccacatgaacattagtgactttctcccaggcgtggaatagctgggtcgacatggaagtggatgagcccaggtcatatcagcagccagggcct

SEQ ID NO: 440093 - DNA, 140 bp, Artificial Sequence
  Synthetic
atacgccatgctgggtctcctgagggactttctgcttatgtcagtgcaagccgtttttcattacttgctgtttagccccattttaaaaggcagagtttataaaatactgagtgctgatggcgtacttgggagtcggccat

SEQ ID NO: 440094 - DNA, 140 bp, Artificial Sequence
  Synthetic
atggccgactcccaagtacgccatcagcactcagtattttataaactctgccttttaaaatggggctaaacagcaagtaatgaaaaacggcttgcactgacataagcagaaagtccctcaggagacccagcatggcgtat

SEQ ID NO: 440095 - DNA, 140 bp, Artificial Sequence
  Synthetic
aggccctggctgctgatatgcttcaaaaccccttgatctcgggcctgagagtagttcagtgggcaacaggggcccattataagctcaagcccattctggatgatctcaatgtatttccatgaccttttgggacagcggtg

SEQ ID NO: 440096 - DNA, 140 bp, Artificial Sequence
  Synthetic
caccgctgtcccaaaaggtcatggaaatacattgagatcatccagaatgggcttgagcttataatgggcccctgttgcccactgaactactctcaggcccgagatcaaggggttttgaagcatatcagcagccagggcct

SEQ ID NO: 440097 - DNA, 140 bp, Artificial Sequence
  Synthetic
atacgccatgctgggtctcctcagaccctgtctctgaggggctatctttttggagagagatttggttaagttcaaatgagtcttggatccatgcactttgtcaagaagcaggaaatccggcgtacttgggagtcggccat

SEQ ID NO: 440098 - DNA, 140 bp, Artificial Sequence
  Synthetic
atggccgactcccaagtacgccggatttcctgcttcttgacaaagtgcatggatccaagactcatttgaacttaaccaaatctctctccaaaaagatagcccctcagagacagggtctgaggagacccagcatggcgtat

SEQ ID NO: 440099 - DNA, 140 bp, Artificial Sequence
  Synthetic
atacgccatgctgggtctccctgtcagcacagacacgatgtcagacttgactcatgatgggagaaactatgactttatgtttcaaccgttgatgctttatgcgcaaacatggacatcagacgtacttgggagtcggccat

SEQ ID NO: 440100 - DNA, 140 bp, Artificial Sequence
  Synthetic
atggccgactcccaagtacgtctgatgtccatgtttgcgcataaagcatcaacggttgaaacataaagtcatagtttctcccatcatgagtcaagtctgacatcgtgtctgtgctgacagggagacccagcatggcgtat

SEQ ID NO: 440101 - DNA, 140 bp, Artificial Sequence
  Synthetic
aggccctggctgctgatatgaaacgacctgatggcgtcaggaacacatccattgcctccctctgcaatcatgagtggaggagaggacatcatctctagggtaattgattttgactccattgaccttttgggacagcggtg

SEQ ID NO: 440102 - DNA, 140 bp, Artificial Sequence
  Synthetic
caccgctgtcccaaaaggtcaatggagtcaaaatcaattaccctagagatgatgtcctctcctccactcatgattgcagagggaggcaatggatgtgttcctgacgccatcaggtcgtttcatatcagcagccagggcct

SEQ ID NO: 440103 - DNA, 140 bp, Artificial Sequence
  Synthetic
atacgccatgctgggtctccttcgatgtaacaagtgcataaggcccattgatgatattacccttgagacttctcaggtcttcgagttcccggatgtttcaagaagaatatctagaatggtcgtacttgggagtcggccat

SEQ ID NO: 440104 - DNA, 140 bp, Artificial Sequence
  Synthetic
atggccgactcccaagtacgaccattctagatattcttcttgaaacatccgggaactcgaagacctgagaagtctcaagggtaatatcatcaatgggccttatgcacttgttacatcgaaggagacccagcatggcgtat

SEQ ID NO: 440105 - DNA, 140 bp, Artificial Sequence
  Synthetic
aggccctggctgctgatatgcagaggtcactgatattgcatcaatcaaccgaataaccctcctaatgtctgatttcgcattgtccatagatggtccactttacctggttttcaaaacttagaccttttgggacagcggtg

SEQ ID NO: 440106 - DNA, 140 bp, Artificial Sequence
  Synthetic
caccgctgtcccaaaaggtctaagttttgaaaaccaggtaaagtggaccatctatggacaatgcgaaatcagacattaggagggttattcggttgattgatgcaatatcagtgacctctgcatatcagcagccagggcct

SEQ ID NO: 440107 - DNA, 140 bp, Artificial Sequence
  Synthetic
atacgccatgctgggtctcccagatctcctaagagaaatctcgtgggggagaaaggtggttggcacaaccgtccctcacccctctgagatgttggggttgcttcccaaatcttcaatctccgtacttgggagtcggccat

SEQ ID NO: 440108 - DNA, 140 bp, Artificial Sequence
  Synthetic
atggccgactcccaagtacggagattgaagatttgggaagcaaccccaacatctcagaggggtgagggacggttgtgccaaccacctttctcccccacgagatttctcttaggagatctgggagacccagcatggcgtat

SEQ ID NO: 440109 - DNA, 140 bp, Artificial Sequence
  Synthetic
atacgccatgctgggtctcctacctgggctcatctacatccatgtcaacccaactgttccatgcttgggagaaggtcaccaatgttcatgtggtgaaaagggccctttcactcaaagagtcgtacttgggagtcggccat

SEQ ID NO: 440110 - DNA, 140 bp, Artificial Sequence
  Synthetic
atggccgactcccaagtacgactctttgagtgaaagggcccttttcaccacatgaacattggtgaccttctcccaagcatggaacagttgggttgacatggatgtagatgagcccaggtaggagacccagcatggcgtat

SEQ ID NO: 440111 - DNA, 140 bp, Artificial Sequence
  Synthetic
aggccctggctgctgatatgaaatcctgagacatttcaacatatgttgcagcaccatgatgtacttgtccactgccttaggggatgtgcccagctttgcgagacttcatgacctgtacaagaccttttgggacagcggtg

SEQ ID NO: 440112 - DNA, 140 bp, Artificial Sequence
  Synthetic
caccgctgtcccaaaaggtcttgtacaggtcatgaagtctcgcaaagctgggcacatcccctaaggcagtggacaagtacatcatggtgctgcaacatatgttgaaatgtctcaggatttcatatcagcagccagggcct

SEQ ID NO: 440113 - DNA, 140 bp, Artificial Sequence
  Synthetic
atacgccatgctgggtctccgaggacaccttagagtcagacgaagacattcagaggctgttaaaagactctttgcgcaggacaaggtgggtagatcaggaagtacgccatgcagcgagaacgtacttgggagtcggccat

SEQ ID NO: 440114 - DNA, 140 bp, Artificial Sequence
  Synthetic
atggccgactcccaagtacgttctcgctgcatggcgtacttcctgatctacccaccttgtcctgcgcaaagagtcttttaacagcctctgaatgtcttcgtctgactctaaggtgtcctcggagacccagcatggcgtat

SEQ ID NO: 440115 - DNA, 140 bp, Artificial Sequence
  Synthetic
aggccctggctgctgatatgtttgcgcaggacaaggtgggtagatcaggaagtacgccatgcagcgagaaccatgacaggaggttacagccccaacaagagaatgtcacgcaaggcaggggaccttttgggacagcggtg

SEQ ID NO: 440116 - DNA, 140 bp, Artificial Sequence
  Synthetic
caccgctgtcccaaaaggtcccctgccttgcgtgacattctcttgttggggctgtaacctcctgtcatggttctcgctgcatggcgtacttcctgatctacccaccttgtcctgcgcaaacatatcagcagccagggcct

SEQ ID NO: 440117 - DNA, 140 bp, Artificial Sequence
  Synthetic
aggccctggctgctgatatgatctgtcctggagttggtctgatgacgcctcagtgttcaagagggtggcatgcaactctagcttaagtctctcatctcactggatcaggctgatctacaagaccttttgggacagcggtg

SEQ ID NO: 440118 - DNA, 140 bp, Artificial Sequence
  Synthetic
caccgctgtcccaaaaggtcttgtagatcagcctgatccagtgagatgagagacttaagctagagttgcatgccaccctcttgaacactgaggcgtcatcagaccaactccaggacagatcatatcagcagccagggcct

SEQ ID NO: 440119 - DNA, 140 bp, Artificial Sequence
  Synthetic
atacgccatgctgggtctccaactggtgcaaaaggacatacggctgagagactccacctttcactggcatcttcgatgcaataagtgtataaggtccatcgatgacatcactctagagaccgtacttgggagtcggccat

SEQ ID NO: 440120 - DNA, 140 bp, Artificial Sequence
  Synthetic
atggccgactcccaagtacggtctctagagtgatgtcatcgatggaccttatacacttattgcatcgaagatgccagtgaaaggtggagtctctcagccgtatgtccttttgcaccagttggagacccagcatggcgtat

SEQ ID NO: 440121 - DNA, 140 bp, Artificial Sequence
  Synthetic
atacgccatgctgggtctcctaacccagcccctgcctccgagctggacatcagggccctctctagaaggcttcaaaacccgttgatctcgggcctgagagtggttcagtgggcgacagggcgtacttgggagtcggccat

SEQ ID NO: 440122 - DNA, 140 bp, Artificial Sequence
  Synthetic
atggccgactcccaagtacgccctgtcgcccactgaaccactctcaggcccgagatcaacgggttttgaagccttctagagagggccctgatgtccagctcggaggcaggggctgggttaggagacccagcatggcgtat

SEQ ID NO: 440123 - DNA, 140 bp, Artificial Sequence
  Synthetic
aggccctggctgctgatatgttcaaaacccgttgatctcgggcctgagagtggttcagtgggcgacaggggcccattataaactcaaacctattctggatggtctcaatgtattcccgtcgaccttttgggacagcggtg

SEQ ID NO: 440124 - DNA, 140 bp, Artificial Sequence
  Synthetic
caccgctgtcccaaaaggtcgacgggaatacattgagaccatccagaataggtttgagtttataatgggcccctgtcgcccactgaaccactctcaggcccgagatcaacgggttttgaacatatcagcagccagggcct

SEQ ID NO: 440125 - DNA, 140 bp, Artificial Sequence
  Synthetic
aggccctggctgctgatatgattaggtccagatcgtctctcttagattatagctgcctgtaacctaaatgctctcgaaggaatgtacagactccgactcttagacaatgcaccctgaaaagaccttttgggacagcggtg

SEQ ID NO: 440126 - DNA, 140 bp, Artificial Sequence
  Synthetic
caccgctgtcccaaaaggtcttttcagggtgcattgtctaagagtcggagtctgtacattccttcgagagcatttaggttacaggcagctataatctaagagagacgatctggacctaatcatatcagcagccagggcct

SEQ ID NO: 440127 - DNA, 140 bp, Artificial Sequence
  Synthetic
atacgccatgctgggtctcccctggagactttgagtctctaagtgacaaagagaagtcacgccacatagggtcggctcaggggctcttgtattcgatcctggttgcgattcacgactctgcgtacttgggagtcggccat

SEQ ID NO: 440128 - DNA, 140 bp, Artificial Sequence
  Synthetic
atggccgactcccaagtacgcagagtcgtgaatcgcaaccaggatcgaatacaagagcccctgagccgaccctatgtggcgtgacttctctttgtcacttagagactcaaagtctccaggggagacccagcatggcgtat

SEQ ID NO: 440129 - DNA, 140 bp, Artificial Sequence
  Synthetic
atacgccatgctgggtctccttaacatgtttccggatgccaggcttgtattcaatagcttgttagaagtaaatgacctgatggcgtcaggaacacatccgttgcccccctcagcaatcatcgtacttgggagtcggccat

SEQ ID NO: 440130 - DNA, 140 bp, Artificial Sequence
  Synthetic
atggccgactcccaagtacgatgattgctgaggggggcaacggatgtgttcctgacgccatcaggtcatttacttctaacaagctattgaatacaagcctggcatccggaaacatgttaaggagacccagcatggcgtat

SEQ ID NO: 440131 - DNA, 140 bp, Artificial Sequence
  Synthetic
atacgccatgctgggtctcctatctgctttctgacaagaatgacaaacatcaacatcaacagacctcttgaactaatctcaggagtgatctcatacatcctccttagattagacaatcaccgtacttgggagtcggccat

SEQ ID NO: 440132 - DNA, 140 bp, Artificial Sequence
  Synthetic
atggccgactcccaagtacggtgattgtctaatctaaggaggatgtatgagatcactcctgagattagttcaagaggtctgttgatgttgatgtttgtcattcttgtcagaaagcagataggagacccagcatggcgtat

SEQ ID NO: 440133 - DNA, 140 bp, Artificial Sequence
  Synthetic
atacgccatgctgggtctccgaaaaggccctgatttaaacaaagcatacaagtcaatcttatccggcatgaatgcagccaaacttgaccctgatgatgtatgctcttatctggcagctgccgtacttgggagtcggccat

SEQ ID NO: 440134 - DNA, 140 bp, Artificial Sequence
  Synthetic
atggccgactcccaagtacggcagctgccagataagagcatacatcatcagggtcaagtttggctgcattcatgccggataagattgacttgtatgctttgtttaaatcagggccttttcggagacccagcatggcgtat

SEQ ID NO: 440135 - DNA, 140 bp, Artificial Sequence
  Synthetic
atacgccatgctgggtctccataaaacgtactcatgtggaagggaattgggctctgacagggggtatggagttgacaagggaccccactgttgcagaacatgcatctctggtcggtcttccgtacttgggagtcggccat

SEQ ID NO: 440136 - DNA, 140 bp, Artificial Sequence
  Synthetic
atggccgactcccaagtacggaagaccgaccagagatgcatgttctgcaacagtggggtcccttgtcaactccataccccctgtcagagcccaattcccttccacatgagtacgttttatggagacccagcatggcgtat

SEQ ID NO: 440137 - DNA, 140 bp, Artificial Sequence
  Synthetic
atacgccatgctgggtctccaacttacgacagatgagctctctcatgagacaggtattgggcgggcatggcgaagacaccttagaatcagatgaggacattcagaggttgttgaaagactcgtacttgggagtcggccat

SEQ ID NO: 440138 - DNA, 140 bp, Artificial Sequence
  Synthetic
atggccgactcccaagtacgagtctttcaacaacctctgaatgtcctcatctgattctaaggtgtcttcgccatgcccgcccaatacctgtctcatgagagagctcatctgtcgtaagttggagacccagcatggcgtat

SEQ ID NO: 440139 - DNA, 140 bp, Artificial Sequence
  Synthetic
atacgccatgctgggtctccttttgtaaagattgtagaacatcatactctgatgacaacccacaaaatgtgcgctaactggagtaccataccaaactttagatttctagccggaacctaccgtacttgggagtcggccat

SEQ ID NO: 440140 - DNA, 140 bp, Artificial Sequence
  Synthetic
atggccgactcccaagtacggtaggttccggctagaaatctaaagtttggtatggtactccagttagcgcacattttgtgggttgtcatcagagtatgatgttctacaatctttacaaaaggagacccagcatggcgtat

SEQ ID NO: 440141 - DNA, 140 bp, Artificial Sequence
  Synthetic
atacgccatgctgggtctccatgttcagaatgggtctgctctgctcaacaggttgctgtttcaacctcagcaaatccagcccctgtctctgagctggacatcagggctctctccaaaagacgtacttgggagtcggccat

SEQ ID NO: 440142 - DNA, 140 bp, Artificial Sequence
  Synthetic
atggccgactcccaagtacgtcttttggagagagccctgatgtccagctcagagacaggggctggatttgctgaggttgaaacagcaacctgttgagcagagcagacccattctgaacatggagacccagcatggcgtat

SEQ ID NO: 440143 - DNA, 140 bp, Artificial Sequence
  Synthetic
atacgccatgctgggtctccggtttattaaacaaataaatctcactgcaagagaagcaatactatatttcttccacaagaatttcgaagaggagataagaaggatgtttgagccggggcacgtacttgggagtcggccat

SEQ ID NO: 440144 - DNA, 140 bp, Artificial Sequence
  Synthetic
atggccgactcccaagtacgtgccccggctcaaacatccttcttatctcctcttcgaaattcttgtggaagaaatatagtattgcttctcttgcagtgagatttatttgtttaataaaccggagacccagcatggcgtat

SEQ ID NO: 440145 - DNA, 140 bp, Artificial Sequence
  Synthetic
atacgccatgctgggtctccccttatgtcttgtggtcggagacggatcaggggggatttcaagggctgtactcaatatgtttccggatgctaggctcgtgttcaacagcctgttggaagtcgtacttgggagtcggccat

SEQ ID NO: 440146 - DNA, 140 bp, Artificial Sequence
  Synthetic
atggccgactcccaagtacgacttccaacaggctgttgaacacgagcctagcatccggaaacatattgagtacagcccttgaaatcccccctgatccgtctccgaccacaagacataaggggagacccagcatggcgtat

SEQ ID NO: 440147 - DNA, 140 bp, Artificial Sequence
  Synthetic
atacgccatgctgggtctccgcaactctagcttgagtctctcatctcactggatcaggctgatctacaaaatagtgaagaccaccagacttgtcggaaggatagaagacctgtctggggacgtacttgggagtcggccat

SEQ ID NO: 440148 - DNA, 140 bp, Artificial Sequence
  Synthetic
atggccgactcccaagtacgtccccagacaggtcttctatccttccgacaagtctggtggtcttcactattttgtagatcagcctgatccagtgagatgagagactcaagctagagttgcggagacccagcatggcgtat

SEQ ID NO: 440149 - DNA, 140 bp, Artificial Sequence
  Synthetic
atacgccatgctgggtctcctgggaaaagccttctgacttaaggaatttgacgacatggaggtacttccagtcagttcaagaacgagtgaatatgtcctatgatcttattatttgtgacgcgtacttgggagtcggccat

SEQ ID NO: 440150 - DNA, 140 bp, Artificial Sequence
  Synthetic
atggccgactcccaagtacgcgtcacaaataataagatcataggacatattcactcgttcttgaactgactggaagtacctccatgtcgtcaaattccttaagtcagaaggcttttcccaggagacccagcatggcgtat

SEQ ID NO: 440151 - DNA, 140 bp, Artificial Sequence
  Synthetic
atacgccatgctgggtctccttagatccagatcatctcttttagattatagctgcttgtaaactaggcattctcgagggaatatacagactaagactctttgacggtgcaacctgaaaaacgtacttgggagtcggccat

SEQ ID NO: 440152 - DNA, 140 bp, Artificial Sequence
  Synthetic
atggccgactcccaagtacgtttttcaggttgcaccgtcaaagagtcttagtctgtatattccctcgagaatgcctagtttacaagcagctataatctaaaagagatgatctggatctaaggagacccagcatggcgtat

SEQ ID NO: 440153 - DNA, 140 bp, Artificial Sequence
  Synthetic
atacgccatgctgggtctcctggaaccatgctcgtgaatcctgattacagagccgttcaacatctgtccagagcatttcccacagtcacaggattcataacccagatgacatcatccttccgtacttgggagtcggccat

SEQ ID NO: 440154 - DNA, 140 bp, Artificial Sequence
  Synthetic
atggccgactcccaagtacggaaggatgatgtcatctgggttatgaatcctgtgactgtgggaaatgctctggacagatgttgaacggctctgtaatcaggattcacgagcatggttccaggagacccagcatggcgtat

SEQ ID NO: 440155 - DNA, 140 bp, Artificial Sequence
  Synthetic
atacgccatgctgggtctcctcaactgcagcagcccaaaaagtgagatgcagagggcccgctctctgaattaccaggaccttgtaagaggatttcctgaggagatcatatccaacccatacgtacttgggagtcggccat

SEQ ID NO: 440156 - DNA, 140 bp, Artificial Sequence
  Synthetic
atggccgactcccaagtacgtatgggttggatatgatctcctcaggaaatcctcttacaaggtcctggtaattcagagagcgggccctctgcatctcactttttgggctgctgcagttgaggagacccagcatggcgtat

SEQ ID NO: 440157 - DNA, 140 bp, Artificial Sequence
  Synthetic
aggccctggctgctgatatgcagttccaatcatcaagcccgtccaaactcgtttgctgagtttctaaataaaacgtattctagtgactcataaagagttgaataacaagattgcgaaaaagaccttttgggacagcggtg

SEQ ID NO: 440158 - DNA, 140 bp, Artificial Sequence
  Synthetic
caccgctgtcccaaaaggtctttttcgcaatcttgttattcaactctttatgagtcactagaatacgttttatttagaaactcagcaaacgagtttggacgggcttgatgattggaactgcatatcagcagccagggcct

SEQ ID NO: 440159 - DNA, 140 bp, Artificial Sequence
  Synthetic
aggccctggctgctgatatgtcctgattgcacgaaaaggagataagatcaccccagattctctggtggagataaagcgtactgatgtagaggggaattgggctctgacaggaggcatggagaccttttgggacagcggtg

SEQ ID NO: 440160 - DNA, 140 bp, Artificial Sequence
  Synthetic
caccgctgtcccaaaaggtctccatgcctcctgtcagagcccaattcccctctacatcagtacgctttatctccaccagagaatctggggtgatcttatctccttttcgtgcaatcaggacatatcagcagccagggcct

SEQ ID NO: 440161 - DNA, 140 bp, Artificial Sequence
  Synthetic
aggccctggctgctgatatgactgacaagggaccccactgtctctgagcatgcgtctttagttggtcttctattgagtctgtataggttgagcaaaatatccggacaaaacactggtaacgaccttttgggacagcggtg

SEQ ID NO: 440162 - DNA, 140 bp, Artificial Sequence
  Synthetic
caccgctgtcccaaaaggtcgttaccagtgttttgtccggatattttgctcaacctatacagactcaatagaagaccaactaaagacgcatgctcagagacagtggggtcccttgtcagtcatatcagcagccagggcct

SEQ ID NO: 440163 - DNA, 140 bp, Artificial Sequence
  Synthetic
atacgccatgctgggtctcctgtctcgaaaccgttgactgaccctttattcaatccgccgtctgaccccaaaatcttgagacacttcaatatttgctgcagtaccatgatgtacttgtctcgtacttgggagtcggccat

SEQ ID NO: 440164 - DNA, 140 bp, Artificial Sequence
  Synthetic
atggccgactcccaagtacgagacaagtacatcatggtactgcagcaaatattgaagtgtctcaagattttggggtcagacggcggattgaataaagggtcagtcaacggtttcgagacaggagacccagcatggcgtat

SEQ ID NO: 440165 - DNA, 140 bp, Artificial Sequence
  Synthetic
atacgccatgctgggtctccgtgccaattggagtactataccaaacttcagatttttggccggaacctatgacatgtttttctcccggattgagcatctatattcagcaatcagagttggcgtacttgggagtcggccat

SEQ ID NO: 440166 - DNA, 140 bp, Artificial Sequence
  Synthetic
atggccgactcccaagtacgccaactctgattgctgaatatagatgctcaatccgggagaaaaacatgtcataggttccggccaaaaatctgaagtttggtatagtactccaattggcacggagacccagcatggcgtat

SEQ ID NO: 440167 - DNA, 140 bp, Artificial Sequence
  Synthetic
atacgccatgctgggtctccatttatcctggagttggtccgacgacacctcagtgttcaaaagggtggcttgcaattctagttttagcctctcggctcactggataaggctgatttacaacgtacttgggagtcggccat

SEQ ID NO: 440168 - DNA, 140 bp, Artificial Sequence
  Synthetic
atggccgactcccaagtacgttgtaaatcagccttatccagtgagccgagaggctaaaactagaattgcaagccacccttttgaacactgaggtgtcgtcggaccaactccaggataaatggagacccagcatggcgtat

SEQ ID NO: 440169 - DNA, 140 bp, Artificial Sequence
  Synthetic
atacgccatgctgggtctccaatagtgaagaccaccagacttgtcggaaatactgagaatctgtccagggaggtagaaaagcaccttcgagggtacaacaggtggattaccctagacgaccgtacttgggagtcggccat

SEQ ID NO: 440170 - DNA, 140 bp, Artificial Sequence
  Synthetic
atggccgactcccaagtacggtcgtctagggtaatccacctgttgtaccctcgaaggtgcttttctacctccctggacagattctcagtatttccgacaagtctggtggtcttcactattggagacccagcatggcgtat

SEQ ID NO: 440171 - DNA, 140 bp, Artificial Sequence
  Synthetic
atacgccatgctgggtctccccgatcatcggggatattcttgtacaattttgagcagttaaagatgaacctcgatgacatagttaaagagtcaaaaaatgtaccgggcgtggctcgcttgcgtacttgggagtcggccat

SEQ ID NO: 440172 - DNA, 140 bp, Artificial Sequence
  Synthetic
atggccgactcccaagtacgcaagcgagccacgcccggtacattttttgactctttaactatgtcatcgaggttcatctttaactgctcaaaattgtacaagaatatccccgatgatcggggagacccagcatggcgtat

SEQ ID NO: 440173 - DNA, 140 bp, Artificial Sequence
  Synthetic
aggccctggctgctgatatgtgagtgggaaatctccttattcatcaaatgctgtcggtcacgtgttcaatctcattcactttgttggatgttatatgggtcaagtcagatccctaaatgcgaccttttgggacagcggtg

SEQ ID NO: 440174 - DNA, 140 bp, Artificial Sequence
  Synthetic
caccgctgtcccaaaaggtcgcatttagggatctgacttgacccatataacatccaacaaagtgaatgagattgaacacgtgaccgacagcatttgatgaataaggagatttcccactcacatatcagcagccagggcct

SEQ ID NO: 440175 - DNA, 140 bp, Artificial Sequence
  Synthetic
atacgccatgctgggtctccacaccttgggacggtatgccctgaaaaaaacaagaccctgatccgtaacctctgtttgcttgatggttttttttgtctttgttgtttttttgttaagcgtcgtacttgggagtcggccat

SEQ ID NO: 440176 - DNA, 140 bp, Artificial Sequence
  Synthetic
atggccgactcccaagtacgacgcttaacaaaaaaacaacaaagacaaaaaaaaccatcaagcaaacagaggttacggatcagggtcttgtttttttcagggcataccgtcccaaggtgtggagacccagcatggcgtat

SEQ ID NO: 440177 - DNA, 140 bp, Artificial Sequence
  Synthetic
atacgccatgctgggtctccataaaataatgcaagatgacctaaaccgttatgtgccccattgactgatctctcaaactcggtcccactatacaatcaaattcgaactgttttaaatccacgtacttgggagtcggccat

SEQ ID NO: 440178 - DNA, 140 bp, Artificial Sequence
  Synthetic
atggccgactcccaagtacgtggatttaaaacagttcgaatttgattgtatagtgggaccgagtttgagagatcagtcaatggggcacataacggtttaggtcatcttgcattattttatggagacccagcatggcgtat

SEQ ID NO: 440179 - DNA, 140 bp, Artificial Sequence
  Synthetic
atacgccatgctgggtctccagagatgagaaagaacttcaagaatacgaggcagctgaactaacaaagactgacgtagcactggcagatgatggaactgtcaactccgacgacgaggactcgtacttgggagtcggccat

SEQ ID NO: 440180 - DNA, 140 bp, Artificial Sequence
  Synthetic
atggccgactcccaagtacgagtcctcgtcgtcggagttgacagttccatcatctgccagtgctacgtcagtctttgttagttcagctgcctcgtattcttgaagttctttctcatctctggagacccagcatggcgtat

SEQ ID NO: 440181 - DNA, 140 bp, Artificial Sequence
  Synthetic
aggccctggctgctgatatgaatgctgccaagcttgatcctgatgatgtgtgttcctatttagcagccgcaatgcaattctttgagggaacatgccctgaggactggaccagttatggaagaccttttgggacagcggtg

SEQ ID NO: 440182 - DNA, 140 bp, Artificial Sequence
  Synthetic
caccgctgtcccaaaaggtcttccataactggtccagtcctcagggcatgttccctcaaagaattgcattgcggctgctaaataggaacacacatcatcaggatcaagcttggcagcattcatatcagcagccagggcct

SEQ ID NO: 440183 - DNA, 140 bp, Artificial Sequence
  Synthetic
atacgccatgctgggtctccggctcctccagacgatgatgatttgtggttaccccctccagaatatgttccgctgaaggagcttgcaggcaagaagaacatgagaaacttctgcattaatcgtacttgggagtcggccat

SEQ ID NO: 440184 - DNA, 140 bp, Artificial Sequence
  Synthetic
atggccgactcccaagtacgattaatgcagaagtttctcatgttcttcttgcctgcaagctccttcagcggaacatattctggagggggtaaccacaaatcatcatcgtctggaggagccggagacccagcatggcgtat

SEQ ID NO: 440185 - DNA, 140 bp, Artificial Sequence
  Synthetic
aggccctggctgctgatatgctatagattgtgtatatccatcatgaaaaaaactaacacccctcctttcgaaccatcccaaatatgagcaaaatcttcgtcaatcctagtgctatcagaggaccttttgggacagcggtg

SEQ ID NO: 440186 - DNA, 140 bp, Artificial Sequence
  Synthetic
caccgctgtcccaaaaggtcctctgatagcactaggattgacgaagattttgctcatatttgggatggttcgaaaggaggggtgttagtttttttcatgatggatatacacaatctatagcatatcagcagccagggcct

SEQ ID NO: 440187 - DNA, 140 bp, Artificial Sequence
  Synthetic
atacgccatgctgggtctccaaccatcccaaatatgagcaaaatcttcgtcaatcctagtgctatcagagccggtctggctgatcttgagatggctgaagagactgttgatctaattaatcgtacttgggagtcggccat

SEQ ID NO: 440188 - DNA, 140 bp, Artificial Sequence
  Synthetic
atggccgactcccaagtacgattaattagatcaacagtctcttcagccatctcaagatcagccagaccggctctgatagcactaggattgacgaagattttgctcatatttgggatggttggagacccagcatggcgtat

SEQ ID NO: 440189 - DNA, 140 bp, Artificial Sequence
  Synthetic
atacgccatgctgggtctcctacaagacaaacattgcggataggatagagcagatttttgagactgccccttttgttaagatcgtggagcaccatactctgatgacaactcacaagatgtcgtacttgggagtcggccat

SEQ ID NO: 440190 - DNA, 140 bp, Artificial Sequence
  Synthetic
atggccgactcccaagtacgacatcttgtgagttgtcatcagagtatggtgctccacgatcttaacaaaaggggcagtctcaaaaatctgctctatcctatccgcaatgtttgtcttgtaggagacccagcatggcgtat

SEQ ID NO: 440191 - DNA, 140 bp, Artificial Sequence
  Synthetic
aggccctggctgctgatatgttttgttaagatcgtggagcaccatactctgatgacaactcacaagatgtgtgccaactggagtaccataccgaacttcagattcttagctggaacctacgaccttttgggacagcggtg

SEQ ID NO: 440192 - DNA, 140 bp, Artificial Sequence
  Synthetic
caccgctgtcccaaaaggtcgtaggttccagctaagaatctgaagttcggtatggtactccagttggcacacatcttgtgagttgtcatcagagtatggtgctccacgatcttaacaaaacatatcagcagccagggcct

SEQ ID NO: 440193 - DNA, 140 bp, Artificial Sequence
  Synthetic
atacgccatgctgggtctccgtaagtgcaagacaatgccatattcagggcaggatttggtgtattaacatgaactctcgggcttgtcaattgtggtctgacatgtctcttcaaacacaaacgtacttgggagtcggccat

SEQ ID NO: 440194 - DNA, 140 bp, Artificial Sequence
  Synthetic
atggccgactcccaagtacgtttgtgtttgaagagacatgtcagaccacaattgacaagcccgagagttcatgttaatacaccaaatcctgccctgaatatggcattgtcttgcacttacggagacccagcatggcgtat

SEQ ID NO: 440195 - DNA, 140 bp, Artificial Sequence
  Synthetic
aggccctggctgctgatatgtactgttgtcactgcttacgaagattgctcaggactggtatcatttacagggttcataaagcaaataaatctcactgcaagagaagcaatactatatttcgaccttttgggacagcggtg

SEQ ID NO: 440196 - DNA, 140 bp, Artificial Sequence
  Synthetic
caccgctgtcccaaaaggtcgaaatatagtattgcttctcttgcagtgagatttatttgctttatgaaccctgtaaatgataccagtcctgagcaatcttcgtaagcagtgacaacagtacatatcagcagccagggcct

SEQ ID NO: 440197 - DNA, 140 bp, Artificial Sequence
  Synthetic
aggccctggctgctgatatgccagactactggccgagagcccaagaaggaaacaacatccactccctctcagagagaaagccaatcttcgaaagccaggatggcggctcaagctgcctctgaccttttgggacagcggtg

SEQ ID NO: 440198 - DNA, 140 bp, Artificial Sequence
  Synthetic
caccgctgtcccaaaaggtcagaggcagcttgagccgccatcctggctttcgaagattggctttctctctgagagggagtggatgttgtttccttcttgggctctcggccagtagtctggcatatcagcagccagggcct

SEQ ID NO: 440199 - DNA, 140 bp, Artificial Sequence
  Synthetic
aggccctggctgctgatatggacagttattgccgcatgtgctccccatgaaatgtctgttcttggaggctatttgggagaggagttcttcggaaaagggacgtttgaaaggagattcttcgaccttttgggacagcggtg

SEQ ID NO: 440200 - DNA, 140 bp, Artificial Sequence
  Synthetic
caccgctgtcccaaaaggtcgaagaatctcctttcaaacgtcccttttccgaagaactcctctcccaaatagcctccaagaacagacatttcatggggagcacatgcggcaataactgtccatatcagcagccagggcct

SEQ ID NO: 440201 - DNA, 140 bp, Artificial Sequence
  Synthetic
aggccctggctgctgatatgagtagaggctgagatcgctcaccagattgctgaaagtttctccaaaaagtacaagtttccctctcgatcctcaggaatattcttgtataattttgagcaggaccttttgggacagcggtg

SEQ ID NO: 440202 - DNA, 140 bp, Artificial Sequence
  Synthetic
caccgctgtcccaaaaggtcctgctcaaaattatacaagaatattcctgaggatcgagagggaaacttgtactttttggagaaactttcagcaatctggtgagcgatctcagcctctactcatatcagcagccagggcct

SEQ ID NO: 440203 - DNA, 140 bp, Artificial Sequence
  Synthetic
aggccctggctgctgatatgatttctctggtgagaccaggagtcctgaggctgtctatactcgaatcatgatgaatggaggtcgactaaagagatcacatataaggagatatgtttcagtgaccttttgggacagcggtg

SEQ ID NO: 440204 - DNA, 140 bp, Artificial Sequence
  Synthetic
caccgctgtcccaaaaggtcactgaaacatatctccttatatgtgatctctttagtcgacctccattcatcatgattcgagtatagacagcctcaggactcctggtctcaccagagaaatcatatcagcagccagggcct

SEQ ID NO: 440205 - DNA, 140 bp, Artificial Sequence
  Synthetic
aggccctggctgctgatatgtgggatgggtcgctttggctaattctaagaaattccaactgttagtcgaagccgacaaactaaacaaaatcatgcaagatgacttgaatcgctatgcatcgaccttttgggacagcggtg

SEQ ID NO: 440206 - DNA, 140 bp, Artificial Sequence
  Synthetic
caccgctgtcccaaaaggtcgatgcatagcgattcaagtcatcttgcatgattttgtttagtttgtcggcttcgactaacagttggaatttcttagaattagccaaagcgacccatcccacatatcagcagccagggcct

SEQ ID NO: 440207 - DNA, 140 bp, Artificial Sequence
  Synthetic
aggccctggctgctgatatgtgtcctagagtagacatgaaaaaaacaggcaacaccactgataaaatgaactttctacggaaaatagtgaaaaactgtagggatgaggaccctcaaaaacgaccttttgggacagcggtg

SEQ ID NO: 440208 - DNA, 140 bp, Artificial Sequence
  Synthetic
caccgctgtcccaaaaggtcgtttttgagggtcctcatccctacagtttttcactattttccgtagaaagttcattttatcagtggtgttgcctgtttttttcatgtctactctaggacacatatcagcagccagggcct

SEQ ID NO: 440209 - DNA, 140 bp, Artificial Sequence
  Synthetic
atacgccatgctgggtctccctctcgttatcatatcaccaagtgtggctgatttggatccctacgataaatcccttcattcaagagtcttctcagatgggaagtgtttgggaataacaatcgtacttgggagtcggccat

SEQ ID NO: 440210 - DNA, 140 bp, Artificial Sequence
  Synthetic
atggccgactcccaagtacgattgttattcccaaacacttcccatctgagaagactcttgaatgaagggatttatcgtagggatccaaatcagccacacttggtgatatgataacgagagggagacccagcatggcgtat

SEQ ID NO: 440211 - DNA, 140 bp, Artificial Sequence
  Synthetic
aggccctggctgctgatatggccggtttggctgatctggagatggccgaggagactgttgatctaatcaatagaaacatagaagacaatcaggctcatctccaaggagagcctatagagggaccttttgggacagcggtg

SEQ ID NO: 440212 - DNA, 140 bp, Artificial Sequence
  Synthetic
caccgctgtcccaaaaggtccctctataggctctccttggagatgagcctgattgtcttctatgtttctattgattagatcaacagtctcctcggccatctccagatcagccaaaccggccatatcagcagccagggcct

SEQ ID NO: 440213 - DNA, 140 bp, Artificial Sequence
  Synthetic
atacgccatgctgggtctccaagagagcctctaaagggggcaagacttgcggattcgttgatgaaaggggtttatataagtctctcaaaggggcatgtaagctcaaactgtgcggagtttcgtacttgggagtcggccat

SEQ ID NO: 440214 - DNA, 140 bp, Artificial Sequence
  Synthetic
atggccgactcccaagtacgaaactccgcacagtttgagcttacatgcccctttgagagacttatataaacccctttcatcaacgaatccgcaagtcttgccccctttagaggctctcttggagacccagcatggcgtat

SEQ ID NO: 440215 - DNA, 140 bp, Artificial Sequence
  Synthetic
aggccctggctgctgatatgaatcataggatgattgggttagttaaagttgttattggattagctttgtcaggggctccagtccctgagggcatgaactgggtgtacaagttgaggagaagaccttttgggacagcggtg

SEQ ID NO: 440216 - DNA, 140 bp, Artificial Sequence
  Synthetic
caccgctgtcccaaaaggtcttctcctcaacttgtacacccagttcatgccctcagggactggagcccctgacaaagctaatccaataacaactttaactaacccaatcatcctatgattcatatcagcagccagggcct

SEQ ID NO: 440217 - DNA, 140 bp, Artificial Sequence
  Synthetic
atacgccatgctgggtctccacctggacaatgtcggagtccagatagtcagacaaatgaggtcaggagaaagatttctcaagatctggtcacagaccgtagaggaaattatctcctatgtcgtacttgggagtcggccat

SEQ ID NO: 440218 - DNA, 140 bp, Artificial Sequence
  Synthetic
atggccgactcccaagtacgacataggagataatttcctctacggtctgtgaccagatcttgagaaatctttctcctgacctcatttgtctgactatctggactccgacattgtccaggtggagacccagcatggcgtat

SEQ ID NO: 440219 - DNA, 140 bp, Artificial Sequence
  Synthetic
atacgccatgctgggtctccctcggatgagatagaacatcttgttgtagaggagttggtcaagaagagggaagagtgtctggatgcattggagtctattatgaccaccaaatcggtaagccgtacttgggagtcggccat

SEQ ID NO: 440220 - DNA, 140 bp, Artificial Sequence
  Synthetic
atggccgactcccaagtacggcttaccgatttggtggtcataatagactccaatgcatccagacactcttccctcttcttgaccaactcctctacaacaagatgttctatctcatccgagggagacccagcatggcgtat

SEQ ID NO: 440221 - DNA, 140 bp, Artificial Sequence
  Synthetic
aggccctggctgctgatatgcaaagagaaagtcaatcttcgaaagccagaatggtggctcaaactgcctctggtccaccggctctcgaatggtctgcgaccaatgaagaagatgacttatgaccttttgggacagcggtg

SEQ ID NO: 440222 - DNA, 140 bp, Artificial Sequence
  Synthetic
caccgctgtcccaaaaggtcataagtcatcttcttcattggtcgcagaccattcgagagccggtggaccagaggcagtttgagccaccattctggctttcgaagattgactttctctttgcatatcagcagccagggcct

SEQ ID NO: 440223 - DNA, 140 bp, Artificial Sequence
  Synthetic
atacgccatgctgggtctcctggtccaccggctctcgaatggtctgcgaccaatgaagaagatgacttatccgtagaggcagagatcgctcatcagattgctgagagcttttccaagaagcgtacttgggagtcggccat

SEQ ID NO: 440224 - DNA, 140 bp, Artificial Sequence
  Synthetic
atggccgactcccaagtacgcttcttggaaaagctctcagcaatctgatgagcgatctctgcctctacggataagtcatcttcttcattggtcgcagaccattcgagagccggtggaccaggagacccagcatggcgtat

SEQ ID NO: 440225 - DNA, 140 bp, Artificial Sequence
  Synthetic
atacgccatgctgggtctcccagttcggacttggagtgaggtcatcccatcgaaagggtgcctaagtgtcggaggaaggtgtcatccccatgagaacggagtgtttttcaatggtataatcgtacttgggagtcggccat

SEQ ID NO: 440226 - DNA, 140 bp, Artificial Sequence
  Synthetic
atggccgactcccaagtacgattataccattgaaaaacactccgttctcatggggatgacaccttcctccgacacttaggcaccctttcgatgggatgacctcactccaagtccgaactgggagacccagcatggcgtat

SEQ ID NO: 440227 - DNA, 140 bp, Artificial Sequence
  Synthetic
aggccctggctgctgatatgtggcggtctcattctgtttcgggaaattccccatttacacaataccagacaagcttggtccctggagcccgattgacatacatcatcttagctgtccaaagaccttttgggacagcggtg

SEQ ID NO: 440228 - DNA, 140 bp, Artificial Sequence
  Synthetic
caccgctgtcccaaaaggtctttggacagctaagatgatgtatgtcaatcgggctccagggaccaagcttgtctggtattgtgtaaatggggaatttcccgaaacagaatgagaccgccacatatcagcagccagggcct

SEQ ID NO: 440229 - DNA, 140 bp, Artificial Sequence
  Synthetic
aggccctggctgctgatatggttaaaaatgaaccttgacgacatagtcaaggagtctaaaaatgtacccggtgtgacccgtttagctcatgatggatctaaactccctctaagatgtgtagaccttttgggacagcggtg

SEQ ID NO: 440230 - DNA, 140 bp, Artificial Sequence
  Synthetic
caccgctgtcccaaaaggtctacacatcttagagggagtttagatccatcatgagctaaacgggtcacaccgggtacatttttagactccttgactatgtcgtcaaggttcatttttaaccatatcagcagccagggcct

SEQ ID NO: 440231 - DNA, 140 bp, Artificial Sequence
  Synthetic
aggccctggctgctgatatgtttacattctgagcctcttggatgtgaaaaaaactattaacatccctcaaaagacttaaggaaagatggttcctcaggctcttttggttgtgccccttctgaccttttgggacagcggtg

SEQ ID NO: 440232 - DNA, 140 bp, Artificial Sequence
  Synthetic
caccgctgtcccaaaaggtcagaaggggcacaaccaaaagagcctgaggaaccatctttccttaagtcttttgagggatgttaatagtttttttcacatccaagaggctcagaatgtaaacatatcagcagccagggcct

SEQ ID NO: 440233 - DNA, 140 bp, Artificial Sequence
  Synthetic
atacgccatgctgggtctcccccttggcaaacccatcaacggtcttcaaggatggtgacgaggcggaggactttgttgaagttcaccttccagacgttcaagaacagatctcaggggttgcgtacttgggagtcggccat

SEQ ID NO: 440234 - DNA, 140 bp, Artificial Sequence
  Synthetic
atggccgactcccaagtacgcaacccctgagatctgttcttgaacgtctggaaggtgaacttcaacaaagtcctccgcctcgtcaccatccttgaagaccgttgatgggtttgccaagggggagacccagcatggcgtat

SEQ ID NO: 440235 - DNA, 140 bp, Artificial Sequence
  Synthetic
atacgccatgctgggtctcccggtgctttcattcttcaggaactgataccaaaggttgtggacaggccgagggatatctcggatgactacctatttgagcatggatagaggctatagtatcgtacttgggagtcggccat

SEQ ID NO: 440236 - DNA, 140 bp, Artificial Sequence
  Synthetic
atggccgactcccaagtacgatactatagcctctatccatgctcaaataggtagtcatccgagatatccctcggcctgtccacaacctttggtatcagttcctgaagaatgaaagcaccgggagacccagcatggcgtat

SEQ ID NO: 440237 - DNA, 140 bp, Artificial Sequence
  Synthetic
atacgccatgctgggtctcctaatagaacaagatcaacacaacgagatcttggggggttagaaaggaaagtatcggttcctcccaaagatgggagagtcatgtcttcatgggagtcataccgtacttgggagtcggccat

SEQ ID NO: 440238 - DNA, 140 bp, Artificial Sequence
  Synthetic
atggccgactcccaagtacggtatgactcccatgaagacatgactctcccatctttgggaggaaccgatactttcctttctaaccccccaagatctcgttgtgttgatcttgttctattaggagacccagcatggcgtat

SEQ ID NO: 440239 - DNA, 140 bp, Artificial Sequence
  Synthetic
aggccctggctgctgatatgcctgaatatgttccgttgaaagaactcacgggcaagaaaaacatgaggaacttttgtatcaacggagaggtcaaggtgtgcagtccgaacggctattcgtgaccttttgggacagcggtg

SEQ ID NO: 440240 - DNA, 140 bp, Artificial Sequence
  Synthetic
caccgctgtcccaaaaggtcacgaatagccgttcggactgcacaccttgacctctccgttgatacaaaagttcctcatgtttttcttgcccgtgagttctttcaacggaacatattcaggcatatcagcagccagggcct

SEQ ID NO: 440241 - DNA, 140 bp, Artificial Sequence
  Synthetic
aggccctggctgctgatatgtcaggatcttgcggcacattctaagatcatttggtgagatatattctggaaatcacagaatgatcggattagtcaaggtcgttattggactggctttatcgaccttttgggacagcggtg

SEQ ID NO: 440242 - DNA, 140 bp, Artificial Sequence
  Synthetic
caccgctgtcccaaaaggtcgataaagccagtccaataacgaccttgactaatccgatcattctgtgatttccagaatatatctcaccaaatgatcttagaatgtgccgcaagatcctgacatatcagcagccagggcct

SEQ ID NO: 440243 - DNA, 140 bp, Artificial Sequence
  Synthetic
atacgccatgctgggtctcccccatatgacaaatcccttcactcgagggtcttccctagcggaaaatgctcaggaataacggtgtcttctacctactgttcaactaaccatgattacacccgtacttgggagtcggccat

SEQ ID NO: 440244 - DNA, 140 bp, Artificial Sequence
  Synthetic
atggccgactcccaagtacgggtgtaatcatggttagttgaacagtaggtagaagacaccgttattcctgagcattttccgctagggaagaccctcgagtgaagggatttgtcatatgggggagacccagcatggcgtat

SEQ ID NO: 440245 - DNA, 140 bp, Artificial Sequence
  Synthetic
aggccctggctgctgatatgctcttatcttccaatgggctgattccaggggccctcttgagggggaggagttggaatactctcaagaaatcacctgggatgacgatactgagtttgtcgggaccttttgggacagcggtg

SEQ ID NO: 440246 - DNA, 140 bp, Artificial Sequence
  Synthetic
caccgctgtcccaaaaggtcccgacaaactcagtatcgtcatcccaggtgatttcttgagagtattccaactcctccccctcaagagggcccctggaatcagcccattggaagataagagcatatcagcagccagggcct

SEQ ID NO: 440247 - DNA, 140 bp, Artificial Sequence
  Synthetic
atacgccatgctgggtctccgactctgtgcttacgcttgggtaaaggccatagcaaggtcctctgcaatagatcgggtgggggttgactgagagaagtgatttgcctcctatgaaggatacgtacttgggagtcggccat

SEQ ID NO: 440248 - DNA, 140 bp, Artificial Sequence
  Synthetic
atggccgactcccaagtacgtatccttcataggaggcaaatcacttctctcagtcaacccccacccgatctattgcagaggaccttgctatggcctttacccaagcgtaagcacagagtcggagacccagcatggcgtat

SEQ ID NO: 440249 - DNA, 140 bp, Artificial Sequence
  Synthetic
aggccctggctgctgatatgtagatgaaagaggcctgtataagtctctaaaaggagcatgcaaactcaagttatgtggagttctaggacttaaacttatggatgggacatgggtcgcgatgaccttttgggacagcggtg

SEQ ID NO: 440250 - DNA, 140 bp, Artificial Sequence
  Synthetic
caccgctgtcccaaaaggtcatcgcgacccatgtcccatccataagtttaagtcctagaactccacataacttgagtttgcatgctccttttagagacttatacaggcctctttcatctacatatcagcagccagggcct

SEQ ID NO: 440251 - DNA, 140 bp, Artificial Sequence
  Synthetic
atacgccatgctgggtctccggagaaggaattggcaacacttctcatcctgattactgcatcatgatgattgatccaggggaagtttatgacgaccccattgatccaattgagtcagaggcgtacttgggagtcggccat

SEQ ID NO: 440252 - DNA, 140 bp, Artificial Sequence
  Synthetic
atggccgactcccaagtacgcctctgactcaattggatcaatggggtcgtcataaacttcccctggatcaatcatcatgatgcagtaatcaggatgagaagtgttgccaattccttctccggagacccagcatggcgtat

SEQ ID NO: 440253 - DNA, 140 bp, Artificial Sequence
  Synthetic
aggccctggctgctgatatgagaacatacgggcttaactccaacctttgggagcaatagaacaaaaacatgttatggtgccattaaatcgctgcattttatcaaaatcagattaattaccgaccttttgggacagcggtg

SEQ ID NO: 440254 - DNA, 140 bp, Artificial Sequence
  Synthetic
caccgctgtcccaaaaggtcggtaattaatctgattttgataaaatgcagcgatttaatggcaccataacatgtttttgttctattgctcccaaaggttggagttaagcccgtatgttctcatatcagcagccagggcct

SEQ ID NO: 440255 - DNA, 140 bp, Artificial Sequence
  Synthetic
atacgccatgctgggtctccatggttgaagacaggaaataggcctctccggatgactgtgacggacaattgctctagatcttataaagtgctgaaggattatttcaagaaagtcgacatacgtacttgggagtcggccat

SEQ ID NO: 440256 - DNA, 140 bp, Artificial Sequence
  Synthetic
atggccgactcccaagtacgtatgtcgactttcttgaaataatccttcagcactttataagatctagagcaattgtccgtcacagtcatccggagaggcctatttcctgtcttcaaccatggagacccagcatggcgtat

SEQ ID NO: 440257 - DNA, 140 bp, Artificial Sequence
  Synthetic
atacgccatgctgggtctccacttgcacaggcgttgtgacagaggcagaaacctacaccaactttgtcggttatgtcacaaccacgttcaagagaaagcattttcgcccaacaccagatgcgtacttgggagtcggccat

SEQ ID NO: 440258 - DNA, 140 bp, Artificial Sequence
  Synthetic
atggccgactcccaagtacgcatctggtgttgggcgaaaatgctttctcttgaacgtggttgtgacataaccgacaaagttggtgtaggtttctgcctctgtcacaacgcctgtgcaagtggagacccagcatggcgtat

SEQ ID NO: 440259 - DNA, 140 bp, Artificial Sequence
  Synthetic
aggccctggctgctgatatggtgtttaaaagtgggggggaggtgtcatcctcatgtgaacggggtgtttttcaacggtgtgatattagggcctgacggccatgttctgatccccgagatggaccttttgggacagcggtg

SEQ ID NO: 440260 - DNA, 140 bp, Artificial Sequence
  Synthetic
caccgctgtcccaaaaggtccatctcggggatcagaacatggccgtcaggccctaatatcacaccgttgaaaaacaccccgttcacatgaggatgacacctcccccccacttttaaacaccatatcagcagccagggcct

SEQ ID NO: 440261 - DNA, 140 bp, Artificial Sequence
  Synthetic
atacgccatgctgggtctccacttggctcagttctattccaagtcttcccccatagaaaaactgttgaactgcacactcggaaatagagggctaagaatccccccggagggagtcctaagcgtacttgggagtcggccat

SEQ ID NO: 440262 - DNA, 140 bp, Artificial Sequence
  Synthetic
atggccgactcccaagtacgcttaggactccctccggggggattcttagccctctatttccgagtgtgcagttcaacagtttttctatgggggaagacttggaatagaactgagccaagtggagacccagcatggcgtat

SEQ ID NO: 440263 - DNA, 140 bp, Artificial Sequence
  Synthetic
aggccctggctgctgatatgtatgtcaccaccacgtttaagagaaagcactttcgccctatgccggatgcgtgcagagccgcatacaactggaagatggctggtgaccccaggtatgaaggaccttttgggacagcggtg

SEQ ID NO: 440264 - DNA, 140 bp, Artificial Sequence
  Synthetic
caccgctgtcccaaaaggtccttcatacctggggtcaccagccatcttccagttgtatgcggctctgcacgcatccggcatagggcgaaagtgctttctcttaaacgtggtggtgacatacatatcagcagccagggcct

SEQ ID NO: 440265 - DNA, 140 bp, Artificial Sequence
  Synthetic
atacgccatgctgggtctccgccttagactgggatgaggaaaagaccatcctggcactgtggagggatttaacctctgtagatatcgggaaggacttggtcaagttcaaagatcagatatcgtacttgggagtcggccat

SEQ ID NO: 440266 - DNA, 140 bp, Artificial Sequence
  Synthetic
atggccgactcccaagtacgatatctgatctttgaacttgaccaagtccttcccgatatctacagaggttaaatccctccacagtgccaggatggtcttttcctcatcccagtctaaggcggagacccagcatggcgtat

SEQ ID NO: 440267 - DNA, 140 bp, Artificial Sequence
  Synthetic
aggccctggctgctgatatgcccgtacgataaatcccttcactcgagagtttttcctggcggaaaatgctcaggaataaccgtgtcctccacttgctgctctactaaccacgactacaccgaccttttgggacagcggtg

SEQ ID NO: 440268 - DNA, 140 bp, Artificial Sequence
  Synthetic
caccgctgtcccaaaaggtcggtgtagtcgtggttagtagagcagcaagtggaggacacggttattcctgagcattttccgccaggaaaaactctcgagtgaagggatttatcgtacgggcatatcagcagccagggcct

SEQ ID NO: 440269 - DNA, 140 bp, Artificial Sequence
  Synthetic
atacgccatgctgggtctcctttatggaaagacttgacgtcagttgatgttgggaaagacttagtcaagttcaaagatcaaatatggggactactaattgtgacgaaggactttgtgtaccgtacttgggagtcggccat

SEQ ID NO: 440270 - DNA, 140 bp, Artificial Sequence
  Synthetic
atggccgactcccaagtacggtacacaaagtccttcgtcacaattagtagtccccatatttgatctttgaacttgactaagtctttcccaacatcaactgacgtcaagtctttccataaaggagacccagcatggcgtat

SEQ ID NO: 440271 - DNA, 140 bp, Artificial Sequence
  Synthetic
aggccctggctgctgatatgtggatgaaagaggcttgtacaagtctctaaagggagcatgcaagctgaagctatgtggggttctaggacttagacttatggacggaacatgggtcgcgatgaccttttgggacagcggtg

SEQ ID NO: 440272 - DNA, 140 bp, Artificial Sequence
  Synthetic
caccgctgtcccaaaaggtcatcgcgacccatgttccgtccataagtctaagtcctagaaccccacatagcttcagcttgcatgctccctttagagacttgtacaagcctctttcatccacatatcagcagccagggcct

SEQ ID NO: 440273 - DNA, 140 bp, Artificial Sequence
  Synthetic
atacgccatgctgggtctccatgtagattctcataatacgggaaatcttctagcagtttcagtgaccaacggtgctttcattctccaaggcctgataccaaaggttgcgaacaggccaagcgtacttgggagtcggccat

SEQ ID NO: 440274 - DNA, 140 bp, Artificial Sequence
  Synthetic
atggccgactcccaagtacgcttggcctgttcgcaacctttggtatcaggccttggagaatgaaagcaccgttggtcactgaaactgctagaagatttcccgtattatgagaatctacatggagacccagcatggcgtat

SEQ ID NO: 440275 - DNA, 140 bp, Artificial Sequence
  Synthetic
aggccctggctgctgatatgtcagacatcagatgagatcaaatggtgctctcctgatcagctagtaaatctacacgactttcactcggatgagattgaacatcttgttgtggaggagttggaccttttgggacagcggtg

SEQ ID NO: 440276 - DNA, 140 bp, Artificial Sequence
  Synthetic
caccgctgtcccaaaaggtccaactcctccacaacaagatgttcaatctcatccgagtgaaagtcgtgtagatttactagctgatcaggagagcaccatttgatctcatctgatgtctgacatatcagcagccagggcct

SEQ ID NO: 440277 - DNA, 140 bp, Artificial Sequence
  Synthetic
aggccctggctgctgatatggtcaaaaagagggaagagtgtctggacgcactggagactattatgaccacaaagtccgtgagtttcagacgtcttagtcatttgaggaagctagtccctggaccttttgggacagcggtg

SEQ ID NO: 440278 - DNA, 140 bp, Artificial Sequence
  Synthetic
caccgctgtcccaaaaggtccagggactagcttcctcaaatgactaagacgtctgaaactcacggactttgtggtcataatagtctccagtgcgtccagacactcttccctctttttgaccatatcagcagccagggcct

SEQ ID NO: 440279 - DNA, 140 bp, Artificial Sequence
  Synthetic
atacgccatgctgggtctcccccatgaaggacataagcaatagctcacaatcatcttacatctcagcaaagtgtgcataattataaagggctgggtcatccaagcttctcagtcgagaaacgtacttgggagtcggccat

SEQ ID NO: 440280 - DNA, 140 bp, Artificial Sequence
  Synthetic
atggccgactcccaagtacgtttctcgactgagaagcttggatgacccagccctttataattatgcacactttgctgagatgtaagatgattgtgagctattgcttatgtccttcatgggggagacccagcatggcgtat

SEQ ID NO: 440281 - DNA, 140 bp, Artificial Sequence
  Synthetic
atacgccatgctgggtctcctatgatcaagtccacatcaagaaggtgatagataagtcctatcaggagtgtttggcaagcgatctggccaagagaatcctcaggtgggggtttgataagtcgtacttgggagtcggccat

SEQ ID NO: 440282 - DNA, 140 bp, Artificial Sequence
  Synthetic
atggccgactcccaagtacgacttatcaaacccccacctgaggattctcttggccagatcgcttgccaaacactcctgataggacttatctatcaccttcttgatgtggacttgatcataggagacccagcatggcgtat

SEQ ID NO: 440283 - DNA, 140 bp, Artificial Sequence
  Synthetic
aggccctggctgctgatatgcactttttgacgcgctgactatgacagacaacctgaacaaggtgtttaaaaagctgatcgacagggtcaccgggcaagggcttttggactattcaagggtgaccttttgggacagcggtg

SEQ ID NO: 440284 - DNA, 140 bp, Artificial Sequence
  Synthetic
caccgctgtcccaaaaggtcacccttgaatagtccaaaagcccttgcccggtgaccctgtcgatcagctttttaaacaccttgttcaggttgtctgtcatagtcagcgcgtcaaaaagtgcatatcagcagccagggcct

SEQ ID NO: 440285 - DNA, 140 bp, Artificial Sequence
  Synthetic
atacgccatgctgggtctccactccttatattaaaacccagacctggcctccaaaacatatagtggacttggtgggtgatgcctggcacagacttccgatcacccagatattcgagatcccgtacttgggagtcggccat

SEQ ID NO: 440286 - DNA, 140 bp, Artificial Sequence
  Synthetic
atggccgactcccaagtacgggatctcgaatatctgggtgatcggaagtctgtgccaggcatcacccaccaagtccactatatgttttggaggccaggtctgggttttaatataaggagtggagacccagcatggcgtat

SEQ ID NO: 440287 - DNA, 140 bp, Artificial Sequence
  Synthetic
aggccctggctgctgatatgacgaggcagaggactttgttgaggttcaccttccggatgtgcacaagcagatctcgggggttgatcttggtctcccaaactgggggaagtatgtgctgatgaccttttgggacagcggtg

SEQ ID NO: 440288 - DNA, 140 bp, Artificial Sequence
  Synthetic
caccgctgtcccaaaaggtcatcagcacatacttcccccagtttgggagaccaagatcaacccccgagatctgcttgtgcacatccggaaggtgaacctcaacaaagtcctctgcctcgtcatatcagcagccagggcct

SEQ ID NO: 440289 - DNA, 140 bp, Artificial Sequence
  Synthetic
atacgccatgctgggtctccccccagcgagaaggtcattattactgctctttctaagcctcctgtcaaccccagagaattcttaaaatctatagaccttggaggattgccagacgaggatcgtacttgggagtcggccat

SEQ ID NO: 440290 - DNA, 140 bp, Artificial Sequence
  Synthetic
atggccgactcccaagtacgatcctcgtctggcaatcctccaaggtctatagattttaagaattctctggggttgacaggaggcttagaaagagcagtaataatgaccttctcgctggggggagacccagcatggcgtat

SEQ ID NO: 440291 - DNA, 140 bp, Artificial Sequence
  Synthetic
atacgccatgctgggtctccagaagctcctagccaattatatcttgccactcttcgatgcattgactatgacagataacttgaacaaagtgttcaaaaagctgatcgacagagtcaccggcgtacttgggagtcggccat

SEQ ID NO: 440292 - DNA, 140 bp, Artificial Sequence
  Synthetic
atggccgactcccaagtacgccggtgactctgtcgatcagctttttgaacactttgttcaagttatctgtcatagtcaatgcatcgaagagtggcaagatataattggctaggagcttctggagacccagcatggcgtat

SEQ ID NO: 440293 - DNA, 140 bp, Artificial Sequence
  Synthetic
atacgccatgctgggtctccttcaagagtcatgagacttccattaatcatctcaaccgatcagacatggtcacgtagattcttataataaaagaaatcttctagcagttccagtgactaacgtacttgggagtcggccat

SEQ ID NO: 440294 - DNA, 140 bp, Artificial Sequence
  Synthetic
atggccgactcccaagtacgttagtcactggaactgctagaagatttcttttattataagaatctacgtgaccatgtctgatcggttgagatgattaatggaagtctcatgactcttgaaggagacccagcatggcgtat

SEQ ID NO: 440295 - DNA, 140 bp, Artificial Sequence
  Synthetic
aggccctggctgctgatatgcacgtagattcttataataaaagaaatcttctagcagttccagtgactaatggtgcttttaccctccaagaactgataccaaaggtggtggacacgccgagaccttttgggacagcggtg

SEQ ID NO: 440296 - DNA, 140 bp, Artificial Sequence
  Synthetic
caccgctgtcccaaaaggtctcggcgtgtccaccacctttggtatcagttcttggagggtaaaagcaccattagtcactggaactgctagaagatttcttttattataagaatctacgtgcatatcagcagccagggcct

SEQ ID NO: 440297 - DNA, 140 bp, Artificial Sequence
  Synthetic
aggccctggctgctgatatggaaccccgatactcagatgacttaatatctcagctgtgccagctatacatcgctggggatcaagtcttgtctatgtgtggaaattccggttatgaagtcagaccttttgggacagcggtg

SEQ ID NO: 440298 - DNA, 140 bp, Artificial Sequence
  Synthetic
caccgctgtcccaaaaggtctgacttcataaccggaatttccacacatagacaagacttgatccccagcgatgtatagctggcacagctgagatattaagtcatctgagtatcggggttccatatcagcagccagggcct

SEQ ID NO: 440299 - DNA, 140 bp, Artificial Sequence
  Synthetic
aggccctggctgctgatatgtcccatgaaggacataagcaatagatcactatcatcttgcatctcagcaaaatgtgtatacttataaagggctgggtcatctacgcttttcagtcgagaagaccttttgggacagcggtg

SEQ ID NO: 440300 - DNA, 140 bp, Artificial Sequence
  Synthetic
caccgctgtcccaaaaggtcttctcgactgaaaagcgtagatgacccagccctttataagtatacacattttgctgagatgcaagatgatagtgatctattgcttatgtccttcatgggacatatcagcagccagggcct

SEQ ID NO: 440301 - DNA, 140 bp, Artificial Sequence
  Synthetic
atacgccatgctgggtctccaatgtgtatacttataaagggctgggtcatctacgcttttcagtcgagaaaaaaactgtagaactaaagaacaactagcaacacttctcatcttgagattcgtacttgggagtcggccat

SEQ ID NO: 440302 - DNA, 140 bp, Artificial Sequence
  Synthetic
atggccgactcccaagtacgaatctcaagatgagaagtgttgctagttgttctttagttctacagtttttttctcgactgaaaagcgtagatgacccagccctttataagtatacacattggagacccagcatggcgtat

SEQ ID NO: 440303 - DNA, 140 bp, Artificial Sequence
  Synthetic
aggccctggctgctgatatgagaggttatcacagcatccccagagaatgattggttgtggatcttctcggacttcagaagttctaaaatgacgtacctaaccctcattacttatcagtctgaccttttgggacagcggtg

SEQ ID NO: 440304 - DNA, 140 bp, Artificial Sequence
  Synthetic
caccgctgtcccaaaaggtcagactgataagtaatgagggttaggtacgtcattttagaacttctgaagtccgagaagatccacaaccaatcattctctggggatgctgtgataacctctcatatcagcagccagggcct

SEQ ID NO: 440305 - DNA, 140 bp, Artificial Sequence
  Synthetic
aggccctggctgctgatatggggcatccaaactagggctcatcataaagaaggaagagaccatgtgcagctatgactttctcatctatgggaaaactcctttatttcgaggtaacatcctgaccttttgggacagcggtg

SEQ ID NO: 440306 - DNA, 140 bp, Artificial Sequence
  Synthetic
caccgctgtcccaaaaggtcaggatgttacctcgaaataaaggagttttcccatagatgagaaagtcatagctgcacatggtctcttccttctttatgatgagccctagtttggatgccccatatcagcagccagggcct

SEQ ID NO: 440307 - DNA, 140 bp, Artificial Sequence
  Synthetic
atacgccatgctgggtctccactgtagctcaacactctcagtccttgattaagccgatgagagactttttacttatgtcagtacaagccgttttccattacttgttgtttagtcccatttcgtacttgggagtcggccat

SEQ ID NO: 440308 - DNA, 140 bp, Artificial Sequence
  Synthetic
atggccgactcccaagtacgaaatgggactaaacaacaagtaatggaaaacggcttgtactgacataagtaaaaagtctctcatcggcttaatcaaggactgagagtgttgagctacagtggagacccagcatggcgtat

SEQ ID NO: 440309 - DNA, 140 bp, Artificial Sequence
  Synthetic
aggccctggctgctgatatgagaccaccccttgactccttacatcagaacccaaacatggccacccaaacatgtagtggacttggtgggggatacatggcacaagctcccgatcacgcaggaccttttgggacagcggtg

SEQ ID NO: 440310 - DNA, 140 bp, Artificial Sequence
  Synthetic
caccgctgtcccaaaaggtcctgcgtgatcgggagcttgtgccatgtatcccccaccaagtccactacatgtttgggtggccatgtttgggttctgatgtaaggagtcaaggggtggtctcatatcagcagccagggcct

SEQ ID NO: 440311 - DNA, 140 bp, Artificial Sequence
  Synthetic
aggccctggctgctgatatgccctagagattatttgagagggctcgcaagaggggtcttgatagggtcctcgatttgcttcttgacacgaatgacaaatatcaacattaacagacctcttgaccttttgggacagcggtg

SEQ ID NO: 440312 - DNA, 140 bp, Artificial Sequence
  Synthetic
caccgctgtcccaaaaggtcaagaggtctgttaatgttgatatttgtcattcgtgtcaagaagcaaatcgaggaccctatcaagacccctcttgcgagccctctcaaataatctctagggcatatcagcagccagggcct

SEQ ID NO: 440313 - DNA, 140 bp, Artificial Sequence
  Synthetic
aggccctggctgctgatatgaaaagttattaaattgcacacttggaaatagaggactaagaatccccccagaaggagtattgagttgccttgaaagggttgactatgataaggcattcgggaccttttgggacagcggtg

SEQ ID NO: 440314 - DNA, 140 bp, Artificial Sequence
  Synthetic
caccgctgtcccaaaaggtcccgaatgccttatcatagtcaaccctttcaaggcaactcaatactccttctggggggattcttagtcctctatttccaagtgtgcaatttaataacttttcatatcagcagccagggcct

SEQ ID NO: 440315 - DNA, 140 bp, Artificial Sequence
  Synthetic
aggccctggctgctgatatgtgggatgtctcttggaaggttccacatacgtcagttctcagaccctgtctcagaaggtttgtctttttggagagagatctggctaagttccaatgaatctgaccttttgggacagcggtg

SEQ ID NO: 440316 - DNA, 140 bp, Artificial Sequence
  Synthetic
caccgctgtcccaaaaggtcagattcattggaacttagccagatctctctccaaaaagacaaaccttctgagacagggtctgagaactgacgtatgtggaaccttccaagagacatcccacatatcagcagccagggcct

SEQ ID NO: 440317 - DNA, 140 bp, Artificial Sequence
  Synthetic
atacgccatgctgggtctccattttcgaagctagcagatgccgaagctctcagaccaggtaccctgaaaaaaacgagatcccaaatcagaacctctgattgtttgatcattttttttgtccgtacttgggagtcggccat

SEQ ID NO: 440318 - DNA, 140 bp, Artificial Sequence
  Synthetic
atggccgactcccaagtacggacaaaaaaaatgatcaaacaatcagaggttctgatttgggatctcgtttttttcagggtacctggtctgagagcttcggcatctgctagcttcgaaaatggagacccagcatggcgtat

SEQ ID NO: 440319 - DNA, 140 bp, Artificial Sequence
  Synthetic
aggccctggctgctgatatgctatggaaagatttgacctccgtagatattgggaaggacttggtaaagttcaaagatcaaatatgggggctactaattgtgacaaaggactttgtttactgaccttttgggacagcggtg

SEQ ID NO: 440320 - DNA, 140 bp, Artificial Sequence
  Synthetic
caccgctgtcccaaaaggtcagtaaacaaagtcctttgtcacaattagtagcccccatatttgatctttgaactttaccaagtccttcccaatatctacggaggtcaaatctttccatagcatatcagcagccagggcct

SEQ ID NO: 440321 - DNA, 140 bp, Artificial Sequence
  Synthetic
atacgccatgctgggtctccttagaggaggggccagtcccactattctcctcaaagatgcaatcaggaaggctctgtatgatgaggtagacaaggtggagaactcagagtttagggaagccgtacttgggagtcggccat

SEQ ID NO: 440322 - DNA, 140 bp, Artificial Sequence
  Synthetic
atggccgactcccaagtacggcttccctaaactctgagttctccaccttgtctacctcatcatacagagccttcctgattgcatctttgaggagaatagtgggactggcccctcctctaaggagacccagcatggcgtat

SEQ ID NO: 440323 - DNA, 140 bp, Artificial Sequence
  Synthetic
atacgccatgctgggtctccttcctggggattcctgagtcgatcatcgggttgatacaaaattccagaacaataagaagacagtttaggaggagtctctcaagagctctggaagagtcctcgtacttgggagtcggccat

SEQ ID NO: 440324 - DNA, 140 bp, Artificial Sequence
  Synthetic
atggccgactcccaagtacgaggactcttccagagctcttgagagactcctcctaaactgtcttcttattgttctggaattttgtatcaacccgatgatcgactcaggaatccccaggaaggagacccagcatggcgtat

SEQ ID NO: 440325 - DNA, 140 bp, Artificial Sequence
  Synthetic
atacgccatgctgggtctcctttctagaacacacgagttttttcagaagtcctggatctattattcagacagatcagacctcatcgggttatgggaggatcagatatactgcttggatatcgtacttgggagtcggccat

SEQ ID NO: 440326 - DNA, 140 bp, Artificial Sequence
  Synthetic
atggccgactcccaagtacgatatccaagcagtatatctgatcctcccataacccgatgaggtctgatctgtctgaataatagatccaggacttctgaaaaaactcgtgtgttctagaaaggagacccagcatggcgtat

SEQ ID NO: 440327 - DNA, 140 bp, Artificial Sequence
  Synthetic
aggccctggctgctgatatgaagacaaggtgagtcaacttgaagggacgtttggtcccagtgcaaaaaggttttttagagttctggatcaatttgacaatatacatgacctggtttttgtgaccttttgggacagcggtg

SEQ ID NO: 440328 - DNA, 140 bp, Artificial Sequence
  Synthetic
caccgctgtcccaaaaggtcacaaaaaccaggtcatgtatattgtcaaattgatccagaactctaaaaaacctttttgcactgggaccaaacgtcccttcaagttgactcaccttgtcttcatatcagcagccagggcct

SEQ ID NO: 440329 - DNA, 140 bp, Artificial Sequence
  Synthetic
atacgccatgctgggtctccagagatttcatgggggaggaaggtggtcggcacaacagtccctcatccctctgagatgttggggttgattcctaaatcctcaatttcctgtacttgcggacgtacttgggagtcggccat

SEQ ID NO: 440330 - DNA, 140 bp, Artificial Sequence
  Synthetic
atggccgactcccaagtacgtccgcaagtacaggaaattgaggatttaggaatcaaccccaacatctcagagggatgagggactgttgtgccgaccaccttcctcccccatgaaatctctggagacccagcatggcgtat

SEQ ID NO: 440331 - DNA, 140 bp, Artificial Sequence
  Synthetic
aggccctggctgctgatatggtacggatgttacagacattgggggcatccttatatagactatagaaagggtctgtcgaagttatatgatcaagttcatatcaagaaggtgatagacaaggaccttttgggacagcggtg

SEQ ID NO: 440332 - DNA, 140 bp, Artificial Sequence
  Synthetic
caccgctgtcccaaaaggtccttgtctatcaccttcttgatatgaacttgatcatataacttcgacagaccctttctatagtctatataaggatgcccccaatgtctgtaacatccgtaccatatcagcagccagggcct

SEQ ID NO: 440333 - DNA, 140 bp, Artificial Sequence
  Synthetic
aggccctggctgctgatatgaagatagtgaagactaccagactcgttggcagcatagaagatctatcaggagaggtagaacgacacctgcatgggtacaacagatggatcaccctcgagggaccttttgggacagcggtg

SEQ ID NO: 440334 - DNA, 140 bp, Artificial Sequence
  Synthetic
caccgctgtcccaaaaggtccctcgagggtgatccatctgttgtacccatgcaggtgtcgttctacctctcctgatagatcttctatgctgccaacgagtctggtagtcttcactatcttcatatcagcagccagggcct

SEQ ID NO: 440335 - DNA, 140 bp, Artificial Sequence
  Synthetic
atacgccatgctgggtctccagaaggcaacagatcgattttgtgttatctccaacatgtgctgcgctatgagcgggaggtgatcacggcgtctcctgagaatgactggttgtggatcttccgtacttgggagtcggccat

SEQ ID NO: 440336 - DNA, 140 bp, Artificial Sequence
  Synthetic
atggccgactcccaagtacggaagatccacaaccagtcattctcaggagacgccgtgatcacctcccgctcatagcgcagcacatgttggagataacacaaaatcgatctgttgccttctggagacccagcatggcgtat

SEQ ID NO: 440337 - DNA, 140 bp, Artificial Sequence
  Synthetic
aggccctggctgctgatatgaagaccatcccttaaatccttatatcaaaactcagacatggccacccaaacacatagtagatttggtaggggatacatggcataaactcccaatcacacagaccttttgggacagcggtg

SEQ ID NO: 440338 - DNA, 140 bp, Artificial Sequence
  Synthetic
caccgctgtcccaaaaggtctgtgtgattgggagtttatgccatgtatcccctaccaaatctactatgtgtttgggtggccatgtctgagttttgatataaggatttaagggatggtcttcatatcagcagccagggcct

SEQ ID NO: 440339 - DNA, 140 bp, Artificial Sequence
  Synthetic
atacgccatgctgggtctcccacatagtagatttggtaggggatacatggcataaactcccaatcacacaaatatttgaaatccctgaatccatggatccatcagagatactggatgacacgtacttgggagtcggccat

SEQ ID NO: 440340 - DNA, 140 bp, Artificial Sequence
  Synthetic
atggccgactcccaagtacgtgtcatccagtatctctgatggatccatggattcagggatttcaaatatttgtgtgattgggagtttatgccatgtatcccctaccaaatctactatgtgggagacccagcatggcgtat

SEQ ID NO: 440341 - DNA, 140 bp, Artificial Sequence
  Synthetic
atacgccatgctgggtctccctctgacaggcccggactttcctctggaagaagcacctgtattcaagaggacagggtctgccttgcacagattcaagtcagccaggtacagtgaagggggcgtacttgggagtcggccat

SEQ ID NO: 440342 - DNA, 140 bp, Artificial Sequence
  Synthetic
atggccgactcccaagtacgcccccttcactgtacctggctgacttgaatctgtgcaaggcagaccctgtcctcttgaatacaggtgcttcttccagaggaaagtccgggcctgtcagagggagacccagcatggcgtat

SEQ ID NO: 440343 - DNA, 140 bp, Artificial Sequence
  Synthetic
aggccctggctgctgatatgtaggatcctcgatttgcttcttgacaagaatgacaaatatcaatattaatagacctcttgaattgatctcaggggtaatctcatatattctcctgaggctgaccttttgggacagcggtg

SEQ ID NO: 440344 - DNA, 140 bp, Artificial Sequence
  Synthetic
caccgctgtcccaaaaggtcagcctcaggagaatatatgagattacccctgagatcaattcaagaggtctattaatattgatatttgtcattcttgtcaagaagcaaatcgaggatcctacatatcagcagccagggcct

SEQ ID NO: 440345 - DNA, 140 bp, Artificial Sequence
  Synthetic
aggccctggctgctgatatgtttagcccaatcttaaagggcagagtttataagattctgagtgctgaaggggagagttttctcctagccatgtcgaggataatctatctcgatccttcttgaccttttgggacagcggtg

SEQ ID NO: 440346 - DNA, 140 bp, Artificial Sequence
  Synthetic
caccgctgtcccaaaaggtcaagaaggatcgagatagattatcctcgacatggctaggagaaaactctccccttcagcactcagaatcttataaactctgccctttaagattgggctaaacatatcagcagccagggcct

SEQ ID NO: 440347 - DNA, 140 bp, Artificial Sequence
  Synthetic
atacgccatgctgggtctccgcctcattttcgaaaacttcctgatattcgtttaaaaccgggtgacttcgaatctctaagtggcaaggagagatcacgccatatagggtcagctcaagggcgtacttgggagtcggccat

SEQ ID NO: 440348 - DNA, 140 bp, Artificial Sequence
  Synthetic
atggccgactcccaagtacgcccttgagctgaccctatatggcgtgatctctccttgccacttagagattcgaagtcacccggttttaaacgaatatcaggaagttttcgaaaatgaggcggagacccagcatggcgtat

SEQ ID NO: 440349 - DNA, 140 bp, Artificial Sequence
  Synthetic
atacgccatgctgggtctcctctccatctggactatgaaaagtggaacaatcaccaaaggttggagtcaacagaagatgtattttcggtcctggatcaggtgtttggattgaaaagggtgcgtacttgggagtcggccat

SEQ ID NO: 440350 - DNA, 140 bp, Artificial Sequence
  Synthetic
atggccgactcccaagtacgcacccttttcaatccaaacacctgatccaggaccgaaaatacatcttctgttgactccaacctttggtgattgttccacttttcatagtccagatggagaggagacccagcatggcgtat

SEQ ID NO: 440351 - DNA, 140 bp, Artificial Sequence
  Synthetic
aggccctggctgctgatatgtgcaatcaggaaggctttgtatgacgaggtggataaggtggaaaattcagagtttcgagaggcaatcctgttgtccaagacccatagagataatttcatagaccttttgggacagcggtg

SEQ ID NO: 440352 - DNA, 140 bp, Artificial Sequence
  Synthetic
caccgctgtcccaaaaggtctatgaaattatctctatgggtcttggacaacaggattgcctctcgaaactctgaattttccaccttatccacctcgtcatacaaagccttcctgattgcacatatcagcagccagggcct

SEQ ID NO: 440353 - DNA, 140 bp, Artificial Sequence
  Synthetic
atacgccatgctgggtctcctaagagggctcgcgagaggagtcttgatagggtcttcgatttgcttcttgacaagaatgacgaatattaacatcaatcgacctcttgaactgatctccggcgtacttgggagtcggccat

SEQ ID NO: 440354 - DNA, 140 bp, Artificial Sequence
  Synthetic
atggccgactcccaagtacgccggagatcagttcaagaggtcgattgatgttaatattcgtcattcttgtcaagaagcaaatcgaagaccctatcaagactcctctcgcgagccctcttaggagacccagcatggcgtat

SEQ ID NO: 440355 - DNA, 140 bp, Artificial Sequence
  Synthetic
atacgccatgctgggtctccctcttcttaaaatctgttgagcctctgtttcctcgatttctcagtgagcttttcagctcgtcttttttgggaatccctgagtcaatcattggactgataccgtacttgggagtcggccat

SEQ ID NO: 440356 - DNA, 140 bp, Artificial Sequence
  Synthetic
atggccgactcccaagtacggtatcagtccaatgattgactcagggattcccaaaaaagacgagctgaaaagctcactgagaaatcgaggaaacagaggctcaacagattttaagaagagggagacccagcatggcgtat

SEQ ID NO: 440357 - DNA, 140 bp, Artificial Sequence
  Synthetic
aggccctggctgctgatatgaaaactcccggacaataagaaggcagtttagaaagagcctctcaagaactttagaagaatccttctacaactcagagatccacgggattactcggatgacgaccttttgggacagcggtg

SEQ ID NO: 440358 - DNA, 140 bp, Artificial Sequence
  Synthetic
caccgctgtcccaaaaggtcgtcatccgagtaatcccgtggatctctgagttgtagaaggattcttctaaagttcttgagaggctctttctaaactgccttcttattgtccgggagttttcatatcagcagccagggcct

SEQ ID NO: 440359 - DNA, 140 bp, Artificial Sequence
  Synthetic
aggccctggctgctgatatgaggttctatgtccgacatatatgctgtcccctgggctgtcgagagaggggcttctctatgaattggagagcatatcgaggaatgccctttctatataccggaccttttgggacagcggtg

SEQ ID NO: 440360 - DNA, 140 bp, Artificial Sequence
  Synthetic
caccgctgtcccaaaaggtccggtatatagaaagggcattcctcgatatgctctccaattcatagagaagcccctctctcgacagcccaggggacagcatatatgtcggacatagaacctcatatcagcagccagggcct

SEQ ID NO: 440361 - DNA, 140 bp, Artificial Sequence
  Synthetic
atacgccatgctgggtctccaggcaacagatcaatcttgtgttatctccaacatgtgttacgatatgagcgagaggtaatcacggcgtctccagagaatgactggctgtggatcttctcccgtacttgggagtcggccat

SEQ ID NO: 440362 - DNA, 140 bp, Artificial Sequence
  Synthetic
atggccgactcccaagtacgggagaagatccacagccagtcattctctggagacgccgtgattacctctcgctcatatcgtaacacatgttggagataacacaagattgatctgttgcctggagacccagcatggcgtat

SEQ ID NO: 440363 - DNA, 140 bp, Artificial Sequence
  Synthetic
atacgccatgctgggtctccgagggtcgagaaaaatctctccaaaagcatgagagccaacctacgacaaatgagctctctaatgagacaggtgttgggtgggcatggtgaagatacattacgtacttgggagtcggccat

SEQ ID NO: 440364 - DNA, 140 bp, Artificial Sequence
  Synthetic
atggccgactcccaagtacgtaatgtatcttcaccatgcccacccaacacctgtctcattagagagctcatttgtcgtaggttggctctcatgcttttggagagatttttctcgaccctcggagacccagcatggcgtat

SEQ ID NO: 440365 - DNA, 140 bp, Artificial Sequence
  Synthetic
aggccctggctgctgatatggaggagggccggtccccagtgagaaggtcattattacggctctttccaggcctcctgtcaaccccagagaattcttgaaatctatagacctaggaggattgaccttttgggacagcggtg

SEQ ID NO: 440366 - DNA, 140 bp, Artificial Sequence
  Synthetic
caccgctgtcccaaaaggtcaatcctcctaggtctatagatttcaagaattctctggggttgacaggaggcctggaaagagccgtaataatgaccttctcactggggaccggccctcctccatatcagcagccagggcct

SEQ ID NO: 440367 - DNA, 140 bp, Artificial Sequence
  Synthetic
aggccctggctgctgatatgatgagggactttctacttatgtcagtacaggcagtctttcattacttgttgttcagtccaatcctaaaaggcagagtttacaagattttgagtgcagaaggaccttttgggacagcggtg

SEQ ID NO: 440368 - DNA, 140 bp, Artificial Sequence
  Synthetic
caccgctgtcccaaaaggtccttctgcactcaaaatcttgtaaactctgccttttaggattggactgaacaacaagtaatgaaagactgcctgtactgacataagtagaaagtccctcatcatatcagcagccagggcct

SEQ ID NO: 440369 - DNA, 140 bp, Artificial Sequence
  Synthetic
aggccctggctgctgatatggttacagccccaacaagaagatgtcacgcaaagcagggtgttcagaatgggtatgctctgctcaacaggttgcggtttcaacctcagcgaacccagccccgaccttttgggacagcggtg

SEQ ID NO: 440370 - DNA, 140 bp, Artificial Sequence
  Synthetic
caccgctgtcccaaaaggtcggggctgggttcgctgaggttgaaaccgcaacctgttgagcagagcatacccattctgaacaccctgctttgcgtgacatcttcttgttggggctgtaaccatatcagcagccagggcct

SEQ ID NO: 440371 - DNA, 140 bp, Artificial Sequence
  Synthetic
atacgccatgctgggtctcccttaaacctattctggatgatctcaatgtcttcccatctctatgtcttgtggttggggatggatcaggggggatctcaagagcagtacttaacatgtttccgtacttgggagtcggccat

SEQ ID NO: 440372 - DNA, 140 bp, Artificial Sequence
  Synthetic
atggccgactcccaagtacggaaacatgttaagtactgctcttgagatcccccctgatccatccccaaccacaagacatagagatgggaagacattgagatcatccagaataggtttaagggagacccagcatggcgtat

SEQ ID NO: 440373 - DNA, 140 bp, Artificial Sequence
  Synthetic
aggccctggctgctgatatgagctggtacagagagacacaaggctgaaagactctacatttcattggcacctccggtgcaacaggtgtgtaaggcctattgacgatataacactggagacgaccttttgggacagcggtg

SEQ ID NO: 440374 - DNA, 140 bp, Artificial Sequence
  Synthetic
caccgctgtcccaaaaggtcgtctccagtgttatatcgtcaataggccttacacacctgttgcaccggaggtgccaatgaaatgtagagtctttcagccttgtgtctctctgtaccagctcatatcagcagccagggcct

SEQ ID NO: 440375 - DNA, 140 bp, Artificial Sequence
  Synthetic
aggccctggctgctgatatgatgctatcagaaaggccctgtatgacgaggtggacaaggtggaaaactcggagtttagagaggcaattctcttgtccaagacccatagggacaactttatgaccttttgggacagcggtg

SEQ ID NO: 440376 - DNA, 140 bp, Artificial Sequence
  Synthetic
caccgctgtcccaaaaggtcataaagttgtccctatgggtcttggacaagagaattgcctctctaaactccgagttttccaccttgtccacctcgtcatacagggcctttctgatagcatcatatcagcagccagggcct

SEQ ID NO: 440377 - DNA, 140 bp, Artificial Sequence
  Synthetic
atacgccatgctgggtctcctgacatcatatccagagtgattgactttgattccatctgggagaaaccttctgatttgagaaacctggctacatggaaatacttccagtcagtccaagagcgtacttgggagtcggccat

SEQ ID NO: 440378 - DNA, 140 bp, Artificial Sequence
  Synthetic
atggccgactcccaagtacgctcttggactgactggaagtatttccatgtagccaggtttctcaaatcagaaggtttctcccagatggaatcaaagtcaatcactctggatatgatgtcaggagacccagcatggcgtat

SEQ ID NO: 440379 - DNA, 140 bp, Artificial Sequence
  Synthetic
aggccctggctgctgatatgttttcagctcgtctttcttggggatccctgagtcaatcattggattgatacaaaactcgcggacaataagaagacagtttagaaaaagtctctcaagaacgaccttttgggacagcggtg

SEQ ID NO: 440380 - DNA, 140 bp, Artificial Sequence
  Synthetic
caccgctgtcccaaaaggtcgttcttgagagactttttctaaactgtcttcttattgtccgcgagttttgtatcaatccaatgattgactcagggatccccaagaaagacgagctgaaaacatatcagcagccagggcct

SEQ ID NO: 440381 - DNA, 140 bp, Artificial Sequence
  Synthetic
atacgccatgctgggtctcccatcgcgtcaatcaaccgaataaccctgctaatgtctgatttcgcattgtccatagatggcccgctttatttggttttcaaaacttatggcaccatgctgcgtacttgggagtcggccat

SEQ ID NO: 440382 - DNA, 140 bp, Artificial Sequence
  Synthetic
atggccgactcccaagtacgcagcatggtgccataagttttgaaaaccaaataaagcgggccatctatggacaatgcgaaatcagacattagcagggttattcggttgattgacgcgatgggagacccagcatggcgtat

SEQ ID NO: 440383 - DNA, 140 bp, Artificial Sequence
  Synthetic
aggccctggctgctgatatgggatcaggttgatttacaagatagtgaagactaccagactcgttggcagcatagaagatctatcaggagaggtagaacgacacctgcatgggtacaacaggaccttttgggacagcggtg

SEQ ID NO: 440384 - DNA, 140 bp, Artificial Sequence
  Synthetic
caccgctgtcccaaaaggtcctgttgtacccatgcaggtgtcgttctacctctcctgatagatcttctatgctgccaacgagtctggtagtcttcactatcttgtaaatcaacctgatcccatatcagcagccagggcct

SEQ ID NO: 440385 - DNA, 140 bp, Artificial Sequence
  Synthetic
aggccctggctgctgatatggcagatctcttaagagagatttcttgggggaggaaagtggtgggcacaactgttcctcacccctctgagatgttggggctgcttcctaagtcctctatttgaccttttgggacagcggtg

SEQ ID NO: 440386 - DNA, 140 bp, Artificial Sequence
  Synthetic
caccgctgtcccaaaaggtcaaatagaggacttaggaagcagccccaacatctcagaggggtgaggaacagttgtgcccaccactttcctcccccaagaaatctctcttaagagatctgccatatcagcagccagggcct

SEQ ID NO: 440387 - DNA, 140 bp, Artificial Sequence
  Synthetic
aggccctggctgctgatatgaccttcgattctcaaaacggggaaagttctttcgggatgcagaatatttgacctcttctactcttcgagaaatgagccttgtattgttcaactgtagcaggaccttttgggacagcggtg

SEQ ID NO: 440388 - DNA, 140 bp, Artificial Sequence
  Synthetic
caccgctgtcccaaaaggtcctgctacagttgaacaatacaaggctcatttctcgaagagtagaagaggtcaaatattctgcatcccgaaagaactttccccgttttgagaatcgaaggtcatatcagcagccagggcct

SEQ ID NO: 440389 - DNA, 140 bp, Artificial Sequence
  Synthetic
aggccctggctgctgatatgccctctttgtacataatgctcagagaaccgtccctcagaggagagatattttctatcccccagaaaatccccgccgcttatccaaccactatgaaagaaggaccttttgggacagcggtg

SEQ ID NO: 440390 - DNA, 140 bp, Artificial Sequence
  Synthetic
caccgctgtcccaaaaggtccttctttcatagtggttggataagcggcggggattttctgggggatagaaaatatctctcctctgagggacggttctctgagcattatgtacaaagagggcatatcagcagccagggcct

SEQ ID NO: 440391 - DNA, 140 bp, Artificial Sequence
  Synthetic
atacgccatgctgggtctccataactctgattgacagtgatgtagaatctttcctggttcacaagatggtggatgatctggagttacagcgaggaactttgtctaaagtctctatcattacgtacttgggagtcggccat

SEQ ID NO: 440392 - DNA, 140 bp, Artificial Sequence
  Synthetic
atggccgactcccaagtacgtaatgatagagactttagacaaagttcctcgctgtaactccagatcatccaccatcttgtgaaccaggaaagattctacatcactgtcaatcagagttatggagacccagcatggcgtat

SEQ ID NO: 440393 - DNA, 140 bp, Artificial Sequence
  Synthetic
aggccctggctgctgatatgatctcctactccagagggttgagagaaacctgtctaagagtatgagagctaacctgcgacaaatgagttccttgatgaggcaggtgctgggtgggcacgggaccttttgggacagcggtg

SEQ ID NO: 440394 - DNA, 140 bp, Artificial Sequence
  Synthetic
caccgctgtcccaaaaggtcccgtgcccacccagcacctgcctcatcaaggaactcatttgtcgcaggttagctctcatactcttagacaggtttctctcaaccctctggagtaggagatcatatcagcagccagggcct

SEQ ID NO: 440395 - DNA, 140 bp, Artificial Sequence
  Synthetic
atacgccatgctgggtctcccttcaacatatgctgcagtactatgatgtacttgtccacagctttaggggatgtatccagctttgcaagacttcatgaactgtacaacaggcccataacccgtacttgggagtcggccat

SEQ ID NO: 440396 - DNA, 140 bp, Artificial Sequence
  Synthetic
atggccgactcccaagtacgggttatgggcctgttgtacagttcatgaagtcttgcaaagctggatacatcccctaaagctgtggacaagtacatcatagtactgcagcatatgttgaagggagacccagcatggcgtat

SEQ ID NO: 440397 - DNA, 140 bp, Artificial Sequence
  Synthetic
aggccctggctgctgatatgatgttcagaatgggtctgttctgctcaacaggttgcagtctctacctcagcaaacccggcccttgtctcagagcttgacataagggccctctccaagagggaccttttgggacagcggtg

SEQ ID NO: 440398 - DNA, 140 bp, Artificial Sequence
  Synthetic
caccgctgtcccaaaaggtccctcttggagagggcccttatgtcaagctctgagacaagggccgggtttgctgaggtagagactgcaacctgttgagcagaacagacccattctgaacatcatatcagcagccagggcct

SEQ ID NO: 440399 - DNA, 140 bp, Artificial Sequence
  Synthetic
aggccctggctgctgatatgccttcgatgtaacaagtgtgtaaggcccatagatgatatcacactggagaccccccagatctttgagtttccagatgtgtcaaaaagaatatctaggatggaccttttgggacagcggtg

SEQ ID NO: 440400 - DNA, 140 bp, Artificial Sequence
  Synthetic
caccgctgtcccaaaaggtccatcctagatattctttttgacacatctggaaactcaaagatctggggggtctccagtgtgatatcatctatgggccttacacacttgttacatcgaaggcatatcagcagccagggcct

SEQ ID NO: 440401 - DNA, 140 bp, Artificial Sequence
  Synthetic
aggccctggctgctgatatggtgtctggagctgtgccccactttcaaaagcttcccgacatccatctgaaacccggagattttgaatctctaagtggtagggagaaatcccgccatataggaccttttgggacagcggtg

SEQ ID NO: 440402 - DNA, 140 bp, Artificial Sequence
  Synthetic
caccgctgtcccaaaaggtcctatatggcgggatttctccctaccacttagagattcaaaatctccgggtttcagatggatgtcgggaagcttttgaaagtggggcacagctccagacaccatatcagcagccagggcct

SEQ ID NO: 440403 - DNA, 140 bp, Artificial Sequence
  Synthetic
atacgccatgctgggtctccccctctgtcttgtagttggagacgggtcaggggggatctcaagggcagtcctcaacatgttcccagatgctaaacttgtgttcaacagccttttagaggtcgtacttgggagtcggccat

SEQ ID NO: 440404 - DNA, 140 bp, Artificial Sequence
  Synthetic
atggccgactcccaagtacgacctctaaaaggctgttgaacacaagtttagcatctgggaacatgttgaggactgcccttgagatcccccctgacccgtctccaactacaagacagagggggagacccagcatggcgtat

SEQ ID NO: 440405 - DNA, 140 bp, Artificial Sequence
  Synthetic
atacgccatgctgggtctccgtaatgaccaagactcagggatgatgtaccctgaaaaaaacgagatcccaattcatgacctctgttttttagactgtttttcccatctttattgttttttcgtacttgggagtcggccat

SEQ ID NO: 440406 - DNA, 140 bp, Artificial Sequence
  Synthetic
atggccgactcccaagtacgaaaaaacaataaagatgggaaaaacagtctaaaaaacagaggtcatgaattgggatctcgtttttttcagggtacatcatccctgagtcttggtcattacggagacccagcatggcgtat

SEQ ID NO: 440407 - DNA, 140 bp, Artificial Sequence
  Synthetic
aggccctggctgctgatatgacctagagactatttaagagggcttgcaagaggagtcttaatagggtcctcaatttgcttcttgactagaatgaccaacatcaacatcaataggcctcttgaccttttgggacagcggtg

SEQ ID NO: 440408 - DNA, 140 bp, Artificial Sequence
  Synthetic
caccgctgtcccaaaaggtcaagaggcctattgatgttgatgttggtcattctagtcaagaagcaaattgaggaccctattaagactcctcttgcaagccctcttaaatagtctctaggtcatatcagcagccagggcct

SEQ ID NO: 440409 - DNA, 140 bp, Artificial Sequence
  Synthetic
aggccctggctgctgatatgtgggaaaagccttccgacttgagaaacttggccacctggagatacttccagtcagtccaaaaacaggtcaacatgtcttatgacctcataatttgtgatggaccttttgggacagcggtg

SEQ ID NO: 440410 - DNA, 140 bp, Artificial Sequence
  Synthetic
caccgctgtcccaaaaggtccatcacaaattatgaggtcataagacatgttgacctgtttttggactgactggaagtatctccaggtggccaagtttctcaagtcggaaggcttttcccacatatcagcagccagggcct

SEQ ID NO: 440411 - DNA, 140 bp, Artificial Sequence
  Synthetic
aggccctggctgctgatatgctgggaaaagccgtcagatctgaggaacttgaccacctggaagtacttccagtcagtccaaaaacaggtgaacatgtcttatgacctaatcatttgtgacgaccttttgggacagcggtg

SEQ ID NO: 440412 - DNA, 140 bp, Artificial Sequence
  Synthetic
caccgctgtcccaaaaggtcgtcacaaatgattaggtcataagacatgttcacctgtttttggactgactggaagtacttccaggtggtcaagttcctcagatctgacggcttttcccagcatatcagcagccagggcct

SEQ ID NO: 440413 - DNA, 140 bp, Artificial Sequence
  Synthetic
atacgccatgctgggtctcctgggactatgctagtaaacccagactataaggctgttcaacacctgtcaagagcgttcccctcagtcacagggtttataacccaagtgacttcatcctttcgtacttgggagtcggccat

SEQ ID NO: 440414 - DNA, 140 bp, Artificial Sequence
  Synthetic
atggccgactcccaagtacgaaaggatgaagtcacttgggttataaaccctgtgactgaggggaacgctcttgacaggtgttgaacagccttatagtctgggtttactagcatagtcccaggagacccagcatggcgtat

SEQ ID NO: 440415 - DNA, 140 bp, Artificial Sequence
  Synthetic
aggccctggctgctgatatgagaggttattacagcatcccctgagaatgactggttgtggatcttctcggactttagaagttccaaaatgacgtacctaactctcatcacctatcagtctgaccttttgggacagcggtg

SEQ ID NO: 440416 - DNA, 140 bp, Artificial Sequence
  Synthetic
caccgctgtcccaaaaggtcagactgataggtgatgagagttaggtacgtcattttggaacttctaaagtccgagaagatccacaaccagtcattctcaggggatgctgtaataacctctcatatcagcagccagggcct

SEQ ID NO: 440417 - DNA, 140 bp, Artificial Sequence
  Synthetic
atacgccatgctgggtctccactttagaagttccaaaatgacgtacctaactctcatcacctatcagtctcatctactacttcagagagttgaaagaaatctatctaagagcatgagagccgtacttgggagtcggccat

SEQ ID NO: 440418 - DNA, 140 bp, Artificial Sequence
  Synthetic
atggccgactcccaagtacggctctcatgctcttagatagatttctttcaactctctgaagtagtagatgagactgataggtgatgagagttaggtacgtcattttggaacttctaaagtggagacccagcatggcgtat

SEQ ID NO: 440419 - DNA, 140 bp, Artificial Sequence
  Synthetic
atacgccatgctgggtctcctcaactgtagcagccccaagagtgagatgcagagagctcgttccttgaactatcaagatcttgtaaggggattccctgaagaaatcatatcaaatccttacgtacttgggagtcggccat

SEQ ID NO: 440420 - DNA, 140 bp, Artificial Sequence
  Synthetic
atggccgactcccaagtacgtaaggatttgatatgatttcttcagggaatccccttacaagatcttgatagttcaaggaacgagctctctgcatctcactcttggggctgctacagttgaggagacccagcatggcgtat

SEQ ID NO: 440421 - DNA, 140 bp, Artificial Sequence
  Synthetic
aggccctggctgctgatatggagaagataccttagaatcggacgacgacattcagaggctactgaaagactctctgcgcagaacgaggtgggtggatcaagaagtgcgccatgcagccaggaccttttgggacagcggtg

SEQ ID NO: 440422 - DNA, 140 bp, Artificial Sequence
  Synthetic
caccgctgtcccaaaaggtcctggctgcatggcgcacttcttgatccacccacctcgttctgcgcagagagtctttcagtagcctctgaatgtcgtcgtccgattctaaggtatcttctccatatcagcagccagggcct

SEQ ID NO: 440423 - DNA, 140 bp, Artificial Sequence
  Synthetic
atacgccatgctgggtctcctctctgcgcagaacgaggtgggtggatcaagaagtgcgccatgcagccagaaccatgatcggggattacagccctaacaaaaagatgtcacgcaaggcagcgtacttgggagtcggccat

SEQ ID NO: 440424 - DNA, 140 bp, Artificial Sequence
  Synthetic
atggccgactcccaagtacgctgccttgcgtgacatctttttgttagggctgtaatccccgatcatggttctggctgcatggcgcacttcttgatccacccacctcgttctgcgcagagaggagacccagcatggcgtat

SEQ ID NO: 440425 - DNA, 140 bp, Artificial Sequence
  Synthetic
atacgccatgctgggtctcctccacaagatggtggatgaccttgagttacagaggggaactctgtctaaaatggctatcattatagccatcatgatagttttctccaacagagtattcaacgtacttgggagtcggccat

SEQ ID NO: 440426 - DNA, 140 bp, Artificial Sequence
  Synthetic
atggccgactcccaagtacgttgaatactctgttggagaaaactatcatgatggctataatgatagccattttagacagagttcccctctgtaactcaaggtcatccaccatcttgtggaggagacccagcatggcgtat

SEQ ID NO: 440427 - DNA, 140 bp, Artificial Sequence
  Synthetic
aggccctggctgctgatatggacatgtttttctcccggattgaacatctgtattcagcgattagagtaggcacagttgtcactgcttatgaggattgctcaggactggtgtcatttacaggaccttttgggacagcggtg

SEQ ID NO: 440428 - DNA, 140 bp, Artificial Sequence
  Synthetic
caccgctgtcccaaaaggtcctgtaaatgacaccagtcctgagcaatcctcataagcagtgacaactgtgcctactctaatcgctgaatacagatgttcaatccgggagaaaaacatgtccatatcagcagccagggcct

SEQ ID NO: 440429 - DNA, 140 bp, Artificial Sequence
  Synthetic
aggccctggctgctgatatggtttcagaaccctcttatctcaggcttgagagtggttcagtgggcaactggtgcccattataagctcaagcccattctagatgatctcaatgttttcccagaccttttgggacagcggtg

SEQ ID NO: 440430 - DNA, 140 bp, Artificial Sequence
  Synthetic
caccgctgtcccaaaaggtctgggaaaacattgagatcatctagaatgggcttgagcttataatgggcaccagttgcccactgaaccactctcaagcctgagataagagggttctgaaaccatatcagcagccagggcct

SEQ ID NO: 440431 - DNA, 140 bp, Artificial Sequence
  Synthetic
aggccctggctgctgatatgtccctatgtctcgtggtcggggatggatcaggagggatatctagagcagtgctcaacatgttcccagatgccaggcttgtattcaacagcctgttggagggaccttttgggacagcggtg

SEQ ID NO: 440432 - DNA, 140 bp, Artificial Sequence
  Synthetic
caccgctgtcccaaaaggtccctccaacaggctgttgaatacaagcctggcatctgggaacatgttgagcactgctctagatatccctcctgatccatccccgaccacgagacatagggacatatcagcagccagggcct

SEQ ID NO: 440433 - DNA, 140 bp, Artificial Sequence
  Synthetic
aggccctggctgctgatatggatagtgaagactactagactcgttggcagcgccgaggacctgtccggagaggtggaaagacaccttcatgggtacaataggtggatcacccttgaggatgaccttttgggacagcggtg

SEQ ID NO: 440434 - DNA, 140 bp, Artificial Sequence
  Synthetic
caccgctgtcccaaaaggtcatcctcaagggtgatccacctattgtacccatgaaggtgtctttccacctctccggacaggtcctcggcgctgccaacgagtctagtagtcttcactatccatatcagcagccagggcct

SEQ ID NO: 440435 - DNA, 140 bp, Artificial Sequence
  Synthetic
aggccctggctgctgatatgctgggagaaaccatcagacctgaggaacttgacaacatggaagtacttccagtcagtccaaagaaaggttaacatgtcttatgacctcatcatttgtgatgaccttttgggacagcggtg

SEQ ID NO: 440436 - DNA, 140 bp, Artificial Sequence
  Synthetic
caccgctgtcccaaaaggtcatcacaaatgatgaggtcataagacatgttaacctttctttggactgactggaagtacttccatgttgtcaagttcctcaggtctgatggtttctcccagcatatcagcagccagggcct

SEQ ID NO: 440437 - DNA, 140 bp, Artificial Sequence
  Synthetic
aggccctggctgctgatatgcagctctaatcatcaaactcgccctaactcgtttgctgaatttttaaacaagacatattcgagtgactcttaaagagttgaacaacaagatggtaagcacgaccttttgggacagcggtg

SEQ ID NO: 440438 - DNA, 140 bp, Artificial Sequence
  Synthetic
caccgctgtcccaaaaggtcgtgcttaccatcttgttgttcaactctttaagagtcactcgaatatgtcttgtttaaaaattcagcaaacgagttagggcgagtttgatgattagagctgcatatcagcagccagggcct

SEQ ID NO: 440439 - DNA, 140 bp, Artificial Sequence
  Synthetic
aggccctggctgctgatatgtgttgtggtgccattaagccgctgcatttcatcaaagtcaagttaatcacctttacagtttgagcctcgtggatgtgaaaaaaactattaacatccctcagaccttttgggacagcggtg

SEQ ID NO: 440440 - DNA, 140 bp, Artificial Sequence
  Synthetic
caccgctgtcccaaaaggtctgagggatgttaatagtttttttcacatccacgaggctcaaactgtaaaggtgattaacttgactttgatgaaatgcagcggcttaatggcaccacaacacatatcagcagccagggcct

SEQ ID NO: 440441 - DNA, 140 bp, Artificial Sequence
  Synthetic
aggccctggctgctgatatgttcaactgcagcagccccaagagtgagatgcagagagcccgctctttaaattatcaggatcttgtaagaggattccccgaggagattatctccaatccttgaccttttgggacagcggtg

SEQ ID NO: 440442 - DNA, 140 bp, Artificial Sequence
  Synthetic
caccgctgtcccaaaaggtcaaggattggagataatctcctcggggaatcctcttacaagatcctgataatttaaagagcgggctctctgcatctcactcttggggctgctgcagttgaacatatcagcagccagggcct

SEQ ID NO: 440443 - DNA, 140 bp, Artificial Sequence
  Synthetic
atacgccatgctgggtctccgttcacaagatggtagacgatctagaattacagagaggaactctatctaagatgtctatcattatagctattatgatagtattctccaacagagttttcacgtacttgggagtcggccat

SEQ ID NO: 440444 - DNA, 140 bp, Artificial Sequence
  Synthetic
atggccgactcccaagtacgtgaaaactctgttggagaatactatcataatagctataatgatagacatcttagatagagttcctctctgtaattctagatcgtctaccatcttgtgaacggagacccagcatggcgtat

SEQ ID NO: 440445 - DNA, 140 bp, Artificial Sequence
  Synthetic
aggccctggctgctgatatgattgactagggaccctactgtctctgaacatgcgtctctggtcggtcttctcttgagtctgtataggttgagcaaaatatcaggacaaaacactggtaacgaccttttgggacagcggtg

SEQ ID NO: 440446 - DNA, 140 bp, Artificial Sequence
  Synthetic
caccgctgtcccaaaaggtcgttaccagtgttttgtcctgatattttgctcaacctatacagactcaagagaagaccgaccagagacgcatgttcagagacagtagggtccctagtcaatcatatcagcagccagggcct

SEQ ID NO: 440447 - DNA, 140 bp, Artificial Sequence
  Synthetic
aggccctggctgctgatatgaaaatcttgaggcacttcaacatatgctgcagtacaatgatgtatctgtcgacagctttaggtgatgtccccagctttgcaagacttcatgatttatacagaccttttgggacagcggtg

SEQ ID NO: 440448 - DNA, 140 bp, Artificial Sequence
  Synthetic
caccgctgtcccaaaaggtctgtataaatcatgaagtcttgcaaagctggggacatcacctaaagctgtcgacagatacatcattgtactgcagcatatgttgaagtgcctcaagattttcatatcagcagccagggcct

SEQ ID NO: 440449 - DNA, 140 bp, Artificial Sequence
  Synthetic
atacgccatgctgggtctccacagtcaactttcccggtgctccggggaagtccttaaaagaccaggctactcagactgctggccgtgaactctcgaaggagacaaagtctgcttcttctccgtacttgggagtcggccat

SEQ ID NO: 440450 - DNA, 140 bp, Artificial Sequence
  Synthetic
atggccgactcccaagtacggagaagaagcagactttgtctccttcgagagttcacggccagcagtctgagtagcctggtcttttaaggacttccccggagcaccgggaaagttgactgtggagacccagcatggcgtat

SEQ ID NO: 440451 - DNA, 140 bp, Artificial Sequence
  Synthetic
atacgccatgctgggtctccgtgctaattggagtactataccgaatttcagatttttggccggaacctacgacatgtttttctcccggattgagcatctatattcagcaatcagagtgggcgtacttgggagtcggccat

SEQ ID NO: 440452 - DNA, 140 bp, Artificial Sequence
  Synthetic
atggccgactcccaagtacgcccactctgattgctgaatatagatgctcaatccgggagaaaaacatgtcgtaggttccggccaaaaatctgaaattcggtatagtactccaattagcacggagacccagcatggcgtat

SEQ ID NO: 440453 - DNA, 140 bp, Artificial Sequence
  Synthetic
atacgccatgctgggtctccctgtaactctagcttgagtctgtcatctcactggatcaggctgatttacaagatagtgaagaccactagactcatcggaagtgtcgaagatctatcaagacgtacttgggagtcggccat

SEQ ID NO: 440454 - DNA, 140 bp, Artificial Sequence
  Synthetic
atggccgactcccaagtacgtcttgatagatcttcgacacttccgatgagtctagtggtcttcactatcttgtaaatcagcctgatccagtgagatgacagactcaagctagagttacagggagacccagcatggcgtat

SEQ ID NO: 440455 - DNA, 140 bp, Artificial Sequence
  Synthetic
aggccctggctgctgatatgggttcataaagcagatcaatctcaccgcaagagaagcaatactatacttcttccacaagaactttgaggaagagataagaagaatgtttgagccagggcagaccttttgggacagcggtg

SEQ ID NO: 440456 - DNA, 140 bp, Artificial Sequence
  Synthetic
caccgctgtcccaaaaggtctgccctggctcaaacattcttcttatctcttcctcaaagttcttgtggaagaagtatagtattgcttctcttgcggtgagattgatctgctttatgaacccatatcagcagccagggcct

SEQ ID NO: 440457 - DNA, 140 bp, Artificial Sequence
  Synthetic
atacgccatgctgggtctccctcattcactttgttggatgctatatgggtcaagtcagatccctaaatgcaacagttattgccgcatgtgctcctcatgagatgtctgttctagggggctcgtacttgggagtcggccat

SEQ ID NO: 440458 - DNA, 140 bp, Artificial Sequence
  Synthetic
atggccgactcccaagtacgagccccctagaacagacatctcatgaggagcacatgcggcaataactgttgcatttagggatctgacttgacccatatagcatccaacaaagtgaatgagggagacccagcatggcgtat

SEQ ID NO: 440459 - DNA, 140 bp, Artificial Sequence
  Synthetic
aggccctggctgctgatatggaactgatctcaggagtgatatcatacatcctcttgagactggacaatcacccatccttgtatataatgctcagagagccatcccttagaggagagatatgaccttttgggacagcggtg

SEQ ID NO: 440460 - DNA, 140 bp, Artificial Sequence
  Synthetic
caccgctgtcccaaaaggtcatatctctcctctaagggatggctctctgagcattatatacaaggatgggtgattgtccagtctcaagaggatgtatgatatcactcctgagatcagttccatatcagcagccagggcct

SEQ ID NO: 440461 - DNA, 140 bp, Artificial Sequence
  Synthetic
aggccctggctgctgatatgtcttgattgcaagaaaaggagataagatcaccccggattctcttgtggagataaagcgtactgatgtagaagggaattgggctttgacgggaggaatggagaccttttgggacagcggtg

SEQ ID NO: 440462 - DNA, 140 bp, Artificial Sequence
  Synthetic
caccgctgtcccaaaaggtctccattcctcccgtcaaagcccaattcccttctacatcagtacgctttatctccacaagagaatccggggtgatcttatctccttttcttgcaatcaagacatatcagcagccagggcct

SEQ ID NO: 440463 - DNA, 140 bp, Artificial Sequence
  Synthetic
aggccctggctgctgatatgctatcgattgtgtatatccatcatgaaaaaaactaacacccctcctttcgaaccatcccaaatatgagcaagattttcgtcaacccgagtgctatcagaggaccttttgggacagcggtg

SEQ ID NO: 440464 - DNA, 140 bp, Artificial Sequence
  Synthetic
caccgctgtcccaaaaggtcctctgatagcactcgggttgacgaaaatcttgctcatatttgggatggttcgaaaggaggggtgttagtttttttcatgatggatatacacaatcgatagcatatcagcagccagggcct

SEQ ID NO: 440465 - DNA, 140 bp, Artificial Sequence
  Synthetic
atacgccatgctgggtctccctctcattttccaatgggctgattccagaggccctctagaaggggaggaattggaatactctcaggagattacctgggatgatgatgcagaatttgtcggcgtacttgggagtcggccat

SEQ ID NO: 440466 - DNA, 140 bp, Artificial Sequence
  Synthetic
atggccgactcccaagtacgccgacaaattctgcatcatcatcccaggtaatctcctgagagtattccaattcctccccttctagagggcctctggaatcagcccattggaaaatgagagggagacccagcatggcgtat

SEQ ID NO: 440467 - DNA, 140 bp, Artificial Sequence
  Synthetic
atacgccatgctgggtctccaaaaacatagaagacaatcaggctcatctccagggggaacccatagaagtggacaatctccctgaggacatgcggcgacttcacctggatgatgggaaatcgtacttgggagtcggccat

SEQ ID NO: 440468 - DNA, 140 bp, Artificial Sequence
  Synthetic
atggccgactcccaagtacgatttcccatcatccaggtgaagtcgccgcatgtcctcagggagattgtccacttctatgggttccccctggagatgagcctgattgtcttctatgtttttggagacccagcatggcgtat

SEQ ID NO: 440469 - DNA, 140 bp, Artificial Sequence
  Synthetic
aggccctggctgctgatatggtgccaattggagtactataccaaacttcagattcttggcagggacctacgacatgtttttctcccggattgagcacctgtattcagcaatcagagtagggaccttttgggacagcggtg

SEQ ID NO: 440470 - DNA, 140 bp, Artificial Sequence
  Synthetic
caccgctgtcccaaaaggtccctactctgattgctgaatacaggtgctcaatccgggagaaaaacatgtcgtaggtccctgccaagaatctgaagtttggtatagtactccaattggcaccatatcagcagccagggcct

SEQ ID NO: 440471 - DNA, 140 bp, Artificial Sequence
  Synthetic
aggccctggctgctgatatgcctggacaatgttggagtccaaatagtcagacaaatgaggtcaggagagagattcctcaagatatggtcacagaccgtagaagagattatatcctatgtcgaccttttgggacagcggtg

SEQ ID NO: 440472 - DNA, 140 bp, Artificial Sequence
  Synthetic
caccgctgtcccaaaaggtcgacataggatataatctcttctacggtctgtgaccatatcttgaggaatctctctcctgacctcatttgtctgactatttggactccaacattgtccaggcatatcagcagccagggcct

SEQ ID NO: 440473 - DNA, 140 bp, Artificial Sequence
  Synthetic
aggccctggctgctgatatgacggtcaactttcccaaccctccaggaaggtccttggaggacaagtcaacccaaactactggtcgagagcccctgaaggagacaacatccactccttcccgaccttttgggacagcggtg

SEQ ID NO: 440474 - DNA, 140 bp, Artificial Sequence
  Synthetic
caccgctgtcccaaaaggtcgggaaggagtggatgttgtctccttcaggggctctcgaccagtagtttgggttgacttgtcctccaaggaccttcctggagggttgggaaagttgaccgtcatatcagcagccagggcct

SEQ ID NO: 440475 - DNA, 140 bp, Artificial Sequence
  Synthetic
atacgccatgctgggtctcctttacattttaagcttctctgatgtgaaaaaaactatcaacatccctcaaaagacctaaagaaagatgatctttcaggctcttctatttgtgcctctcctcgtacttgggagtcggccat

SEQ ID NO: 440476 - DNA, 140 bp, Artificial Sequence
  Synthetic
atggccgactcccaagtacgaggagaggcacaaatagaagagcctgaaagatcatctttctttaggtcttttgagggatgttgatagtttttttcacatcagagaagcttaaaatgtaaaggagacccagcatggcgtat

SEQ ID NO: 440477 - DNA, 140 bp, Artificial Sequence
  Synthetic
aggccctggctgctgatatgggccctccagctcttgaatggtctgctaccaatgaggaggatgatctatcagtagaggctgagatcgctcaccagattgctgaaagcttttccaagaagtgaccttttgggacagcggtg

SEQ ID NO: 440478 - DNA, 140 bp, Artificial Sequence
  Synthetic
caccgctgtcccaaaaggtcacttcttggaaaagctttcagcaatctggtgagcgatctcagcctctactgatagatcatcctcctcattggtagcagaccattcaagagctggagggcccatatcagcagccagggcct

SEQ ID NO: 440479 - DNA, 140 bp, Artificial Sequence
  Synthetic
atacgccatgctgggtctccagtagaggctgagatcgctcaccagattgctgaaagcttttccaagaagtacaagtttccctctcgatcttcagggatattcttgtataattttgagcagcgtacttgggagtcggccat

SEQ ID NO: 440480 - DNA, 140 bp, Artificial Sequence
  Synthetic
atggccgactcccaagtacgctgctcaaaattatacaagaatatccctgaagatcgagagggaaacttgtacttcttggaaaagctttcagcaatctggtgagcgatctcagcctctactggagacccagcatggcgtat

SEQ ID NO: 440481 - DNA, 140 bp, Artificial Sequence
  Synthetic
aggccctggctgctgatatgtgggatgggttgctttggccaattccaagaaattccaattgctagtagaggccgacaagctaagtaaaatcatgcaggatgatttgaatcgctatgcatcgaccttttgggacagcggtg

SEQ ID NO: 440482 - DNA, 140 bp, Artificial Sequence
  Synthetic
caccgctgtcccaaaaggtcgatgcatagcgattcaaatcatcctgcatgattttacttagcttgtcggcctctactagcaattggaatttcttggaattggccaaagcaacccatcccacatatcagcagccagggcct

SEQ ID NO: 440483 - DNA, 140 bp, Artificial Sequence
  Synthetic
aggccctggctgctgatatgacgggactatgctagtaaacccagactataaagctattcaacatctgtcaagagcgttcccttcagtcacagggtttataacccaagtaacctcgtccttgaccttttgggacagcggtg

SEQ ID NO: 440484 - DNA, 140 bp, Artificial Sequence
  Synthetic
caccgctgtcccaaaaggtcaaggacgaggttacttgggttataaaccctgtgactgaagggaacgctcttgacagatgttgaatagctttatagtctgggtttactagcatagtcccgtcatatcagcagccagggcct

SEQ ID NO: 440485 - DNA, 140 bp, Artificial Sequence
  Synthetic
aggccctggctgctgatatgcctctcccgtgtcagcccctccggatgacgatgacctgtggcttccaccccctgaatacgtcccactgaaagaactcacaagcaagaagaacatgaggaagaccttttgggacagcggtg

SEQ ID NO: 440486 - DNA, 140 bp, Artificial Sequence
  Synthetic
caccgctgtcccaaaaggtcttcctcatgttcttcttgcttgtgagttctttcagtgggacgtattcagggggtggaagccacaggtcatcgtcatccggaggggctgacacgggagaggcatatcagcagccagggcct

SEQ ID NO: 440487 - DNA, 140 bp, Artificial Sequence
  Synthetic
aggccctggctgctgatatggactttcagatggatgagggggaggatcctagcctcctcttccagtcatacctggacaatgttggagtacagatagtcagacaaatgaggtcaggagagagaccttttgggacagcggtg

SEQ ID NO: 440488 - DNA, 140 bp, Artificial Sequence
  Synthetic
caccgctgtcccaaaaggtctctctcctgacctcatttgtctgactatctgtactccaacattgtccaggtatgactggaagaggaggctaggatcctccccctcatccatctgaaagtccatatcagcagccagggcct

SEQ ID NO: 440489 - DNA, 140 bp, Artificial Sequence
  Synthetic
atacgccatgctgggtctcctcgacagggtcactgggcaagggcttttagactattcaagggtcacatatgcatttcacctggactatgagaagtggaacaatcatcaaagattagagtccgtacttgggagtcggccat

SEQ ID NO: 440490 - DNA, 140 bp, Artificial Sequence
  Synthetic
atggccgactcccaagtacggactctaatctttgatgattgttccacttctcatagtccaggtgaaatgcatatgtgacccttgaatagtctaaaagcccttgcccagtgaccctgtcgaggagacccagcatggcgtat

SEQ ID NO: 440491 - DNA, 140 bp, Artificial Sequence
  Synthetic
atacgccatgctgggtctccaatgatttctctctggctgtatggtgcccactctgagtcgaacaggagtcggagatgcatagccgaattagctcatttctattccaagtcatcccccatacgtacttgggagtcggccat

SEQ ID NO: 440492 - DNA, 140 bp, Artificial Sequence
  Synthetic
atggccgactcccaagtacgtatgggggatgacttggaatagaaatgagctaattcggctatgcatctccgactcctgttcgactcagagtgggcaccatacagccagagagaaatcattggagacccagcatggcgtat

SEQ ID NO: 440493 - DNA, 140 bp, Artificial Sequence
  Synthetic
aggccctggctgctgatatgagagagacagccaatcctcgaaagccaggatggtggctcaaaccgcctctggtcctccagcccttgaatggtctgctaccaacgaagaggatgatctatcgaccttttgggacagcggtg

SEQ ID NO: 440494 - DNA, 140 bp, Artificial Sequence
  Synthetic
caccgctgtcccaaaaggtcgatagatcatcctcttcgttggtagcagaccattcaagggctggaggaccagaggcggtttgagccaccatcctggctttcgaggattggctgtctctctcatatcagcagccagggcct

SEQ ID NO: 440495 - DNA, 140 bp, Artificial Sequence
  Synthetic
atacgccatgctgggtctccgttatggtgccattaaaccgctgcattttatcaaagtcaagttaattacctttacattttgagcctcttggatgtgaaaaaaactattaacatccctcaacgtacttgggagtcggccat

SEQ ID NO: 440496 - DNA, 140 bp, Artificial Sequence
  Synthetic
atggccgactcccaagtacgttgagggatgttaatagtttttttcacatccaagaggctcaaaatgtaaaggtaattaacttgactttgataaaatgcagcggtttaatggcaccataacggagacccagcatggcgtat

SEQ ID NO: 440497 - DNA, 140 bp, Artificial Sequence
  Synthetic
aggccctggctgctgatatgtttacattttgagcctcttggatgtgaaaaaaactattaacatccctcaagagacttaaggaaagatggttcctcaagtttttttgtttgtacctcttctgaccttttgggacagcggtg

SEQ ID NO: 440498 - DNA, 140 bp, Artificial Sequence
  Synthetic
caccgctgtcccaaaaggtcagaagaggtacaaacaaaaaaacttgaggaaccatctttccttaagtctcttgagggatgttaatagtttttttcacatccaagaggctcaaaatgtaaacatatcagcagccagggcct

SEQ ID NO: 440499 - DNA, 140 bp, Artificial Sequence
  Synthetic
atacgccatgctgggtctccgattgcaggtggtctagcgacactagttctgataatcttcttgatggcatgttgtagaagaaccaagagaacagaatcaagacggcgaggctctggggaacgtacttgggagtcggccat

SEQ ID NO: 440500 - DNA, 140 bp, Artificial Sequence
  Synthetic
atggccgactcccaagtacgttccccagagcctcgccgtcttgattctgttctcttggttcttctacaacatgccatcaagaagattatcagaactagtgtcgctagaccacctgcaatcggagacccagcatggcgtat

SEQ ID NO: 440501 - DNA, 140 bp, Artificial Sequence
  Synthetic
aggccctggctgctgatatgcttgcacgggcgttgtgacagaggcagaaacctacaccaactttgttggttatgtcaccaccacgttcagaagaaagcatttccgtccaacaccagatgcgaccttttgggacagcggtg

SEQ ID NO: 440502 - DNA, 140 bp, Artificial Sequence
  Synthetic
caccgctgtcccaaaaggtcgcatctggtgttggacggaaatgctttcttctgaacgtggtggtgacataaccaacaaagttggtgtaggtttctgcctctgtcacaacgcccgtgcaagcatatcagcagccagggcct

SEQ ID NO: 440503 - DNA, 140 bp, Artificial Sequence
  Synthetic
aggccctggctgctgatatgccagaatatgtcccgctgaaagaactcacaggcaaaaagaacatgaggaacttttgcatcaacggagaggttaaagtgtgtagcccaaatggttactcgtgaccttttgggacagcggtg

SEQ ID NO: 440504 - DNA, 140 bp, Artificial Sequence
  Synthetic
caccgctgtcccaaaaggtcacgagtaaccatttgggctacacactttaacctctccgttgatgcaaaagttcctcatgttctttttgcctgtgagttctttcagcgggacatattctggcatatcagcagccagggcct

SEQ ID NO: 440505 - DNA, 140 bp, Artificial Sequence
  Synthetic
atacgccatgctgggtctcccttttgcatcaacggagaggttaaagtgtgtagcccaaatggttactcgttcaggatcctacggcacattctgagatcgttcgacgagatatattccgggcgtacttgggagtcggccat

SEQ ID NO: 440506 - DNA, 140 bp, Artificial Sequence
  Synthetic
atggccgactcccaagtacgcccggaatatatctcgtcgaacgatctcagaatgtgccgtaggatcctgaacgagtaaccatttgggctacacactttaacctctccgttgatgcaaaagggagacccagcatggcgtat

SEQ ID NO: 440507 - DNA, 140 bp, Artificial Sequence
  Synthetic
aggccctggctgctgatatgaccaccaaggagtctctcgttatcatatcccctagtgtggcagatttggacccatatgacaaatcccttcactcgagggtcttccctagtggaaagtgctgaccttttgggacagcggtg

SEQ ID NO: 440508 - DNA, 140 bp, Artificial Sequence
  Synthetic
caccgctgtcccaaaaggtcagcactttccactagggaagaccctcgagtgaagggatttgtcatatgggtccaaatctgccacactaggggatatgataacgagagactccttggtggtcatatcagcagccagggcct

SEQ ID NO: 440509 - DNA, 140 bp, Artificial Sequence
  Synthetic
atacgccatgctgggtctccggtgctctcatcctccaaggaccgatgctaaaggtggtggacagaacaactgctatctcaaacaactctatgaccgagcccaagcagaggctatcatgagcgtacttgggagtcggccat

SEQ ID NO: 440510 - DNA, 140 bp, Artificial Sequence
  Synthetic
atggccgactcccaagtacgctcatgatagcctctgcttgggctcggtcatagagttgtttgagatagcagttgttctgtccaccacctttagcatcggtccttggaggatgagagcaccggagacccagcatggcgtat

SEQ ID NO: 440511 - DNA, 140 bp, Artificial Sequence
  Synthetic
aggccctggctgctgatatgatttggatgcccgagaatccgagaccagggacatcttgtgacatttttaccaatagtagaggaaagagagcatccaaagggagtaagacctgcggctttggaccttttgggacagcggtg

SEQ ID NO: 440512 - DNA, 140 bp, Artificial Sequence
  Synthetic
caccgctgtcccaaaaggtccaaagccgcaggtcttactccctttggatgctctctttcctctactattggtaaaaatgtcacaagatgtccctggtctcggattctcgggcatccaaatcatatcagcagccagggcct

SEQ ID NO: 440513 - DNA, 140 bp, Artificial Sequence
  Synthetic
atacgccatgctgggtctccggtctcccctagagactatttgcgagggctcgcgagaggagtcttgatagggtcttcgatttgcttcttgacaagaatgacaaacattaacatcaatagacgtacttgggagtcggccat

SEQ ID NO: 440514 - DNA, 140 bp, Artificial Sequence
  Synthetic
atggccgactcccaagtacgtctattgatgttaatgtttgtcattcttgtcaagaagcaaatcgaagaccctatcaagactcctctcgcgagccctcgcaaatagtctctaggggagaccggagacccagcatggcgtat

SEQ ID NO: 440515 - DNA, 140 bp, Artificial Sequence
  Synthetic
atacgccatgctgggtctccgcgtatataactacaaagggatggaccatccaggcctttcagtcaagaaaaaaactgtagaatatatgggcaatcaacaacacttctcatcccaagaactcgtacttgggagtcggccat

SEQ ID NO: 440516 - DNA, 140 bp, Artificial Sequence
  Synthetic
atggccgactcccaagtacgagttcttgggatgagaagtgttgttgattgcccatatattctacagtttttttcttgactgaaaggcctggatggtccatccctttgtagttatatacgcggagacccagcatggcgtat

SEQ ID NO: 440517 - DNA, 140 bp, Artificial Sequence
  Synthetic
aggccctggctgctgatatgacttgtaccggtgtagtgacagaggctgagacctataccaacttcgttggttatgttaccacaacattcaagagaaagcactttcgcccaatgccagatggaccttttgggacagcggtg

SEQ ID NO: 440518 - DNA, 140 bp, Artificial Sequence
  Synthetic
caccgctgtcccaaaaggtccatctggcattgggcgaaagtgctttctcttgaatgttgtggtaacataaccaacgaagttggtataggtctcagcctctgtcactacaccggtacaagtcatatcagcagccagggcct

SEQ ID NO: 440519 - DNA, 140 bp, Artificial Sequence
  Synthetic
aggccctggctgctgatatgggtttggaaaagcatataccatattcaacaagaccttgatggaggctgatgctcactacaagtcagtccggacttggaatgagatcatcccctcaaaagggaccttttgggacagcggtg

SEQ ID NO: 440520 - DNA, 140 bp, Artificial Sequence
  Synthetic
caccgctgtcccaaaaggtcccttttgaggggatgatctcattccaagtccggactgacttgtagtgagcatcagcctccatcaaggtcttgttgaatatggtatatgcttttccaaacccatatcagcagccagggcct

SEQ ID NO: 440521 - DNA, 140 bp, Artificial Sequence
  Synthetic
aggccctggctgctgatatgcaatcatccctcctccagcaacatatggagctgttggaatcctcagttattcccctgatgcaccccctggcagacccgtccacagtttttaaggacggtggaccttttgggacagcggtg

SEQ ID NO: 440522 - DNA, 140 bp, Artificial Sequence
  Synthetic
caccgctgtcccaaaaggtccaccgtccttaaaaactgtggacgggtctgccagggggtgcatcaggggaataactgaggattccaacagctccatatgttgctggaggagggatgattgcatatcagcagccagggcct

SEQ ID NO: 440523 - DNA, 140 bp, Artificial Sequence
  Synthetic
atacgccatgctgggtctccatgcatgtcgagctgcttacaattggaagatggccggtgaccccagatatgaagaatcgctgcacaatccgtaccctgactaccactggcttcgaaccgtcgtacttgggagtcggccat

SEQ ID NO: 440524 - DNA, 140 bp, Artificial Sequence
  Synthetic
atggccgactcccaagtacgacggttcgaagccagtggtagtcagggtacggattgtgcagcgattcttcatatctggggtcaccggccatcttccaattgtaagcagctcgacatgcatggagacccagcatggcgtat

SEQ ID NO: 440525 - DNA, 140 bp, Artificial Sequence
  Synthetic
aggccctggctgctgatatggagtgcaggggccctgattgccttaatgttgatgatctttttaatgacatgctgtagaaaagtcaatcgaccagaatctacgcagcgcagtctcgggggggaccttttgggacagcggtg

SEQ ID NO: 440526 - DNA, 140 bp, Artificial Sequence
  Synthetic
caccgctgtcccaaaaggtcccccccgagactgcgctgcgtagattctggtcgattgacttttctacagcatgtcattaaaaagatcatcaacattaaggcaatcagggcccctgcactccatatcagcagccagggcct

SEQ ID NO: 440527 - DNA, 140 bp, Artificial Sequence
  Synthetic
atacgccatgctgggtctccaaagataagatatggggactgctgattgtgaccaaagattttgtgtattcccaaagttctagttgtctcttcgatagaaactatacacttatgttaaaagcgtacttgggagtcggccat

SEQ ID NO: 440528 - DNA, 140 bp, Artificial Sequence
  Synthetic
atggccgactcccaagtacgcttttaacataagtgtatagtttctatcgaagagacaactagaactttgggaatacacaaaatctttggtcacaatcagcagtccccatatcttatctttggagacccagcatggcgtat

SEQ ID NO: 440529 - DNA, 140 bp, Artificial Sequence
  Synthetic
aggccctggctgctgatatgacagggaggaaggtgtcgatcacttcccaaagcgggaaggttatatcttcatgggagtcatataagagtgggggtgagactagactgtgaaggctggtcagaccttttgggacagcggtg

SEQ ID NO: 440530 - DNA, 140 bp, Artificial Sequence
  Synthetic
caccgctgtcccaaaaggtctgaccagccttcacagtctagtctcacccccactcttatatgactcccatgaagatataaccttcccgctttgggaagtgatcgacaccttcctccctgtcatatcagcagccagggcct

SEQ ID NO: 440531 - DNA, 140 bp, Artificial Sequence
  Synthetic
atacgccatgctgggtctccatgggagtcatataagagtgggggtgagactagactgtgaaggctggtcatcctttcgacgcttcaagtcctaaagatcacctccccttggggttgggggcgtacttgggagtcggccat

SEQ ID NO: 440532 - DNA, 140 bp, Artificial Sequence
  Synthetic
atggccgactcccaagtacgcccccaaccccaaggggaggtgatctttaggacttgaagcgtcgaaaggatgaccagccttcacagtctagtctcacccccactcttatatgactcccatggagacccagcatggcgtat

SEQ ID NO: 440533 - DNA, 140 bp, Artificial Sequence
  Synthetic
atacgccatgctgggtctcccgcaggagatcacgtcttgtccatgtgcggaaactctggatatgaggtcatcaaaatactggagccttatgttgtgaacagcttagttcagagggcagaacgtacttgggagtcggccat

SEQ ID NO: 440534 - DNA, 140 bp, Artificial Sequence
  Synthetic
atggccgactcccaagtacgttctgccctctgaactaagctgttcacaacataaggctccagtattttgatgacctcatatccagagtttccgcacatggacaagacgtgatctcctgcgggagacccagcatggcgtat

SEQ ID NO: 440535 - DNA, 140 bp, Artificial Sequence
  Synthetic
aggccctggctgctgatatgcaagttatgtggagttcttggccttagacttatggatggaacgtgggttgcgatgcaaacatcggacgaaaccaagtggtgtcctcctgatcagttggtagaccttttgggacagcggtg

SEQ ID NO: 440536 - DNA, 140 bp, Artificial Sequence
  Synthetic
caccgctgtcccaaaaggtctaccaactgatcaggaggacaccacttggtttcgtccgatgtttgcatcgcaacccacgttccatccataagtctaaggccaagaactccacataacttgcatatcagcagccagggcct

SEQ ID NO: 440537 - DNA, 140 bp, Artificial Sequence
  Synthetic
atacgccatgctgggtctcccgatgcaaacatcggacgaaaccaagtggtgtcctcctgatcagttggtaaatctgcacgactttcgctcagacgagatcgaacatcttgttgtggaggacgtacttgggagtcggccat

SEQ ID NO: 440538 - DNA, 140 bp, Artificial Sequence
  Synthetic
atggccgactcccaagtacgtcctccacaacaagatgttcgatctcgtctgagcgaaagtcgtgcagatttaccaactgatcaggaggacaccacttggtttcgtccgatgtttgcatcgggagacccagcatggcgtat

SEQ ID NO: 440539 - DNA, 140 bp, Artificial Sequence
  Synthetic
aggccctggctgctgatatgtcccgtgacaacggactcagtatgagtttactgagaaaggcaatctgcctcccatgaaggacataagcaatagctcacaatcatcttgcatctcagcaaagaccttttgggacagcggtg

SEQ ID NO: 440540 - DNA, 140 bp, Artificial Sequence
  Synthetic
caccgctgtcccaaaaggtctttgctgagatgcaagatgattgtgagctattgcttatgtccttcatgggaggcagattgcctttctcagtaaactcatactgagtccgttgtcacgggacatatcagcagccagggcct

SEQ ID NO: 440541 - DNA, 140 bp, Artificial Sequence
  Synthetic
aggccctggctgctgatatgcccatgaaggacataagcaatagctcacaatcatcttgcatctcagcaaagtgtgcataattataaagggctgggtcatctaagcttttcagtcgagaaagaccttttgggacagcggtg

SEQ ID NO: 440542 - DNA, 140 bp, Artificial Sequence
  Synthetic
caccgctgtcccaaaaggtctttctcgactgaaaagcttagatgacccagccctttataattatgcacactttgctgagatgcaagatgattgtgagctattgcttatgtccttcatgggcatatcagcagccagggcct

SEQ ID NO: 440543 - DNA, 140 bp, Artificial Sequence
  Synthetic
aggccctggctgctgatatgaaaactgtggatcgaaagagtaactggcaacacttctcatcctggaacccacatcaagatgctagatccaggagaagtctacgatgaccccattgatctagaccttttgggacagcggtg

SEQ ID NO: 440544 - DNA, 140 bp, Artificial Sequence
  Synthetic
caccgctgtcccaaaaggtctagatcaatggggtcatcgtagacttctcctggatctagcatcttgatgtgggttccaggatgagaagtgttgccagttactctttcgatccacagttttcatatcagcagccagggcct

SEQ ID NO: 440545 - DNA, 140 bp, Artificial Sequence
  Synthetic
atacgccatgctgggtctccatttttgagattcccgaatcaatggacccatcagagatactcgatgacaaatcacactccttcactagaacaagactggcgtcatggctatcggagaacacgtacttgggagtcggccat

SEQ ID NO: 440546 - DNA, 140 bp, Artificial Sequence
  Synthetic
atggccgactcccaagtacgtgttctccgatagccatgacgccagtcttgttctagtgaaggagtgtgatttgtcatcgagtatctctgatgggtccattgattcgggaatctcaaaaatggagacccagcatggcgtat

SEQ ID NO: 440547 - DNA, 140 bp, Artificial Sequence
  Synthetic
atacgccatgctgggtctccgaggagggccagttcccagtgaaaaggtcattatcacggccctttccaaaccccctgtcaatcccagagaattcctaaaatctatagaccttggaggattcgtacttgggagtcggccat

SEQ ID NO: 440548 - DNA, 140 bp, Artificial Sequence
  Synthetic
atggccgactcccaagtacgaatcctccaaggtctatagattttaggaattctctgggattgacagggggtttggaaagggccgtgataatgaccttttcactgggaactggccctcctcggagacccagcatggcgtat

SEQ ID NO: 440549 - DNA, 140 bp, Artificial Sequence
  Synthetic
atacgccatgctgggtctcctgatttctctttggttacatggtgcccactctgaatcaaacaggagccggagatgtataacagacttggcccatttctattccaagtcatcccccatagacgtacttgggagtcggccat

SEQ ID NO: 440550 - DNA, 140 bp, Artificial Sequence
  Synthetic
atggccgactcccaagtacgtctatgggggatgacttggaatagaaatgggccaagtctgttatacatctccggctcctgtttgattcagagtgggcaccatgtaaccaaagagaaatcaggagacccagcatggcgtat

SEQ ID NO: 440551 - DNA, 140 bp, Artificial Sequence
  Synthetic
aggccctggctgctgatatgacatgttgcgggagagtccgtcgacccaagtctacacaacacagtctcggagggacagggaggaaggtgtcggtcacttcccaaagcgggaaggtcatatgaccttttgggacagcggtg

SEQ ID NO: 440552 - DNA, 140 bp, Artificial Sequence
  Synthetic
caccgctgtcccaaaaggtcatatgaccttcccgctttgggaagtgaccgacaccttcctccctgtccctccgagactgtgttgtgtagacttgggtcgacggactctcccgcaacatgtcatatcagcagccagggcct

SEQ ID NO: 440553 - DNA, 140 bp, Artificial Sequence
  Synthetic
aggccctggctgctgatatgagggggtgttaagttgccttgagagggtcgattatgataaggcatttgggaggtatcttgccaacacgtattcctcttatttgtttttccatgtaatcacgaccttttgggacagcggtg

SEQ ID NO: 440554 - DNA, 140 bp, Artificial Sequence
  Synthetic
caccgctgtcccaaaaggtcgtgattacatggaaaaacaaataagaggaatacgtgttggcaagatacctcccaaatgccttatcataatcgaccctctcaaggcaacttaacaccccctcatatcagcagccagggcct

SEQ ID NO: 440555 - DNA, 140 bp, Artificial Sequence
  Synthetic
aggccctggctgctgatatgtttcacctggactatgagaaatggaataatcatcagcggctggaatcgactgaggatgtatttgccgtacttgatcaagtgtttggactgaaaagggtgtgaccttttgggacagcggtg

SEQ ID NO: 440556 - DNA, 140 bp, Artificial Sequence
  Synthetic
caccgctgtcccaaaaggtcacacccttttcagtccaaacacttgatcaagtacggcaaatacatcctcagtcgattccagccgctgatgattattccatttctcatagtccaggtgaaacatatcagcagccagggcct

SEQ ID NO: 440557 - DNA, 140 bp, Artificial Sequence
  Synthetic
aggccctggctgctgatatgtggtcgtgtagattcttaaaatataagaaatcttcttgcagtttcagtgaccaacggtgctttcatcctccaggggtcgataccaaaggttgtggacagggaccttttgggacagcggtg

SEQ ID NO: 440558 - DNA, 140 bp, Artificial Sequence
  Synthetic
caccgctgtcccaaaaggtccctgtccacaacctttggtatcgacccctggaggatgaaagcaccgttggtcactgaaactgcaagaagatttcttatattttaagaatctacacgaccacatatcagcagccagggcct

SEQ ID NO: 440559 - DNA, 140 bp, Artificial Sequence
  Synthetic
atacgccatgctgggtctccgtcaagtgtgcataattataaagggctgggtcatctaagcttttcagtcgagaaaaaaactgtaggccgaaagtgcaactggcaacacttctcatcctcacgtacttgggagtcggccat

SEQ ID NO: 440560 - DNA, 140 bp, Artificial Sequence
  Synthetic
atggccgactcccaagtacgtgaggatgagaagtgttgccagttgcactttcggcctacagtttttttctcgactgaaaagcttagatgacccagccctttataattatgcacacttgacggagacccagcatggcgtat

SEQ ID NO: 440561 - DNA, 140 bp, Artificial Sequence
  Synthetic
aggccctggctgctgatatgaagtttaggcctcttattcattccttgggagactttcctgtatttataaaagacaaggtgagtcagcttgaagggactttcggtcccagtgcaaaaaggtgaccttttgggacagcggtg

SEQ ID NO: 440562 - DNA, 140 bp, Artificial Sequence
  Synthetic
caccgctgtcccaaaaggtcacctttttgcactgggaccgaaagtcccttcaagctgactcaccttgtcttttataaatacaggaaagtctcccaaggaatgaataagaggcctaaacttcatatcagcagccagggcct

SEQ ID NO: 440563 - DNA, 140 bp, Artificial Sequence
  Synthetic
atacgccatgctgggtctccggatttgataagtactccaagtggtatctggattcgcgattccttgcccgagaccaccccttgactccttatatcaaaacccagacatggccacccaaaccgtacttgggagtcggccat

SEQ ID NO: 440564 - DNA, 140 bp, Artificial Sequence
  Synthetic
atggccgactcccaagtacggtttgggtggccatgtctgggttttgatataaggagtcaaggggtggtctcgggcaaggaatcgcgaatccagataccacttggagtacttatcaaatccggagacccagcatggcgtat

SEQ ID NO: 440565 - DNA, 140 bp, Artificial Sequence
  Synthetic
aggccctggctgctgatatgatctttgagattcctgaatcaatggacccgtcagaaatactggatgacaaatcacattctttcaccagaacaagactagcttcctggctgtcagagaaccgaccttttgggacagcggtg

SEQ ID NO: 440566 - DNA, 140 bp, Artificial Sequence
  Synthetic
caccgctgtcccaaaaggtcggttctctgacagccaggaagctagtcttgttctggtgaaagaatgtgatttgtcatccagtatttctgacgggtccattgattcaggaatctcaaagatcatatcagcagccagggcct

SEQ ID NO: 440567 - DNA, 140 bp, Artificial Sequence
  Synthetic
atacgccatgctgggtctccatcacattctttcaccagaacaagactagcttcctggctgtcagagaaccgaggagggcctgttccgagtgagaaagttattatcacagccttgtctaagcgtacttgggagtcggccat

SEQ ID NO: 440568 - DNA, 140 bp, Artificial Sequence
  Synthetic
atggccgactcccaagtacgcttagacaaggctgtgataataactttctcactcggaacaggccctcctcggttctctgacagccaggaagctagtcttgttctggtgaaagaatgtgatggagacccagcatggcgtat

SEQ ID NO: 440569 - DNA, 140 bp, Artificial Sequence
  Synthetic
aggccctggctgctgatatgaagtttcaattattgtagctataatgatagtcttttccaatagggtgttcaatgtctcgaaacccctgactgaccctttattctacccgccatctgatccgaccttttgggacagcggtg

SEQ ID NO: 440570 - DNA, 140 bp, Artificial Sequence
  Synthetic
caccgctgtcccaaaaggtcggatcagatggcgggtagaataaagggtcagtcaggggtttcgagacattgaacaccctattggaaaagactatcattatagctacaataattgaaacttcatatcagcagccagggcct

SEQ ID NO: 440571 - DNA, 140 bp, Artificial Sequence
  Synthetic
atacgccatgctgggtctccaccactctgaatattagaggaggagccagtcccaccattcttctaaaggatgcgatcagaaaagccctgtatgatgaagtagacaaagtcgagaactcagcgtacttgggagtcggccat

SEQ ID NO: 440572 - DNA, 140 bp, Artificial Sequence
  Synthetic
atggccgactcccaagtacgctgagttctcgactttgtctacttcatcatacagggcttttctgatcgcatcctttagaagaatggtgggactggctcctcctctaatattcagagtggtggagacccagcatggcgtat

SEQ ID NO: 440573 - DNA, 140 bp, Artificial Sequence
  Synthetic
aggccctggctgctgatatgagttcaaagatcaaatatggggactactaattgtgacgaaagacttcgtttattctcagagttctaactgtctttttgacagaaactacacacttatgctgaccttttgggacagcggtg

SEQ ID NO: 440574 - DNA, 140 bp, Artificial Sequence
  Synthetic
caccgctgtcccaaaaggtcagcataagtgtgtagtttctgtcaaaaagacagttagaactctgagaataaacgaagtctttcgtcacaattagtagtccccatatttgatctttgaactcatatcagcagccagggcct

SEQ ID NO: 440575 - DNA, 140 bp, Artificial Sequence
  Synthetic
atacgccatgctgggtctccctctttttgaaatctgtcgagcctttgtttccccgattcctcagtgaactcttcagttcatcgttcttagggattcctgagtcaattatcgggttgataccgtacttgggagtcggccat

SEQ ID NO: 440576 - DNA, 140 bp, Artificial Sequence
  Synthetic
atggccgactcccaagtacggtatcaacccgataattgactcaggaatccctaagaacgatgaactgaagagttcactgaggaatcggggaaacaaaggctcgacagatttcaaaaagagggagacccagcatggcgtat

SEQ ID NO: 440577 - DNA, 140 bp, Artificial Sequence
  Synthetic
atacgccatgctgggtctcctttcacctggactatgagaagtggaacaatcatcaaaggttagagtcaacagaggacgtgttctctgtcctggatcgggtgtttggattgaagagagcgtcgtacttgggagtcggccat

SEQ ID NO: 440578 - DNA, 140 bp, Artificial Sequence
  Synthetic
atggccgactcccaagtacgacgctctcttcaatccaaacacccgatccaggacagagaacacgtcctctgttgactctaacctttgatgattgttccacttctcatagtccaggtgaaaggagacccagcatggcgtat

SEQ ID NO: 440579 - DNA, 140 bp, Artificial Sequence
  Synthetic
aggccctggctgctgatatgcagaaaagtttaggcctctcattcactccctgggagactttcctgtatttataaaagataaggtaagtcaactcgaggggacttttggccccagtgcaaagaccttttgggacagcggtg

SEQ ID NO: 440580 - DNA, 140 bp, Artificial Sequence
  Synthetic
caccgctgtcccaaaaggtctttgcactggggccaaaagtcccctcgagttgacttaccttatcttttataaatacaggaaagtctcccagggagtgaatgagaggcctaaacttttctgcatatcagcagccagggcct

SEQ ID NO: 440581 - DNA, 140 bp, Artificial Sequence
  Synthetic
atacgccatgctgggtctccctataaactggttcattacaaggaactcaaatctggcccaaaccctagttagaaacataatgtccctgacaggtccagattttccgctagaagaggctcccgtacttgggagtcggccat

SEQ ID NO: 440582 - DNA, 140 bp, Artificial Sequence
  Synthetic
atggccgactcccaagtacgggagcctcttctagcggaaaatctggacctgtcagggacattatgtttctaactagggtttgggccagatttgagttccttgtaatgaaccagtttatagggagacccagcatggcgtat

SEQ ID NO: 440583 - DNA, 140 bp, Artificial Sequence
  Synthetic
atacgccatgctgggtctcccttaccgaaagcctgcacatgctaagactcttgtatgatgcatcttgaaaaaaacaggatcttgaatctgagcctctggttgcttgattgtttttcccatcgtacttgggagtcggccat

SEQ ID NO: 440584 - DNA, 140 bp, Artificial Sequence
  Synthetic
atggccgactcccaagtacgatgggaaaaacaatcaagcaaccagaggctcagattcaagatcctgtttttttcaagatgcatcatacaagagtcttagcatgtgcaggctttcggtaagggagacccagcatggcgtat

SEQ ID NO: 440585 - DNA, 140 bp, Artificial Sequence
  Synthetic
aggccctggctgctgatatggaacagaggggggcctgttcccagcgagaaggtcattatcactgccttgtctaagccgcccgtcaatcccagagaatttttaaagtctatcgatctcggagaccttttgggacagcggtg

SEQ ID NO: 440586 - DNA, 140 bp, Artificial Sequence
  Synthetic
caccgctgtcccaaaaggtctccgagatcgatagactttaaaaattctctgggattgacgggcggcttagacaaggcagtgataatgaccttctcgctgggaacaggcccccctctgttccatatcagcagccagggcct

SEQ ID NO: 440587 - DNA, 140 bp, Artificial Sequence
  Synthetic
aggccctggctgctgatatgtgtactttgttatcactgaaaagcttttggccaactacatcctgccactttttgatgcattgactatgacagacaatttgaacaaggtgtttaaaaagctgaccttttgggacagcggtg

SEQ ID NO: 440588 - DNA, 140 bp, Artificial Sequence
  Synthetic
caccgctgtcccaaaaggtcagctttttaaacaccttgttcaaattgtctgtcatagtcaatgcatcaaaaagtggcaggatgtagttggccaaaagcttttcagtgataacaaagtacacatatcagcagccagggcct

SEQ ID NO: 440589 - DNA, 140 bp, Artificial Sequence
  Synthetic
atacgccatgctgggtctcctttgatgcattgactatgacagacaatttgaacaaggtgtttaaaaagctgatcgacagagtcactggacaaggacttttggactactcgagggtcacatcgtacttgggagtcggccat

SEQ ID NO: 440590 - DNA, 140 bp, Artificial Sequence
  Synthetic
atggccgactcccaagtacgatgtgaccctcgagtagtccaaaagtccttgtccagtgactctgtcgatcagctttttaaacaccttgttcaaattgtctgtcatagtcaatgcatcaaaggagacccagcatggcgtat

SEQ ID NO: 440591 - DNA, 140 bp, Artificial Sequence
  Synthetic
atacgccatgctgggtctccggtacaacgatggaaccattttccctgtcaacatatataataaggtctcccctagagattatttacaagggctcgcgagaggagttttgatcgggtcttccgtacttgggagtcggccat

SEQ ID NO: 440592 - DNA, 140 bp, Artificial Sequence
  Synthetic
atggccgactcccaagtacggaagacccgatcaaaactcctctcgcgagcccttgtaaataatctctaggggagaccttattatatatgttgacagggaaaatggttccatcgttgtaccggagacccagcatggcgtat

SEQ ID NO: 440593 - DNA, 140 bp, Artificial Sequence
  Synthetic
aggccctggctgctgatatgtgcaatcagaaaggctctgtatgacgaagtggacaaggtggaaaattcagagtttcgagaggcgatcctgttgtccaagacccatagagacaacttcatagaccttttgggacagcggtg

SEQ ID NO: 440594 - DNA, 140 bp, Artificial Sequence
  Synthetic
caccgctgtcccaaaaggtctatgaagttgtctctatgggtcttggacaacaggatcgcctctcgaaactctgaattttccaccttgtccacttcgtcatacagagcctttctgattgcacatatcagcagccagggcct

SEQ ID NO: 440595 - DNA, 140 bp, Artificial Sequence
  Synthetic
atacgccatgctgggtctccccatccttgtatataatgctaagagagccagctcttcgaggagaaatattctctattccccaaaaagttcctgcagcttacccgaccacaatgagagaggcgtacttgggagtcggccat

SEQ ID NO: 440596 - DNA, 140 bp, Artificial Sequence
  Synthetic
atggccgactcccaagtacgcctctctcattgtggtcgggtaagctgcaggaactttttggggaatagagaatatttctcctcgaagagctggctctcttagcattatatacaaggatggggagacccagcatggcgtat

SEQ ID NO: 440597 - DNA, 140 bp, Artificial Sequence
  Synthetic
aggccctggctgctgatatggagaatcccaaaccaggaacacaagaaccaagatattagctcaaggggacaaccaggttctatgtccgacatatatgttgtccccagggctatctcgagagaccttttgggacagcggtg

SEQ ID NO: 440598 - DNA, 140 bp, Artificial Sequence
  Synthetic
caccgctgtcccaaaaggtctctcgagatagccctggggacaacatatatgtcggacatagaacctggttgtccccttgagctaatatcttggttcttgtgttcctggtttgggattctccatatcagcagccagggcct

SEQ ID NO: 440599 - DNA, 140 bp, Artificial Sequence
  Synthetic
atacgccatgctgggtctccctttagaagctcgaagatgacgtatctgactcttatcacttaccagtctcatcttttacttcagaaggttgagaaaaatctctccaaaagtatgagggcccgtacttgggagtcggccat

SEQ ID NO: 440600 - DNA, 140 bp, Artificial Sequence
  Synthetic
atggccgactcccaagtacgggccctcatacttttggagagatttttctcaaccttctgaagtaaaagatgagactggtaagtgataagagtcagatacgtcatcttcgagcttctaaagggagacccagcatggcgtat

SEQ ID NO: 440601 - DNA, 140 bp, Artificial Sequence
  Synthetic
atacgccatgctgggtctccgttatgtggagttcttggacttagacttatggatggaacatgggtcgcgatgcaaacatcagatgagaccaaatggtgccctcctgatcagttggtgaatcgtacttgggagtcggccat

SEQ ID NO: 440602 - DNA, 140 bp, Artificial Sequence
  Synthetic
atggccgactcccaagtacgattcaccaactgatcaggagggcaccatttggtctcatctgatgtttgcatcgcgacccatgttccatccataagtctaagtccaagaactccacataacggagacccagcatggcgtat

SEQ ID NO: 440603 - DNA, 140 bp, Artificial Sequence
  Synthetic
atacgccatgctgggtctccaacttgcgacaaatgagctctctaatgaggcaagtgttgggtggccatggcgaagataccttggagtcagatgaagacattcagaggctgttgaaagactcgtacttgggagtcggccat

SEQ ID NO: 440604 - DNA, 140 bp, Artificial Sequence
  Synthetic
atggccgactcccaagtacgagtctttcaacagcctctgaatgtcttcatctgactccaaggtatcttcgccatggccacccaacacttgcctcattagagagctcatttgtcgcaagttggagacccagcatggcgtat

SEQ ID NO: 440605 - DNA, 140 bp, Artificial Sequence
  Synthetic
atacgccatgctgggtctccccctatgccttgtagtgggggatgggtcaggcgggatatcaagagcggtgctcaacatgtttccggatgccaggcttgtattcaatagcctattagaggtcgtacttgggagtcggccat

SEQ ID NO: 440606 - DNA, 140 bp, Artificial Sequence
  Synthetic
atggccgactcccaagtacgacctctaataggctattgaatacaagcctggcatccggaaacatgttgagcaccgctcttgatatcccgcctgacccatcccccactacaaggcatagggggagacccagcatggcgtat

SEQ ID NO: 440607 - DNA, 140 bp, Artificial Sequence
  Synthetic
aggccctggctgctgatatgttctcagatcttcgagttcccggatgtgtcaaaaagaatatccagaatggtttctggggctgtgcctcacttccagaagcttcctgatatccgtctgagagaccttttgggacagcggtg

SEQ ID NO: 440608 - DNA, 140 bp, Artificial Sequence
  Synthetic
caccgctgtcccaaaaggtctctcagacggatatcaggaagcttctggaagtgaggcacagccccagaaaccattctggatattctttttgacacatccgggaactcgaagatctgagaacatatcagcagccagggcct

SEQ ID NO: 440609 - DNA, 140 bp, Artificial Sequence
  Synthetic
atacgccatgctgggtctccctattgatccaattgagtcagaggctgaacccagaggaacccccactgtccccaacatcttgaggaactctgactacaatctcaactctcctttgattgacgtacttgggagtcggccat

SEQ ID NO: 440610 - DNA, 140 bp, Artificial Sequence
  Synthetic
atggccgactcccaagtacgtcaatcaaaggagagttgagattgtagtcagagttcctcaagatgttggggacagtgggggttcctctgggttcagcctctgactcaattggatcaatagggagacccagcatggcgtat

SEQ ID NO: 440611 - DNA, 140 bp, Artificial Sequence
  Synthetic
atacgccatgctgggtctccgattttgcattgtccatagacggcccactttatttggtttttaaaacttatggcaccatgctggtgaatccagactacaaagcaattcaacatttatctacgtacttgggagtcggccat

SEQ ID NO: 440612 - DNA, 140 bp, Artificial Sequence
  Synthetic
atggccgactcccaagtacgtagataaatgttgaattgctttgtagtctggattcaccagcatggtgccataagttttaaaaaccaaataaagtgggccgtctatggacaatgcaaaatcggagacccagcatggcgtat

SEQ ID NO: 440613 - DNA, 140 bp, Artificial Sequence
  Synthetic
aggccctggctgctgatatgcctagagattacttgagaggactcgcgagaggagtcttgataggatcctcgatttgtttcttgacaagaatgacaaacatcaacattaatagacctcttggaccttttgggacagcggtg

SEQ ID NO: 440614 - DNA, 140 bp, Artificial Sequence
  Synthetic
caccgctgtcccaaaaggtccaagaggtctattaatgttgatgtttgtcattcttgtcaagaaacaaatcgaggatcctatcaagactcctctcgcgagtcctctcaagtaatctctaggcatatcagcagccagggcct

SEQ ID NO: 440615 - DNA, 140 bp, Artificial Sequence
  Synthetic
aggccctggctgctgatatgagttgatatcaggagtaatctcatatatcctcctgaggttagataatcacccctccttgtacataatgctccgagaaccgtctcttagaggagaaatattgaccttttgggacagcggtg

SEQ ID NO: 440616 - DNA, 140 bp, Artificial Sequence
  Synthetic
caccgctgtcccaaaaggtcaatatttctcctctaagagacggttctcggagcattatgtacaaggaggggtgattatctaacctcaggaggatatatgagattactcctgatatcaactcatatcagcagccagggcct

SEQ ID NO: 440617 - DNA, 140 bp, Artificial Sequence
  Synthetic
aggccctggctgctgatatgcctctcctgtgtcagcccctccatatgatgatgacctatggcttccacccccggaatacgtcccgctaaaagaattcgcaggtaagaagaacatgaggaagaccttttgggacagcggtg

SEQ ID NO: 440618 - DNA, 140 bp, Artificial Sequence
  Synthetic
caccgctgtcccaaaaggtcttcctcatgttcttcttacctgcgaattcttttagcgggacgtattccgggggtggaagccataggtcatcatcatatggaggggctgacacaggagaggcatatcagcagccagggcct

SEQ ID NO: 440619 - DNA, 140 bp, Artificial Sequence
  Synthetic
atacgccatgctgggtctcccatatcaaagccgctgactgatcctttattctatcctccatctgaccccaaaatcctgagacacttcaacatatgctgcagtaccatgatgtacttatcacgtacttgggagtcggccat

SEQ ID NO: 440620 - DNA, 140 bp, Artificial Sequence
  Synthetic
atggccgactcccaagtacgtgataagtacatcatggtactgcagcatatgttgaagtgtctcaggattttggggtcagatggaggatagaataaaggatcagtcagcggctttgatatgggagacccagcatggcgtat

SEQ ID NO: 440621 - DNA, 140 bp, Artificial Sequence
  Synthetic
aggccctggctgctgatatgaaatcctgagacacttcaacatatgctgcagtaccatgatgtacttatcaactgccttaggggatgtgcctagctttgcaagacttcatgatctatataagaccttttgggacagcggtg

SEQ ID NO: 440622 - DNA, 140 bp, Artificial Sequence
  Synthetic
caccgctgtcccaaaaggtcttatatagatcatgaagtcttgcaaagctaggcacatcccctaaggcagttgataagtacatcatggtactgcagcatatgttgaagtgtctcaggatttcatatcagcagccagggcct

SEQ ID NO: 440623 - DNA, 140 bp, Artificial Sequence
  Synthetic
aggccctggctgctgatatggggcccattacaagctcaaacctattttggatgatctcaatgtgttcccatccctatgtcttgttgtcggggatggatcaggggggatatcaagagcagtgaccttttgggacagcggtg

SEQ ID NO: 440624 - DNA, 140 bp, Artificial Sequence
  Synthetic
caccgctgtcccaaaaggtcactgctcttgatatcccccctgatccatccccgacaacaagacatagggatgggaacacattgagatcatccaaaataggtttgagcttgtaatgggccccatatcagcagccagggcct

SEQ ID NO: 440625 - DNA, 140 bp, Artificial Sequence
  Synthetic
atacgccatgctgggtctccatgttcagaatgggtctgctctgctcaacaggttgcagtctccacctcggcaaacccagcccctgtctcagagcttgacataaggaccctctctaagaggcgtacttgggagtcggccat

SEQ ID NO: 440626 - DNA, 140 bp, Artificial Sequence
  Synthetic
atggccgactcccaagtacgcctcttagagagggtccttatgtcaagctctgagacaggggctgggtttgccgaggtggagactgcaacctgttgagcagagcagacccattctgaacatggagacccagcatggcgtat

SEQ ID NO: 440627 - DNA, 140 bp, Artificial Sequence
  Synthetic
aggccctggctgctgatatggagacttctcagatctttgagtttccggacgtgtcaaaaagaatatctagaatggtttctggagctgtgccccactttcagaaacttcctgacatccgccgaccttttgggacagcggtg

SEQ ID NO: 440628 - DNA, 140 bp, Artificial Sequence
  Synthetic
caccgctgtcccaaaaggtcggcggatgtcaggaagtttctgaaagtggggcacagctccagaaaccattctagatattctttttgacacgtccggaaactcaaagatctgagaagtctccatatcagcagccagggcct

SEQ ID NO: 440629 - DNA, 140 bp, Artificial Sequence
  Synthetic
aggccctggctgctgatatgcgcccattataagcttaagcccattctagacgatcttaatgttttcccatccctctgtcttgtagttggggacgggtcaggggggatatcaagggcagttgaccttttgggacagcggtg

SEQ ID NO: 440630 - DNA, 140 bp, Artificial Sequence
  Synthetic
caccgctgtcccaaaaggtcaactgcccttgatatcccccctgacccgtccccaactacaagacagagggatgggaaaacattaagatcgtctagaatgggcttaagcttataatgggcgcatatcagcagccagggcct

SEQ ID NO: 440631 - DNA, 140 bp, Artificial Sequence
  Synthetic
atacgccatgctgggtctcccccccgagagaatgtacaaactgatactcttggacggtgcaccctgaaaaaaactggaccaaaattccgaacctctgtcgtcttgattgtttttccatctcgtacttgggagtcggccat

SEQ ID NO: 440632 - DNA, 140 bp, Artificial Sequence
  Synthetic
atggccgactcccaagtacgagatggaaaaacaatcaagacgacagaggttcggaattttggtccagtttttttcagggtgcaccgtccaagagtatcagtttgtacattctctcgggggggagacccagcatggcgtat

SEQ ID NO: 440633 - DNA, 140 bp, Artificial Sequence
  Synthetic
aggccctggctgctgatatgttctcaataccccagaaaattcccgcagcttacccgaccacgatgaaagagggcaatcgatccattttgtgttatctccaacatgttctacgatatgagcgaccttttgggacagcggtg

SEQ ID NO: 440634 - DNA, 140 bp, Artificial Sequence
  Synthetic
caccgctgtcccaaaaggtcgctcatatcgtagaacatgttggagataacacaaaatggatcgattgccctctttcatcgtggtcgggtaagctgcgggaattttctggggtattgagaacatatcagcagccagggcct

SEQ ID NO: 440635 - DNA, 140 bp, Artificial Sequence
  Synthetic
aggccctggctgctgatatgctcaggatacaatgatggcaccatctttcctgtcaacatatatggcaaggtctcccctagagattatttgagggggctcgcaagaggagtcttgataggggaccttttgggacagcggtg

SEQ ID NO: 440636 - DNA, 140 bp, Artificial Sequence
  Synthetic
caccgctgtcccaaaaggtcccctatcaagactcctcttgcgagccccctcaaataatctctaggggagaccttgccatatatgttgacaggaaagatggtgccatcattgtatcctgagcatatcagcagccagggcct

SEQ ID NO: 440637 - DNA, 140 bp, Artificial Sequence
  Synthetic
aggccctggctgctgatatgtgagtggaggagatgacatcgtttccagagtgatagattttgactcaatctgggaaaaaccgtctgacctgagaaacttggccacctggagatactttcagaccttttgggacagcggtg

SEQ ID NO: 440638 - DNA, 140 bp, Artificial Sequence
  Synthetic
caccgctgtcccaaaaggtctgaaagtatctccaggtggccaagtttctcaggtcagacggtttttcccagattgagtcaaaatctatcactctggaaacgatgtcatctcctccactcacatatcagcagccagggcct

SEQ ID NO: 440639 - DNA, 140 bp, Artificial Sequence
  Synthetic
aggccctggctgctgatatgtcttgaattgatctccggggtaatctcatatatcctcctgagactagataatcacccctctttatatataatgctcagagaaccgtcccttagaggagaggaccttttgggacagcggtg

SEQ ID NO: 440640 - DNA, 140 bp, Artificial Sequence
  Synthetic
caccgctgtcccaaaaggtcctctcctctaagggacggttctctgagcattatatataaagaggggtgattatctagtctcaggaggatatatgagattaccccggagatcaattcaagacatatcagcagccagggcct

SEQ ID NO: 440641 - DNA, 140 bp, Artificial Sequence
  Synthetic
aggccctggctgctgatatggattttgcattgtctatagacggaccactttatttggtcttcaaaacttacgggactatgctagtgaacccagactataaggctattcaacacctgtcaagaccttttgggacagcggtg

SEQ ID NO: 440642 - DNA, 140 bp, Artificial Sequence
  Synthetic
caccgctgtcccaaaaggtcttgacaggtgttgaatagccttatagtctgggttcactagcatagtcccgtaagttttgaagaccaaataaagtggtccgtctatagacaatgcaaaatccatatcagcagccagggcct

SEQ ID NO: 440643 - DNA, 140 bp, Artificial Sequence
  Synthetic
atacgccatgctgggtctccaatgcagttctttgagggagcatgtcccgatgattggattagctacggaatcctgatagcacggaagggcgacaaaatcaccccaggctctcttgtggatcgtacttgggagtcggccat

SEQ ID NO: 440644 - DNA, 140 bp, Artificial Sequence
  Synthetic
atggccgactcccaagtacgatccacaagagagcctggggtgattttgtcgcccttccgtgctatcaggattccgtagctaatccaatcatcgggacatgctccctcaaagaactgcattggagacccagcatggcgtat

SEQ ID NO: 440645 - DNA, 140 bp, Artificial Sequence
  Synthetic
aggccctggctgctgatatggagctaacttgcgacaaatgagttcattgatgaggcaggtgttgggagggcatggagaagacaccttggagtcagatgatgatgttcaacgactattgaagaccttttgggacagcggtg

SEQ ID NO: 440646 - DNA, 140 bp, Artificial Sequence
  Synthetic
caccgctgtcccaaaaggtcttcaatagtcgttgaacatcatcatctgactccaaggtgtcttctccatgccctcccaacacctgcctcatcaatgaactcatttgtcgcaagttagctccatatcagcagccagggcct

SEQ ID NO: 440647 - DNA, 140 bp, Artificial Sequence
  Synthetic
aggccctggctgctgatatgcaatgagatgatcataactctgattgacagtgatgtagaatctttcctcgtccacaagatggtggatgatcttgagttacagaggggaaccctgtctaaagaccttttgggacagcggtg

SEQ ID NO: 440648 - DNA, 140 bp, Artificial Sequence
  Synthetic
caccgctgtcccaaaaggtctttagacagggttcccctctgtaactcaagatcatccaccatcttgtggacgaggaaagattctacatcactgtcaatcagagttatgatcatctcattgcatatcagcagccagggcct

SEQ ID NO: 440649 - DNA, 140 bp, Artificial Sequence
  Synthetic
aggccctggctgctgatatgtccacaagatggtggatgatcttgagttacagaggggaaccctgtctaaagtggctatcattatagccatcatgatagttttctccaacagagtcttcaagaccttttgggacagcggtg

SEQ ID NO: 440650 - DNA, 140 bp, Artificial Sequence
  Synthetic
caccgctgtcccaaaaggtcttgaagactctgttggagaaaactatcatgatggctataatgatagccactttagacagggttcccctctgtaactcaagatcatccaccatcttgtggacatatcagcagccagggcct

SEQ ID NO: 440651 - DNA, 140 bp, Artificial Sequence
  Synthetic
aggccctggctgctgatatggcaggaggctcagaatgggtttgctctgctcaacaggttgcagtctccacctcagctaacccagcccctgtctcagagcttgacataagggccctctccagaccttttgggacagcggtg

SEQ ID NO: 440652 - DNA, 140 bp, Artificial Sequence
  Synthetic
caccgctgtcccaaaaggtctggagagggcccttatgtcaagctctgagacaggggctgggttagctgaggtggagactgcaacctgttgagcagagcaaacccattctgagcctcctgccatatcagcagccagggcct

SEQ ID NO: 440653 - DNA, 140 bp, Artificial Sequence
  Synthetic
atacgccatgctgggtctccctcagctaacccagcccctgtctcagagcttgacataagggccctctccaagaggtttcaaaaccccttgatctcaggcctgagagtagttcagtgggcacgtacttgggagtcggccat

SEQ ID NO: 440654 - DNA, 140 bp, Artificial Sequence
  Synthetic
atggccgactcccaagtacgtgcccactgaactactctcaggcctgagatcaaggggttttgaaacctcttggagagggcccttatgtcaagctctgagacaggggctgggttagctgagggagacccagcatggcgtat

SEQ ID NO: 440655 - DNA, 140 bp, Artificial Sequence
  Synthetic
aggccctggctgctgatatggctagagggcttacggcagaagggctggagtctagtcagcttattgatgatagatagagaatctcaaaccaggaacacaagaaccaagatactagctcaagaccttttgggacagcggtg

SEQ ID NO: 440656 - DNA, 140 bp, Artificial Sequence
  Synthetic
caccgctgtcccaaaaggtcttgagctagtatcttggttcttgtgttcctggtttgagattctctatctatcatcaataagctgactagactccagcccttctgccgtaagccctctagccatatcagcagccagggcct

SEQ ID NO: 440657 - DNA, 140 bp, Artificial Sequence
  Synthetic
aggccctggctgctgatatgcagtactcaacatgtttccagacgccaaacttgtgttcaacagcttgttagaggtgaatgacctaatggcttccggaacacatccactgcctccttcggcgaccttttgggacagcggtg

SEQ ID NO: 440658 - DNA, 140 bp, Artificial Sequence
  Synthetic
caccgctgtcccaaaaggtcgccgaaggaggcagtggatgtgttccggaagccattaggtcattcacctctaacaagctgttgaacacaagtttggcgtctggaaacatgttgagtactgcatatcagcagccagggcct

SEQ ID NO: 440659 - DNA, 140 bp, Artificial Sequence
  Synthetic
atacgccatgctgggtctccctcattcactttgttggatgttacatgggccaagtgagatctctgaatgcaacggttattgctacatgtgccccacatgagatgtctgttcttgggggttcgtacttgggagtcggccat

SEQ ID NO: 440660 - DNA, 140 bp, Artificial Sequence
  Synthetic
atggccgactcccaagtacgaacccccaagaacagacatctcatgtggggcacatgtagcaataaccgttgcattcagagatctcacttggcccatgtaacatccaacaaagtgaatgagggagacccagcatggcgtat

SEQ ID NO: 440661 - DNA, 140 bp, Artificial Sequence
  Synthetic
atacgccatgctgggtctcccaatataccgagctatcgaggaaggagcatctaaactggggctgatcatcaagaaagaagagaccatgtgtagttatgactttctcatatatgggaagaccgtacttgggagtcggccat

SEQ ID NO: 440662 - DNA, 140 bp, Artificial Sequence
  Synthetic
atggccgactcccaagtacggtcttcccatatatgagaaagtcataactacacatggtctcttctttcttgatgatcagccccagtttagatgctccttcctcgatagctcggtatattgggagacccagcatggcgtat

SEQ ID NO: 440663 - DNA, 140 bp, Artificial Sequence
  Synthetic
atacgccatgctgggtctccagaagtggctttggcagatgacggaaccgtcaactctgatgatgaggactacttctcaagtgagaccaggagtcctgaggcggtttacacccgaatcatgcgtacttgggagtcggccat

SEQ ID NO: 440664 - DNA, 140 bp, Artificial Sequence
  Synthetic
atggccgactcccaagtacgcatgattcgggtgtaaaccgcctcaggactcctggtctcacttgagaagtagtcctcatcatcagagttgacggttccgtcatctgccaaagccacttctggagacccagcatggcgtat

SEQ ID NO: 440665 - DNA, 140 bp, Artificial Sequence
  Synthetic
aggccctggctgctgatatgggtgtattaacatgaactctcgagcatgtcagctatggtctgacctatccctccaaacacagaggtctgatgaggataaagattcttcagtgcttctggagaccttttgggacagcggtg

SEQ ID NO: 440666 - DNA, 140 bp, Artificial Sequence
  Synthetic
caccgctgtcccaaaaggtctccagaagcactgaagaatctttatcctcatcagacctctgtgtttggagggataggtcagaccatagctgacatgctcgagagttcatgttaatacacccatatcagcagccagggcct

SEQ ID NO: 440667 - DNA, 140 bp, Artificial Sequence
  Synthetic
aggccctggctgctgatatgcttattcaattgtagcagcccaaagagtgagatgcagagagctcgctccttaaattatcaagatcttgtaaggggatttcccgaagagatcatatcaaatgaccttttgggacagcggtg

SEQ ID NO: 440668 - DNA, 140 bp, Artificial Sequence
  Synthetic
caccgctgtcccaaaaggtcatttgatatgatctcttcgggaaatccccttacaagatcttgataatttaaggagcgagctctctgcatctcactctttgggctgctacaattgaataagcatatcagcagccagggcct

SEQ ID NO: 440669 - DNA, 140 bp, Artificial Sequence
  Synthetic
aggccctggctgctgatatgaatgccgccaaacttgatcctgatgatgtatgttcctacttggcagcagcaatgcagttctttgaggggacgtgtccggaagactggaccagctatggaagaccttttgggacagcggtg

SEQ ID NO: 440670 - DNA, 140 bp, Artificial Sequence
  Synthetic
caccgctgtcccaaaaggtcttccatagctggtccagtcttccggacacgtcccctcaaagaactgcattgctgctgccaagtaggaacatacatcatcaggatcaagtttggcggcattcatatcagcagccagggcct

SEQ ID NO: 440671 - DNA, 140 bp, Artificial Sequence
  Synthetic
aggccctggctgctgatatgataaaacgtactgatgtagaagggaattgggctctgacaggaggcatggaactgacaagggaccccactgtctctgagcatgcgtctttagtcggtcttcgaccttttgggacagcggtg

SEQ ID NO: 440672 - DNA, 140 bp, Artificial Sequence
  Synthetic
caccgctgtcccaaaaggtcgaagaccgactaaagacgcatgctcagagacagtggggtcccttgtcagttccatgcctcctgtcagagcccaattcccttctacatcagtacgttttatcatatcagcagccagggcct

SEQ ID NO: 440673 - DNA, 140 bp, Artificial Sequence
  Synthetic
atacgccatgctgggtctccactgacaagggaccccactgtctctgagcatgcgtctttagtcggtcttctcttgagtctgtataggttgagcaaaatatcaggacaaaacaccggtaaccgtacttgggagtcggccat

SEQ ID NO: 440674 - DNA, 140 bp, Artificial Sequence
  Synthetic
atggccgactcccaagtacggttaccggtgttttgtcctgatattttgctcaacctatacagactcaagagaagaccgactaaagacgcatgctcagagacagtggggtcccttgtcagtggagacccagcatggcgtat

SEQ ID NO: 440675 - DNA, 140 bp, Artificial Sequence
  Synthetic
atacgccatgctgggtctccacggtcaacttctccagtctgccagggaagtctacagaagacaaggccacccagaccgccagccgtgaacccaagaaagagactgtgtctgccccctctccgtacttgggagtcggccat

SEQ ID NO: 440676 - DNA, 140 bp, Artificial Sequence
  Synthetic
atggccgactcccaagtacggagagggggcagacacagtctctttcttgggttcacggctggcggtctgggtggccttgtcttctgtagacttccctggcagactggagaagttgaccgtggagacccagcatggcgtat

SEQ ID NO: 440677 - DNA, 140 bp, Artificial Sequence
  Synthetic
aggccctggctgctgatatgtggcctgtaactctagcctgagtctatcatctcactggatcaggttgatttacaagatagtgaaaaccaccagactggttggaagcattgaggacctatcgaccttttgggacagcggtg

SEQ ID NO: 440678 - DNA, 140 bp, Artificial Sequence
  Synthetic
caccgctgtcccaaaaggtcgataggtcctcaatgcttccaaccagtctggtggttttcactatcttgtaaatcaacctgatccagtgagatgatagactcaggctagagttacaggccacatatcagcagccagggcct

SEQ ID NO: 440679 - DNA, 140 bp, Artificial Sequence
  Synthetic
aggccctggctgctgatatgacaaattcccttctcgatcatcagggatatttctgtacaattttgagcagttgaagatgaaccttgacgacatagtcaaagagtcaaaaaatgtgccaaggaccttttgggacagcggtg

SEQ ID NO: 440680 - DNA, 140 bp, Artificial Sequence
  Synthetic
caccgctgtcccaaaaggtccttggcacattttttgactctttgactatgtcgtcaaggttcatcttcaactgctcaaaattgtacagaaatatccctgatgatcgagaagggaatttgtcatatcagcagccagggcct

SEQ ID NO: 440681 - DNA, 140 bp, Artificial Sequence
  Synthetic
aggccctggctgctgatatgaagagaccatgtgtagttatgactttctcatatatgggaagacccccttatttcgaggcaacatattggtgcctgaatccaaaagatgggcccgagtctcgaccttttgggacagcggtg

SEQ ID NO: 440682 - DNA, 140 bp, Artificial Sequence
  Synthetic
caccgctgtcccaaaaggtcgagactcgggcccatcttttggattcaggcaccaatatgttgcctcgaaataagggggtcttcccatatatgagaaagtcataactacacatggtctcttcatatcagcagccagggcct

SEQ ID NO: 440683 - DNA, 140 bp, Artificial Sequence
  Synthetic
aggccctggctgctgatatgtgagtgggaagtctccttattcatcgaatgccgttggtcatgtgttcaatctcattcactttgttggatgctatatgggtcaagtcagatccctaaatgcgaccttttgggacagcggtg

SEQ ID NO: 440684 - DNA, 140 bp, Artificial Sequence
  Synthetic
caccgctgtcccaaaaggtcgcatttagggatctgacttgacccatatagcatccaacaaagtgaatgagattgaacacatgaccaacggcattcgatgaataaggagacttcccactcacatatcagcagccagggcct

SEQ ID NO: 440685 - DNA, 140 bp, Artificial Sequence
  Synthetic
aggccctggctgctgatatgtattgattgcacgaaagggagacaagatcacccctgattcccttgttgagataaaacgtactgatgtagaagggaattgggccttgacgggaggtatggagaccttttgggacagcggtg

SEQ ID NO: 440686 - DNA, 140 bp, Artificial Sequence
  Synthetic
caccgctgtcccaaaaggtctccatacctcccgtcaaggcccaattcccttctacatcagtacgttttatctcaacaagggaatcaggggtgatcttgtctccctttcgtgcaatcaatacatatcagcagccagggcct

SEQ ID NO: 440687 - DNA, 140 bp, Artificial Sequence
  Synthetic
atacgccatgctgggtctcctgctccaaattccatatgaaaaaaacaggcaacaccactgataagatgaacttcctgcgcaagatagtgaagacctgtagagatgaggacgcccagaaaccgtacttgggagtcggccat

SEQ ID NO: 440688 - DNA, 140 bp, Artificial Sequence
  Synthetic
atggccgactcccaagtacggtttctgggcgtcctcatctctacaggtcttcactatcttgcgcaggaagttcatcttatcagtggtgttgcctgtttttttcatatggaatttggagcaggagacccagcatggcgtat

SEQ ID NO: 440689 - DNA, 140 bp, Artificial Sequence
  Synthetic
aggccctggctgctgatatgctatcgattgtgcatatccatcatgaaaaaaactaacacccctcctttcgaacaatcccaaatatgagcaagatttttgtcaatccaagtgccatcagaggaccttttgggacagcggtg

SEQ ID NO: 440690 - DNA, 140 bp, Artificial Sequence
  Synthetic
caccgctgtcccaaaaggtcctctgatggcacttggattgacaaaaatcttgctcatatttgggattgttcgaaaggaggggtgttagtttttttcatgatggatatgcacaatcgatagcatatcagcagccagggcct

SEQ ID NO: 440691 - DNA, 140 bp, Artificial Sequence
  Synthetic
atacgccatgctgggtctccaaacgtattctagtgactcataaagagttgaataacaagattgcgaaaaacccatgtattgtatacattctacatgaaaaaaactaacacccctcctttccgtacttgggagtcggccat

SEQ ID NO: 440692 - DNA, 140 bp, Artificial Sequence
  Synthetic
atggccgactcccaagtacggaaaggaggggtgttagtttttttcatgtagaatgtatacaatacatgggtttttcgcaatcttgttattcaactctttatgagtcactagaatacgtttggagacccagcatggcgtat

SEQ ID NO: 440693 - DNA, 140 bp, Artificial Sequence
  Synthetic
aggccctggctgctgatatgagaaacatagaagacaatcaggctcatctccaaggggaacctatcgaagtggacaaccttcctgaggacatgaggcgacttaacttggatgatgggaaatgaccttttgggacagcggtg

SEQ ID NO: 440694 - DNA, 140 bp, Artificial Sequence
  Synthetic
caccgctgtcccaaaaggtcatttcccatcatccaagttaagtcgcctcatgtcctcaggaaggttgtccacttcgataggttccccttggagatgagcctgattgtcttctatgtttctcatatcagcagccagggcct

SEQ ID NO: 440695 - DNA, 140 bp, Artificial Sequence
  Synthetic
aggccctggctgctgatatgcctggacaatgttggagtccaaatagtccgacaaatgaggtcaggagaaagattcctcaagatatggtcacagaccgtagaggagattatatcctatgtcgaccttttgggacagcggtg

SEQ ID NO: 440696 - DNA, 140 bp, Artificial Sequence
  Synthetic
caccgctgtcccaaaaggtcgacataggatataatctcctctacggtctgtgaccatatcttgaggaatctttctcctgacctcatttgtcggactatttggactccaacattgtccaggcatatcagcagccagggcct

SEQ ID NO: 440697 - DNA, 140 bp, Artificial Sequence
  Synthetic
aggccctggctgctgatatgccagactactggtagagagcctaagaaggagacgacatccactccctctcagagagaaagccaatcctcgaaggccaggatggcggctcaagctgcctctgaccttttgggacagcggtg

SEQ ID NO: 440698 - DNA, 140 bp, Artificial Sequence
  Synthetic
caccgctgtcccaaaaggtcagaggcagcttgagccgccatcctggccttcgaggattggctttctctctgagagggagtggatgtcgtctccttcttaggctctctaccagtagtctggcatatcagcagccagggcct

SEQ ID NO: 440699 - DNA, 140 bp, Artificial Sequence
  Synthetic
aggccctggctgctgatatgatatggaactgaaggtgggatacatctctgccataaaggtgaacgggttcacttgtaccggtgttgtgacagaagccgagacctacaccaactttgtcgggaccttttgggacagcggtg

SEQ ID NO: 440700 - DNA, 140 bp, Artificial Sequence
  Synthetic
caccgctgtcccaaaaggtcccgacaaagttggtgtaggtctcggcttctgtcacaacaccggtacaagtgaacccgttcacctttatggcagagatgtatcccaccttcagttccatatcatatcagcagccagggcct

SEQ ID NO: 440701 - DNA, 140 bp, Artificial Sequence
  Synthetic
aggccctggctgctgatatgagtaagccgtttggcccatgatggatccaaactccccctaagatgtgtactgggatgggtcgctttggccaactctaaaaaattccaattgttagtcgaagaccttttgggacagcggtg

SEQ ID NO: 440702 - DNA, 140 bp, Artificial Sequence
  Synthetic
caccgctgtcccaaaaggtcttcgactaacaattggaattttttagagttggccaaagcgacccatcccagtacacatcttagggggagtttggatccatcatgggccaaacggcttactcatatcagcagccagggcct

SEQ ID NO: 440703 - DNA, 140 bp, Artificial Sequence
  Synthetic
atacgccatgctgggtctccgattctcttcaaaatccttatcctgattaccattggctacggaccgtaaagaccaccaaggagtcgctcgttattatatccccgagtgttgctgatttggcgtacttgggagtcggccat

SEQ ID NO: 440704 - DNA, 140 bp, Artificial Sequence
  Synthetic
atggccgactcccaagtacgccaaatcagcaacactcggggatataataacgagcgactccttggtggtctttacggtccgtagccaatggtaatcaggataaggattttgaagagaatcggagacccagcatggcgtat

SEQ ID NO: 440705 - DNA, 140 bp, Artificial Sequence
  Synthetic
atacgccatgctgggtctcccgcaaggcaggatgttcagaatgggtctgctctgctcaacaggttgccgtctccacctcagccaacccggcccctgtctcagagcttgacattagggccccgtacttgggagtcggccat

SEQ ID NO: 440706 - DNA, 140 bp, Artificial Sequence
  Synthetic
atggccgactcccaagtacggggccctaatgtcaagctctgagacaggggccgggttggctgaggtggagacggcaacctgttgagcagagcagacccattctgaacatcctgccttgcgggagacccagcatggcgtat

SEQ ID NO: 440707 - DNA, 140 bp, Artificial Sequence
  Synthetic
atacgccatgctgggtctccgttgcctggaagtcggagggagatgtcatccccctgtgaacggagtattcttcaatggtataattttgggtccagatggaaatgttctgatccctgagatcgtacttgggagtcggccat

SEQ ID NO: 440708 - DNA, 140 bp, Artificial Sequence
  Synthetic
atggccgactcccaagtacgatctcagggatcagaacatttccatctggacccaaaattataccattgaagaatactccgttcacagggggatgacatctccctccgacttccaggcaacggagacccagcatggcgtat

SEQ ID NO: 440709 - DNA, 140 bp, Artificial Sequence
  Synthetic
atacgccatgctgggtctccgttccttaaactatcaagatcttgtaaggggatttcctgaagagatcatatcaaatccttacaatgaaatgatcataactctgattgacagtgatgtagacgtacttgggagtcggccat

SEQ ID NO: 440710 - DNA, 140 bp, Artificial Sequence
  Synthetic
atggccgactcccaagtacgtctacatcactgtcaatcagagttatgatcatttcattgtaaggatttgatatgatctcttcaggaaatccccttacaagatcttgatagtttaaggaacggagacccagcatggcgtat

SEQ ID NO: 440711 - DNA, 140 bp, Artificial Sequence
  Synthetic
aggccctggctgctgatatgaacttggtccctggagcccgattgacatacatcatctcagctgtccaaacaatttagttgtggaggacgaaggatgcaccaacctgtcagggttctcctagaccttttgggacagcggtg

SEQ ID NO: 440712 - DNA, 140 bp, Artificial Sequence
  Synthetic
caccgctgtcccaaaaggtctaggagaaccctgacaggttggtgcatccttcgtcctccacaactaaattgtttggacagctgagatgatgtatgtcaatcgggctccagggaccaagttcatatcagcagccagggcct

SEQ ID NO: 440713 - DNA, 140 bp, Artificial Sequence
  Synthetic
aggccctggctgctgatatgacagggaggaaagtgtcggtgacttctcacaacggaagggtcatatcttcatgggaatcatataaaagcggaagtgagaccaagctgtgaggacaagtcagaccttttgggacagcggtg

SEQ ID NO: 440714 - DNA, 140 bp, Artificial Sequence
  Synthetic
caccgctgtcccaaaaggtctgacttgtcctcacagcttggtctcacttccgcttttatatgattcccatgaagatatgacccttccgttgtgagaagtcaccgacactttcctccctgtcatatcagcagccagggcct

SEQ ID NO: 440715 - DNA, 140 bp, Artificial Sequence
  Synthetic
atacgccatgctgggtctccggatcctatcttcttgacaatccctcatggaccatgtgccactggatagaattaagattgaagaaactttcattaatcatctcaactaattaagcacagtcgtacttgggagtcggccat

SEQ ID NO: 440716 - DNA, 140 bp, Artificial Sequence
  Synthetic
atggccgactcccaagtacgactgtgcttaattagttgagatgattaatgaaagtttcttcaatcttaattctatccagtggcacatggtccatgagggattgtcaagaagataggatccggagacccagcatggcgtat

SEQ ID NO: 440717 - DNA, 140 bp, Artificial Sequence
  Synthetic
atacgccatgctgggtctcccatgttgactctggcaatatatgacgtcctctgacagtatcatttactaatggtgctctcatccctcaaggactgataccaaaggtcatgaacaatccaacgtacttgggagtcggccat

SEQ ID NO: 440718 - DNA, 140 bp, Artificial Sequence
  Synthetic
atggccgactcccaagtacgttggattgttcatgacctttggtatcagtccttgagggatgagagcaccattagtaaatgatactgtcagaggacgtcatatattgccagagtcaacatgggagacccagcatggcgtat

SEQ ID NO: 440719 - DNA, 140 bp, Artificial Sequence
  Synthetic
atacgccatgctgggtctccaccaccaaggagtctctcgttatcatatccccaagtgtggcagatttggacccatatgacaagtcccttcactcgagggtcttccctagcggaaagtgctcgtacttgggagtcggccat

SEQ ID NO: 440720 - DNA, 140 bp, Artificial Sequence
  Synthetic
atggccgactcccaagtacgagcactttccgctagggaagaccctcgagtgaagggacttgtcatatgggtccaaatctgccacacttggggatatgataacgagagactccttggtggtggagacccagcatggcgtat

SEQ ID NO: 440721 - DNA, 140 bp, Artificial Sequence
  Synthetic
aggccctggctgctgatatgagaagctagatttgggatccctcaaagtgggtgggactgcagcccagtcgatgatatctctttggctgtatggagcccactctgaatcaaacaggagccggaccttttgggacagcggtg

SEQ ID NO: 440722 - DNA, 140 bp, Artificial Sequence
  Synthetic
caccgctgtcccaaaaggtccggctcctgtttgattcagagtgggctccatacagccaaagagatatcatcgactgggctgcagtcccacccactttgagggatcccaaatctagcttctcatatcagcagccagggcct

SEQ ID NO: 440723 - DNA, 140 bp, Artificial Sequence
  Synthetic
atacgccatgctgggtctccctcctatgaaggacacaagcaatagatcacaatcatcttacatcccgatgagatgagcataactacaaagggctgggccatccaagcctttcagtcaagacgtacttgggagtcggccat

SEQ ID NO: 440724 - DNA, 140 bp, Artificial Sequence
  Synthetic
atggccgactcccaagtacgtcttgactgaaaggcttggatggcccagccctttgtagttatgctcatctcatcgggatgtaagatgattgtgatctattgcttgtgtccttcataggagggagacccagcatggcgtat

SEQ ID NO: 440725 - DNA, 140 bp, Artificial Sequence
  Synthetic
atacgccatgctgggtctcctaagccggacattaatgaaagcctgtacatgctaaaattcttgtatgatgcatcttgaaaaaaacaagatcttgaatcagaacctctggttgtttgattgcgtacttgggagtcggccat

SEQ ID NO: 440726 - DNA, 140 bp, Artificial Sequence
  Synthetic
atggccgactcccaagtacgcaatcaaacaaccagaggttctgattcaagatcttgtttttttcaagatgcatcatacaagaattttagcatgtacaggctttcattaatgtccggcttaggagacccagcatggcgtat

SEQ ID NO: 440727 - DNA, 140 bp, Artificial Sequence
  Synthetic
aggccctggctgctgatatgtgagcctcggtattcagacgacttgatatctcagttatgccaactatacatagctggggatcaagttttgtccatgtgcggaaactctggttatgaagtcgaccttttgggacagcggtg

SEQ ID NO: 440728 - DNA, 140 bp, Artificial Sequence
  Synthetic
caccgctgtcccaaaaggtcgacttcataaccagagtttccgcacatggacaaaacttgatccccagctatgtatagttggcataactgagatatcaagtcgtctgaataccgaggctcacatatcagcagccagggcct

SEQ ID NO: 440729 - DNA, 140 bp, Artificial Sequence
  Synthetic
aggccctggctgctgatatgggttcggaaaagcatacaccatattcaacaagaccttgatggaggctgatgctcattacaaatcagtccggacttggaatgagatcatcccctcaaaggggaccttttgggacagcggtg

SEQ ID NO: 440730 - DNA, 140 bp, Artificial Sequence
  Synthetic
caccgctgtcccaaaaggtcccctttgaggggatgatctcattccaagtccggactgatttgtaatgagcatcagcctccatcaaggtcttgttgaatatggtgtatgcttttccgaacccatatcagcagccagggcct

SEQ ID NO: 440731 - DNA, 140 bp, Artificial Sequence
  Synthetic
aggccctggctgctgatatgatgagtggaggagatgacattatctccagggtaattgactttgactccatctgggagaaaccttctgacttgaggaatttgaccacatggaggtacttccgaccttttgggacagcggtg

SEQ ID NO: 440732 - DNA, 140 bp, Artificial Sequence
  Synthetic
caccgctgtcccaaaaggtcggaagtacctccatgtggtcaaattcctcaagtcagaaggtttctcccagatggagtcaaagtcaattaccctggagataatgtcatctcctccactcatcatatcagcagccagggcct

SEQ ID NO: 440733 - DNA, 140 bp, Artificial Sequence
  Synthetic
atacgccatgctgggtctcccgagggggtcctgagttgtcttgagagagttgattatgataaagcatttgggaggtatctggccaacatatactcttcttatttattctttcatgtgatccgtacttgggagtcggccat

SEQ ID NO: 440734 - DNA, 140 bp, Artificial Sequence
  Synthetic
atggccgactcccaagtacggatcacatgaaagaataaataagaagagtatatgttggccagatacctcccaaatgctttatcataatcaactctctcaagacaactcaggaccccctcgggagacccagcatggcgtat

SEQ ID NO: 440735 - DNA, 140 bp, Artificial Sequence
  Synthetic
atacgccatgctgggtctccttaaggatcagatatggggagcgctgattgtgaccaaagattttgtgtactcccaaagctctggctgcctctttgacagaaactatacacttatgttgaacgtacttgggagtcggccat

SEQ ID NO: 440736 - DNA, 140 bp, Artificial Sequence
  Synthetic
atggccgactcccaagtacgttcaacataagtgtatagtttctgtcaaagaggcagccagagctttgggagtacacaaaatctttggtcacaatcagcgctccccatatctgatccttaaggagacccagcatggcgtat

SEQ ID NO: 440737 - DNA, 140 bp, Artificial Sequence
  Synthetic
aggccctggctgctgatatggttgtagaagagtcaatcgaccagaatctacgcaacgctgtcttggagggacagggagaaaggtgtcagttacttcccaaagcgggaaagtcatatcttcgaccttttgggacagcggtg

SEQ ID NO: 440738 - DNA, 140 bp, Artificial Sequence
  Synthetic
caccgctgtcccaaaaggtcgaagatatgactttcccgctttgggaagtaactgacacctttctccctgtccctccaagacagcgttgcgtagattctggtcgattgactcttctacaaccatatcagcagccagggcct

SEQ ID NO: 440739 - DNA, 140 bp, Artificial Sequence
  Synthetic
aggccctggctgctgatatggaatctccgggctcaatagtcctccttgaactccatgcaacagggtagattcaagagtcatgagactttcattaatcatctcagttgatcaaacaaggtcgaccttttgggacagcggtg

SEQ ID NO: 440740 - DNA, 140 bp, Artificial Sequence
  Synthetic
caccgctgtcccaaaaggtcgaccttgtttgatcaactgagatgattaatgaaagtctcatgactcttgaatctaccctgttgcatggagttcaaggaggactattgagcccggagattccatatcagcagccagggcct

SEQ ID NO: 440741 - DNA, 140 bp, Artificial Sequence
  Synthetic
atacgccatgctgggtctccagagataaggtgggtcagcttgagggaacatttgggcctagtgcaaaaaggttctttaaggttctggaccaattcgacaacatacacgacctggtctttgcgtacttgggagtcggccat

SEQ ID NO: 440742 - DNA, 140 bp, Artificial Sequence
  Synthetic
atggccgactcccaagtacgcaaagaccaggtcgtgtatgttgtcgaattggtccagaaccttaaagaacctttttgcactaggcccaaatgttccctcaagctgacccaccttatctctggagacccagcatggcgtat

SEQ ID NO: 440743 - DNA, 140 bp, Artificial Sequence
  Synthetic
aggccctggctgctgatatgggtgctttcgttttccaggaactgataccaaaggttgtggacgggccaagaggtgttttggatgactccgtgcttgggcacggacagaggtcatagtacggaccttttgggacagcggtg

SEQ ID NO: 440744 - DNA, 140 bp, Artificial Sequence
  Synthetic
caccgctgtcccaaaaggtccgtactatgacctctgtccgtgcccaagcacggagtcatccaaaacacctcttggcccgtccacaacctttggtatcagttcctggaaaacgaaagcacccatatcagcagccagggcct

SEQ ID NO: 440745 - DNA, 140 bp, Artificial Sequence
  Synthetic
aggccctggctgctgatatgaatgccgccaaacttgatccggatgatgtatgctcctacttggcagcagcaatgcagttctttgaggggacatgtccggaagactggaccagctatggaagaccttttgggacagcggtg

SEQ ID NO: 440746 - DNA, 140 bp, Artificial Sequence
  Synthetic
caccgctgtcccaaaaggtcttccatagctggtccagtcttccggacatgtcccctcaaagaactgcattgctgctgccaagtaggagcatacatcatccggatcaagtttggcggcattcatatcagcagccagggcct

SEQ ID NO: 440747 - DNA, 140 bp, Artificial Sequence
  Synthetic
atacgccatgctgggtctccatcgagtcagaggctgaacccagaggagccccaactgttcccaacatcttgagaaactctgactacaatcttaactcccctttgatagaagatccagcaacgtacttgggagtcggccat

SEQ ID NO: 440748 - DNA, 140 bp, Artificial Sequence
  Synthetic
atggccgactcccaagtacgttgctggatcttctatcaaaggggagttaagattgtagtcagagtttctcaagatgttgggaacagttggggctcctctgggttcagcctctgactcgatggagacccagcatggcgtat

SEQ ID NO: 440749 - DNA, 140 bp, Artificial Sequence
  Synthetic
aggccctggctgctgatatgaaaggtagatttgggttctcttaaggtgggcgggaccgctgcacagtcaatgatttctctctggttatatggtgcccactctgaatcaaacaggagccgggaccttttgggacagcggtg

SEQ ID NO: 440750 - DNA, 140 bp, Artificial Sequence
  Synthetic
caccgctgtcccaaaaggtcccggctcctgtttgattcagagtgggcaccatataaccagagagaaatcattgactgtgcagcggtcccgcccaccttaagagaacccaaatctacctttcatatcagcagccagggcct

SEQ ID NO: 440751 - DNA, 140 bp, Artificial Sequence
  Synthetic
atacgccatgctgggtctccaataatcaggtggtctctctgaagcctgaaattatcgtggaccaatatgagtacaagtacccggctatcaaagacctgaagaagcccagtataaccttagcgtacttgggagtcggccat

SEQ ID NO: 440752 - DNA, 140 bp, Artificial Sequence
  Synthetic
atggccgactcccaagtacgctaaggttatactgggcttcttcaggtctttgatagccgggtacttgtactcatattggtccacgataatttcaggcttcagagagaccacctgattattggagacccagcatggcgtat

SEQ ID NO: 440753 - DNA, 140 bp, Artificial Sequence
  Synthetic
atacgccatgctgggtctccgaaaagctcctgatttgaataaagcatacaaatcaattttatctggcatgaatgcagccaaactcgaccctgatgatgtatgctcttatctggctgccgccgtacttgggagtcggccat

SEQ ID NO: 440754 - DNA, 140 bp, Artificial Sequence
  Synthetic
atggccgactcccaagtacggcggcagccagataagagcatacatcatcagggtcgagtttggctgcattcatgccagataaaattgatttgtatgctttattcaaatcaggagcttttcggagacccagcatggcgtat

SEQ ID NO: 440755 - DNA, 140 bp, Artificial Sequence
  Synthetic
atacgccatgctgggtctccgattcctcaaaatatggtcacagacggtggaagagattatatcttacgtcacagtcaactttcccaacccaccgggcaaatccctagaagacaaatccaccgtacttgggagtcggccat

SEQ ID NO: 440756 - DNA, 140 bp, Artificial Sequence
  Synthetic
atggccgactcccaagtacggtggatttgtcttctagggatttgcccggtgggttgggaaagttgactgtgacgtaagatataatctcttccaccgtctgtgaccatattttgaggaatcggagacccagcatggcgtat

SEQ ID NO: 440757 - DNA, 140 bp, Artificial Sequence
  Synthetic
atacgccatgctgggtctccaaagatcaaatatggggactactgattgtgacaaaggactttgtttactctcagagttctaactgtctttttgacagaaactatacactcatgctgaaagcgtacttgggagtcggccat

SEQ ID NO: 440758 - DNA, 140 bp, Artificial Sequence
  Synthetic
atggccgactcccaagtacgctttcagcatgagtgtatagtttctgtcaaaaagacagttagaactctgagagtaaacaaagtcctttgtcacaatcagtagtccccatatttgatctttggagacccagcatggcgtat

SEQ ID NO: 440759 - DNA, 140 bp, Artificial Sequence
  Synthetic
atacgccatgctgggtctccgcttctctacgagttggagagcatatccagaaatgctctctcaatctatcgggccattgaggagggggcatccaaattggggctcatcataaagaaagaacgtacttgggagtcggccat

SEQ ID NO: 440760 - DNA, 140 bp, Artificial Sequence
  Synthetic
atggccgactcccaagtacgttctttctttatgatgagccccaatttggatgccccctcctcaatggcccgatagattgagagagcatttctggatatgctctccaactcgtagagaagcggagacccagcatggcgtat

SEQ ID NO: 440761 - DNA, 140 bp, Artificial Sequence
  Synthetic
aggccctggctgctgatatggtatctctaatgaccaaatagtcaaccttgccaatataatgtcgacagtatccaccaatgcattgactgtagcacaacactctcagtccttgattaagccgaccttttgggacagcggtg

SEQ ID NO: 440762 - DNA, 140 bp, Artificial Sequence
  Synthetic
caccgctgtcccaaaaggtcggcttaatcaaggactgagagtgttgtgctacagtcaatgcattggtggatactgtcgacattatattggcaaggttgactatttggtcattagagataccatatcagcagccagggcct

SEQ ID NO: 440763 - DNA, 140 bp, Artificial Sequence
  Synthetic
aggccctggctgctgatatgtacggctgttacaggcattgggggcacccctatatagattaccgaaagggtctgtcgaaactatatgatcaagttcatattaagaaagtgatagataaatgaccttttgggacagcggtg

SEQ ID NO: 440764 - DNA, 140 bp, Artificial Sequence
  Synthetic
caccgctgtcccaaaaggtcatttatctatcactttcttaatatgaacttgatcatatagtttcgacagaccctttcggtaatctatataggggtgcccccaatgcctgtaacagccgtacatatcagcagccagggcct

SEQ ID NO: 440765 - DNA, 140 bp, Artificial Sequence
  Synthetic
aggccctggctgctgatatgagaccaccccctaactccttatatcaaaacccaaacatggccacctaaacacatagtagacttagtgggggatacatggcacaagctcccgatcacacaagaccttttgggacagcggtg

SEQ ID NO: 440766 - DNA, 140 bp, Artificial Sequence
  Synthetic
caccgctgtcccaaaaggtcttgtgtgatcgggagcttgtgccatgtatcccccactaagtctactatgtgtttaggtggccatgtttgggttttgatataaggagttagggggtggtctcatatcagcagccagggcct

SEQ ID NO: 440767 - DNA, 140 bp, Artificial Sequence
  Synthetic
atacgccatgctgggtctcctaattagaaacattatgtctctaacaggccccgatttccctctcgaagaggcccctgtctttaaaagaacagggtcagcattgcacaggttcaagtctgccgtacttgggagtcggccat

SEQ ID NO: 440768 - DNA, 140 bp, Artificial Sequence
  Synthetic
atggccgactcccaagtacggcagacttgaacctgtgcaatgctgaccctgttcttttaaagacaggggcctcttcgagagggaaatcggggcctgttagagacataatgtttctaattaggagacccagcatggcgtat

SEQ ID NO: 440769 - DNA, 140 bp, Artificial Sequence
  Synthetic
atacgccatgctgggtctccaagctcttagacgatataccctgaaaaaaacgagatcccaaatcagaacctctggttgcttgattatttttttcatttttgttgtttttttgttaagcgtcgtacttgggagtcggccat

SEQ ID NO: 440770 - DNA, 140 bp, Artificial Sequence
  Synthetic
atggccgactcccaagtacgacgcttaacaaaaaaacaacaaaaatgaaaaaaataatcaagcaaccagaggttctgatttgggatctcgtttttttcagggtatatcgtctaagagcttggagacccagcatggcgtat

SEQ ID NO: 440771 - DNA, 140 bp, Artificial Sequence
  Synthetic
atacgccatgctgggtctcctgtcgaggctgagattgctcaccagattgctgagagcttttctaagaagtacaaatttccttcccggtcatcagggatattcttgtataactttgagcagcgtacttgggagtcggccat

SEQ ID NO: 440772 - DNA, 140 bp, Artificial Sequence
  Synthetic
atggccgactcccaagtacgctgctcaaagttatacaagaatatccctgatgaccgggaaggaaatttgtacttcttagaaaagctctcagcaatctggtgagcaatctcagcctcgacaggagacccagcatggcgtat

SEQ ID NO: 440773 - DNA, 140 bp, Artificial Sequence
  Synthetic
aggccctggctgctgatatggagaaagtcacaaatgttcatgtggtgaaaagagccctgtcactcaaggaatctataaactggttcattaccagaaactcaaatctggcccaaactctgagaccttttgggacagcggtg

SEQ ID NO: 440774 - DNA, 140 bp, Artificial Sequence
  Synthetic
caccgctgtcccaaaaggtctcagagtttgggccagatttgagtttctggtaatgaaccagtttatagattccttgagtgacagggctcttttcaccacatgaacatttgtgactttctccatatcagcagccagggcct

SEQ ID NO: 440775 - DNA, 140 bp, Artificial Sequence
  Synthetic
aggccctggctgctgatatgtctcagaccaggaacacaagaaccaagatactagctcagggagacaaccaggttctatgtccgacatatatgttgtcaccggggctgtctcgagaggggcgaccttttgggacagcggtg

SEQ ID NO: 440776 - DNA, 140 bp, Artificial Sequence
  Synthetic
caccgctgtcccaaaaggtcgcccctctcgagacagccccggtgacaacatatatgtcggacatagaacctggttgtctccctgagctagtatcttggttcttgtgttcctggtctgagacatatcagcagccagggcct

SEQ ID NO: 440777 - DNA, 140 bp, Artificial Sequence
  Synthetic
aggccctggctgctgatatgacccagacacctcaacgagtcggaagggtatggccttgctcctcggaaagggcagatctcttgagggagatctcttgggggaggaaagtggtaggtaccagaccttttgggacagcggtg

SEQ ID NO: 440778 - DNA, 140 bp, Artificial Sequence
  Synthetic
caccgctgtcccaaaaggtctggtacctaccactttcctcccccaagagatctccctcaagagatctgccctttccgaggagcaaggccatacccttccgactcgttgaggtgtctgggtcatatcagcagccagggcct

SEQ ID NO: 440779 - DNA, 140 bp, Artificial Sequence
  Synthetic
atacgccatgctgggtctcctgcttcaagtctaccatgaaaaaaacaagcaacaccactgataaaatgaactttctacgtaagatggtaaagaactgtagagatgaggacacccagaagccgtacttgggagtcggccat

SEQ ID NO: 440780 - DNA, 140 bp, Artificial Sequence
  Synthetic
atggccgactcccaagtacggcttctgggtgtcctcatctctacagttctttaccatcttacgtagaaagttcattttatcagtggtgttgcttgtttttttcatggtagacttgaagcaggagacccagcatggcgtat

SEQ ID NO: 440781 - DNA, 140 bp, Artificial Sequence
  Synthetic
aggccctggctgctgatatgctttctacgtaagatggtaaagaactgtagagatgaggacacccagaagccctctctcatatcagctcctccagatgacgatgatctatggttaccccctgaccttttgggacagcggtg

SEQ ID NO: 440782 - DNA, 140 bp, Artificial Sequence
  Synthetic
caccgctgtcccaaaaggtcagggggtaaccatagatcatcgtcatctggaggagctgatatgagagagggcttctgggtgtcctcatctctacagttctttaccatcttacgtagaaagcatatcagcagccagggcct

SEQ ID NO: 440783 - DNA, 140 bp, Artificial Sequence
  Synthetic
atacgccatgctgggtctccttcagcccaatcttaaagggaagagtttacaagattctgagtgctgaaggggagagttttctcctagccatgtcgaggataatttacctagacccttcttcgtacttgggagtcggccat

SEQ ID NO: 440784 - DNA, 140 bp, Artificial Sequence
  Synthetic
atggccgactcccaagtacgaagaagggtctaggtaaattatcctcgacatggctaggagaaaactctccccttcagcactcagaatcttgtaaactcttccctttaagattgggctgaaggagacccagcatggcgtat

SEQ ID NO: 440785 - DNA, 140 bp, Artificial Sequence
  Synthetic
atacgccatgctgggtctcctctgtcagtacagacactatgtctgatttgactcaagacgggaagaactatgatttcatgttccagccattgatgctttatgcgcagacatggacatcagcgtacttgggagtcggccat

SEQ ID NO: 440786 - DNA, 140 bp, Artificial Sequence
  Synthetic
atggccgactcccaagtacgctgatgtccatgtctgcgcataaagcatcaatggctggaacatgaaatcatagttcttcccgtcttgagtcaaatcagacatagtgtctgtactgacagaggagacccagcatggcgtat

SEQ ID NO: 440787 - DNA, 140 bp, Artificial Sequence
  Synthetic
atacgccatgctgggtctcccgaactgatctcaggagtgatttcatatatcctcttaagactggataatcacccttctttgtacataatgctcagagagccctctctcagaggagagatacgtacttgggagtcggccat

SEQ ID NO: 440788 - DNA, 140 bp, Artificial Sequence
  Synthetic
atggccgactcccaagtacgtatctctcctctgagagagggctctctgagcattatgtacaaagaagggtgattatccagtcttaagaggatatatgaaatcactcctgagatcagttcgggagacccagcatggcgtat

SEQ ID NO: 440789 - DNA, 140 bp, Artificial Sequence
  Synthetic
aggccctggctgctgatatgacccttctttgtacataatgctcagagagccctctctcagaggagagatattttccattccccaaaaggttcccgctgcttacccgaccacaatgaaagagaccttttgggacagcggtg

SEQ ID NO: 440790 - DNA, 140 bp, Artificial Sequence
  Synthetic
caccgctgtcccaaaaggtctctttcattgtggtcgggtaagcagcgggaaccttttggggaatggaaaatatctctcctctgagagagggctctctgagcattatgtacaaagaagggtcatatcagcagccagggcct

SEQ ID NO: 440791 - DNA, 140 bp, Artificial Sequence
  Synthetic
aggccctggctgctgatatgcttcagttcgtctttcttgggaatccccgaatcaatcattggactgatacaaaactcccggacgataagaaggcagtttagaaagagtctttcaagaactgaccttttgggacagcggtg

SEQ ID NO: 440792 - DNA, 140 bp, Artificial Sequence
  Synthetic
caccgctgtcccaaaaggtcagttcttgaaagactctttctaaactgccttcttatcgtccgggagttttgtatcagtccaatgattgattcggggattcccaagaaagacgaactgaagcatatcagcagccagggcct

SEQ ID NO: 440793 - DNA, 140 bp, Artificial Sequence
  Synthetic
atacgccatgctgggtctccgactttagaagctccaagatgacatacctgactctgatcacctaccagtctcatcttttacttcagagagttgagaaaaatctctccaaaagtatgagagcgtacttgggagtcggccat

SEQ ID NO: 440794 - DNA, 140 bp, Artificial Sequence
  Synthetic
atggccgactcccaagtacgctctcatacttttggagagatttttctcaactctctgaagtaaaagatgagactggtaggtgatcagagtcaggtatgtcatcttggagcttctaaagtcggagacccagcatggcgtat

SEQ ID NO: 440795 - DNA, 140 bp, Artificial Sequence
  Synthetic
atacgccatgctgggtctccagcttggtccttggagccccatcgatatacatcacctcagctgtccaaataatttagttgtggaggacgaggggtgcaccaatctatcagggttctcttacgtacttgggagtcggccat

SEQ ID NO: 440796 - DNA, 140 bp, Artificial Sequence
  Synthetic
atggccgactcccaagtacgtaagagaaccctgatagattggtgcacccctcgtcctccacaactaaattatttggacagctgaggtgatgtatatcgatggggctccaaggaccaagctggagacccagcatggcgtat

SEQ ID NO: 440797 - DNA, 140 bp, Artificial Sequence
  Synthetic
aggccctggctgctgatatgcagatctgcttagggagatctcttggggaagaaaagtggtaggtacgacagttcctcatccttctgagatgttggggttactccccaaatcctccatttcgaccttttgggacagcggtg

SEQ ID NO: 440798 - DNA, 140 bp, Artificial Sequence
  Synthetic
caccgctgtcccaaaaggtcgaaatggaggatttggggagtaaccccaacatctcagaaggatgaggaactgtcgtacctaccacttttcttccccaagagatctccctaagcagatctgcatatcagcagccagggcct

SEQ ID NO: 440799 - DNA, 140 bp, Artificial Sequence
  Synthetic
aggccctggctgctgatatgctataaactggttcattactagaaattccaacttggctcaaactctaattaggaacattatgtctctgactggccctgatttccctctagaggaggccccgaccttttgggacagcggtg

SEQ ID NO: 440800 - DNA, 140 bp, Artificial Sequence
  Synthetic
caccgctgtcccaaaaggtcggggcctcctctagagggaaatcagggccagtcagagacataatgttcctaattagagtttgagccaagttggaatttctagtaatgaaccagtttatagcatatcagcagccagggcct

SEQ ID NO: 440801 - DNA, 140 bp, Artificial Sequence
  Synthetic
aggccctggctgctgatatgtgggaataacggtttcttccacctactgctcaaccaaccatgattacaccatctggatgcccgaggaaccaagactcgggacatcttgcgacatttttacgaccttttgggacagcggtg

SEQ ID NO: 440802 - DNA, 140 bp, Artificial Sequence
  Synthetic
caccgctgtcccaaaaggtcgtaaaaatgtcgcaagatgtcccgagtcttggttcctcgggcatccagatggtgtaatcatggttggttgagcagtaggtggaagaaaccgttattcccacatatcagcagccagggcct

SEQ ID NO: 440803 - DNA, 140 bp, Artificial Sequence
  Synthetic
atacgccatgctgggtctccatcgagtcagagactgaacccaggggatcccccactgttcccaacatcttgaggaactctgactacaatctcaactctcctttgatcgaagaccctgctacgtacttgggagtcggccat

SEQ ID NO: 440804 - DNA, 140 bp, Artificial Sequence
  Synthetic
atggccgactcccaagtacgtagcagggtcttcgatcaaaggagagttgagattgtagtcagagttcctcaagatgttgggaacagtgggggatcccctgggttcagtctctgactcgatggagacccagcatggcgtat

SEQ ID NO: 440805 - DNA, 140 bp, Artificial Sequence
  Synthetic
aggccctggctgctgatatgcatgagtgggggagatgatatcatctccagggtaattgactttgattccatctgggagaaaccttctgacttgaggaacttgactacatggaggtacttcgaccttttgggacagcggtg

SEQ ID NO: 440806 - DNA, 140 bp, Artificial Sequence
  Synthetic
caccgctgtcccaaaaggtcgaagtacctccatgtagtcaagttcctcaagtcagaaggtttctcccagatggaatcaaagtcaattaccctggagatgatatcatctcccccactcatgcatatcagcagccagggcct

SEQ ID NO: 440807 - DNA, 140 bp, Artificial Sequence
  Synthetic
aggccctggctgctgatatgcaccaacgctttgactgtcgcacaacactcccagtctttgattaagccgatgagagacttcttgctcatgtcagtacaggcagtcttccattacctgctggaccttttgggacagcggtg

SEQ ID NO: 440808 - DNA, 140 bp, Artificial Sequence
  Synthetic
caccgctgtcccaaaaggtccagcaggtaatggaagactgcctgtactgacatgagcaagaagtctctcatcggcttaatcaaagactgggagtgttgtgcgacagtcaaagcgttggtgcatatcagcagccagggcct

SEQ ID NO: 440809 - DNA, 140 bp, Artificial Sequence
  Synthetic
atacgccatgctgggtctccggtggactttgatgatgtatgaagcatttttacagtatcagcgactaatggtgctctcaccctctaaggactggtactaaaggtagcggacaggctgacccgtacttgggagtcggccat

SEQ ID NO: 440810 - DNA, 140 bp, Artificial Sequence
  Synthetic
atggccgactcccaagtacgggtcagcctgtccgctacctttagtaccagtccttagagggtgagagcaccattagtcgctgatactgtaaaaatgcttcatacatcatcaaagtccaccggagacccagcatggcgtat

SEQ ID NO: 440811 - DNA, 140 bp, Artificial Sequence
  Synthetic
atacgccatgctgggtctccggtttggaaaggcatacactatattcaacaagactttgatggaggctgacgcccactacaagtcagttcggacttggaacgagatcatcccctcaaaaggcgtacttgggagtcggccat

SEQ ID NO: 440812 - DNA, 140 bp, Artificial Sequence
  Synthetic
atggccgactcccaagtacgccttttgaggggatgatctcgttccaagtccgaactgacttgtagtgggcgtcagcctccatcaaagtcttgttgaatatagtgtatgcctttccaaaccggagacccagcatggcgtat

SEQ ID NO: 440813 - DNA, 140 bp, Artificial Sequence
  Synthetic
atacgccatgctgggtctccgtgtttgaaagtcagagagaggtgtcatcctcctgtggacggagtgttcttcaacggcataattctgggtccggacgggaatgtcctgatacctgagatgcgtacttgggagtcggccat

SEQ ID NO: 440814 - DNA, 140 bp, Artificial Sequence
  Synthetic
atggccgactcccaagtacgcatctcaggtatcaggacattcccgtccggacccagaattatgccgttgaagaacactccgtccacaggaggatgacacctctctctgactttcaaacacggagacccagcatggcgtat

SEQ ID NO: 440815 - DNA, 140 bp, Artificial Sequence
  Synthetic
atacgccatgctgggtctcctcaccatgatgattgatccaggggaggtttatgatgaccccatcgatccagtcgagtctgagagtgagccaagaggaaactccaatatccccaacatcttcgtacttgggagtcggccat

SEQ ID NO: 440816 - DNA, 140 bp, Artificial Sequence
  Synthetic
atggccgactcccaagtacgaagatgttggggatattggagtttcctcttggctcactctcagactcgactggatcgatggggtcatcataaacctcccctggatcaatcatcatggtgaggagacccagcatggcgtat

SEQ ID NO: 440817 - DNA, 140 bp, Artificial Sequence
  Synthetic
atacgccatgctgggtctccgacggttattgctgcatgtgcccctcatgagatgtctgttctagggggctatttgggagaggaattcttcggaaaagggacatttgaaagaaggttcttccgtacttgggagtcggccat

SEQ ID NO: 440818 - DNA, 140 bp, Artificial Sequence
  Synthetic
atggccgactcccaagtacggaagaaccttctttcaaatgtcccttttccgaagaattcctctcccaaatagccccctagaacagacatctcatgaggggcacatgcagcaataaccgtcggagacccagcatggcgtat

SEQ ID NO: 440819 - DNA, 140 bp, Artificial Sequence
  Synthetic
atacgccatgctgggtctccctttagaagtgctaaaatgacgtacctgaccctcattacttaccagtctcatctcctactccagagggttgagagaaacttgtctaagagtatgagagctcgtacttgggagtcggccat

SEQ ID NO: 440820 - DNA, 140 bp, Artificial Sequence
  Synthetic
atggccgactcccaagtacgagctctcatactcttagacaagtttctctcaaccctctggagtaggagatgagactggtaagtaatgagggtcaggtacgtcattttagcacttctaaagggagacccagcatggcgtat

SEQ ID NO: 440821 - DNA, 140 bp, Artificial Sequence
  Synthetic
atacgccatgctgggtctccatctcctactccagagggttgagagaaacttgtctaagagtatgagagctaacctgagacaaatgagttccttgatgaggcaggtgctgggtggacacggcgtacttgggagtcggccat

SEQ ID NO: 440822 - DNA, 140 bp, Artificial Sequence
  Synthetic
atggccgactcccaagtacgccgtgtccacccagcacctgcctcatcaaggaactcatttgtctcaggttagctctcatactcttagacaagtttctctcaaccctctggagtaggagatggagacccagcatggcgtat

SEQ ID NO: 440823 - DNA, 140 bp, Artificial Sequence
  Synthetic
atacgccatgctgggtctcctcaagagtcagaaaacattcattagccatctcagctgatcaaaaacagtcatgtagatttttatgatgtatgatgtattttgacagtgtcattgactaatcgtacttgggagtcggccat

SEQ ID NO: 440824 - DNA, 140 bp, Artificial Sequence
  Synthetic
atggccgactcccaagtacgattagtcaatgacactgtcaaaatacatcatacatcataaaaatctacatgactgtttttgatcagctgagatggctaatgaatgttttctgactcttgaggagacccagcatggcgtat

SEQ ID NO: 440825 - DNA, 140 bp, Artificial Sequence
  Synthetic
aggccctggctgctgatatgcgcccattataagcttaagcccattctagacgatctcaatgttttcccatccctctgtcttgtagttggggacggatcaggagggatatcaagggcagttgaccttttgggacagcggtg

SEQ ID NO: 440826 - DNA, 140 bp, Artificial Sequence
  Synthetic
caccgctgtcccaaaaggtcaactgcccttgatatccctcctgatccgtccccaactacaagacagagggatgggaaaacattgagatcgtctagaatgggcttaagcttataatgggcgcatatcagcagccagggcct

SEQ ID NO: 440827 - DNA, 140 bp, Artificial Sequence
  Synthetic
aggccctggctgctgatatgtcaaaactctcggacaataagaaggcagtttagaaagagtctctcaagaactttagaagagtccttctacaactcagagatccacgggattaataggatggaccttttgggacagcggtg

SEQ ID NO: 440828 - DNA, 140 bp, Artificial Sequence
  Synthetic
caccgctgtcccaaaaggtccatcctattaatcccgtggatctctgagttgtagaaggactcttctaaagttcttgagagactctttctaaactgccttcttattgtccgagagttttgacatatcagcagccagggcct

SEQ ID NO: 440829 - DNA, 140 bp, Artificial Sequence
  Synthetic
aggccctggctgctgatatgataaagcgtactgatgtagaagggaattgggctctgacaggaggcatggaactgacaagggaccccactgtctctgaacatgcatctttagtcggtcttcgaccttttgggacagcggtg

SEQ ID NO: 440830 - DNA, 140 bp, Artificial Sequence
  Synthetic
caccgctgtcccaaaaggtcgaagaccgactaaagatgcatgttcagagacagtggggtcccttgtcagttccatgcctcctgtcagagcccaattcccttctacatcagtacgctttatcatatcagcagccagggcct

SEQ ID NO: 440831 - DNA, 140 bp, Artificial Sequence
  Synthetic
atacgccatgctgggtctccaaagataaaatatgggggttgctgattgtgaccaaagattttgtgtattcccaaagttctggttgtctctttgatagaaactatacacttatgttaaaagcgtacttgggagtcggccat

SEQ ID NO: 440832 - DNA, 140 bp, Artificial Sequence
  Synthetic
atggccgactcccaagtacgcttttaacataagtgtatagtttctatcaaagagacaaccagaactttgggaatacacaaaatctttggtcacaatcagcaacccccatattttatctttggagacccagcatggcgtat

SEQ ID NO: 440833 - DNA, 140 bp, Artificial Sequence
  Synthetic
aggccctggctgctgatatgtgagtgggaagtctccttattcatcaaatgccgtcggtcatgtgttcaatctcattcactttgttggatgctatatgggtcaagtcagatctctaaatgcgaccttttgggacagcggtg

SEQ ID NO: 440834 - DNA, 140 bp, Artificial Sequence
  Synthetic
caccgctgtcccaaaaggtcgcatttagagatctgacttgacccatatagcatccaacaaagtgaatgagattgaacacatgaccgacggcatttgatgaataaggagacttcccactcacatatcagcagccagggcct

SEQ ID NO: 440835 - DNA, 140 bp, Artificial Sequence
  Synthetic
aggccctggctgctgatatggatagtgaagactaccagactcgttggcagcatcgaagacttgtctggagaggtggaaagacaccttcatgggtacaataggtggatcaccctagaggatgaccttttgggacagcggtg

SEQ ID NO: 440836 - DNA, 140 bp, Artificial Sequence
  Synthetic
caccgctgtcccaaaaggtcatcctctagggtgatccacctattgtacccatgaaggtgtctttccacctctccagacaagtcttcgatgctgccaacgagtctggtagtcttcactatccatatcagcagccagggcct

SEQ ID NO: 440837 - DNA, 140 bp, Artificial Sequence
  Synthetic
aggccctggctgctgatatgctcccggaagcctgtacatgctaagactcttgtgtgatgtatcttgaaaaaaacaagatcttgaatccgatcctctggttgtttgattgtttttttcatcgaccttttgggacagcggtg

SEQ ID NO: 440838 - DNA, 140 bp, Artificial Sequence
  Synthetic
caccgctgtcccaaaaggtcgatgaaaaaaacaatcaaacaaccagaggatcggattcaagatcttgtttttttcaagatacatcacacaagagtcttagcatgtacaggcttccgggagcatatcagcagccagggcct

SEQ ID NO: 440839 - DNA, 140 bp, Artificial Sequence
  Synthetic
aggccctggctgctgatatgaataatcaggtggtctctttgaagcctgagattatcgtggatcaatatgagtacaagtaccctgctattaaggacttgaagaagcccagtatcaccctaggaccttttgggacagcggtg

SEQ ID NO: 440840 - DNA, 140 bp, Artificial Sequence
  Synthetic
caccgctgtcccaaaaggtcctagggtgatactgggcttcttcaagtccttaatagcagggtacttgtactcatattgatccacgataatctcaggcttcaaagagaccacctgattattcatatcagcagccagggcct

SEQ ID NO: 440841 - DNA, 140 bp, Artificial Sequence
  Synthetic
atacgccatgctgggtctcccgcattgactatgacagacaacttgaacaaggtgtttaagaagttgatcgacagagtcaccggacaggggcttttagactattcaagagtcacatacgcccgtacttgggagtcggccat

SEQ ID NO: 440842 - DNA, 140 bp, Artificial Sequence
  Synthetic
atggccgactcccaagtacgggcgtatgtgactcttgaatagtctaaaagcccctgtccggtgactctgtcgatcaacttcttaaacaccttgttcaagttgtctgtcatagtcaatgcgggagacccagcatggcgtat

SEQ ID NO: 440843 - DNA, 140 bp, Artificial Sequence
  Synthetic
aggccctggctgctgatatgacagagtcaccggacaggggcttttagactattcaagagtcacatacgcctttcacctggactacgagaagtggaataatcatcagcggctggagtcgacgaccttttgggacagcggtg

SEQ ID NO: 440844 - DNA, 140 bp, Artificial Sequence
  Synthetic
caccgctgtcccaaaaggtcgtcgactccagccgctgatgattattccacttctcgtagtccaggtgaaaggcgtatgtgactcttgaatagtctaaaagcccctgtccggtgactctgtcatatcagcagccagggcct

SEQ ID NO: 440845 - DNA, 140 bp, Artificial Sequence
  Synthetic
aggccctggctgctgatatgacggtcaactttcctaaccctccaggaaggtcttcggaggataaatcaacccaaactactggccgggagctcaagaaggagacaacatccattctttctcgaccttttgggacagcggtg

SEQ ID NO: 440846 - DNA, 140 bp, Artificial Sequence
  Synthetic
caccgctgtcccaaaaggtcgagaaagaatggatgttgtctccttcttgagctcccggccagtagtttgggttgatttatcctccgaagaccttcctggagggttaggaaagttgaccgtcatatcagcagccagggcct

SEQ ID NO: 440847 - DNA, 140 bp, Artificial Sequence
  Synthetic
aggccctggctgctgatatgactgacgagggaccccactgttccagagcatgcgtctttagtcggtcttctcttgagcctgtatagactaagcaaaatatctgggcaaaacaccggtaacgaccttttgggacagcggtg

SEQ ID NO: 440848 - DNA, 140 bp, Artificial Sequence
  Synthetic
caccgctgtcccaaaaggtcgttaccggtgttttgcccagatattttgcttagtctatacaggctcaagagaagaccgactaaagacgcatgctctggaacagtggggtccctcgtcagtcatatcagcagccagggcct

SEQ ID NO: 440849 - DNA, 140 bp, Artificial Sequence
  Synthetic
aggccctggctgctgatatgcgtgacccgtctggcccatgatggatccaaaatccccctaagatgtgtactgggatgggtcgctttggccaactccaagaaattccaattgctagtcgaggaccttttgggacagcggtg

SEQ ID NO: 440850 - DNA, 140 bp, Artificial Sequence
  Synthetic
caccgctgtcccaaaaggtcctcgactagcaattggaatttcttggagttggccaaagcgacccatcccagtacacatcttagggggattttggatccatcatgggccagacgggtcacgcatatcagcagccagggcct

SEQ ID NO: 440851 - DNA, 140 bp, Artificial Sequence
  Synthetic
aggccctggctgctgatatgtaccaatgccttgactgtggcacaacactctcaatctttaatcaagccgatgagggactttttacttatgtctgttcaagctgtattccattacctgctggaccttttgggacagcggtg

SEQ ID NO: 440852 - DNA, 140 bp, Artificial Sequence
  Synthetic
caccgctgtcccaaaaggtccagcaggtaatggaatacagcttgaacagacataagtaaaaagtccctcatcggcttgattaaagattgagagtgttgtgccacagtcaaggcattggtacatatcagcagccagggcct

SEQ ID NO: 440853 - DNA, 140 bp, Artificial Sequence
  Synthetic
aggccctggctgctgatatgctttctatgtaagatagtgaaaaactgtagggatgaggacacccaaaagccctctcctgcgtcagcccctccggatggcgatgacctgtggcttccacctgaccttttgggacagcggtg

SEQ ID NO: 440854 - DNA, 140 bp, Artificial Sequence
  Synthetic
caccgctgtcccaaaaggtcaggtggaagccacaggtcatcgccatccggaggggctgacgcaggagagggcttttgggtgtcctcatccctacagtttttcactatcttacatagaaagcatatcagcagccagggcct

SEQ ID NO: 440855 - DNA, 140 bp, Artificial Sequence
  Synthetic
aggccctggctgctgatatgatttgggggaggagtttttcgggaaggggacgtttgagaggagattcttcagagatgagaaggaacttcaagaatatgagacggctgaattgacaaagacgaccttttgggacagcggtg

SEQ ID NO: 440856 - DNA, 140 bp, Artificial Sequence
  Synthetic
caccgctgtcccaaaaggtcgtctttgtcaattcagccgtctcatattcttgaagttccttctcatctctgaagaatctcctctcaaacgtccccttcccgaaaaactcctcccccaaatcatatcagcagccagggcct

SEQ ID NO: 440857 - DNA, 140 bp, Artificial Sequence
  Synthetic
aggccctggctgctgatatgcatgacagacaacctgaacaaggtgtttaagaagctgatcgaccgggtcaccgggcaagggcttttggactattcgagggttacctatgcatttcatctggaccttttgggacagcggtg

SEQ ID NO: 440858 - DNA, 140 bp, Artificial Sequence
  Synthetic
caccgctgtcccaaaaggtccagatgaaatgcataggtaaccctcgaatagtccaaaagcccttgcccggtgacccggtcgatcagcttcttaaacaccttgttcaggttgtctgtcatgcatatcagcagccagggcct

SEQ ID NO: 440859 - DNA, 140 bp, Artificial Sequence
  Synthetic
aggccctggctgctgatatgatgaacgggggcagactaaagagatcgcacatacggagatatgtctcagtcagctcaaatcaccaagctcgtccaaactcatttgctgagtttctaaacagaccttttgggacagcggtg

SEQ ID NO: 440860 - DNA, 140 bp, Artificial Sequence
  Synthetic
caccgctgtcccaaaaggtctgtttagaaactcagcaaatgagtttggacgagcttggtgatttgagctgactgagacatatctccgtatgtgcgatctctttagtctgcccccgttcatcatatcagcagccagggcct

SEQ ID NO: 440861 - DNA, 140 bp, Artificial Sequence
  Synthetic
atacgccatgctgggtctcccagctcaaatcaccaagctcgtccaaactcatttgctgagtttctaaacaagacgtattctagtgactcgtaaatagttgaataacggaacacaataaatcgtacttgggagtcggccat

SEQ ID NO: 440862 - DNA, 140 bp, Artificial Sequence
  Synthetic
atggccgactcccaagtacgatttattgtgttccgttattcaactatttacgagtcactagaatacgtcttgtttagaaactcagcaaatgagtttggacgagcttggtgatttgagctgggagacccagcatggcgtat

SEQ ID NO: 440863 - DNA, 140 bp, Artificial Sequence
  Synthetic
atacgccatgctgggtctccataatcagataatatcccgcaatttcatcacttgtttacttctggaggagagaacatacgggcttaactccaatccttgggagcaatagaacaaaaaaaccgtacttgggagtcggccat

SEQ ID NO: 440864 - DNA, 140 bp, Artificial Sequence
  Synthetic
atggccgactcccaagtacggtttttttgttctattgctcccaaggattggagttaagcccgtatgttctctcctccagaagtaaacaagtgatgaaattgcgggatattatctgattatggagacccagcatggcgtat

SEQ ID NO: 440865 - DNA, 140 bp, Artificial Sequence
  Synthetic
atacgccatgctgggtctcccctggacaatgttggagtacagatagtcagacaaatgaggtcaggggagagattcctcaagatatggtcacaaaccgtggaggaaatcatatcttatgtccgtacttgggagtcggccat

SEQ ID NO: 440866 - DNA, 140 bp, Artificial Sequence
  Synthetic
atggccgactcccaagtacggacataagatatgatttcctccacggtttgtgaccatatcttgaggaatctctcccctgacctcatttgtctgactatctgtactccaacattgtccaggggagacccagcatggcgtat

SEQ ID NO: 440867 - DNA, 140 bp, Artificial Sequence
  Synthetic
atacgccatgctgggtctcctacatggaacttaaagtgggatacatctcagccataaaagtgaacgggttcacttgcacaggtgttgtgacagaggcagaaacctacaccaactttgttgcgtacttgggagtcggccat

SEQ ID NO: 440868 - DNA, 140 bp, Artificial Sequence
  Synthetic
atggccgactcccaagtacgcaacaaagttggtgtaggtttctgcctctgtcacaacacctgtgcaagtgaacccgttcacttttatggctgagatgtatcccactttaagttccatgtaggagacccagcatggcgtat

SEQ ID NO: 440869 - DNA, 140 bp, Artificial Sequence
  Synthetic
aggccctggctgctgatatgagagagacagtcaatcctcgaaagccaggatggtggctcaagccgcctctggtcccccagccctcgagtggtctgctaccaacgaggaggatgatctgtcgaccttttgggacagcggtg

SEQ ID NO: 440870 - DNA, 140 bp, Artificial Sequence
  Synthetic
caccgctgtcccaaaaggtcgacagatcatcctcctcgttggtagcagaccactcgagggctgggggaccagaggcggcttgagccaccatcctggctttcgaggattgactgtctctctcatatcagcagccagggcct

SEQ ID NO: 440871 - DNA, 140 bp, Artificial Sequence
  Synthetic
atacgccatgctgggtctcccttcagaagttccaagatgacctatttaaccctcatcacctatcagtctcatcttttacttcagagggttgagaagaatctctctaaaagtatgagggcccgtacttgggagtcggccat

SEQ ID NO: 440872 - DNA, 140 bp, Artificial Sequence
  Synthetic
atggccgactcccaagtacgggccctcatacttttagagagattcttctcaaccctctgaagtaaaagatgagactgataggtgatgagggttaaataggtcatcttggaacttctgaagggagacccagcatggcgtat

SEQ ID NO: 440873 - DNA, 140 bp, Artificial Sequence
  Synthetic
aggccctggctgctgatatgttaaaaatgaaccttgacgacatagttaaagaagcaaaaaatgtgccgggtgtcacccgtttagcccatgacggatctaaactccctctaagatgtgtacgaccttttgggacagcggtg

SEQ ID NO: 440874 - DNA, 140 bp, Artificial Sequence
  Synthetic
caccgctgtcccaaaaggtcgtacacatcttagagggagtttagatccgtcatgggctaaacgggtgacacccggcacattttttgcttctttaactatgtcgtcaaggttcatttttaacatatcagcagccagggcct

SEQ ID NO: 440875 - DNA, 140 bp, Artificial Sequence
  Synthetic
aggccctggctgctgatatgtgtcacccgtttagcccatgacggatctaaactccctctaagatgtgtactgggatgggttggtctggccaattctaaaaaattccagttgttagtcgaggaccttttgggacagcggtg

SEQ ID NO: 440876 - DNA, 140 bp, Artificial Sequence
  Synthetic
caccgctgtcccaaaaggtcctcgactaacaactggaattttttagaattggccagaccaacccatcccagtacacatcttagagggagtttagatccgtcatgggctaaacgggtgacacatatcagcagccagggcct

SEQ ID NO: 440877 - DNA, 140 bp, Artificial Sequence
  Synthetic
aggccctggctgctgatatgcttttgcatcaacggagaggttaaggtgtgtagcccgaacggttactcgtttaggatcctgcgacacattctgagatcattcgacgagatatattctggggaccttttgggacagcggtg

SEQ ID NO: 440878 - DNA, 140 bp, Artificial Sequence
  Synthetic
caccgctgtcccaaaaggtccccagaatatatctcgtcgaatgatctcagaatgtgtcgcaggatcctaaacgagtaaccgttcgggctacacaccttaacctctccgttgatgcaaaagcatatcagcagccagggcct

SEQ ID NO: 440879 - DNA, 140 bp, Artificial Sequence
  Synthetic
aggccctggctgctgatatgaatcacagaatgatcgggctagtcaaggttgttgtcggactggctttgtcaggagcccccgtcccagagggcatgaactgggtatacaagttgaggagaagaccttttgggacagcggtg

SEQ ID NO: 440880 - DNA, 140 bp, Artificial Sequence
  Synthetic
caccgctgtcccaaaaggtcttctcctcaacttgtatacccagttcatgccctctgggacgggggctcctgacaaagccagtccgacaacaaccttgactagcccgatcattctgtgattcatatcagcagccagggcct

SEQ ID NO: 440881 - DNA, 140 bp, Artificial Sequence
  Synthetic
aggccctggctgctgatatgtttcaatggtataatattagggtctgacggccatgttctaatcccagagatgcagtcatccctcctccagcaacatatggagttgttggaatcttcagttgaccttttgggacagcggtg

SEQ ID NO: 440882 - DNA, 140 bp, Artificial Sequence
  Synthetic
caccgctgtcccaaaaggtcaactgaagattccaacaactccatatgttgctggaggagggatgactgcatctctgggattagaacatggccgtcagaccctaatattataccattgaaacatatcagcagccagggcct

SEQ ID NO: 440883 - DNA, 140 bp, Artificial Sequence
  Synthetic
atacgccatgctgggtctccaggtctcaggagttgacctgggtctcccgaaatgggggaagtatgtattgatgattgcaggggccttgattgccctgatgttgataattttcctgatgaccgtacttgggagtcggccat

SEQ ID NO: 440884 - DNA, 140 bp, Artificial Sequence
  Synthetic
atggccgactcccaagtacggtcatcaggaaaattatcaacatcagggcaatcaaggcccctgcaatcatcaatacatacttcccccatttcgggagacccaggtcaactcctgagacctggagacccagcatggcgtat

SEQ ID NO: 440885 - DNA, 140 bp, Artificial Sequence
  Synthetic
atacgccatgctgggtctccatgttgcagaagagtcaatcgaccagaatctacgcaaagcaatcttggagggacagggagaaatgtgtcagtcacttcccaaagcggaaaagtcatatctcgtacttgggagtcggccat

SEQ ID NO: 440886 - DNA, 140 bp, Artificial Sequence
  Synthetic
atggccgactcccaagtacgagatatgacttttccgctttgggaagtgactgacacatttctccctgtccctccaagattgctttgcgtagattctggtcgattgactcttctgcaacatggagacccagcatggcgtat

SEQ ID NO: 440887 - DNA, 140 bp, Artificial Sequence
  Synthetic
aggccctggctgctgatatgtaaatgacctgatggcatcaggaacacatccgttgcccccctcagcaatcatgagtggaggagatgacatcatatccagggtaattggcttcgactccatgaccttttgggacagcggtg

SEQ ID NO: 440888 - DNA, 140 bp, Artificial Sequence
  Synthetic
caccgctgtcccaaaaggtcatggagtcgaagccaattaccctggatatgatgtcatctcctccactcatgattgctgaggggggcaacggatgtgttcctgatgccatcaggtcatttacatatcagcagccagggcct

SEQ ID NO: 440889 - DNA, 140 bp, Artificial Sequence
  Synthetic
atacgccatgctgggtctcctcatgggagtcatataagagtggaggcgagaccagactgtgaaggccggtcatccttttgacacctcaagtccagaggataacctcctctcggggttgggcgtacttgggagtcggccat

SEQ ID NO: 440890 - DNA, 140 bp, Artificial Sequence
  Synthetic
atggccgactcccaagtacgcccaaccccgagaggaggttatcctctggacttgaggtgtcaaaaggatgaccggccttcacagtctggtctcgcctccactcttatatgactcccatgaggagacccagcatggcgtat

SEQ ID NO: 440891 - DNA, 140 bp, Artificial Sequence
  Synthetic
aggccctggctgctgatatgtcaaaagacttaaggaatgatgattcctcaagctcttttgtttgtgccccttctggcttttccaatgtgtttcgggaaattccccatctacacaataccagaccttttgggacagcggtg

SEQ ID NO: 440892 - DNA, 140 bp, Artificial Sequence
  Synthetic
caccgctgtcccaaaaggtctggtattgtgtagatggggaatttcccgaaacacattggaaaagccagaaggggcacaaacaaaagagcttgaggaatcatcattccttaagtcttttgacatatcagcagccagggcct

SEQ ID NO: 440893 - DNA, 140 bp, Artificial Sequence
  Synthetic
aggccctggctgctgatatggacaaacttggtccctggagcccgattgacatacatcatctcagctgtccaaataacttggttgtggaagacgaaggatgcaccaacttgtcgggtttctgaccttttgggacagcggtg

SEQ ID NO: 440894 - DNA, 140 bp, Artificial Sequence
  Synthetic
caccgctgtcccaaaaggtcagaaacccgacaagttggtgcatccttcgtcttccacaaccaagttatttggacagctgagatgatgtatgtcaatcgggctccagggaccaagtttgtccatatcagcagccagggcct

SEQ ID NO: 440895 - DNA, 140 bp, Artificial Sequence
  Synthetic
aggccctggctgctgatatgacggtgctttcattctccaggaactgataccaaaggttgtggacaagccaaggggtgcttcggattactctgtgcttgggcacagaaagaggtcgtagttgaccttttgggacagcggtg

SEQ ID NO: 440896 - DNA, 140 bp, Artificial Sequence
  Synthetic
caccgctgtcccaaaaggtcaactacgacctctttctgtgcccaagcacagagtaatccgaagcaccccttggcttgtccacaacctttggtatcagttcctggagaatgaaagcaccgtcatatcagcagccagggcct

SEQ ID NO: 440897 - DNA, 140 bp, Artificial Sequence
  Synthetic
atacgccatgctgggtctcctgagcggaggagatgacattatctccagggtgattgactttgactctatctgggaaaaaccttctgacttgagaaacttgacaacatggaggtacttccacgtacttgggagtcggccat

SEQ ID NO: 440898 - DNA, 140 bp, Artificial Sequence
  Synthetic
atggccgactcccaagtacgtggaagtacctccatgttgtcaagtttctcaagtcagaaggtttttcccagatagagtcaaagtcaatcaccctggagataatgtcatctcctccgctcaggagacccagcatggcgtat

SEQ ID NO: 440899 - DNA, 140 bp, Artificial Sequence
  Synthetic
atacgccatgctgggtctccggggatttgacaagtactccaagtggtatctagattcgcgattccttgcccgagatcaccctttgactccttatatcaaaacccaaacatggccacccaacgtacttgggagtcggccat

SEQ ID NO: 440900 - DNA, 140 bp, Artificial Sequence
  Synthetic
atggccgactcccaagtacgttgggtggccatgtttgggttttgatataaggagtcaaagggtgatctcgggcaaggaatcgcgaatctagataccacttggagtacttgtcaaatccccggagacccagcatggcgtat

SEQ ID NO: 440901 - DNA, 140 bp, Artificial Sequence
  Synthetic
aggccctggctgctgatatgtagatccatatgacaaatcccttcactcgagggtctttcctagcgggaagtgtttgggaataacaatatcatctacctactgctcgactaaccatgattagaccttttgggacagcggtg

SEQ ID NO: 440902 - DNA, 140 bp, Artificial Sequence
  Synthetic
caccgctgtcccaaaaggtctaatcatggttagtcgagcagtaggtagatgatattgttattcccaaacacttcccgctaggaaagaccctcgagtgaagggatttgtcatatggatctacatatcagcagccagggcct

SEQ ID NO: 440903 - DNA, 140 bp, Artificial Sequence
  Synthetic
aggccctggctgctgatatgttaccaatagtagagggaagagagcatccaaagggagcaagacttgcggatttgttgacgaaagaggcttgtataagtctttgaagggggcatgcaagctgaccttttgggacagcggtg

SEQ ID NO: 440904 - DNA, 140 bp, Artificial Sequence
  Synthetic
caccgctgtcccaaaaggtcagcttgcatgcccccttcaaagacttatacaagcctctttcgtcaacaaatccgcaagtcttgctccctttggatgctctcttccctctactattggtaacatatcagcagccagggcct

SEQ ID NO: 440905 - DNA, 140 bp, Artificial Sequence
  Synthetic
aggccctggctgctgatatgagaacacacgggcttaacttcaacccttgggagcaatagaacaaaaacatgttatggtaccattcaaccgctgcattttatcagagttaagttgattgccgaccttttgggacagcggtg

SEQ ID NO: 440906 - DNA, 140 bp, Artificial Sequence
  Synthetic
caccgctgtcccaaaaggtcggcaatcaacttaactctgataaaatgcagcggttgaatggtaccataacatgtttttgttctattgctcccaagggttgaagttaagcccgtgtgttctcatatcagcagccagggcct

SEQ ID NO: 440907 - DNA, 140 bp, Artificial Sequence
  Synthetic
aggccctggctgctgatatgtgatgctcactacaagtcagtcaggacctggaacgagatcatcccctccaaggggtgtctgagagttggagggaggtgtcatccccatgtaaacggagtggaccttttgggacagcggtg

SEQ ID NO: 440908 - DNA, 140 bp, Artificial Sequence
  Synthetic
caccgctgtcccaaaaggtccactccgtttacatggggatgacacctccctccaactctcagacaccccttggaggggatgatctcgttccaggtcctgactgacttgtagtgagcatcacatatcagcagccagggcct

SEQ ID NO: 440909 - DNA, 140 bp, Artificial Sequence
  Synthetic
atacgccatgctgggtctcctcaaagatcaaatatggggactgctgattgtgacaaaggactttgtttactctcagagttctaactgtctttttgacagaaactatacactgatgctaaacgtacttgggagtcggccat

SEQ ID NO: 440910 - DNA, 140 bp, Artificial Sequence
  Synthetic
atggccgactcccaagtacgtttagcatcagtgtatagtttctgtcaaaaagacagttagaactctgagagtaaacaaagtcctttgtcacaatcagcagtccccatatttgatctttgaggagacccagcatggcgtat

SEQ ID NO: 440911 - DNA, 140 bp, Artificial Sequence
  Synthetic
aggccctggctgctgatatgattaaaatactagagccatatgtcgtaaacagtttagtccagagggcagagaagtttagacctcttattcattctctaggggatttccctgtgttcataagaccttttgggacagcggtg

SEQ ID NO: 440912 - DNA, 140 bp, Artificial Sequence
  Synthetic
caccgctgtcccaaaaggtcttatgaacacagggaaatcccctagagaatgaataagaggtctaaacttctctgccctctggactaaactgtttacgacatatggctctagtattttaatcatatcagcagccagggcct

SEQ ID NO: 440913 - DNA, 140 bp, Artificial Sequence
  Synthetic
aggccctggctgctgatatgacatgttgtggaagaggtaatcgacccaagtccacacaacacagtcttggaggaatagggaggaaggtgtcagccacttcccaaagcgggaaggtcatatgaccttttgggacagcggtg

SEQ ID NO: 440914 - DNA, 140 bp, Artificial Sequence
  Synthetic
caccgctgtcccaaaaggtcatatgaccttcccgctttgggaagtggctgacaccttcctccctattcctccaagactgtgttgtgtggacttgggtcgattacctcttccacaacatgtcatatcagcagccagggcct

SEQ ID NO: 440915 - DNA, 140 bp, Artificial Sequence
  Synthetic
aggccctggctgctgatatggggggaatctctgggttcaacagtcctccctggactccatgcaacagggtaggcttaagagtcatgagactttcattaatcatctccgttaatcagacaagaccttttgggacagcggtg

SEQ ID NO: 440916 - DNA, 140 bp, Artificial Sequence
  Synthetic
caccgctgtcccaaaaggtcttgtctgattaacggagatgattaatgaaagtctcatgactcttaagcctaccctgttgcatggagtccagggaggactgttgaacccagagattccccccatatcagcagccagggcct

SEQ ID NO: 440917 - DNA, 140 bp, Artificial Sequence
  Synthetic
aggccctggctgctgatatgacttctccggtgaaaccagaagtccagaagctgtttatactcgaatcatgatgaatggaggtcgactaaagagatcgcatatacggagatatgtctcagtgaccttttgggacagcggtg

SEQ ID NO: 440918 - DNA, 140 bp, Artificial Sequence
  Synthetic
caccgctgtcccaaaaggtcactgagacatatctccgtatatgcgatctctttagtcgacctccattcatcatgattcgagtataaacagcttctggacttctggtttcaccggagaagtcatatcagcagccagggcct

SEQ ID NO: 440919 - DNA, 140 bp, Artificial Sequence
  Synthetic
atacgccatgctgggtctccataagacgtaccaatgtggaagggagttgggctctaacagggggtatggagttgacaagagatcccactgttccagagcatgcatccttggtcggtcttccgtacttgggagtcggccat

SEQ ID NO: 440920 - DNA, 140 bp, Artificial Sequence
  Synthetic
atggccgactcccaagtacggaagaccgaccaaggatgcatgctctggaacagtgggatctcttgtcaactccataccccctgttagagcccaactcccttccacattggtacgtcttatggagacccagcatggcgtat

SEQ ID NO: 440921 - DNA, 140 bp, Artificial Sequence
  Synthetic
atacgccatgctgggtctcctcttgagcttgtataggttaagcaaaatatcaggacagaacactggcaattacaagacaaacattgcagacagaatagagcaaattttcgagacagcccccgtacttgggagtcggccat

SEQ ID NO: 440922 - DNA, 140 bp, Artificial Sequence
  Synthetic
atggccgactcccaagtacgggggctgtctcgaaaatttgctctattctgtctgcaatgtttgtcttgtaattgccagtgttctgtcctgatattttgcttaacctatacaagctcaagaggagacccagcatggcgtat

SEQ ID NO: 440923 - DNA, 140 bp, Artificial Sequence
  Synthetic
aggccctggctgctgatatggaaaaaaactgtaggccggaagaacaactggcaacacttctcatcttcggacatagatcaaaatgcttgatccaggagaggtctatgatgaccccgttgagaccttttgggacagcggtg

SEQ ID NO: 440924 - DNA, 140 bp, Artificial Sequence
  Synthetic
caccgctgtcccaaaaggtctcaacggggtcatcatagacctctcctggatcaagcattttgatctatgtccgaagatgagaagtgttgccagttgttcttccggcctacagtttttttccatatcagcagccagggcct

SEQ ID NO: 440925 - DNA, 140 bp, Artificial Sequence
  Synthetic
atacgccatgctgggtctccgcgccaactggagtaccataccgaacttcagattcctagccggaacctatgacatgtttttctcccggattgaacatctgtattcagcaattagggtaggcgtacttgggagtcggccat

SEQ ID NO: 440926 - DNA, 140 bp, Artificial Sequence
  Synthetic
atggccgactcccaagtacgcctaccctaattgctgaatacagatgttcaatccgggagaaaaacatgtcataggttccggctaggaatctgaagttcggtatggtactccagttggcgcggagacccagcatggcgtat

SEQ ID NO: 440927 - DNA, 140 bp, Artificial Sequence
  Synthetic
atacgccatgctgggtctcctcaagagtcaagaaactttcatcaatcatctcaactgatcagacacagtcatgtagattctgataatgtatgatgtcttctgacagtatcattgattaatcgtacttgggagtcggccat

SEQ ID NO: 440928 - DNA, 140 bp, Artificial Sequence
  Synthetic
atggccgactcccaagtacgattaatcaatgatactgtcagaagacatcatacattatcagaatctacatgactgtgtctgatcagttgagatgattgatgaaagtttcttgactcttgaggagacccagcatggcgtat

SEQ ID NO: 440929 - DNA, 140 bp, Artificial Sequence
  Synthetic
atacgccatgctgggtctccggttcataaagcaaataaatctcactgcaagagaagcgctgctatacttcttccacaagaacttcgaagaagagataagaaggatgtttgagccggggcacgtacttgggagtcggccat

SEQ ID NO: 440930 - DNA, 140 bp, Artificial Sequence
  Synthetic
atggccgactcccaagtacgtgccccggctcaaacatccttcttatctcttcttcgaagttcttgtggaagaagtatagcagcgcttctcttgcagtgagatttatttgctttatgaaccggagacccagcatggcgtat

SEQ ID NO: 440931 - DNA, 140 bp, Artificial Sequence
  Synthetic
aggccctggctgctgatatgtagaaaatgcataactgaattagctcatttctattccaagtcatcccctatagagaagttgctgaattgtactcttggaaatagagggctgaggattcccgaccttttgggacagcggtg

SEQ ID NO: 440932 - DNA, 140 bp, Artificial Sequence
  Synthetic
caccgctgtcccaaaaggtcgggaatcctcagccctctatttccaagagtacaattcagcaacttctctataggggatgacttggaatagaaatgagctaattcagttatgcattttctacatatcagcagccagggcct

SEQ ID NO: 440933 - DNA, 140 bp, Artificial Sequence
  Synthetic
aggccctggctgctgatatgccagagggggtattaagttgccttgagagggtcgattatgataaggcatttgggagatatctggctaacacatattcctcttatttatttttccatgtgagaccttttgggacagcggtg

SEQ ID NO: 440934 - DNA, 140 bp, Artificial Sequence
  Synthetic
caccgctgtcccaaaaggtctcacatggaaaaataaataagaggaatatgtgttagccagatatctcccaaatgccttatcataatcgaccctctcaaggcaacttaataccccctctggcatatcagcagccagggcct

SEQ ID NO: 440935 - DNA, 140 bp, Artificial Sequence
  Synthetic
atacgccatgctgggtctccgttcaaagatcaaatatggggactactaattgtgacaaaagactttgtttattctcagagttctaactgtctttttgacagaaactacacactcatgctacgtacttgggagtcggccat

SEQ ID NO: 440936 - DNA, 140 bp, Artificial Sequence
  Synthetic
atggccgactcccaagtacgtagcatgagtgtgtagtttctgtcaaaaagacagttagaactctgagaataaacaaagtcttttgtcacaattagtagtccccatatttgatctttgaacggagacccagcatggcgtat

SEQ ID NO: 440937 - DNA, 140 bp, Artificial Sequence
  Synthetic
atacgccatgctgggtctcccagctccaatcatcaggcccgtcctaactcattcgctgaatttttgaacaagacatactcaagtgattcttaaagagtagaacaacgagatggtaaacatcgtacttgggagtcggccat

SEQ ID NO: 440938 - DNA, 140 bp, Artificial Sequence
  Synthetic
atggccgactcccaagtacgatgtttaccatctcgttgttctactctttaagaatcacttgagtatgtcttgttcaaaaattcagcgaatgagttaggacgggcctgatgattggagctgggagacccagcatggcgtat

SEQ ID NO: 440939 - DNA, 140 bp, Artificial Sequence
  Synthetic
aggccctggctgctgatatgacatagctggggatcaagtcctttccatgtgtggaaactctggttatgacgttatcaagatactggagccctatgtcgtgaacagcctcgtccagagggcgaccttttgggacagcggtg

SEQ ID NO: 440940 - DNA, 140 bp, Artificial Sequence
  Synthetic
caccgctgtcccaaaaggtcgccctctggacgaggctgttcacgacatagggctccagtatcttgataacgtcataaccagagtttccacacatggaaaggacttgatccccagctatgtcatatcagcagccagggcct

SEQ ID NO: 440941 - DNA, 140 bp, Artificial Sequence
  Synthetic
aggccctggctgctgatatgaggttttttggagttctggatcaattcgacaacatacatgacttggtttttgtgtacggctgttacaggcattggggtcatccctatatagattatagaagaccttttgggacagcggtg

SEQ ID NO: 440942 - DNA, 140 bp, Artificial Sequence
  Synthetic
caccgctgtcccaaaaggtcttctataatctatatagggatgaccccaatgcctgtaacagccgtacacaaaaaccaagtcatgtatgttgtcgaattgatccagaactccaaaaaacctcatatcagcagccagggcct

SEQ ID NO: 440943 - DNA, 140 bp, Artificial Sequence
  Synthetic
atacgccatgctgggtctccgactttcaaatggatgaggcggaggaccccgccctattgttccagtcatacctggacaacattggaattcaaatagtcagacagatgaagtcaggagagacgtacttgggagtcggccat

SEQ ID NO: 440944 - DNA, 140 bp, Artificial Sequence
  Synthetic
atggccgactcccaagtacgtctctcctgacttcatctgtctgactatttgaattccaatgttgtccaggtatgactggaacaatagggcggggtcctccgcctcatccatttgaaagtcggagacccagcatggcgtat

SEQ ID NO: 440945 - DNA, 140 bp, Artificial Sequence
  Synthetic
aggccctggctgctgatatgcctggacaacattggaattcaaatagtcagacagatgaagtcaggagagagattcctcaagatatggtcccagaccgtcgaggagatcatatcctatgtcgaccttttgggacagcggtg

SEQ ID NO: 440946 - DNA, 140 bp, Artificial Sequence
  Synthetic
caccgctgtcccaaaaggtcgacataggatatgatctcctcgacggtctgggaccatatcttgaggaatctctctcctgacttcatctgtctgactatttgaattccaatgttgtccaggcatatcagcagccagggcct

SEQ ID NO: 440947 - DNA, 140 bp, Artificial Sequence
  Synthetic
aggccctggctgctgatatggtgggggtttgacaagtattctaaatggtatcttgattcacgacttctcgcccgcgaccaccctttgactccctacatcaaaacccagacatggccacccgaccttttgggacagcggtg

SEQ ID NO: 440948 - DNA, 140 bp, Artificial Sequence
  Synthetic
caccgctgtcccaaaaggtcgggtggccatgtctgggttttgatgtagggagtcaaagggtggtcgcgggcgagaagtcgtgaatcaagataccatttagaatacttgtcaaacccccaccatatcagcagccagggcct

SEQ ID NO: 440949 - DNA, 140 bp, Artificial Sequence
  Synthetic
atacgccatgctgggtctcctcaaactgccagccgtgaacccaagaaagagactgtgtctgctccctctcagcaagacagtcaatcatccaagaccagaatggcggctcaaaccgcctctcgtacttgggagtcggccat

SEQ ID NO: 440950 - DNA, 140 bp, Artificial Sequence
  Synthetic
atggccgactcccaagtacgagaggcggtttgagccgccattctggtcttggatgattgactgtcttgctgagagggagcagacacagtctctttcttgggttcacggctggcagtttgaggagacccagcatggcgtat

SEQ ID NO: 440951 - DNA, 140 bp, Artificial Sequence
  Synthetic
aggccctggctgctgatatgatcagacgtaccaatgtggaagggaattgggctctaacagggggtatggagttgactagagaccccactgtttctgaacatgcatctttggttggtcttcgaccttttgggacagcggtg

SEQ ID NO: 440952 - DNA, 140 bp, Artificial Sequence
  Synthetic
caccgctgtcccaaaaggtcgaagaccaaccaaagatgcatgttcagaaacagtggggtctctagtcaactccataccccctgttagagcccaattcccttccacattggtacgtctgatcatatcagcagccagggcct

SEQ ID NO: 440953 - DNA, 140 bp, Artificial Sequence
  Synthetic
aggccctggctgctgatatgacaaatcccattctttcaccagaacaagactggcttcctggttgtcggagaacagaggggggcctgttcccagcgagaaagtcattatcacggcgttgtcgaccttttgggacagcggtg

SEQ ID NO: 440954 - DNA, 140 bp, Artificial Sequence
  Synthetic
caccgctgtcccaaaaggtcgacaacgccgtgataatgactttctcgctgggaacaggcccccctctgttctccgacaaccaggaagccagtcttgttctggtgaaagaatgggatttgtcatatcagcagccagggcct

SEQ ID NO: 440955 - DNA, 140 bp, Artificial Sequence
  Synthetic
aggccctggctgctgatatgctaaagattgagggccgattttttgctctgatgtcatggaatctaagattgtattttgttattacggaaaagcttttggccaactacatcctgccactttgaccttttgggacagcggtg

SEQ ID NO: 440956 - DNA, 140 bp, Artificial Sequence
  Synthetic
caccgctgtcccaaaaggtcaaagtggcaggatgtagttggccaaaagcttttccgtaataacaaaatacaatcttagattccatgacatcagagcaaaaaatcggccctcaatctttagcatatcagcagccagggcct

SEQ ID NO: 440957 - DNA, 140 bp, Artificial Sequence
  Synthetic
atacgccatgctgggtctcccccgacaagctaaataaaataatgcaagacgacctgaaccgttacgcattcctatgaacacaccccctagcttggtcacactatgcaataaattctggcccgtacttgggagtcggccat

SEQ ID NO: 440958 - DNA, 140 bp, Artificial Sequence
  Synthetic
atggccgactcccaagtacgggccagaatttattgcatagtgtgaccaagctagggggtgtgttcataggaatgcgtaacggttcaggtcgtcttgcattattttatttagcttgtcgggggagacccagcatggcgtat

SEQ ID NO: 440959 - DNA, 140 bp, Artificial Sequence
  Synthetic
atacgccatgctgggtctccaaaactgtggaatggaggagtaattaacaacacttctcatcctgagaactgaaccatgatgattgatccaggggaggtttatgatgaccccattgatccgcgtacttgggagtcggccat

SEQ ID NO: 440960 - DNA, 140 bp, Artificial Sequence
  Synthetic
atggccgactcccaagtacgcggatcaatggggtcatcataaacctcccctggatcaatcatcatggttcagttctcaggatgagaagtgttgttaattactcctccattccacagttttggagacccagcatggcgtat

SEQ ID NO: 440961 - DNA, 140 bp, Artificial Sequence
  Synthetic
atacgccatgctgggtctcccccctctcgtgtcggcccctccagatgatgatgacctgtggttaccccctcctgagtatgttccgctgaaggaactcacgggcaagaaaaatatgagaaacgtacttgggagtcggccat

SEQ ID NO: 440962 - DNA, 140 bp, Artificial Sequence
  Synthetic
atggccgactcccaagtacgtttctcatatttttcttgcccgtgagttccttcagcggaacatactcaggagggggtaaccacaggtcatcatcatctggaggggccgacacgagaggggggagacccagcatggcgtat

SEQ ID NO: 440963 - DNA, 140 bp, Artificial Sequence
  Synthetic
aggccctggctgctgatatgcctgagtatgttccgctgaaggaactcacgggcaagaaaaatatgagaaacttttgcgtgaacggagaagtcaaggtatgcggtccaaacggttattcgtgaccttttgggacagcggtg

SEQ ID NO: 440964 - DNA, 140 bp, Artificial Sequence
  Synthetic
caccgctgtcccaaaaggtcacgaataaccgtttggaccgcataccttgacttctccgttcacgcaaaagtttctcatatttttcttgcccgtgagttccttcagcggaacatactcaggcatatcagcagccagggcct

SEQ ID NO: 440965 - DNA, 140 bp, Artificial Sequence
  Synthetic
aggccctggctgctgatatgatatgtccaatggcccgacctgctggaatggtcaagatggtgggttagagggcttacggcagaagggctggagtctagtcagcctattaatgatagataggaccttttgggacagcggtg

SEQ ID NO: 440966 - DNA, 140 bp, Artificial Sequence
  Synthetic
caccgctgtcccaaaaggtcctatctatcattaataggctgactagactccagcccttctgccgtaagccctctaacccaccatcttgaccattccagcaggtcgggccattggacatatcatatcagcagccagggcct

SEQ ID NO: 440967 - DNA, 140 bp, Artificial Sequence
  Synthetic
atacgccatgctgggtctccaatcagagaatgatcgggttggtcaaagttgtcgttggattggcgttgtcaggagccccagtcccggagggtatgaactgggtatacaagttgaggagaacgtacttgggagtcggccat

SEQ ID NO: 440968 - DNA, 140 bp, Artificial Sequence
  Synthetic
atggccgactcccaagtacgttctcctcaacttgtatacccagttcataccctccgggactggggctcctgacaacgccaatccaacgacaactttgaccaacccgatcattctctgattggagacccagcatggcgtat

SEQ ID NO: 440969 - DNA, 140 bp, Artificial Sequence
  Synthetic
atacgccatgctgggtctcccccttatcttccagtgggctgaatctaggggccctcttgaaggggaggagttagaatactcccaagagatcacctgggatgatgatacagagtttgtaggcgtacttgggagtcggccat

SEQ ID NO: 440970 - DNA, 140 bp, Artificial Sequence
  Synthetic
atggccgactcccaagtacgcctacaaactctgtatcatcatcccaggtgatctcttgggagtattctaactcctccccttcaagagggcccctagattcagcccactggaagataagggggagacccagcatggcgtat

SEQ ID NO: 440971 - DNA, 140 bp, Artificial Sequence
  Synthetic
aggccctggctgctgatatggggctcctctatgagttggagagtatatcaaggaatgcgctttcaatatacagggccatcgaggaaggagcatctaagctggggctgatcatcaagaaaggaccttttgggacagcggtg

SEQ ID NO: 440972 - DNA, 140 bp, Artificial Sequence
  Synthetic
caccgctgtcccaaaaggtcctttcttgatgatcagccccagcttagatgctccttcctcgatggccctgtatattgaaagcgcattccttgatatactctccaactcatagaggagccccatatcagcagccagggcct

SEQ ID NO: 440973 - DNA, 140 bp, Artificial Sequence
  Synthetic
atacgccatgctgggtctccacttctcagatcttcgagttcccggatgtgtcaaaaaggatatccaggatggtttctggagccgtccctcactttcagaagcttcctgatatccgtctaacgtacttgggagtcggccat

SEQ ID NO: 440974 - DNA, 140 bp, Artificial Sequence
  Synthetic
atggccgactcccaagtacgttagacggatatcaggaagcttctgaaagtgagggacggctccagaaaccatcctggatatcctttttgacacatccgggaactcgaagatctgagaagtggagacccagcatggcgtat

SEQ ID NO: 440975 - DNA, 140 bp, Artificial Sequence
  Synthetic
atacgccatgctgggtctccatgtagattctcataatacggaaaatcttctagcagtttcagtgaccaacggtgctttcattctccaagaactggtgccaaaggttgtggacgggccaagcgtacttgggagtcggccat

SEQ ID NO: 440976 - DNA, 140 bp, Artificial Sequence
  Synthetic
atggccgactcccaagtacgcttggcccgtccacaacctttggcaccagttcttggagaatgaaagcaccgttggtcactgaaactgctagaagattttccgtattatgagaatctacatggagacccagcatggcgtat

SEQ ID NO: 440977 - DNA, 140 bp, Artificial Sequence
  Synthetic
aggccctggctgctgatatgttgcatctctaacgaccaaatagtcaacctagccaatatcatgtcgacagtatctacaaatgcactgacagtagcacaacactctcaatctctgatcaaagaccttttgggacagcggtg

SEQ ID NO: 440978 - DNA, 140 bp, Artificial Sequence
  Synthetic
caccgctgtcccaaaaggtctttgatcagagattgagagtgttgtgctactgtcagtgcatttgtagatactgtcgacatgatattggctaggttgactatttggtcgttagagatgcaacatatcagcagccagggcct

SEQ ID NO: 440979 - DNA, 140 bp, Artificial Sequence
  Synthetic
aggccctggctgctgatatgaaggatctcaggaaaaatgatccctcaggctcttctgtttgtgcctctcctgattccctcgctgtgtatcggggaattccccatctacacgataccagacgaccttttgggacagcggtg

SEQ ID NO: 440980 - DNA, 140 bp, Artificial Sequence
  Synthetic
caccgctgtcccaaaaggtcgtctggtatcgtgtagatggggaattccccgatacacagcgagggaatcaggagaggcacaaacagaagagcctgagggatcatttttcctgagatccttcatatcagcagccagggcct

SEQ ID NO: 440981 - DNA, 140 bp, Artificial Sequence
  Synthetic
aggccctggctgctgatatgccagatcttggagagagaacactcgagagcttcactcgccttctggaggatcctaccaccttaaatattaaaggaggggctagtcccaccatcttactcagaccttttgggacagcggtg

SEQ ID NO: 440982 - DNA, 140 bp, Artificial Sequence
  Synthetic
caccgctgtcccaaaaggtctgagtaagatggtgggactagcccctcctttaatatttaaggtggtaggatcctccagaaggcgagtgaagctctcgagtgttctctctccaagatctggcatatcagcagccagggcct

SEQ ID NO: 440983 - DNA, 140 bp, Artificial Sequence
  Synthetic
aggccctggctgctgatatgaggatgcaatcaggaaggctctgtacgacgaggtggataaggtggaaaactcagagttcagagaggcaatcttgttgtccaagacccatagagataacttgaccttttgggacagcggtg

SEQ ID NO: 440984 - DNA, 140 bp, Artificial Sequence
  Synthetic
caccgctgtcccaaaaggtcaagttatctctatgggtcttggacaacaagattgcctctctgaactctgagttttccaccttatccacctcgtcgtacagagccttcctgattgcatcctcatatcagcagccagggcct

SEQ ID NO: 440985 - DNA, 140 bp, Artificial Sequence
  Synthetic
atacgccatgctgggtctccacccctacgacaagtcccttcattcaagagttttccccagtgggaagtgtttggggataacagtctcttccacctactgctcaaccaaccatgattacaccgtacttgggagtcggccat

SEQ ID NO: 440986 - DNA, 140 bp, Artificial Sequence
  Synthetic
atggccgactcccaagtacggtgtaatcatggttggttgagcagtaggtggaagagactgttatccccaaacacttcccactggggaaaactcttgaatgaagggacttgtcgtaggggtggagacccagcatggcgtat

SEQ ID NO: 440987 - DNA, 140 bp, Artificial Sequence
  Synthetic
aggccctggctgctgatatgagggcagaccttttaagggagatctcttggggaagaaaagtggttggcacaacagtccctcacccttctgagatgttggggttacttcccaagtcctccagaccttttgggacagcggtg

SEQ ID NO: 440988 - DNA, 140 bp, Artificial Sequence
  Synthetic
caccgctgtcccaaaaggtctggaggacttgggaagtaaccccaacatctcagaagggtgagggactgttgtgccaaccacttttcttccccaagagatctcccttaaaaggtctgccctcatatcagcagccagggcct

SEQ ID NO: 440989 - DNA, 140 bp, Artificial Sequence
  Synthetic
atacgccatgctgggtctccgctgtgcggagtccccgggattaggctgatggatggaacctgggtctcaatccagacatcagaagatattaagtggtgccctcctgatcgattagtgaatcgtacttgggagtcggccat

SEQ ID NO: 440990 - DNA, 140 bp, Artificial Sequence
  Synthetic
atggccgactcccaagtacgattcactaatcgatcaggagggcaccacttaatatcttctgatgtctggattgagacccaggttccatccatcagcctaatcccggggactccgcacagcggagacccagcatggcgtat

SEQ ID NO: 440991 - DNA, 140 bp, Artificial Sequence
  Synthetic
aggccctggctgctgatatgtccagacatcagaagatattaagtggtgccctcctgatcgattagtgaatctacacgactttcactcggatgaactagaacatcttgttgtagaggaattgaccttttgggacagcggtg

SEQ ID NO: 440992 - DNA, 140 bp, Artificial Sequence
  Synthetic
caccgctgtcccaaaaggtcaattcctctacaacaagatgttctagttcatccgagtgaaagtcgtgtagattcactaatcgatcaggagggcaccacttaatatcttctgatgtctggacatatcagcagccagggcct

SEQ ID NO: 440993 - DNA, 140 bp, Artificial Sequence
  Synthetic
aggccctggctgctgatatgcatgagtggaggagatgatatcatctccagagtgatagactttgactcaatctgggaaaaaccatccgacctgaggaacttggccacctggagatacttcgaccttttgggacagcggtg

SEQ ID NO: 440994 - DNA, 140 bp, Artificial Sequence
  Synthetic
caccgctgtcccaaaaggtcgaagtatctccaggtggccaagttcctcaggtcggatggtttttcccagattgagtcaaagtctatcactctggagatgatatcatctcctccactcatgcatatcagcagccagggcct

SEQ ID NO: 440995 - DNA, 140 bp, Artificial Sequence
  Synthetic
aggccctggctgctgatatgaattagaaacatcatgtctctgacaggccccgatttccctctagaagaggctcctgtcttcaaaagaacggggtcagcattgcataggttcaagtctgcagaccttttgggacagcggtg

SEQ ID NO: 440996 - DNA, 140 bp, Artificial Sequence
  Synthetic
caccgctgtcccaaaaggtctgcagacttgaacctatgcaatgctgaccccgttcttttgaagacaggagcctcttctagagggaaatcggggcctgtcagagacatgatgtttctaattcatatcagcagccagggcct

SEQ ID NO: 440997 - DNA, 140 bp, Artificial Sequence
  Synthetic
aggccctggctgctgatatggcagaggtcactgacattgcatcaatcaaccgaataaccctgctaatgtctgattttgcattgtccatagacggcccactttatctggttttcaaaacttgaccttttgggacagcggtg

SEQ ID NO: 440998 - DNA, 140 bp, Artificial Sequence
  Synthetic
caccgctgtcccaaaaggtcaagttttgaaaaccagataaagtgggccgtctatggacaatgcaaaatcagacattagcagggttattcggttgattgatgcaatgtcagtgacctctgccatatcagcagccagggcct

SEQ ID NO: 440999 - DNA, 140 bp, Artificial Sequence
  Synthetic
atacgccatgctgggtctccattatgacttcatgtttcagcccttgatgctttatgcgcaaacatggacatcagagctggtacaaagagacacaaggctgagagactccacgtttcattgcgtacttgggagtcggccat

SEQ ID NO: 441000 - DNA, 140 bp, Artificial Sequence
  Synthetic
atggccgactcccaagtacgcaatgaaacgtggagtctctcagccttgtgtctctttgtaccagctctgatgtccatgtttgcgcataaagcatcaagggctgaaacatgaagtcataatggagacccagcatggcgtat

SEQ ID NO: 441001 - DNA, 140 bp, Artificial Sequence
  Synthetic
aggccctggctgctgatatgatggtttctggagctgtgcctcactttcagaaactccctgatatccgcctaaagccaggtgattttgagtctctgaacggtagagaaaagtctcgccatagaccttttgggacagcggtg

SEQ ID NO: 441002 - DNA, 140 bp, Artificial Sequence
  Synthetic
caccgctgtcccaaaaggtctatggcgagacttttctctaccgttcagagactcaaaatcacctggctttaggcggatatcagggagtttctgaaagtgaggcacagctccagaaaccatcatatcagcagccagggcct

SEQ ID NO: 441003 - DNA, 140 bp, Artificial Sequence
  Synthetic
atacgccatgctgggtctcctgttgtaggagggtcaataagacaggatcaacacagagaggtcatagggaatcaagagggaaaatgtcagtagcacctcaaaatgggaagatcatatcctcgtacttgggagtcggccat

SEQ ID NO: 441004 - DNA, 140 bp, Artificial Sequence
  Synthetic
atggccgactcccaagtacgaggatatgatcttcccattttgaggtgctactgacattttccctcttgattccctatgacctctctgtgttgatcctgtcttattgaccctcctacaacaggagacccagcatggcgtat

SEQ ID NO: 441005 - DNA, 140 bp, Artificial Sequence
  Synthetic
aggccctggctgctgatatgctctcctagagactatttgagggggctcgcaaggggagttttgatagggtcttcgatttgcttcttgacaagaatgacaaatatcaatattaatagacctgaccttttgggacagcggtg

SEQ ID NO: 441006 - DNA, 140 bp, Artificial Sequence
  Synthetic
caccgctgtcccaaaaggtcaggtctattaatattgatatttgtcattcttgtcaagaagcaaatcgaagaccctatcaaaactccccttgcgagccccctcaaatagtctctaggagagcatatcagcagccagggcct

SEQ ID NO: 441007 - DNA, 140 bp, Artificial Sequence
  Synthetic
atacgccatgctgggtctcccttcgatttgcttcttgacaagaatgacaaatatcaatattaatagacctcttgaattgatctcaggggtaatctcatatatccttctgagactagacaacgtacttgggagtcggccat

SEQ ID NO: 441008 - DNA, 140 bp, Artificial Sequence
  Synthetic
atggccgactcccaagtacgttgtctagtctcagaaggatatatgagattacccctgagatcaattcaagaggtctattaatattgatatttgtcattcttgtcaagaagcaaatcgaagggagacccagcatggcgtat

SEQ ID NO: 441009 - DNA, 140 bp, Artificial Sequence
  Synthetic
aggccctggctgctgatatgtggtgctctcatcctctaaggactgataccaaaggtcatgaacaatccaaatagaaactcagataactctatggttgagtctgtgtagatgctttagcccgaccttttgggacagcggtg

SEQ ID NO: 441010 - DNA, 140 bp, Artificial Sequence
  Synthetic
caccgctgtcccaaaaggtcgggctaaagcatctacacagactcaaccatagagttatctgagtttctatttggattgttcatgacctttggtatcagtccttagaggatgagagcaccacatatcagcagccagggcct

SEQ ID NO: 441011 - DNA, 140 bp, Artificial Sequence
  Synthetic
aggccctggctgctgatatgtcctctatgagttagagagcatatcaaggaatgcactttcaatataccgagccatcgaagaaggggcatctaaactagggctgatcatcaagaaggaagagaccttttgggacagcggtg

SEQ ID NO: 441012 - DNA, 140 bp, Artificial Sequence
  Synthetic
caccgctgtcccaaaaggtctcttccttcttgatgatcagccctagtttagatgccccttcttcgatggctcggtatattgaaagtgcattccttgatatgctctctaactcatagaggacatatcagcagccagggcct

SEQ ID NO: 441013 - DNA, 140 bp, Artificial Sequence
  Synthetic
aggccctggctgctgatatgggctaacctgcgacaattgagctccttgatgaggcaggtactgggggggcatggggaagatactttagagtcagacgatgatgttcaacgactattaaaagaccttttgggacagcggtg

SEQ ID NO: 441014 - DNA, 140 bp, Artificial Sequence
  Synthetic
caccgctgtcccaaaaggtcttttaatagtcgttgaacatcatcgtctgactctaaagtatcttccccatgcccccccagtacctgcctcatcaaggagctcaattgtcgcaggttagcccatatcagcagccagggcct

SEQ ID NO: 441015 - DNA, 140 bp, Artificial Sequence
  Synthetic
atacgccatgctgggtctccctataaattggtttatcacaagaaactcaaatttggcccaaactttgattagaaacataatgtctctgacaggcccagattttcccttggaagaagcccccgtacttgggagtcggccat

SEQ ID NO: 441016 - DNA, 140 bp, Artificial Sequence
  Synthetic
atggccgactcccaagtacgggggcttcttccaagggaaaatctgggcctgtcagagacattatgtttctaatcaaagtttgggccaaatttgagtttcttgtgataaaccaatttatagggagacccagcatggcgtat

SEQ ID NO: 441017 - DNA, 140 bp, Artificial Sequence
  Synthetic
atacgccatgctgggtctcccaggaggctcagaatgggtttgctctgcccaacaggttgcagtctccacctcagctaacccagcccctgtctcagagcttgacataagggccctctccagcgtacttgggagtcggccat

SEQ ID NO: 441018 - DNA, 140 bp, Artificial Sequence
  Synthetic
atggccgactcccaagtacgctggagagggcccttatgtcaagctctgagacaggggctgggttagctgaggtggagactgcaacctgttgggcagagcaaacccattctgagcctcctgggagacccagcatggcgtat

SEQ ID NO: 441019 - DNA, 140 bp, Artificial Sequence
  Synthetic
atacgccatgctgggtctcccctggacaacgttggagttcaaatggtcagacgtatgaggtcaggagagagattcctcaagatatggtctcagacagtggaggagatcatatcatatgtccgtacttgggagtcggccat

SEQ ID NO: 441020 - DNA, 140 bp, Artificial Sequence
  Synthetic
atggccgactcccaagtacggacatatgatatgatctcctccactgtctgagaccatatcttgaggaatctctctcctgacctcatacgtctgaccatttgaactccaacgttgtccaggggagacccagcatggcgtat

SEQ ID NO: 441021 - DNA, 140 bp, Artificial Sequence
  Synthetic
atacgccatgctgggtctccaagagagtggatctgggatctcttaaagttggcggggccgctgcacagtcgatgatctccctttggctatacggtgcccattctgaatcaaataggagcccgtacttgggagtcggccat

SEQ ID NO: 441022 - DNA, 140 bp, Artificial Sequence
  Synthetic
atggccgactcccaagtacgggctcctatttgattcagaatgggcaccgtatagccaaagggagatcatcgactgtgcagcggccccgccaactttaagagatcccagatccactctcttggagacccagcatggcgtat

SEQ ID NO: 441023 - DNA, 140 bp, Artificial Sequence
  Synthetic
aggccctggctgctgatatgccatctctatgtctagtagtcggagatgggtcaggcgggatatcaagggcagtactccacatgtttccagacgtcaagcttgtgttcaacagtttgttaggaccttttgggacagcggtg

SEQ ID NO: 441024 - DNA, 140 bp, Artificial Sequence
  Synthetic
caccgctgtcccaaaaggtcctaacaaactgttgaacacaagcttgacgtctggaaacatgtggagtactgcccttgatatcccgcctgacccatctccgactactagacatagagatggcatatcagcagccagggcct

SEQ ID NO: 441025 - DNA, 140 bp, Artificial Sequence
  Synthetic
atacgccatgctgggtctccagtactccacatgtttccagacgtcaagcttgtgttcaacagtttgttagaggtaaatgacctaatggcttccggaacacatccactgcctccctcagcacgtacttgggagtcggccat

SEQ ID NO: 441026 - DNA, 140 bp, Artificial Sequence
  Synthetic
atggccgactcccaagtacgtgctgagggaggcagtggatgtgttccggaagccattaggtcatttacctctaacaaactgttgaacacaagcttgacgtctggaaacatgtggagtactggagacccagcatggcgtat

SEQ ID NO: 441027 - DNA, 140 bp, Artificial Sequence
  Synthetic
atacgccatgctgggtctccacttctccggtgaaaccagaagtccagaagctgtctatactcgaatcatgatgaatggaggtcgactgaagagatcacatatacggagatatgtctcagtcgtacttgggagtcggccat

SEQ ID NO: 441028 - DNA, 140 bp, Artificial Sequence
  Synthetic
atggccgactcccaagtacgactgagacatatctccgtatatgtgatctcttcagtcgacctccattcatcatgattcgagtatagacagcttctggacttctggtttcaccggagaagtggagacccagcatggcgtat

SEQ ID NO: 441029 - DNA, 140 bp, Artificial Sequence
  Synthetic
atacgccatgctgggtctccgactttcagatggatgagggagaggaccccaacctcctgttccaatcgtacctggacaatgttggagtccaaatagtcagacaaatgaggtcaggagagacgtacttgggagtcggccat

SEQ ID NO: 441030 - DNA, 140 bp, Artificial Sequence
  Synthetic
atggccgactcccaagtacgtctctcctgacctcatttgtctgactatttggactccaacattgtccaggtacgattggaacaggaggttggggtcctctccctcatccatctgaaagtcggagacccagcatggcgtat

SEQ ID NO: 441031 - DNA, 140 bp, Artificial Sequence
  Synthetic
atacgccatgctgggtctccccagacacctcaaagggtcgggagggtgtggccttgctcttcagagagggcagatctacttagggagatctcttggggaaggaaagtggtaggcacgacacgtacttgggagtcggccat

SEQ ID NO: 441032 - DNA, 140 bp, Artificial Sequence
  Synthetic
atggccgactcccaagtacgtgtcgtgcctaccactttccttccccaagagatctccctaagtagatctgccctctctgaagagcaaggccacaccctcccgaccctttgaggtgtctggggagacccagcatggcgtat

SEQ ID NO: 441033 - DNA, 140 bp, Artificial Sequence
  Synthetic
aggccctggctgctgatatgtactcccatccttcgatcaatcatttttttcacgaggtcccctaaagggatacttgggctcgtccacctctatgtcaacccaactgttccatgcatgggagaccttttgggacagcggtg

SEQ ID NO: 441034 - DNA, 140 bp, Artificial Sequence
  Synthetic
caccgctgtcccaaaaggtctcccatgcatggaacagttgggttgacatagaggtggacgagcccaagtatccctttaggggacctcgtgaaaaaaatgattgatcgaaggatgggagtacatatcagcagccagggcct

SEQ ID NO: 441035 - DNA, 140 bp, Artificial Sequence
  Synthetic
atacgccatgctgggtctccaggaacattatgtctctgacaggtcctgatttccctctagaggaggcccctgttttcaaaaggacagggtcagccttgcataggttcaagtctgccagatcgtacttgggagtcggccat

SEQ ID NO: 441036 - DNA, 140 bp, Artificial Sequence
  Synthetic
atggccgactcccaagtacgatctggcagacttgaacctatgcaaggctgaccctgtccttttgaaaacaggggcctcctctagagggaaatcaggacctgtcagagacataatgttcctggagacccagcatggcgtat

SEQ ID NO: 441037 - DNA, 140 bp, Artificial Sequence
  Synthetic
aggccctggctgctgatatgccaggtgattttgaatctctaagtggtagagaaaagtctcgccatatagggtcggcacaggggctcttatactcgatcttagtggcaattcacgactcaggaccttttgggacagcggtg

SEQ ID NO: 441038 - DNA, 140 bp, Artificial Sequence
  Synthetic
caccgctgtcccaaaaggtcctgagtcgtgaattgccactaagatcgagtataagagcccctgtgccgaccctatatggcgagacttttctctaccacttagagattcaaaatcacctggcatatcagcagccagggcct

SEQ ID NO: 441039 - DNA, 140 bp, Artificial Sequence
  Synthetic
atacgccatgctgggtctccagagatcaccccctgattccttatataaagactcaaacatggcctcccaaacacatagtagatttggtgggggacacatggcataagctccctatcaccccgtacttgggagtcggccat

SEQ ID NO: 441040 - DNA, 140 bp, Artificial Sequence
  Synthetic
atggccgactcccaagtacggggtgatagggagcttatgccatgtgtcccccaccaaatctactatgtgtttgggaggccatgtttgagtctttatataaggaatcagggggtgatctctggagacccagcatggcgtat

SEQ ID NO: 441041 - DNA, 140 bp, Artificial Sequence
  Synthetic
aggccctggctgctgatatgataacagacctataacttattatttcagaaagcaagtcattcgagggaatatttatctctcctggagttggtcagatgatacctcggtgttcaagagggtgaccttttgggacagcggtg

SEQ ID NO: 441042 - DNA, 140 bp, Artificial Sequence
  Synthetic
caccgctgtcccaaaaggtcaccctcttgaacaccgaggtatcatctgaccaactccaggagagataaatattccctcgaatgacttgctttctgaaataataagttataggtctgttatcatatcagcagccagggcct

SEQ ID NO: 441043 - DNA, 140 bp, Artificial Sequence
  Synthetic
aggccctggctgctgatatgagatcttcgaaatccctgaatcaatggacccatctgagatactagatgataaatcacactctttcactagaacaagactcgcatcatggctatcagaaaagaccttttgggacagcggtg

SEQ ID NO: 441044 - DNA, 140 bp, Artificial Sequence
  Synthetic
caccgctgtcccaaaaggtcttttctgatagccatgatgcgagtcttgttctagtgaaagagtgtgatttatcatctagtatctcagatgggtccattgattcagggatttcgaagatctcatatcagcagccagggcct

SEQ ID NO: 441045 - DNA, 140 bp, Artificial Sequence
  Synthetic
aggccctggctgctgatatgggagagattgaaaaacaccttcaggggtacaacagatggattaccctcgaagatatcagatccagaacatctctgctagattacagctgcttgtgaattggaccttttgggacagcggtg

SEQ ID NO: 441046 - DNA, 140 bp, Artificial Sequence
  Synthetic
caccgctgtcccaaaaggtccaattcacaagcagctgtaatctagcagagatgttctggatctgatatcttcgagggtaatccatctgttgtacccctgaaggtgtttttcaatctctcccatatcagcagccagggcct

SEQ ID NO: 441047 - DNA, 140 bp, Artificial Sequence
  Synthetic
atacgccatgctgggtctccttgccggatgaggacttaataatcggtctcaagcctaaggaaagggagctaaaaattgaaggtcggttctttgcattgatgtcctggaatctgaggttatcgtacttgggagtcggccat

SEQ ID NO: 441048 - DNA, 140 bp, Artificial Sequence
  Synthetic
atggccgactcccaagtacgataacctcagattccaggacatcaatgcaaagaaccgaccttcaatttttagctccctttccttaggcttgagaccgattattaagtcctcatccggcaaggagacccagcatggcgtat

SEQ ID NO: 441049 - DNA, 140 bp, Artificial Sequence
  Synthetic
aggccctggctgctgatatggacactctcagaggcttgtacaagctaagacttttgtattatgtaccttgaaaaaaacaagatcttgactccgagcctctgattgtttgattgttttttcgaccttttgggacagcggtg

SEQ ID NO: 441050 - DNA, 140 bp, Artificial Sequence
  Synthetic
caccgctgtcccaaaaggtcgaaaaaacaatcaaacaatcagaggctcggagtcaagatcttgtttttttcaaggtacataatacaaaagtcttagcttgtacaagcctctgagagtgtccatatcagcagccagggcct

SEQ ID NO: 441051 - DNA, 140 bp, Artificial Sequence
  Synthetic
aggccctggctgctgatatgtgacagagttactggacagggacttttagactattcaagagttacatatgcttttcacctggactatgagaaatggaacaatcatcagaggctggaatcagaccttttgggacagcggtg

SEQ ID NO: 441052 - DNA, 140 bp, Artificial Sequence
  Synthetic
caccgctgtcccaaaaggtctgattccagcctctgatgattgttccatttctcatagtccaggtgaaaagcatatgtaactcttgaatagtctaaaagtccctgtccagtaactctgtcacatatcagcagccagggcct

SEQ ID NO: 441053 - DNA, 140 bp, Artificial Sequence
  Synthetic
aggccctggctgctgatatgggaaagcccccgacttaaacaaagcatacaagtcagttttatcaggcatgaatgcagccaaacttgatcctgatgatgtatgttcctacttggcagcagcgaccttttgggacagcggtg

SEQ ID NO: 441054 - DNA, 140 bp, Artificial Sequence
  Synthetic
caccgctgtcccaaaaggtcgctgctgccaagtaggaacatacatcatcaggatcaagtttggctgcattcatgcctgataaaactgacttgtatgctttgtttaagtcgggggctttcccatatcagcagccagggcct

SEQ ID NO: 441055 - DNA, 140 bp, Artificial Sequence
  Synthetic
atacgccatgctgggtctccacaggtctgacctcatcgggttgtgggaggatcaaatatactgtctggacatgtcgaacggcccgacgtgctggaatggccaagatggagggttggagggcgtacttgggagtcggccat

SEQ ID NO: 441056 - DNA, 140 bp, Artificial Sequence
  Synthetic
atggccgactcccaagtacgccctccaaccctccatcttggccattccagcacgtcgggccgttcgacatgtccagacagtatatttgatcctcccacaacccgatgaggtcagacctgtggagacccagcatggcgtat

SEQ ID NO: 441057 - DNA, 140 bp, Artificial Sequence
  Synthetic
aggccctggctgctgatatgatgtcgaacggcccgacgtgctggaatggccaagatggagggttggagggtttaagacagaagggttggagtctggttagtttgttaatgatagatcgtggaccttttgggacagcggtg

SEQ ID NO: 441058 - DNA, 140 bp, Artificial Sequence
  Synthetic
caccgctgtcccaaaaggtccacgatctatcattaacaaactaaccagactccaacccttctgtcttaaaccctccaaccctccatcttggccattccagcacgtcgggccgttcgacatcatatcagcagccagggcct

SEQ ID NO: 441059 - DNA, 140 bp, Artificial Sequence
  Synthetic
atacgccatgctgggtctcctcattcattccctaggagacttccctgtatttataaaagataaggtgggtcaacttgaagggacatttggtcctagcgcaaaaaggttcttcaaggctctcgtacttgggagtcggccat

SEQ ID NO: 441060 - DNA, 140 bp, Artificial Sequence
  Synthetic
atggccgactcccaagtacgagagccttgaagaacctttttgcgctaggaccaaatgtcccttcaagttgacccaccttatcttttataaatacagggaagtctcctagggaatgaatgaggagacccagcatggcgtat

SEQ ID NO: 441061 - DNA, 140 bp, Artificial Sequence
  Synthetic
atacgccatgctgggtctccgtgctaattggagtactataccgaacttcagattcttggccgggacctacgacatgtttttctcccgggttgagcatctatattcagcaatcagagggggcgtacttgggagtcggccat

SEQ ID NO: 441062 - DNA, 140 bp, Artificial Sequence
  Synthetic
atggccgactcccaagtacgccccctctgattgctgaatatagatgctcaacccgggagaaaaacatgtcgtaggtcccggccaagaatctgaagttcggtatagtactccaattagcacggagacccagcatggcgtat

SEQ ID NO: 441063 - DNA, 140 bp, Artificial Sequence
  Synthetic
atacgccatgctgggtctccgtatctctaacgaccaaatagtcaaccttgccaatataatgtcgacagtatccaccaatgcattgactgtagcacaacactctcaatccttgattaagcccgtacttgggagtcggccat

SEQ ID NO: 441064 - DNA, 140 bp, Artificial Sequence
  Synthetic
atggccgactcccaagtacgggcttaatcaaggattgagagtgttgtgctacagtcaatgcattggtggatactgtcgacattatattggcaaggttgactatttggtcgttagagatacggagacccagcatggcgtat

SEQ ID NO: 441065 - DNA, 140 bp, Artificial Sequence
  Synthetic
aggccctggctgctgatatgtgctgagtacttgacctcttccacccttcgggaaatgagccttgtgttattcaattgtagcagccccaagagtgagatgcagagagctcgttccttaaacgaccttttgggacagcggtg

SEQ ID NO: 441066 - DNA, 140 bp, Artificial Sequence
  Synthetic
caccgctgtcccaaaaggtcgtttaaggaacgagctctctgcatctcactcttggggctgctacaattgaataacacaaggctcatttcccgaagggtggaagaggtcaagtactcagcacatatcagcagccagggcct

SEQ ID NO: 441067 - DNA, 140 bp, Artificial Sequence
  Synthetic
atacgccatgctgggtctccctcccatgaaggacataagcaatagttcacaatcatcttgcatctcagtgaagtgtacataactataaagggctgggtcatctaagcatttcagtcgagacgtacttgggagtcggccat

SEQ ID NO: 441068 - DNA, 140 bp, Artificial Sequence
  Synthetic
atggccgactcccaagtacgtctcgactgaaatgcttagatgacccagccctttatagttatgtacacttcactgagatgcaagatgattgtgaactattgcttatgtccttcatgggagggagacccagcatggcgtat

SEQ ID NO: 441069 - DNA, 140 bp, Artificial Sequence
  Synthetic
atacgccatgctgggtctccatgaacggaggtcgactaaagagatcgcatatacggagatatgtctcagtcagttcaaatcatcaagctcgtccaaactcatttgcagaatttctaaacacgtacttgggagtcggccat

SEQ ID NO: 441070 - DNA, 140 bp, Artificial Sequence
  Synthetic
atggccgactcccaagtacgtgtttagaaattctgcaaatgagtttggacgagcttgatgatttgaactgactgagacatatctccgtatatgcgatctctttagtcgacctccgttcatggagacccagcatggcgtat

SEQ ID NO: 441071 - DNA, 140 bp, Artificial Sequence
  Synthetic
atacgccatgctgggtctcccagttcaaatcatcaagctcgtccaaactcatttgcagaatttctaaacaagacatattcgaacgactcataaggagttgaacaacagtgtgccagaagtcgtacttgggagtcggccat

SEQ ID NO: 441072 - DNA, 140 bp, Artificial Sequence
  Synthetic
atggccgactcccaagtacgacttctggcacactgttgttcaactccttatgagtcgttcgaatatgtcttgtttagaaattctgcaaatgagtttggacgagcttgatgatttgaactgggagacccagcatggcgtat

SEQ ID NO: 441073 - DNA, 140 bp, Artificial Sequence
  Synthetic
atacgccatgctgggtctccacagaactccagaacaataagaagacagtttcggaggagtctctcaaggacattggaagagtccttttacaactcagagatccatgggattaaccggatgcgtacttgggagtcggccat

SEQ ID NO: 441074 - DNA, 140 bp, Artificial Sequence
  Synthetic
atggccgactcccaagtacgcatccggttaatcccatggatctctgagttgtaaaaggactcttccaatgtccttgagagactcctccgaaactgtcttcttattgttctggagttctgtggagacccagcatggcgtat

SEQ ID NO: 441075 - DNA, 140 bp, Artificial Sequence
  Synthetic
atacgccatgctgggtctccgatacctgggttcctccacctccatgtcgacccagctattccacgcgtgggagaaggtcacaaatgttcatgtggtgaaaagagccctgtcactcaaagacgtacttgggagtcggccat

SEQ ID NO: 441076 - DNA, 140 bp, Artificial Sequence
  Synthetic
atggccgactcccaagtacgtctttgagtgacagggctcttttcaccacatgaacatttgtgaccttctcccacgcgtggaatagctgggtcgacatggaggtggaggaacccaggtatcggagacccagcatggcgtat

SEQ ID NO: 441077 - DNA, 140 bp, Artificial Sequence
  Synthetic
aggccctggctgctgatatgcctggacaatgttggaatccaaatggtcagacaaatgaggtcaggagagagattcctcaagatatggtcacagaccgtggaagagattatatcctatgttgaccttttgggacagcggtg

SEQ ID NO: 441078 - DNA, 140 bp, Artificial Sequence
  Synthetic
caccgctgtcccaaaaggtcaacataggatataatctcttccacggtctgtgaccatatcttgaggaatctctctcctgacctcatttgtctgaccatttggattccaacattgtccaggcatatcagcagccagggcct

SEQ ID NO: 441079 - DNA, 140 bp, Artificial Sequence
  Synthetic
atacgccatgctgggtctccgattcctcaagatatggtcacagaccgtggaagagattatatcctatgttgcggtcaactttcccaaccctccaggaaggtcctcagaggacaaatcaaccgtacttgggagtcggccat

SEQ ID NO: 441080 - DNA, 140 bp, Artificial Sequence
  Synthetic
atggccgactcccaagtacggttgatttgtcctctgaggaccttcctggagggttgggaaagttgaccgcaacataggatataatctcttccacggtctgtgaccatatcttgaggaatcggagacccagcatggcgtat

SEQ ID NO: 441081 - DNA, 140 bp, Artificial Sequence
  Synthetic
atacgccatgctgggtctccgtacagtgaggggggttactcctccgtttgtccgaatctcctctctcatatctctgtcagcacagacacgatgtctgacttgactcatgatgggagaaaccgtacttgggagtcggccat

SEQ ID NO: 441082 - DNA, 140 bp, Artificial Sequence
  Synthetic
atggccgactcccaagtacggtttctcccatcatgagtcaagtcagacatcgtgtctgtgctgacagagatatgagagaggagattcggacaaacggaggagtaacccccctcactgtacggagacccagcatggcgtat

SEQ ID NO: 441083 - DNA, 140 bp, Artificial Sequence
  Synthetic
aggccctggctgctgatatgtctctgtcagcacagacacgatgtctgacttgactcatgatgggagaaactatgactttatgtttcaaccgttgatgctttatgcacagacatggacatcgaccttttgggacagcggtg

SEQ ID NO: 441084 - DNA, 140 bp, Artificial Sequence
  Synthetic
caccgctgtcccaaaaggtcgatgtccatgtctgtgcataaagcatcaacggttgaaacataaagtcatagtttctcccatcatgagtcaagtcagacatcgtgtctgtgctgacagagacatatcagcagccagggcct

SEQ ID NO: 441085 - DNA, 140 bp, Artificial Sequence
  Synthetic
aggccctggctgctgatatgtgggatgggttgctttggccaattccaagaaattccaattgttggtggaggccgacaagctaaataaaatcatgcaggatgatttgaatcgctatgcatcgaccttttgggacagcggtg

SEQ ID NO: 441086 - DNA, 140 bp, Artificial Sequence
  Synthetic
caccgctgtcccaaaaggtcgatgcatagcgattcaaatcatcctgcatgattttatttagcttgtcggcctccaccaacaattggaatttcttggaattggccaaagcaacccatcccacatatcagcagccagggcct

SEQ ID NO: 441087 - DNA, 140 bp, Artificial Sequence
  Synthetic
atacgccatgctgggtctccaagaagttagatttgggatctgttaaagtaggtggaactgccgcccagtcgatgatctctctctggttatatggtgcccactctgagtcaaacaggagtccgtacttgggagtcggccat

SEQ ID NO: 441088 - DNA, 140 bp, Artificial Sequence
  Synthetic
atggccgactcccaagtacggactcctgtttgactcagagtgggcaccatataaccagagagagatcatcgactgggcggcagttccacctactttaacagatcccaaatctaacttcttggagacccagcatggcgtat

SEQ ID NO: 441089 - DNA, 140 bp, Artificial Sequence
  Synthetic
atacgccatgctgggtctccctcccagagactatttaagagggctcgcgagaggagtcttgatagggtcttcgatttgcttcttaacaagaatgacaaacatcaacatcaacagacctctcgtacttgggagtcggccat

SEQ ID NO: 441090 - DNA, 140 bp, Artificial Sequence
  Synthetic
atggccgactcccaagtacgagaggtctgttgatgttgatgtttgtcattcttgttaagaagcaaatcgaagaccctatcaagactcctctcgcgagccctcttaaatagtctctgggagggagacccagcatggcgtat

SEQ ID NO: 441091 - DNA, 140 bp, Artificial Sequence
  Synthetic
atacgccatgctgggtctcccccgaatacgtcccgctgaaagaactcacaagcaagaagaacatgaggaacttttgtatcaacggggaggtcaaagtgtgcagcccaaatggttactcatcgtacttgggagtcggccat

SEQ ID NO: 441092 - DNA, 140 bp, Artificial Sequence
  Synthetic
atggccgactcccaagtacgatgagtaaccatttgggctgcacactttgacctccccgttgatacaaaagttcctcatgttcttcttgcttgtgagttctttcagcgggacgtattcgggggagacccagcatggcgtat

SEQ ID NO: 441093 - DNA, 140 bp, Artificial Sequence
  Synthetic
aggccctggctgctgatatgactatcaagatcttgtaaggggatttcctgaagagatcatatcaaatccttacaatgaaatgatcataactctgattgacagtgatgtagagtccttcctgaccttttgggacagcggtg

SEQ ID NO: 441094 - DNA, 140 bp, Artificial Sequence
  Synthetic
caccgctgtcccaaaaggtcaggaaggactctacatcactgtcaatcagagttatgatcatttcattgtaaggatttgatatgatctcttcaggaaatccccttacaagatcttgatagtcatatcagcagccagggcct

SEQ ID NO: 441095 - DNA, 140 bp, Artificial Sequence
  Synthetic
aggccctggctgctgatatgataatcagattatatcccgcaagtttatcacttgtttacctctggaggagagaacatacgggcttaactccaatccttgggagcaatagaacaaaaaacagaccttttgggacagcggtg

SEQ ID NO: 441096 - DNA, 140 bp, Artificial Sequence
  Synthetic
caccgctgtcccaaaaggtctgttttttgttctattgctcccaaggattggagttaagcccgtatgttctctcctccagaggtaaacaagtgataaacttgcgggatataatctgattatcatatcagcagccagggcct

SEQ ID NO: 441097 - DNA, 140 bp, Artificial Sequence
  Synthetic
atacgccatgctgggtctccggcttcagaatccattgatttccggcctgagagtggttcaatgggcgacaggggcccattacaagctcaaacctattctggatgatctcaatgtattccccgtacttgggagtcggccat

SEQ ID NO: 441098 - DNA, 140 bp, Artificial Sequence
  Synthetic
atggccgactcccaagtacggggaatacattgagatcatccagaataggtttgagcttgtaatgggcccctgtcgcccattgaaccactctcaggccggaaatcaatggattctgaagccggagacccagcatggcgtat

SEQ ID NO: 441099 - DNA, 140 bp, Artificial Sequence
  Synthetic
atacgccatgctgggtctccaaagatcaaatatggggactgctgattgtgacaaaggactttgtttactctcagagttctaactgtctttttgacagaaactacacacttatgctaaaagcgtacttgggagtcggccat

SEQ ID NO: 441100 - DNA, 140 bp, Artificial Sequence
  Synthetic
atggccgactcccaagtacgcttttagcataagtgtgtagtttctgtcaaaaagacagttagaactctgagagtaaacaaagtcctttgtcacaatcagcagtccccatatttgatctttggagacccagcatggcgtat

SEQ ID NO: 441101 - DNA, 140 bp, Artificial Sequence
  Synthetic
atacgccatgctgggtctcccagtcagttcaagaacaggtaaatatgtcctatgaccttatcatttgtgatgcagaggtcactgacattgcatcaatcaaccgaataaccttgctaatgtcgtacttgggagtcggccat

SEQ ID NO: 441102 - DNA, 140 bp, Artificial Sequence
  Synthetic
atggccgactcccaagtacgacattagcaaggttattcggttgattgatgcaatgtcagtgacctctgcatcacaaatgataaggtcataggacatatttacctgttcttgaactgactgggagacccagcatggcgtat

SEQ ID NO: 441103 - DNA, 140 bp, Artificial Sequence
  Synthetic
atacgccatgctgggtctccatgtagagccgcgtacaactggaagacggccggtgaccccagatatgaggagtctctacacaatccgtaccctgactaccattggcttcgaactgtaaaacgtacttgggagtcggccat

SEQ ID NO: 441104 - DNA, 140 bp, Artificial Sequence
  Synthetic
atggccgactcccaagtacgttttacagttcgaagccaatggtagtcagggtacggattgtgtagagactcctcatatctggggtcaccggccgtcttccagttgtacgcggctctacatggagacccagcatggcgtat

SEQ ID NO: 441105 - DNA, 140 bp, Artificial Sequence
  Synthetic
aggccctggctgctgatatgcagagcatttcccgcggtcacgggattcataactcagatgacatcgtctttctcatctgagctatacctcagattctcaaagcgagggaaattctttagggaccttttgggacagcggtg

SEQ ID NO: 441106 - DNA, 140 bp, Artificial Sequence
  Synthetic
caccgctgtcccaaaaggtccctaaagaatttccctcgctttgagaatctgaggtatagctcagatgagaaagacgatgtcatctgagttatgaatcccgtgaccgcgggaaatgctctgcatatcagcagccagggcct

SEQ ID NO: 441107 - DNA, 140 bp, Artificial Sequence
  Synthetic
aggccctggctgctgatatgtcaggaataacggtgtcctcgacctactgctcaactaatcatgattacaccatttggatgcctgagaatctgagactagggacatcttgtgacatttttagaccttttgggacagcggtg

SEQ ID NO: 441108 - DNA, 140 bp, Artificial Sequence
  Synthetic
caccgctgtcccaaaaggtctaaaaatgtcacaagatgtccctagtctcagattctcaggcatccaaatggtgtaatcatgattagttgagcagtaggtcgaggacaccgttattcctgacatatcagcagccagggcct

SEQ ID NO: 441109 - DNA, 140 bp, Artificial Sequence
  Synthetic
atacgccatgctgggtctccattcaattgtagcagccccaagagcgagatgcagagggcccgatctctgaattaccaagatcttgtaaggggatttccagatgagatcatatccaatcctcgtacttgggagtcggccat

SEQ ID NO: 441110 - DNA, 140 bp, Artificial Sequence
  Synthetic
atggccgactcccaagtacgaggattggatatgatctcatctggaaatccccttacaagatcttggtaattcagagatcgggccctctgcatctcgctcttggggctgctacaattgaatggagacccagcatggcgtat

SEQ ID NO: 441111 - DNA, 140 bp, Artificial Sequence
  Synthetic
atacgccatgctgggtctccggtccacaagatggtggatgatctagagttgcagcgaggaaccttgtctaaagtttcaattattgtagctataatgatagtcttttccaatagggtgttccgtacttgggagtcggccat

SEQ ID NO: 441112 - DNA, 140 bp, Artificial Sequence
  Synthetic
atggccgactcccaagtacggaacaccctattggaaaagactatcattatagctacaataattgaaactttagacaaggttcctcgctgcaactctagatcatccaccatcttgtggaccggagacccagcatggcgtat

SEQ ID NO: 441113 - DNA, 140 bp, Artificial Sequence
  Synthetic
aggccctggctgctgatatgtgcacgactttcgctcggatgaaattgagcatcttgttgtagaggagttggtcaagaaaagagaggagtgtctggatgcactagagtccatcatgaccacgaccttttgggacagcggtg

SEQ ID NO: 441114 - DNA, 140 bp, Artificial Sequence
  Synthetic
caccgctgtcccaaaaggtcgtggtcatgatggactctagtgcatccagacactcctctcttttcttgaccaactcctctacaacaagatgctcaatttcatccgagcgaaagtcgtgcacatatcagcagccagggcct

SEQ ID NO: 441115 - DNA, 140 bp, Artificial Sequence
  Synthetic
atacgccatgctgggtctccccaagtcagtgagtttcagacgtctcagtcacttgagaaaacttgtccctgggtttggaaaagcatataccatattcaacaaaaccttgatggaggctgacgtacttgggagtcggccat

SEQ ID NO: 441116 - DNA, 140 bp, Artificial Sequence
  Synthetic
atggccgactcccaagtacgtcagcctccatcaaggttttgttgaatatggtatatgcttttccaaacccagggacaagttttctcaagtgactgagacgtctgaaactcactgacttggggagacccagcatggcgtat

SEQ ID NO: 441117 - DNA, 140 bp, Artificial Sequence
  Synthetic
aggccctggctgctgatatgaacagacccataacctattatttcaagaaacaagtcattcgggggaatatctatctatcttggagttggtctgatgatacttcggtgtttaaaagggtgggaccttttgggacagcggtg

SEQ ID NO: 441118 - DNA, 140 bp, Artificial Sequence
  Synthetic
caccgctgtcccaaaaggtcccacccttttaaacaccgaagtatcatcagaccaactccaagatagatagatattcccccgaatgacttgtttcttgaaataataggttatgggtctgttcatatcagcagccagggcct

SEQ ID NO: 441119 - DNA, 140 bp, Artificial Sequence
  Synthetic
atacgccatgctgggtctcccttgcaactccagcttgagtctctcttctcactggatcaggctgatctacaaaatagtaaagactaccagacttgttggaagcctagaggacctgtccagcgtacttgggagtcggccat

SEQ ID NO: 441120 - DNA, 140 bp, Artificial Sequence
  Synthetic
atggccgactcccaagtacgctggacaggtcctctaggcttccaacaagtctggtagtctttactattttgtagatcagcctgatccagtgagaagagagactcaagctggagttgcaagggagacccagcatggcgtat

SEQ ID NO: 441121 - DNA, 140 bp, Artificial Sequence
  Synthetic
aggccctggctgctgatatgggtaatcttgaacggtacactgtgaaaaaaactggatcccaatccttaacctctatttgcttgattatttttccatcttcattgtttttttgttaagcgtgaccttttgggacagcggtg

SEQ ID NO: 441122 - DNA, 140 bp, Artificial Sequence
  Synthetic
caccgctgtcccaaaaggtcacgcttaacaaaaaaacaatgaagatggaaaaataatcaagcaaatagaggttaaggattgggatccagtttttttcacagtgtaccgttcaagattacccatatcagcagccagggcct

SEQ ID NO: 441123 - DNA, 140 bp, Artificial Sequence
  Synthetic
aggccctggctgctgatatggttgtagaagagtcaatcgaccagaatctacgcagcacagtcttggagggaaaaggaggaaagtgtcgatcacttcccaaagcgggaaggttatatcttcgaccttttgggacagcggtg

SEQ ID NO: 441124 - DNA, 140 bp, Artificial Sequence
  Synthetic
caccgctgtcccaaaaggtcgaagatataaccttcccgctttgggaagtgatcgacactttcctccttttccctccaagactgtgctgcgtagattctggtcgattgactcttctacaaccatatcagcagccagggcct

SEQ ID NO: 441125 - DNA, 140 bp, Artificial Sequence
  Synthetic
atacgccatgctgggtctccaaaaggaggaaagtgtcgatcacttcccaaagcgggaaggttatatcttcatgggagtcatataagagtgggggtgaaactagactgtaaaggccggtcacgtacttgggagtcggccat

SEQ ID NO: 441126 - DNA, 140 bp, Artificial Sequence
  Synthetic
atggccgactcccaagtacgtgaccggcctttacagtctagtttcacccccactcttatatgactcccatgaagatataaccttcccgctttgggaagtgatcgacactttcctccttttggagacccagcatggcgtat

SEQ ID NO: 441127 - DNA, 140 bp, Artificial Sequence
  Synthetic
atacgccatgctgggtctccatgagactatcattaatcatctcagttgatcaaactaggtcatgtagattctcataatacgggaaatcttctagcagtttcagtgactaacggtgctttccgtacttgggagtcggccat

SEQ ID NO: 441128 - DNA, 140 bp, Artificial Sequence
  Synthetic
atggccgactcccaagtacggaaagcaccgttagtcactgaaactgctagaagatttcccgtattatgagaatctacatgacctagtttgatcaactgagatgattaatgatagtctcatggagacccagcatggcgtat

SEQ ID NO: 441129 - DNA, 140 bp, Artificial Sequence
  Synthetic
atacgccatgctgggtctccctcataatacgggaaatcttctagcagtttcagtgactaacggtgctttcattctccaggagctggtaccaaaggttgtggacaggccgagaggtatttccgtacttgggagtcggccat

SEQ ID NO: 441130 - DNA, 140 bp, Artificial Sequence
  Synthetic
atggccgactcccaagtacggaaatacctctcggcctgtccacaacctttggtaccagctcctggagaatgaaagcaccgttagtcactgaaactgctagaagatttcccgtattatgagggagacccagcatggcgtat

SEQ ID NO: 441131 - DNA, 140 bp, Artificial Sequence
  Synthetic
aggccctggctgctgatatggatcaaaaaagcaactggcaacacttctcatcttgaatcctacatcaagatgctagatccaggagaggtctatgatgaccccattgatccagtcgagtcagaccttttgggacagcggtg

SEQ ID NO: 441132 - DNA, 140 bp, Artificial Sequence
  Synthetic
caccgctgtcccaaaaggtctgactcgactggatcaatggggtcatcatagacctctcctggatctagcatcttgatgtaggattcaagatgagaagtgttgccagttgcttttttgatccatatcagcagccagggcct

SEQ ID NO: 441133 - DNA, 140 bp, Artificial Sequence
  Synthetic
aggccctggctgctgatatgtctgggttctctgaaagtgggcggtactgctgcacaatcgatgatttctctttggttatatggtgcacactctgaatcaaacaggagccggagatgtatagaccttttgggacagcggtg

SEQ ID NO: 441134 - DNA, 140 bp, Artificial Sequence
  Synthetic
caccgctgtcccaaaaggtctatacatctccggctcctgtttgattcagagtgtgcaccatataaccaaagagaaatcatcgattgtgcagcagtaccgcccactttcagagaacccagacatatcagcagccagggcct

SEQ ID NO: 441135 - DNA, 140 bp, Artificial Sequence
  Synthetic
aggccctggctgctgatatggaatgccctggactgggacgaagaaaaaaccatcttggcattgtggagagatttaacctcagtggacatcgggaaggacttggtcaagttcaaagatcaagaccttttgggacagcggtg

SEQ ID NO: 441136 - DNA, 140 bp, Artificial Sequence
  Synthetic
caccgctgtcccaaaaggtcttgatctttgaacttgaccaagtccttcccgatgtccactgaggttaaatctctccacaatgccaagatggttttttcttcgtcccagtccagggcattccatatcagcagccagggcct

SEQ ID NO: 441137 - DNA, 140 bp, Artificial Sequence
  Synthetic
aggccctggctgctgatatgtgtctcgcttcaactccttaatgatcttgctctctccccccgagcccagatactcagacgacttgatctctcagctgtgccagctatacatcgctggggagaccttttgggacagcggtg

SEQ ID NO: 441138 - DNA, 140 bp, Artificial Sequence
  Synthetic
caccgctgtcccaaaaggtctccccagcgatgtatagctggcacagctgagagatcaagtcgtctgagtatctgggctcggggggagagagcaagatcattaaggagttgaagcgagacacatatcagcagccagggcct

SEQ ID NO: 441139 - DNA, 140 bp, Artificial Sequence
  Synthetic
aggccctggctgctgatatgcattaaaatattagaaccatatgtagtgaacagcttagtccaaagggcagaaaagttcaggcctctcattcattctttgggagatttccctgtgtttatagaccttttgggacagcggtg

SEQ ID NO: 441140 - DNA, 140 bp, Artificial Sequence
  Synthetic
caccgctgtcccaaaaggtctataaacacagggaaatctcccaaagaatgaatgagaggcctgaacttttctgccctttggactaagctgttcactacatatggttctaatattttaatgcatatcagcagccagggcct

SEQ ID NO: 441141 - DNA, 140 bp, Artificial Sequence
  Synthetic
atacgccatgctgggtctcctactctcgggaacctgtacatactaaaattcgtgtatgatgtatcttgaaaaaaacaagatcttgaatccgagcctctggctgtttgattgttttttttacgtacttgggagtcggccat

SEQ ID NO: 441142 - DNA, 140 bp, Artificial Sequence
  Synthetic
atggccgactcccaagtacgtaaaaaaaacaatcaaacagccagaggctcggattcaagatcttgtttttttcaagatacatcatacacgaattttagtatgtacaggttcccgagagtaggagacccagcatggcgtat

SEQ ID NO: 441143 - DNA, 140 bp, Artificial Sequence
  Synthetic
atacgccatgctgggtctccttctggatcaattcgacaacatacatgatttggtttttgtgtatggctgttacagacattgggggcacccctatatagattatcgaaagggtctatcgaacgtacttgggagtcggccat

SEQ ID NO: 441144 - DNA, 140 bp, Artificial Sequence
  Synthetic
atggccgactcccaagtacgttcgatagaccctttcgataatctatataggggtgcccccaatgtctgtaacagccatacacaaaaaccaaatcatgtatgttgtcgaattgatccagaaggagacccagcatggcgtat

SEQ ID NO: 441145 - DNA, 140 bp, Artificial Sequence
  Synthetic
atacgccatgctgggtctccaatgcaattcttcgaggggacatgccccgaagactggaatagctacgggatcttgattgcacgaaaaggagacaaaatcacccctgactctcttgtagaccgtacttgggagtcggccat

SEQ ID NO: 441146 - DNA, 140 bp, Artificial Sequence
  Synthetic
atggccgactcccaagtacggtctacaagagagtcaggggtgattttgtctccttttcgtgcaatcaagatcccgtagctattccagtcttcggggcatgtcccctcgaagaattgcattggagacccagcatggcgtat

SEQ ID NO: 441147 - DNA, 140 bp, Artificial Sequence
  Synthetic
aggccctggctgctgatatgcttcaaaaccccttgatctcgggcctgagagtggttcagtgggcgacaggggcccattataaactcaaacctattctggatggtctcaatgtattcccgtgaccttttgggacagcggtg

SEQ ID NO: 441148 - DNA, 140 bp, Artificial Sequence
  Synthetic
caccgctgtcccaaaaggtcacgggaatacattgagaccatccagaataggtttgagtttataatgggcccctgtcgcccactgaaccactctcaggcccgagatcaaggggttttgaagcatatcagcagccagggcct

SEQ ID NO: 441149 - DNA, 140 bp, Artificial Sequence
  Synthetic
aggccctggctgctgatatgggggatttgataagtactccaagtggtatctggattcgcgattccttgcccgagaccaccccttgactccttatatcaaaacccagacatggccacccaagaccttttgggacagcggtg

SEQ ID NO: 441150 - DNA, 140 bp, Artificial Sequence
  Synthetic
caccgctgtcccaaaaggtcttgggtggccatgtctgggttttgatataaggagtcaaggggtggtctcgggcaaggaatcgcgaatccagataccacttggagtacttatcaaatcccccatatcagcagccagggcct

SEQ ID NO: 441151 - DNA, 140 bp, Artificial Sequence
  Synthetic
atacgccatgctgggtctccaaatcaaagaatgattgggctagtcaaggttgttgttggattggcgttgtcaggggccccagttcctgagggtatgaactgggtatacaaattgaggagacgtacttgggagtcggccat

SEQ ID NO: 441152 - DNA, 140 bp, Artificial Sequence
  Synthetic
atggccgactcccaagtacgtctcctcaatttgtatacccagttcataccctcaggaactggggcccctgacaacgccaatccaacaacaaccttgactagcccaatcattctttgatttggagacccagcatggcgtat

SEQ ID NO: 441153 - DNA, 140 bp, Artificial Sequence
  Synthetic
aggccctggctgctgatatgctcatcgggttatgggaggatcaaatatactgcttggatatgtccaacggcccaacctgctggaatggccaggacggcgggctagagggcttacggcagagaccttttgggacagcggtg

SEQ ID NO: 441154 - DNA, 140 bp, Artificial Sequence
  Synthetic
caccgctgtcccaaaaggtctctgccgtaagccctctagcccgccgtcctggccattccagcaggttgggccgttggacatatccaagcagtatatttgatcctcccataacccgatgagcatatcagcagccagggcct

SEQ ID NO: 441155 - DNA, 140 bp, Artificial Sequence
  Synthetic
atacgccatgctgggtctcccccaacctgctggaatggccaggacggcgggctagagggcttacggcagaagggctggagtctagtcagcttattgatgatagatagagaatctcaaacccgtacttgggagtcggccat

SEQ ID NO: 441156 - DNA, 140 bp, Artificial Sequence
  Synthetic
atggccgactcccaagtacgggtttgagattctctatctatcatcaataagctgactagactccagcccttctgccgtaagccctctagcccgccgtcctggccattccagcaggttgggggagacccagcatggcgtat

SEQ ID NO: 441157 - DNA, 140 bp, Artificial Sequence
  Synthetic
atacgccatgctgggtctccagggctggagtctagtcagcttattgatgatagatagagaatctcaaaccaggaacacaagaaccaaaatactagctcaaggagacaaccaggttctatgcgtacttgggagtcggccat

SEQ ID NO: 441158 - DNA, 140 bp, Artificial Sequence
  Synthetic
atggccgactcccaagtacgcatagaacctggttgtctccttgagctagtattttggttcttgtgttcctggtttgagattctctatctatcatcaataagctgactagactccagccctggagacccagcatggcgtat

SEQ ID NO: 441159 - DNA, 140 bp, Artificial Sequence
  Synthetic
atacgccatgctgggtctccgagagcacatgggcttgaccccaactttcaggagcaatagaacaaaaatatgtcatggtgccgttgaatcgctgcattttgtcagagtagactctattaccgtacttgggagtcggccat

SEQ ID NO: 441160 - DNA, 140 bp, Artificial Sequence
  Synthetic
atggccgactcccaagtacggtaatagagtctactctgacaaaatgcagcgattcaacggcaccatgacatatttttgttctattgctcctgaaagttggggtcaagcccatgtgctctcggagacccagcatggcgtat

SEQ ID NO: 441161 - DNA, 140 bp, Artificial Sequence
  Synthetic
atacgccatgctgggtctccttatgtcaccaccacattcaagaggaaacatttccgccctataccggatgcatgcagggctgcatacaactggaagatggctggtgatcctagatatgagcgtacttgggagtcggccat

SEQ ID NO: 441162 - DNA, 140 bp, Artificial Sequence
  Synthetic
atggccgactcccaagtacgctcatatctaggatcaccagccatcttccagttgtatgcagccctgcatgcatccggtatagggcggaaatgtttcctcttgaatgtggtggtgacataaggagacccagcatggcgtat

SEQ ID NO: 441163 - DNA, 140 bp, Artificial Sequence
  Synthetic
aggccctggctgctgatatgttttgcatcaacggggaagtcaaggtgtgtagtccaaacggctattcttttagaatcctacgacacattttgaaatcattcgatgagatctattctggaagaccttttgggacagcggtg

SEQ ID NO: 441164 - DNA, 140 bp, Artificial Sequence
  Synthetic
caccgctgtcccaaaaggtcttccagaatagatctcatcgaatgatttcaaaatgtgtcgtaggattctaaaagaatagccgtttggactacacaccttgacttccccgttgatgcaaaacatatcagcagccagggcct

SEQ ID NO: 441165 - DNA, 140 bp, Artificial Sequence
  Synthetic
aggccctggctgctgatatggtctctgaagggttgtccttctggagagagatctggttaagctcccacgagtcctggattcacgcgttgtgtcaagaggctgggaacccagatcttggaggaccttttgggacagcggtg

SEQ ID NO: 441166 - DNA, 140 bp, Artificial Sequence
  Synthetic
caccgctgtcccaaaaggtcctccaagatctgggttcccagcctcttgacacaacgcgtgaatccaggactcgtgggagcttaaccagatctctctccagaaggacaacccttcagagaccatatcagcagccagggcct

SEQ ID NO: 441167 - DNA, 140 bp, Artificial Sequence
  Synthetic
atacgccatgctgggtctccacccatacgacaaatcccttcattctagggtgttccctggtgggaaatgtttgggaataacggtttcttccacctactgctcaaccaaccatgattacaccgtacttgggagtcggccat

SEQ ID NO: 441168 - DNA, 140 bp, Artificial Sequence
  Synthetic
atggccgactcccaagtacggtgtaatcatggttggttgagcagtaggtggaagaaaccgttattcccaaacatttcccaccagggaacaccctagaatgaagggatttgtcgtatgggtggagacccagcatggcgtat

SEQ ID NO: 441169 - DNA, 140 bp, Artificial Sequence
  Synthetic
aggccctggctgctgatatgaaaggctctgtatgacgaggtggacaaggtggaaaactcagagtttcgagaggctatcctgttgtccaagacccatagagataacttcatactcttcttagaccttttgggacagcggtg

SEQ ID NO: 441170 - DNA, 140 bp, Artificial Sequence
  Synthetic
caccgctgtcccaaaaggtctaagaagagtatgaagttatctctatgggtcttggacaacaggatagcctctcgaaactctgagttttccaccttgtccacctcgtcatacagagcctttcatatcagcagccagggcct

SEQ ID NO: 441171 - DNA, 140 bp, Artificial Sequence
  Synthetic
atacgccatgctgggtctccgtctttcttgggaatccccgagtcaatcattggactgatacaaaactcccggacgataagaaggcagtttagaaagagcctctcaagaactttagaagaacgtacttgggagtcggccat

SEQ ID NO: 441172 - DNA, 140 bp, Artificial Sequence
  Synthetic
atggccgactcccaagtacgttcttctaaagttcttgagaggctctttctaaactgccttcttatcgtccgggagttttgtatcagtccaatgattgactcggggattcccaagaaagacggagacccagcatggcgtat

SEQ ID NO: 441173 - DNA, 140 bp, Artificial Sequence
  Synthetic
atacgccatgctgggtctccctacatgactttcactcagacgaaatagagcatctcgtcgtggaggagttggtcaagaagagggaagagtgtttggacgcattggagtccatcatgacaacgtacttgggagtcggccat

SEQ ID NO: 441174 - DNA, 140 bp, Artificial Sequence
  Synthetic
atggccgactcccaagtacgttgtcatgatggactccaatgcgtccaaacactcttccctcttcttgaccaactcctccacgacgagatgctctatttcgtctgagtgaaagtcatgtagggagacccagcatggcgtat

SEQ ID NO: 441175 - DNA, 140 bp, Artificial Sequence
  Synthetic
atacgccatgctgggtctccaataaattgtgtacatccttcacgaaaaaaactaacacccctccttttgaaccatctcaggcatgagcaagatttttgtcaacccaagtgcgatcagggccgtacttgggagtcggccat

SEQ ID NO: 441176 - DNA, 140 bp, Artificial Sequence
  Synthetic
atggccgactcccaagtacggccctgatcgcacttgggttgacaaaaatcttgctcatgcctgagatggttcaaaaggaggggtgttagtttttttcgtgaaggatgtacacaatttattggagacccagcatggcgtat

SEQ ID NO: 441177 - DNA, 140 bp, Artificial Sequence
  Synthetic
aggccctggctgctgatatgggagccccagtccctgagggcatgaactgggtttacaaattgaggagaactcttatcttccaatgggctgaatctagaggccctcttgaaggggaggagtgaccttttgggacagcggtg

SEQ ID NO: 441178 - DNA, 140 bp, Artificial Sequence
  Synthetic
caccgctgtcccaaaaggtcactcctccccttcaagagggcctctagattcagcccattggaagataagagttctcctcaatttgtaaacccagttcatgccctcagggactggggctcccatatcagcagccagggcct

SEQ ID NO: 441179 - DNA, 140 bp, Artificial Sequence
  Synthetic
atacgccatgctgggtctccgcctgtaattctagcttgagtctgtcatctcactggatcaggttgatttacaagatagtgaagactaccagactcgttggcagcatcgaggacctgtccgcgtacttgggagtcggccat

SEQ ID NO: 441180 - DNA, 140 bp, Artificial Sequence
  Synthetic
atggccgactcccaagtacgcggacaggtcctcgatgctgccaacgagtctggtagtcttcactatcttgtaaatcaacctgatccagtgagatgacagactcaagctagaattacaggcggagacccagcatggcgtat

SEQ ID NO: 441181 - DNA, 140 bp, Artificial Sequence
  Synthetic
atacgccatgctgggtctccctgccatctcaaacaactcaatgattgagtccaagcagaggccattgcgagttccactgcattggaccagttagagattagttgagaaagacgatttgcccgtacttgggagtcggccat

SEQ ID NO: 441182 - DNA, 140 bp, Artificial Sequence
  Synthetic
atggccgactcccaagtacgggcaaatcgtctttctcaactaatctctaactggtccaatgcagtggaactcgcaatggcctctgcttggactcaatcattgagttgtttgagatggcagggagacccagcatggcgtat

SEQ ID NO: 441183 - DNA, 140 bp, Artificial Sequence
  Synthetic
atacgccatgctgggtctccggatacaatgatgggaccatcttccctgtcaacatatacggcaaagtttcccctagagactatttgagagggctcgcaagagggatcttgataggatcctcgtacttgggagtcggccat

SEQ ID NO: 441184 - DNA, 140 bp, Artificial Sequence
  Synthetic
atggccgactcccaagtacgaggatcctatcaagatccctcttgcgagccctctcaaatagtctctaggggaaactttgccgtatatgttgacagggaagatggtcccatcattgtatccggagacccagcatggcgtat

SEQ ID NO: 441185 - DNA, 140 bp, Artificial Sequence
  Synthetic
atacgccatgctgggtctccaaaaactgtgaaatgtaggggcaatcagcaacacttctcatcccaagaactgcaccatgatgattgatccgggagaggtttttgacgaccccatcgatcccgtacttgggagtcggccat

SEQ ID NO: 441186 - DNA, 140 bp, Artificial Sequence
  Synthetic
atggccgactcccaagtacgggatcgatggggtcgtcaaaaacctctcccggatcaatcatcatggtgcagttcttgggatgagaagtgttgctgattgcccctacatttcacagtttttggagacccagcatggcgtat

SEQ ID NO: 441187 - DNA, 140 bp, Artificial Sequence
  Synthetic
atacgccatgctgggtctccaaattgatgttggaatggttgaaaacagggaatagacctctccggatgactctgacagacaattgctctaggtcttacaaagtcttgaaagattatttcacgtacttgggagtcggccat

SEQ ID NO: 441188 - DNA, 140 bp, Artificial Sequence
  Synthetic
atggccgactcccaagtacgtgaaataatctttcaagactttgtaagacctagagcaattgtctgtcagagtcatccggagaggtctattccctgttttcaaccattccaacatcaatttggagacccagcatggcgtat

SEQ ID NO: 441189 - DNA, 140 bp, Artificial Sequence
  Synthetic
atacgccatgctgggtctcctgccaaaatgacgtacctgaccctcattacttaccagtctcatctcctactccagagggttgagagaaatttgtctaagagtatgagagctaacttgcgacgtacttgggagtcggccat

SEQ ID NO: 441190 - DNA, 140 bp, Artificial Sequence
  Synthetic
atggccgactcccaagtacgtcgcaagttagctctcatactcttagacaaatttctctcaaccctctggagtaggagatgagactggtaagtaatgagggtcaggtacgtcattttggcaggagacccagcatggcgtat

SEQ ID NO: 441191 - DNA, 140 bp, Artificial Sequence
  Synthetic
aggccctggctgctgatatggaacaaggtgggtggatcaagaggtgcgccatgcagccagaaccatgaccggagattacagcccctacaagaaggtgtctcgtaaagcaggatgttcagagaccttttgggacagcggtg

SEQ ID NO: 441192 - DNA, 140 bp, Artificial Sequence
  Synthetic
caccgctgtcccaaaaggtctctgaacatcctgctttacgagacaccttcttgtaggggctgtaatctccggtcatggttctggctgcatggcgcacctcttgatccacccaccttgttccatatcagcagccagggcct

SEQ ID NO: 441193 - DNA, 140 bp, Artificial Sequence
  Synthetic
atacgccatgctgggtctccggtaacaggtccattttgtgctacctccaacacgtgctgcgctatgaacgagaggtaatcacatcatctccggagaatgactggttgtggatcttctcggcgtacttgggagtcggccat

SEQ ID NO: 441194 - DNA, 140 bp, Artificial Sequence
  Synthetic
atggccgactcccaagtacgccgagaagatccacaaccagtcattctccggagatgatgtgattacctctcgttcatagcgcagcacgtgttggaggtagcacaaaatggacctgttaccggagacccagcatggcgtat

SEQ ID NO: 441195 - DNA, 140 bp, Artificial Sequence
  Synthetic
aggccctggctgctgatatgaaaacaggtcaacatgtcttatgacctcattatttgtgatgcagaagtcactgacattgcatctatcaaccggataaccctgttaatgtctgatttcgcagaccttttgggacagcggtg

SEQ ID NO: 441196 - DNA, 140 bp, Artificial Sequence
  Synthetic
caccgctgtcccaaaaggtctgcgaaatcagacattaacagggttatccggttgatagatgcaatgtcagtgacttctgcatcacaaataatgaggtcataagacatgttgacctgttttcatatcagcagccagggcct

SEQ ID NO: 441197 - DNA, 140 bp, Artificial Sequence
  Synthetic
atacgccatgctgggtctcctcttatcaggaatgcttggcgagtgacttggccagaaggatcctcaggtggggatttgacaagtactccaaatggtatcttgattcgcgacttctttcaacgtacttgggagtcggccat

SEQ ID NO: 441198 - DNA, 140 bp, Artificial Sequence
  Synthetic
atggccgactcccaagtacgttgaaagaagtcgcgaatcaagataccatttggagtacttgtcaaatccccacctgaggatccttctggccaagtcactcgccaagcattcctgataagaggagacccagcatggcgtat

SEQ ID NO: 441199 - DNA, 140 bp, Artificial Sequence
  Synthetic
atacgccatgctgggtctcccttgacctcttccacccttcgggaaatgagccttgtgttattcaactgcagcagccccaagagtgagatgcaaagagctcgttccttaaactatcaagatcgtacttgggagtcggccat

SEQ ID NO: 441200 - DNA, 140 bp, Artificial Sequence
  Synthetic
atggccgactcccaagtacgatcttgatagtttaaggaacgagctctttgcatctcactcttggggctgctgcagttgaataacacaaggctcatttcccgaagggtggaagaggtcaagggagacccagcatggcgtat

SEQ ID NO: 441201 - DNA, 140 bp, Artificial Sequence
  Synthetic
aggccctggctgctgatatgcaaaaatgtaacacccctacaatggattccgacaagattgtattcaaagtcaataatcaggtggtctctttaaagcctgagattatcgtggatcaatatggaccttttgggacagcggtg

SEQ ID NO: 441202 - DNA, 140 bp, Artificial Sequence
  Synthetic
caccgctgtcccaaaaggtccatattgatccacgataatctcaggctttaaagagaccacctgattattgactttgaatacaatcttgtcggaatccattgtaggggtgttacatttttgcatatcagcagccagggcct

SEQ ID NO: 441203 - DNA, 140 bp, Artificial Sequence
  Synthetic
aggccctggctgctgatatggagaggtggaaagacaccttcatgggtacaacaggtggatcaccctcgaggatatcagatctagatcatctctactagactacagctgcttgtaaaccgagaccttttgggacagcggtg

SEQ ID NO: 441204 - DNA, 140 bp, Artificial Sequence
  Synthetic
caccgctgtcccaaaaggtctcggtttacaagcagctgtagtctagtagagatgatctagatctgatatcctcgagggtgatccacctgttgtacccatgaaggtgtctttccacctctccatatcagcagccagggcct

SEQ ID NO: 441205 - DNA, 140 bp, Artificial Sequence
  Synthetic
aggccctggctgctgatatggaatgccgccaaactagatcccgatgatgtatgttcctacctggcagcagcaatgcagttctttgaggggacatgtccggaagactggaccagctatggagaccttttgggacagcggtg

SEQ ID NO: 441206 - DNA, 140 bp, Artificial Sequence
  Synthetic
caccgctgtcccaaaaggtctccatagctggtccagtcttccggacatgtcccctcaaagaactgcattgctgctgccaggtaggaacatacatcatcgggatctagtttggcggcattccatatcagcagccagggcct

SEQ ID NO: 441207 - DNA, 140 bp, Artificial Sequence
  Synthetic
atacgccatgctgggtctccctcttgagtctgtataggttgagcaagatatcaggacaaaacaccggtaactataaaacaaacattgcagataggatagagcagattttcgagacagccccgtacttgggagtcggccat

SEQ ID NO: 441208 - DNA, 140 bp, Artificial Sequence
  Synthetic
atggccgactcccaagtacggggctgtctcgaaaatctgctctatcctatctgcaatgtttgttttatagttaccggtgttttgtcctgatatcttgctcaacctatacagactcaagagggagacccagcatggcgtat

SEQ ID NO: 441209 - DNA, 140 bp, Artificial Sequence
  Synthetic
atacgccatgctgggtctccaacggttattgctgcatgtgccccgcatgagatgtctgttctcgggggttatcttggggaggagttttttggaaaggggacttttgagagaagattctttcgtacttgggagtcggccat

SEQ ID NO: 441210 - DNA, 140 bp, Artificial Sequence
  Synthetic
atggccgactcccaagtacgaaagaatcttctctcaaaagtcccctttccaaaaaactcctccccaagataacccccgagaacagacatctcatgcggggcacatgcagcaataaccgttggagacccagcatggcgtat

SEQ ID NO: 441211 - DNA, 140 bp, Artificial Sequence
  Synthetic
atacgccatgctgggtctcccttgaactgatctcaggagtgatttcatatatcctcttaagactggacaatcacccttctttgtacataatgctcagagagccctctcttagaggagagacgtacttgggagtcggccat

SEQ ID NO: 441212 - DNA, 140 bp, Artificial Sequence
  Synthetic
atggccgactcccaagtacgtctctcctctaagagagggctctctgagcattatgtacaaagaagggtgattgtccagtcttaagaggatatatgaaatcactcctgagatcagttcaagggagacccagcatggcgtat

SEQ ID NO: 441213 - DNA, 140 bp, Artificial Sequence
  Synthetic
atacgccatgctgggtctcccagagatgagaaagaacttcaagaatacgaggcggctgaactgacaaagactgacgtggcattggcagatgatggaactgtcaactctgacgatgaggaccgtacttgggagtcggccat

SEQ ID NO: 441214 - DNA, 140 bp, Artificial Sequence
  Synthetic
atggccgactcccaagtacggtcctcatcgtcagagttgacagttccatcatctgccaatgccacgtcagtctttgtcagttcagccgcctcgtattcttgaagttctttctcatctctgggagacccagcatggcgtat

SEQ ID NO: 441215 - DNA, 140 bp, Artificial Sequence
  Synthetic
atacgccatgctgggtctcctcagttctaatcatcaagcccgtccaaactcattcgctgagtttttaaacaaaacatattcgagtgactcataaggagctgaataacatggtgccgggaacgtacttgggagtcggccat

SEQ ID NO: 441216 - DNA, 140 bp, Artificial Sequence
  Synthetic
atggccgactcccaagtacgttcccggcaccatgttattcagctccttatgagtcactcgaatatgttttgtttaaaaactcagcgaatgagtttggacgggcttgatgattagaactgaggagacccagcatggcgtat

SEQ ID NO: 441217 - DNA, 140 bp, Artificial Sequence
  Synthetic
aggccctggctgctgatatgccggtctggcagatcttgaaatggctgaagagactgttgatctgatcaatagaaatatagaagacaatcaggctcatctccagggggagcctatagaagtgaccttttgggacagcggtg

SEQ ID NO: 441218 - DNA, 140 bp, Artificial Sequence
  Synthetic
caccgctgtcccaaaaggtcacttctataggctccccctggagatgagcctgattgtcttctatatttctattgatcagatcaacagtctcttcagccatttcaagatctgccagaccggcatatcagcagccagggcct

SEQ ID NO: 441219 - DNA, 140 bp, Artificial Sequence
  Synthetic
aggccctggctgctgatatgtacagtgaggggggttactctgccgtttgtccaaatcttctatctcacatctctgtcagcacagacacgatgtcggatttgactcatgatggaagaaactgaccttttgggacagcggtg

SEQ ID NO: 441220 - DNA, 140 bp, Artificial Sequence
  Synthetic
caccgctgtcccaaaaggtcagtttcttccatcatgagtcaaatccgacatcgtgtctgtgctgacagagatgtgagatagaagatttggacaaacggcagagtaacccccctcactgtacatatcagcagccagggcct

SEQ ID NO: 441221 - DNA, 140 bp, Artificial Sequence
  Synthetic
atacgccatgctgggtctccggacgaaagaggcttgtacaagtctctaaaaggagcatgcaaattgaagctatgtggagttcttggacttagacttatggacggaacatgggctgcaattcgtacttgggagtcggccat

SEQ ID NO: 441222 - DNA, 140 bp, Artificial Sequence
  Synthetic
atggccgactcccaagtacgaattgcagcccatgttccgtccataagtctaagtccaagaactccacatagcttcaatttgcatgctccttttagagacttgtacaagcctctttcgtccggagacccagcatggcgtat

SEQ ID NO: 441223 - DNA, 140 bp, Artificial Sequence
  Synthetic
aggccctggctgctgatatgacggtcaacttccccaacccctcaggaaggtcctcagaagacaaatcgacccaaaccactggtcgagaacccaagaaggagacaacatccactccctctcgaccttttgggacagcggtg

SEQ ID NO: 441224 - DNA, 140 bp, Artificial Sequence
  Synthetic
caccgctgtcccaaaaggtcgagagggagtggatgttgtctccttcttgggttctcgaccagtggtttgggtcgatttgtcttctgaggaccttcctgaggggttggggaagttgaccgtcatatcagcagccagggcct

SEQ ID NO: 441225 - DNA, 140 bp, Artificial Sequence
  Synthetic
atacgccatgctgggtctcccatagttaaagaggcaaaaaatgtaccgggcgtgacccgtctggcccatgatggatccaaaatccccctaagatgtgtactgggatgggtcgctttggcccgtacttgggagtcggccat

SEQ ID NO: 441226 - DNA, 140 bp, Artificial Sequence
  Synthetic
atggccgactcccaagtacgggccaaagcgacccatcccagtacacatcttagggggattttggatccatcatgggccagacgggtcacgcccggtacattttttgcctctttaactatgggagacccagcatggcgtat

SEQ ID NO: 441227 - DNA, 140 bp, Artificial Sequence
  Synthetic
atacgccatgctgggtctcccgtgacccgtttggcccatgacggatccaaactccccctaaggtgtgtactgggatgggtcgctctggccaattcaaagaaattccaattgttagtcgaacgtacttgggagtcggccat

SEQ ID NO: 441228 - DNA, 140 bp, Artificial Sequence
  Synthetic
atggccgactcccaagtacgttcgactaacaattggaatttctttgaattggccagagcgacccatcccagtacacaccttagggggagtttggatccgtcatgggccaaacgggtcacgggagacccagcatggcgtat

SEQ ID NO: 441229 - DNA, 140 bp, Artificial Sequence
  Synthetic
atacgccatgctgggtctccttaaagtgtgtagcccgaacggttactcattcaggatcctgcggcatattctgagatcattcgacgagatatactctgggaatcataggatgattgggttcgtacttgggagtcggccat

SEQ ID NO: 441230 - DNA, 140 bp, Artificial Sequence
  Synthetic
atggccgactcccaagtacgaacccaatcatcctatgattcccagagtatatctcgtcgaatgatctcagaatatgccgcaggatcctgaatgagtaaccgttcgggctacacactttaaggagacccagcatggcgtat

SEQ ID NO: 441231 - DNA, 140 bp, Artificial Sequence
  Synthetic
aggccctggctgctgatatgagactaatgttagaatggttgaaaacagggaatagaccttatcggatgactctgacagacaattgctccaggtcttacaaagttttgaaagattatttcagaccttttgggacagcggtg

SEQ ID NO: 441232 - DNA, 140 bp, Artificial Sequence
  Synthetic
caccgctgtcccaaaaggtctgaaataatctttcaaaactttgtaagacctggagcaattgtctgtcagagtcatccgataaggtctattccctgttttcaaccattctaacattagtctcatatcagcagccagggcct

SEQ ID NO: 441233 - DNA, 140 bp, Artificial Sequence
  Synthetic
atacgccatgctgggtctccgctccaaatctaacatgaaaaaaacaggcaacaccactgataaaatgaactttctgcgcaagatagtgaagaactgtagagatgagaaaactcaggagcccgtacttgggagtcggccat

SEQ ID NO: 441234 - DNA, 140 bp, Artificial Sequence
  Synthetic
atggccgactcccaagtacgggctcctgagttttctcatctctacagttcttcactatcttgcgcagaaagttcattttatcagtggtgttgcctgtttttttcatgttagatttggagcggagacccagcatggcgtat

SEQ ID NO: 441235 - DNA, 140 bp, Artificial Sequence
  Synthetic
atacgccatgctgggtctccagagcatgtcaactatggtctgacatgtctcttcagacacaaaggtctgaagaggacaaagactcttctctgcttctagaataatcagattatatcccgccgtacttgggagtcggccat

SEQ ID NO: 441236 - DNA, 140 bp, Artificial Sequence
  Synthetic
atggccgactcccaagtacggcgggatataatctgattattctagaagcagagaagagtctttgtcctcttcagacctttgtgtctgaagagacatgtcagaccatagttgacatgctctggagacccagcatggcgtat

SEQ ID NO: 441237 - DNA, 140 bp, Artificial Sequence
  Synthetic
atacgccatgctgggtctccactcaacatgtttccggatgccaggcttgtattcaatagcctattagaagtgaatgatctgatggcatcagggacacatccattacccccttcagcaatccgtacttgggagtcggccat

SEQ ID NO: 441238 - DNA, 140 bp, Artificial Sequence
  Synthetic
atggccgactcccaagtacggattgctgaagggggtaatggatgtgtccctgatgccatcagatcattcacttctaataggctattgaatacaagcctggcatccggaaacatgttgagtggagacccagcatggcgtat

SEQ ID NO: 441239 - DNA, 140 bp, Artificial Sequence
  Synthetic
atacgccatgctgggtctcccgctgcattttatcaaagtcaagttaattacctttacattttgagcctcttggatgtgaaaaaaactattaacatccctcaaaagacttaaggaaagatgcgtacttgggagtcggccat

SEQ ID NO: 441240 - DNA, 140 bp, Artificial Sequence
  Synthetic
atggccgactcccaagtacgcatctttccttaagtcttttgagggatgttaatagtttttttcacatccaagaggctcaaaatgtaaaggtaattaacttgactttgataaaatgcagcgggagacccagcatggcgtat

SEQ ID NO: 441241 - DNA, 140 bp, Artificial Sequence
  Synthetic
aggccctggctgctgatatgtttacattttgagcctcctggatgtgaaaaaaactattaacacccctcaaaagacttaaggaaagatggttcctcaggctcttttgtttataccccttttgaccttttgggacagcggtg

SEQ ID NO: 441242 - DNA, 140 bp, Artificial Sequence
  Synthetic
caccgctgtcccaaaaggtcaaaaggggtataaacaaaagagcctgaggaaccatctttccttaagtcttttgaggggtgttaatagtttttttcacatccaggaggctcaaaatgtaaacatatcagcagccagggcct

SEQ ID NO: 441243 - DNA, 140 bp, Artificial Sequence
  Synthetic
atacgccatgctgggtctcccgggaagttccccatttacacgataccagacaaacttggtccctggagccctattgacatacaccatctcagctgtccaaataacctggttgtggaggaccgtacttgggagtcggccat

SEQ ID NO: 441244 - DNA, 140 bp, Artificial Sequence
  Synthetic
atggccgactcccaagtacggtcctccacaaccaggttatttggacagctgagatggtgtatgtcaatagggctccagggaccaagtttgtctggtatcgtgtaaatggggaacttcccgggagacccagcatggcgtat

SEQ ID NO: 441245 - DNA, 140 bp, Artificial Sequence
  Synthetic
atacgccatgctgggtctccctggaagatggccggtgaccccagatatgaagagtctctacacaatccgtaccccgactaccattggcttcgaactgtaaaaaccaccaaagagtctctccgtacttgggagtcggccat

SEQ ID NO: 441246 - DNA, 140 bp, Artificial Sequence
  Synthetic
atggccgactcccaagtacggagagactctttggtggtttttacagttcgaagccaatggtagtcggggtacggattgtgtagagactcttcatatctggggtcaccggccatcttccagggagacccagcatggcgtat

SEQ ID NO: 441247 - DNA, 140 bp, Artificial Sequence
  Synthetic
aggccctggctgctgatatgcccatatgacaaatctcttcactcgaggatcttccctagcgggaagtgctcaggaataacggtgtcttctacctactgctcaactaaccacgattacaccgaccttttgggacagcggtg

SEQ ID NO: 441248 - DNA, 140 bp, Artificial Sequence
  Synthetic
caccgctgtcccaaaaggtcggtgtaatcgtggttagttgagcagtaggtagaagacaccgttattcctgagcacttcccgctagggaagatcctcgagtgaagagatttgtcatatgggcatatcagcagccagggcct

SEQ ID NO: 441249 - DNA, 140 bp, Artificial Sequence
  Synthetic
aggccctggctgctgatatggcattatggaaagatataacctcagtggacaccgagaaggacttggtcaaattcaaagatcacatatggggactgttgattgtgacaaaggactttgtttgaccttttgggacagcggtg

SEQ ID NO: 441250 - DNA, 140 bp, Artificial Sequence
  Synthetic
caccgctgtcccaaaaggtcaaacaaagtcctttgtcacaatcaacagtccccatatgtgatctttgaatttgaccaagtccttctcggtgtccactgaggttatatctttccataatgccatatcagcagccagggcct

SEQ ID NO: 441251 - DNA, 140 bp, Artificial Sequence
  Synthetic
atacgccatgctgggtctcctgccagatgaggacttgataattggcctcaagcctaaggaacgagaattgaagattgagggtcgattctttgctctaatgtcatggaatctaagattgtacgtacttgggagtcggccat

SEQ ID NO: 441252 - DNA, 140 bp, Artificial Sequence
  Synthetic
atggccgactcccaagtacgtacaatcttagattccatgacattagagcaaagaatcgaccctcaatcttcaattctcgttccttaggcttgaggccaattatcaagtcctcatctggcaggagacccagcatggcgtat

SEQ ID NO: 441253 - DNA, 140 bp, Artificial Sequence
  Synthetic
atacgccatgctgggtctccgcctctgatagaatgtgcagactgagacttccggacggtgaaccctgaaaaaaactggatcagaattccgaacctctgtcggcttgattgtttttccatccgtacttgggagtcggccat

SEQ ID NO: 441254 - DNA, 140 bp, Artificial Sequence
  Synthetic
atggccgactcccaagtacggatggaaaaacaatcaagccgacagaggttcggaattctgatccagtttttttcagggttcaccgtccggaagtctcagtctgcacattctatcagaggcggagacccagcatggcgtat

SEQ ID NO: 441255 - DNA, 140 bp, Artificial Sequence
  Synthetic
aggccctggctgctgatatggtacaaataccctgctatcagggatttgaaaaaaccctgtataaccttagggaaagcccctgacttaaacaaagcatacaagtcagttttatcaggcatggaccttttgggacagcggtg

SEQ ID NO: 441256 - DNA, 140 bp, Artificial Sequence
  Synthetic
caccgctgtcccaaaaggtccatgcctgataaaactgacttgtatgctttgtttaagtcaggggctttccctaaggttatacagggttttttcaaatccctgatagcagggtatttgtaccatatcagcagccagggcct

SEQ ID NO: 441257 - DNA, 140 bp, Artificial Sequence
  Synthetic
aggccctggctgctgatatggtctcaggggttgacctgggtctcccgaactgggggaaatatgtattactgagtgcagggaccctgattgccttgatgttgataatttttctaatgacgtgaccttttgggacagcggtg

SEQ ID NO: 441258 - DNA, 140 bp, Artificial Sequence
  Synthetic
caccgctgtcccaaaaggtcacgtcattagaaaaattatcaacatcaaggcaatcagggtccctgcactcagtaatacatatttcccccagttcgggagacccaggtcaacccctgagaccatatcagcagccagggcct

SEQ ID NO: 441259 - DNA, 140 bp, Artificial Sequence
  Synthetic
aggccctggctgctgatatggcagggaggagggtgtcggtcacttcccagagcgggaaggtcatatcttcatgggagtcatataaaagtgggggtgagactagattgtaaaagctggtcagaccttttgggacagcggtg

SEQ ID NO: 441260 - DNA, 140 bp, Artificial Sequence
  Synthetic
caccgctgtcccaaaaggtctgaccagcttttacaatctagtctcacccccacttttatatgactcccatgaagatatgaccttcccgctctgggaagtgaccgacaccctcctccctgccatatcagcagccagggcct

SEQ ID NO: 441261 - DNA, 140 bp, Artificial Sequence
  Synthetic
aggccctggctgctgatatgtgatttcgcattgtctatagatggaccactttgtctggttttcaaaacttacgggactatgctagtaaacccagactataaagctattcaacacctgtcagaccttttgggacagcggtg

SEQ ID NO: 441262 - DNA, 140 bp, Artificial Sequence
  Synthetic
caccgctgtcccaaaaggtctgacaggtgttgaatagctttatagtctgggtttactagcatagtcccgtaagttttgaaaaccagacaaagtggtccatctatagacaatgcgaaatcacatatcagcagccagggcct

SEQ ID NO: 441263 - DNA, 140 bp, Artificial Sequence
  Synthetic
aggccctggctgctgatatggacatgtttttctcccggattgagcatctgtattcagcaatcagagtgggcacagtcgtcactgcttatgaggactgctcggggctggtatcgtttacaggaccttttgggacagcggtg

SEQ ID NO: 441264 - DNA, 140 bp, Artificial Sequence
  Synthetic
caccgctgtcccaaaaggtcctgtaaacgataccagccccgagcagtcctcataagcagtgacgactgtgcccactctgattgctgaatacagatgctcaatccgggagaaaaacatgtccatatcagcagccagggcct

SEQ ID NO: 441265 - DNA, 140 bp, Artificial Sequence
  Synthetic
aggccctggctgctgatatgatagttcacaatcatcttgcatctcagtgaagtgtacataactataaagggctgggtcatctaagcatttcagtcgagaaaaaaactgtagaccaaaagagaccttttgggacagcggtg

SEQ ID NO: 441266 - DNA, 140 bp, Artificial Sequence
  Synthetic
caccgctgtcccaaaaggtctcttttggtctacagtttttttctcgactgaaatgcttagatgacccagccctttatagttatgtacacttcactgagatgcaagatgattgtgaactatcatatcagcagccagggcct

SEQ ID NO: 441267 - DNA, 140 bp, Artificial Sequence
  Synthetic
aggccctggctgctgatatgaacggtaattactgcctgcgctcctcatgagatgtctgttctagggggctacctgggagaggaattcttcggaaaagggacctttgaaagaagattctttgaccttttgggacagcggtg

SEQ ID NO: 441268 - DNA, 140 bp, Artificial Sequence
  Synthetic
caccgctgtcccaaaaggtcaaagaatcttctttcaaaggtcccttttccgaagaattcctctcccaggtagccccctagaacagacatctcatgaggagcgcaggcagtaattaccgttcatatcagcagccagggcct

SEQ ID NO: 441269 - DNA, 140 bp, Artificial Sequence
  Synthetic
aggccctggctgctgatatgggtcttacaaagttttgaaagattatttcaagaaagtagatttgggttctctcaaagtgggaggaactgctgcacaatcaatgatttctctctggttgtagaccttttgggacagcggtg

SEQ ID NO: 441270 - DNA, 140 bp, Artificial Sequence
  Synthetic
caccgctgtcccaaaaggtctacaaccagagagaaatcattgattgtgcagcagttcctcccactttgagagaacccaaatctactttcttgaaataatctttcaaaactttgtaagacccatatcagcagccagggcct

SEQ ID NO: 441271 - DNA, 140 bp, Artificial Sequence
  Synthetic
aggccctggctgctgatatggaagctgttgaattgtacactcggaaatagagggctgagaatccccccagagggggtgttaagttgccttgagagggtcgattatgataaagcgtttggggaccttttgggacagcggtg

SEQ ID NO: 441272 - DNA, 140 bp, Artificial Sequence
  Synthetic
caccgctgtcccaaaaggtccccaaacgctttatcataatcgaccctctcaaggcaacttaacaccccctctggggggattctcagccctctatttccgagtgtacaattcaacagcttccatatcagcagccagggcct

SEQ ID NO: 441273 - DNA, 140 bp, Artificial Sequence
  Synthetic
aggccctggctgctgatatggggtttgggaaggcatacaccatattcaacaagaccttaatggaagctgatgctcattacaagtcagtcaagacttggaacgaggtcatcccttcgaaaggaccttttgggacagcggtg

SEQ ID NO: 441274 - DNA, 140 bp, Artificial Sequence
  Synthetic
caccgctgtcccaaaaggtcctttcgaagggatgacctcgttccaagtcttgactgacttgtaatgagcatcagcttccattaaggtcttgttgaatatggtgtatgccttcccaaaccccatatcagcagccagggcct

SEQ ID NO: 441275 - DNA, 140 bp, Artificial Sequence
  Synthetic
aggccctggctgctgatatgggataatctccctgaggacatgaggcagcttcacttagacgatagacaatcatccaaccttggtgagatggccaaggtgggggaaagcaaatatcgagaggaccttttgggacagcggtg

SEQ ID NO: 441276 - DNA, 140 bp, Artificial Sequence
  Synthetic
caccgctgtcccaaaaggtcctctcgatatttgctttcccccaccttggccatctcaccaaggttggatgattgtctatcgtctaagtgaagctgcctcatgtcctcagggagattatcccatatcagcagccagggcct

SEQ ID NO: 441277 - DNA, 140 bp, Artificial Sequence
  Synthetic
aggccctggctgctgatatgatcttttcttgtctcgcttcaactctttgatgatcctgctttctcccccagagccccgatactcagatgacttgatatctcagctgtgtcagctatacatgaccttttgggacagcggtg

SEQ ID NO: 441278 - DNA, 140 bp, Artificial Sequence
  Synthetic
caccgctgtcccaaaaggtcatgtatagctgacacagctgagatatcaagtcatctgagtatcggggctctgggggagaaagcaggatcatcaaagagttgaagcgagacaagaaaagatcatatcagcagccagggcct

SEQ ID NO: 441279 - DNA, 140 bp, Artificial Sequence
  Synthetic
atacgccatgctgggtctcctgtgggaactccggctatgaagtcatcaaaatattggagccatatgtcgtgaacagtttggtccagagggcagagaagtttaggcctctcatccactcctcgtacttgggagtcggccat

SEQ ID NO: 441280 - DNA, 140 bp, Artificial Sequence
  Synthetic
atggccgactcccaagtacgaggagtggatgagaggcctaaacttctctgccctctggaccaaactgttcacgacatatggctccaatattttgatgacttcatagccggagttcccacaggagacccagcatggcgtat

SEQ ID NO: 441281 - DNA, 140 bp, Artificial Sequence
  Synthetic
aggccctggctgctgatatggattcctcaagatatggtcacagactgtagaggagattatatcctatgtcacggtcaacttccccaaccctccaggaaggtcttcggaggataaatcgacgaccttttgggacagcggtg

SEQ ID NO: 441282 - DNA, 140 bp, Artificial Sequence
  Synthetic
caccgctgtcccaaaaggtcgtcgatttatcctccgaagaccttcctggagggttggggaagttgaccgtgacataggatataatctcctctacagtctgtgaccatatcttgaggaatccatatcagcagccagggcct

SEQ ID NO: 441283 - DNA, 140 bp, Artificial Sequence
  Synthetic
atacgccatgctgggtctccacggtcaacttccccaaccctccaggaaggtcttcggaggataaatcgacccagactactggccgagaggccaagaaggaggcaacatccactccttctccgtacttgggagtcggccat

SEQ ID NO: 441284 - DNA, 140 bp, Artificial Sequence
  Synthetic
atggccgactcccaagtacggagaaggagtggatgttgcctccttcttggcctctcggccagtagtctgggtcgatttatcctccgaagaccttcctggagggttggggaagttgaccgtggagacccagcatggcgtat

SEQ ID NO: 441285 - DNA, 140 bp, Artificial Sequence
  Synthetic
aggccctggctgctgatatgagaccatcctttaactccttatatcaaaacccaaacatggccacccaaacatgtggtagatctggtaggggatacatggcacaagctcccgatcacgcaagaccttttgggacagcggtg

SEQ ID NO: 441286 - DNA, 140 bp, Artificial Sequence
  Synthetic
caccgctgtcccaaaaggtcttgcgtgatcgggagcttgtgccatgtatcccctaccagatctaccacatgtttgggtggccatgtttgggttttgatataaggagttaaaggatggtctcatatcagcagccagggcct

SEQ ID NO: 441287 - DNA, 140 bp, Artificial Sequence
  Synthetic
atacgccatgctgggtctcccccgataaactgagtaaaatcatgcaagacgatttgaatcgctatgcatcctgctaacctaacttataaactcagttcctccagacaataaaatctgagacgtacttgggagtcggccat

SEQ ID NO: 441288 - DNA, 140 bp, Artificial Sequence
  Synthetic
atggccgactcccaagtacgtctcagattttattgtctggaggaactgagtttataagttaggttagcaggatgcatagcgattcaaatcgtcttgcatgattttactcagtttatcgggggagacccagcatggcgtat

SEQ ID NO: 441289 - DNA, 140 bp, Artificial Sequence
  Synthetic
aggccctggctgctgatatgcctctcccgtgtcggcccctccagatgacgacgacctgtggcttccgccccctgaatatgtcccgctgaaagaactcactagcaagaaaaacatgagaaagaccttttgggacagcggtg

SEQ ID NO: 441290 - DNA, 140 bp, Artificial Sequence
  Synthetic
caccgctgtcccaaaaggtctttctcatgtttttcttgctagtgagttctttcagcgggacatattcagggggcggaagccacaggtcgtcgtcatctggaggggccgacacgggagaggcatatcagcagccagggcct

SEQ ID NO: 441291 - DNA, 140 bp, Artificial Sequence
  Synthetic
atacgccatgctgggtctccagaggtaatcacggcgtctccagagaatgactggctgtggatcttctcagactttagaagtgctaaaatgacgtacctgaccctcattacttaccagtctcgtacttgggagtcggccat

SEQ ID NO: 441292 - DNA, 140 bp, Artificial Sequence
  Synthetic
atggccgactcccaagtacgagactggtaagtaatgagggtcaggtacgtcattttagcacttctaaagtctgagaagatccacagccagtcattctctggagacgccgtgattacctctggagacccagcatggcgtat

SEQ ID NO: 441293 - DNA, 140 bp, Artificial Sequence
  Synthetic
aggccctggctgctgatatgtgatgatgtatgctcctacttggcagcagcaatgcagttctttgaggggacatgtccggaagactggaccagctatggaatcctgattgcacgaaaaggagaccttttgggacagcggtg

SEQ ID NO: 441294 - DNA, 140 bp, Artificial Sequence
  Synthetic
caccgctgtcccaaaaggtctccttttcgtgcaatcaggattccatagctggtccagtcttccggacatgtcccctcaaagaactgcattgctgctgccaagtaggagcatacatcatcacatatcagcagccagggcct

SEQ ID NO: 441295 - DNA, 140 bp, Artificial Sequence
  Synthetic
aggccctggctgctgatatgacagggtcactgggcaagggcttttggactattctagggtcacatatgcatttcacctggactatgagaagtggaacaatcatcaaaggttggagtcaacgaccttttgggacagcggtg

SEQ ID NO: 441296 - DNA, 140 bp, Artificial Sequence
  Synthetic
caccgctgtcccaaaaggtcgttgactccaacctttgatgattgttccacttctcatagtccaggtgaaatgcatatgtgaccctagaatagtccaaaagcccttgcccagtgaccctgtcatatcagcagccagggcct

SEQ ID NO: 441297 - DNA, 140 bp, Artificial Sequence
  Synthetic
aggccctggctgctgatatgagaggatgtgttctccgtcctggatcaggtgtttggattgaagagggtgttttctagaacacatgagtttttccagaagtcttggatctattattcagacgaccttttgggacagcggtg

SEQ ID NO: 441298 - DNA, 140 bp, Artificial Sequence
  Synthetic
caccgctgtcccaaaaggtcgtctgaataatagatccaagacttctggaaaaactcatgtgttctagaaaacaccctcttcaatccaaacacctgatccaggacggagaacacatcctctcatatcagcagccagggcct

SEQ ID NO: 441299 - DNA, 140 bp, Artificial Sequence
  Synthetic
atacgccatgctgggtctcctttctagaacacatgagtttttccagaagtcttggatctattattcagacagatcagacctcatcgggttatgggaggatcaaatatactgcttggatatcgtacttgggagtcggccat

SEQ ID NO: 441300 - DNA, 140 bp, Artificial Sequence
  Synthetic
atggccgactcccaagtacgatatccaagcagtatatttgatcctcccataacccgatgaggtctgatctgtctgaataatagatccaagacttctggaaaaactcatgtgttctagaaaggagacccagcatggcgtat

SEQ ID NO: 441301 - DNA, 140 bp, Artificial Sequence
  Synthetic
aggccctggctgctgatatgcgctggggatcaagtcttgtccatgtgtgggaactccggatatgaagtcatcaaaatcttggagccatatgtcgtgaacagtttagtccagagagcagaagaccttttgggacagcggtg

SEQ ID NO: 441302 - DNA, 140 bp, Artificial Sequence
  Synthetic
caccgctgtcccaaaaggtcttctgctctctggactaaactgttcacgacatatggctccaagattttgatgacttcatatccggagttcccacacatggacaagacttgatccccagcgcatatcagcagccagggcct

SEQ ID NO: 441303 - DNA, 140 bp, Artificial Sequence
  Synthetic
aggccctggctgctgatatggttatggtgccattaatccgccgtattttatcaaagtcaagttgattacctttacattttgagcctcttgggtgtgaaaaaaactattaacatccctcaagaccttttgggacagcggtg

SEQ ID NO: 441304 - DNA, 140 bp, Artificial Sequence
  Synthetic
caccgctgtcccaaaaggtcttgagggatgttaatagtttttttcacacccaagaggctcaaaatgtaaaggtaatcaacttgactttgataaaatacggcggattaatggcaccataaccatatcagcagccagggcct

SEQ ID NO: 441305 - DNA, 140 bp, Artificial Sequence
  Synthetic
aggccctggctgctgatatggaggtaacatattggtgcctgaatccaaaagatgggccagagtctcttgcatctctaacgaccaaatagtcaacctcgccaatataatgtcgacagtgtcgaccttttgggacagcggtg

SEQ ID NO: 441306 - DNA, 140 bp, Artificial Sequence
  Synthetic
caccgctgtcccaaaaggtcgacactgtcgacattatattggcgaggttgactatttggtcgttagagatgcaagagactctggcccatcttttggattcaggcaccaatatgttacctccatatcagcagccagggcct

SEQ ID NO: 441307 - DNA, 140 bp, Artificial Sequence
  Synthetic
atacgccatgctgggtctccatttggttgtggaggacgaaggatgcaccaacctgtcagggttctcctacatggaacttaaagtgggatacatctcagccataaaagtgaacggattcaccgtacttgggagtcggccat

SEQ ID NO: 441308 - DNA, 140 bp, Artificial Sequence
  Synthetic
atggccgactcccaagtacggtgaatccgttcacttttatggctgagatgtatcccactttaagttccatgtaggagaaccctgacaggttggtgcatccttcgtcctccacaaccaaatggagacccagcatggcgtat

SEQ ID NO: 441309 - DNA, 140 bp, Artificial Sequence
  Synthetic
aggccctggctgctgatatgcaccaatgcgctaacagtggcacaacactctcaatctctgatcaagcctatgagggattttctgctcatgtcagtacaggcagtcttccactacttgttagaccttttgggacagcggtg

SEQ ID NO: 441310 - DNA, 140 bp, Artificial Sequence
  Synthetic
caccgctgtcccaaaaggtctaacaagtagtggaagactgcctgtactgacatgagcagaaaatccctcataggcttgatcagagattgagagtgttgtgccactgttagcgcattggtgcatatcagcagccagggcct

SEQ ID NO: 441311 - DNA, 140 bp, Artificial Sequence
  Synthetic
aggccctggctgctgatatgccggtctggccgatcttgagatggctgaagagactgttgatctaatcaatagaaacatagaggataatcaggctcatcttcagggagaacccatagaagtgaccttttgggacagcggtg

SEQ ID NO: 441312 - DNA, 140 bp, Artificial Sequence
  Synthetic
caccgctgtcccaaaaggtcacttctatgggttctccctgaagatgagcctgattatcctctatgtttctattgattagatcaacagtctcttcagccatctcaagatcggccagaccggcatatcagcagccagggcct

SEQ ID NO: 441313 - DNA, 140 bp, Artificial Sequence
  Synthetic
aggccctggctgctgatatgtttagcccgatcttaaagggcagagtttacaagattttgaacgcagaaggggagagctttctcctggccatgtcgaggataatctatctagacccttcttgaccttttgggacagcggtg

SEQ ID NO: 441314 - DNA, 140 bp, Artificial Sequence
  Synthetic
caccgctgtcccaaaaggtcaagaagggtctagatagattatcctcgacatggccaggagaaagctctccccttctgcgttcaaaatcttgtaaactctgccctttaagatcgggctaaacatatcagcagccagggcct

SEQ ID NO: 441315 - DNA, 140 bp, Artificial Sequence
  Synthetic
aggccctggctgctgatatgtgcagagccgcgtataactggaagatggcaggcgaccccagatatgaggagtctctacacaatccgtatcccgactaccattggcttcggactgtgaaaagaccttttgggacagcggtg

SEQ ID NO: 441316 - DNA, 140 bp, Artificial Sequence
  Synthetic
caccgctgtcccaaaaggtcttttcacagtccgaagccaatggtagtcgggatacggattgtgtagagactcctcatatctggggtcgcctgccatcttccagttatacgcggctctgcacatatcagcagccagggcct

SEQ ID NO: 441317 - DNA, 140 bp, Artificial Sequence
  Synthetic
aggccctggctgctgatatgacacatagtagatttggtgggggacacatggcataagctccctatcacccagatcttcgaaatccctgaatcaatggacccatctgagatactagatgatgaccttttgggacagcggtg

SEQ ID NO: 441318 - DNA, 140 bp, Artificial Sequence
  Synthetic
caccgctgtcccaaaaggtcatcatctagtatctcagatgggtccattgattcagggatttcgaagatctgggtgatagggagcttatgccatgtgtcccccaccaaatctactatgtgtcatatcagcagccagggcct

SEQ ID NO: 441319 - DNA, 140 bp, Artificial Sequence
  Synthetic
aggccctggctgctgatatgaggaataacggtatcctccacctactgctcaactaaccatgattacaccatttggatgcccgagaatccgagactaggaacatcttgtgatatctttaccgaccttttgggacagcggtg

SEQ ID NO: 441320 - DNA, 140 bp, Artificial Sequence
  Synthetic
caccgctgtcccaaaaggtcggtaaagatatcacaagatgttcctagtctcggattctcgggcatccaaatggtgtaatcatggttagttgagcagtaggtggaggataccgttattcctcatatcagcagccagggcct

SEQ ID NO: 441321 - DNA, 140 bp, Artificial Sequence
  Synthetic
atacgccatgctgggtctccagtttcgagaggcaatcctgttgtctaagacccatagagataactttatactctttttaaaatctgttgagcctctgtttcctcgatttctcagtgagctcgtacttgggagtcggccat

SEQ ID NO: 441322 - DNA, 140 bp, Artificial Sequence
  Synthetic
atggccgactcccaagtacgagctcactgagaaatcgaggaaacagaggctcaacagattttaaaaagagtataaagttatctctatgggtcttagacaacaggattgcctctcgaaactggagacccagcatggcgtat

SEQ ID NO: 441323 - DNA, 140 bp, Artificial Sequence
  Synthetic
aggccctggctgctgatatgattgaatcagaggtcgagcccaaagggaactccaccatccctaacattttacgaaattccgactacaatctcaactcccctttaatcgaagatccagctagaccttttgggacagcggtg

SEQ ID NO: 441324 - DNA, 140 bp, Artificial Sequence
  Synthetic
caccgctgtcccaaaaggtctagctggatcttcgattaaaggggagttgagattgtagtcggaatttcgtaaaatgttagggatggtggagttccctttgggctcgacctctgattcaatcatatcagcagccagggcct

SEQ ID NO: 441325 - DNA, 140 bp, Artificial Sequence
  Synthetic
aggccctggctgctgatatgacgggattaatcggatgacccagacacctcaaagggtcgggagagtgtggccttgctcttcagagagggcagatctacttagggagatctcttggggaaggaccttttgggacagcggtg

SEQ ID NO: 441326 - DNA, 140 bp, Artificial Sequence
  Synthetic
caccgctgtcccaaaaggtccttccccaagagatctccctaagtagatctgccctctctgaagagcaaggccacactctcccgaccctttgaggtgtctgggtcatccgattaatcccgtcatatcagcagccagggcct

SEQ ID NO: 441327 - DNA, 140 bp, Artificial Sequence
  Synthetic
aggccctggctgctgatatgtcaagaaaagagaagagtgtttggatgcattagagtccatcgtgaccaccaaatcagtgagtttcagacgtctcagtcacttaagaaaacttgtccctgggaccttttgggacagcggtg

SEQ ID NO: 441328 - DNA, 140 bp, Artificial Sequence
  Synthetic
caccgctgtcccaaaaggtcccagggacaagttttcttaagtgactgagacgtctgaaactcactgatttggtggtcacgatggactctaatgcatccaaacactcttctcttttcttgacatatcagcagccagggcct

SEQ ID NO: 441329 - DNA, 140 bp, Artificial Sequence
  Synthetic
aggccctggctgctgatatgttgcacttgtggaacaacaggaggaagcaatccaagagtttctgtatcagtgctcccatctttcgatcagtcatttttttcacgaggtcccctaaagggagaccttttgggacagcggtg

SEQ ID NO: 441330 - DNA, 140 bp, Artificial Sequence
  Synthetic
caccgctgtcccaaaaggtctccctttaggggacctcgtgaaaaaaatgactgatcgaaagatgggagcactgatacagaaactcttggattgcttcctcctgttgttccacaagtgcaacatatcagcagccagggcct

SEQ ID NO: 441331 - DNA, 140 bp, Artificial Sequence
  Synthetic
aggccctggctgctgatatgctataaactggttcattactagaaactctaacttggctcaaactctgattaggaacattatgtctctgacaggccctgacttccctctagaggaggccccgaccttttgggacagcggtg

SEQ ID NO: 441332 - DNA, 140 bp, Artificial Sequence
  Synthetic
caccgctgtcccaaaaggtcggggcctcctctagagggaagtcagggcctgtcagagacataatgttcctaatcagagtttgagccaagttagagtttctagtaatgaaccagtttatagcatatcagcagccagggcct

SEQ ID NO: 441333 - DNA, 140 bp, Artificial Sequence
  Synthetic
aggccctggctgctgatatgatggaactgaaggtggggtacatctctgccataaaggtgaatgggttcacttgtactggtgtcgtgacagaagccgagacctacaccaactttgttggttgaccttttgggacagcggtg

SEQ ID NO: 441334 - DNA, 140 bp, Artificial Sequence
  Synthetic
caccgctgtcccaaaaggtcaaccaacaaagttggtgtaggtctcggcttctgtcacgacaccagtacaagtgaacccattcacctttatggcagagatgtaccccaccttcagttccatcatatcagcagccagggcct

SEQ ID NO: 441335 - DNA, 140 bp, Artificial Sequence
  Synthetic
aggccctggctgctgatatgtctgttagtacagacactatgtctgatttgactcaagacgggaagaactacgatttcatgttccagccattgatgctttatgcgcagacatggacatcaggaccttttgggacagcggtg

SEQ ID NO: 441336 - DNA, 140 bp, Artificial Sequence
  Synthetic
caccgctgtcccaaaaggtcctgatgtccatgtctgcgcataaagcatcaatggctggaacatgaaatcgtagttcttcccgtcttgagtcaaatcagacatagtgtctgtactaacagacatatcagcagccagggcct

SEQ ID NO: 441337 - DNA, 140 bp, Artificial Sequence
  Synthetic
atacgccatgctgggtctcccctctctcgcatcggcccccccagatgatgatgatctgtggttgccccctccagaatatgtcccattgagggagctcacagggaagaagaatatgagaaacgtacttgggagtcggccat

SEQ ID NO: 441338 - DNA, 140 bp, Artificial Sequence
  Synthetic
atggccgactcccaagtacgtttctcatattcttcttccctgtgagctccctcaatgggacatattctggagggggcaaccacagatcatcatcatctgggggggccgatgcgagagaggggagacccagcatggcgtat

SEQ ID NO: 441339 - DNA, 140 bp, Artificial Sequence
  Synthetic
aggccctggctgctgatatgttctcagatcttcgagttcccagatgtgtcaaaaagaatttctagaatggtttctggtgccgtacctcatttccagaagcttcctgatatccgtctaaaagaccttttgggacagcggtg

SEQ ID NO: 441340 - DNA, 140 bp, Artificial Sequence
  Synthetic
caccgctgtcccaaaaggtcttttagacggatatcaggaagcttctggaaatgaggtacggcaccagaaaccattctagaaattctttttgacacatctgggaactcgaagatctgagaacatatcagcagccagggcct

SEQ ID NO: 441341 - DNA, 140 bp, Artificial Sequence
  Synthetic
aggccctggctgctgatatggtctcctgataacggacccaacaggagtgaactgagaattgcaatctgcctcccatgaaggacataagcaatagctcataatcatcctgcatctctgcgagaccttttgggacagcggtg

SEQ ID NO: 441342 - DNA, 140 bp, Artificial Sequence
  Synthetic
caccgctgtcccaaaaggtctcgcagagatgcaggatgattatgagctattgcttatgtccttcatgggaggcagattgcaattctcagttcactcctgttgggtccgttatcaggagaccatatcagcagccagggcct

SEQ ID NO: 441343 - DNA, 140 bp, Artificial Sequence
  Synthetic
atacgccatgctgggtctcccctgaggctggataatcatccctctctgtatataatgcttagagaaccgtctcttagaggagagatattctctatccctcagaaaatccccgccgcttaccgtacttgggagtcggccat

SEQ ID NO: 441344 - DNA, 140 bp, Artificial Sequence
  Synthetic
atggccgactcccaagtacggtaagcggcggggattttctgagggatagagaatatctctcctctaagagacggttctctaagcattatatacagagagggatgattatccagcctcaggggagacccagcatggcgtat

SEQ ID NO: 441345 - DNA, 140 bp, Artificial Sequence
  Synthetic
aggccctggctgctgatatgtgaggaactcagactacaatcttaactcccctttgatagaggatcctgccagactaatgttagaatgggtgaaaacaggaaatagaccttatcgaatgacgaccttttgggacagcggtg

SEQ ID NO: 441346 - DNA, 140 bp, Artificial Sequence
  Synthetic
caccgctgtcccaaaaggtcgtcattcgataaggtctatttcctgttttcacccattctaacattagtctggcaggatcctctatcaaaggggagttaagattgtagtctgagttcctcacatatcagcagccagggcct

SEQ ID NO: 441347 - DNA, 140 bp, Artificial Sequence
  Synthetic
aggccctggctgctgatatgctttagaagtgccaaaatgacgtacctgaccctcattacttatcagtctcatctcctactccagagggttgagagaaacttgtctaagggtatgagagctgaccttttgggacagcggtg

SEQ ID NO: 441348 - DNA, 140 bp, Artificial Sequence
  Synthetic
caccgctgtcccaaaaggtcagctctcatacccttagacaagtttctctcaaccctctggagtaggagatgagactgataagtaatgagggtcaggtacgtcattttggcacttctaaagcatatcagcagccagggcct

SEQ ID NO: 441349 - DNA, 140 bp, Artificial Sequence
  Synthetic
aggccctggctgctgatatgatgatttctctctggttatacggtgcccactctgaatcaaacaggagccggagatgcatgaatgatctggcccatttctattctaaatcatcccccataggaccttttgggacagcggtg

SEQ ID NO: 441350 - DNA, 140 bp, Artificial Sequence
  Synthetic
caccgctgtcccaaaaggtcctatgggggatgatttagaatagaaatgggccagatcattcatgcatctccggctcctgtttgattcagagtgggcaccgtataaccagagagaaatcatcatatcagcagccagggcct

SEQ ID NO: 441351 - DNA, 140 bp, Artificial Sequence
  Synthetic
atacgccatgctgggtctccgagatgcatgaatgatctggcccatttctattctaaatcatcccccatagagaagctgttaaattgcacgctagggaatagagggctgagaatacccccacgtacttgggagtcggccat

SEQ ID NO: 441352 - DNA, 140 bp, Artificial Sequence
  Synthetic
atggccgactcccaagtacgtgggggtattctcagccctctattccctagcgtgcaatttaacagcttctctatgggggatgatttagaatagaaatgggccagatcattcatgcatctcggagacccagcatggcgtat

SEQ ID NO: 441353 - DNA, 140 bp, Artificial Sequence
  Synthetic
aggccctggctgctgatatgccctatacatgaacgccctagactgggatgaagagaaaaccatcctagcactatggaaagacttaacctcagtggatattgggaaggacttagtcaagttgaccttttgggacagcggtg

SEQ ID NO: 441354 - DNA, 140 bp, Artificial Sequence
  Synthetic
caccgctgtcccaaaaggtcaacttgactaagtccttcccaatatccactgaggttaagtctttccatagtgctaggatggttttctcttcatcccagtctagggcgttcatgtatagggcatatcagcagccagggcct

SEQ ID NO: 441355 - DNA, 140 bp, Artificial Sequence
  Synthetic
atacgccatgctgggtctccctatggaaagacttaacctcagtggatattgggaaggacttagtcaagttcaaagatcaaatatggggattgctgattgtgactaaggactttgtttactcgtacttgggagtcggccat

SEQ ID NO: 441356 - DNA, 140 bp, Artificial Sequence
  Synthetic
atggccgactcccaagtacgagtaaacaaagtccttagtcacaatcagcaatccccatatttgatctttgaacttgactaagtccttcccaatatccactgaggttaagtctttccatagggagacccagcatggcgtat

SEQ ID NO: 441357 - DNA, 140 bp, Artificial Sequence
  Synthetic
aggccctggctgctgatatgctcagagctccaattgtctttttgacagaaactacacacttatgctcaaggatcttttcttgtctcgcttcaactccttaatgatattgcttgctcccccgaccttttgggacagcggtg

SEQ ID NO: 441358 - DNA, 140 bp, Artificial Sequence
  Synthetic
caccgctgtcccaaaaggtcgggggagcaagcaatatcattaaggagttgaagcgagacaagaaaagatccttgagcataagtgtgtagtttctgtcaaaaagacaattggagctctgagcatatcagcagccagggcct

SEQ ID NO: 441359 - DNA, 140 bp, Artificial Sequence
  Synthetic
atacgccatgctgggtctccaatcaaagaatgattgggttagtcaaagttgttgtcggattggccttgtctggagccccagtccccgagggcatgaactgggtttataaactaaggagaacgtacttgggagtcggccat

SEQ ID NO: 441360 - DNA, 140 bp, Artificial Sequence
  Synthetic
atggccgactcccaagtacgttctccttagtttataaacccagttcatgccctcggggactggggctccagacaaggccaatccgacaacaactttgactaacccaatcattctttgattggagacccagcatggcgtat

SEQ ID NO: 441361 - DNA, 140 bp, Artificial Sequence
  Synthetic
aggccctggctgctgatatgatcaaaatattggagccctatgtagtgaacagcttagtccaaagagcagaaaagttcaggcctctcattcattcattgggagactttcctgtatttataagaccttttgggacagcggtg

SEQ ID NO: 441362 - DNA, 140 bp, Artificial Sequence
  Synthetic
caccgctgtcccaaaaggtcttataaatacaggaaagtctcccaatgaatgaatgagaggcctgaacttttctgctctttggactaagctgttcactacatagggctccaatattttgatcatatcagcagccagggcct

SEQ ID NO: 441363 - DNA, 140 bp, Artificial Sequence
  Synthetic
aggccctggctgctgatatggataactctgttgatgtctgatttcgcattgtctatagatggaccactttatctggtcttcaaaacttacgggactatgctagtgaacccagactataaagaccttttgggacagcggtg

SEQ ID NO: 441364 - DNA, 140 bp, Artificial Sequence
  Synthetic
caccgctgtcccaaaaggtctttatagtctgggttcactagcatagtcccgtaagttttgaagaccagataaagtggtccatctatagacaatgcgaaatcagacatcaacagagttatccatatcagcagccagggcct

SEQ ID NO: 441365 - DNA, 140 bp, Artificial Sequence
  Synthetic
aggccctggctgctgatatggactttgcattgtctatagatggaccactgtgtttggtctttaaaacttacgggaccatgctagtaaacccagactataaggctatccaacacctgtcaagaccttttgggacagcggtg

SEQ ID NO: 441366 - DNA, 140 bp, Artificial Sequence
  Synthetic
caccgctgtcccaaaaggtcttgacaggtgttggatagccttatagtctgggtttactagcatggtcccgtaagttttaaagaccaaacacagtggtccatctatagacaatgcaaagtccatatcagcagccagggcct

SEQ ID NO: 441367 - DNA, 140 bp, Artificial Sequence
  Synthetic
aggccctggctgctgatatggtacggttgttacaggcattgggggcacccctatatagattatagaaagggtttgtcgaaactctacgatcaagttcacattaagaaagtgatagacaaggaccttttgggacagcggtg

SEQ ID NO: 441368 - DNA, 140 bp, Artificial Sequence
  Synthetic
caccgctgtcccaaaaggtccttgtctatcactttcttaatgtgaacttgatcgtagagtttcgacaaaccctttctataatctatataggggtgcccccaatgcctgtaacaaccgtaccatatcagcagccagggcct

SEQ ID NO: 441369 - DNA, 140 bp, Artificial Sequence
  Synthetic
aggccctggctgctgatatggagatcaccccttgactccttatatcaaaacccagacatggccaccaaaacatatagtagacttggtaggggacacctggcacaagctcccgattacgcagaccttttgggacagcggtg

SEQ ID NO: 441370 - DNA, 140 bp, Artificial Sequence
  Synthetic
caccgctgtcccaaaaggtctgcgtaatcgggagcttgtgccaggtgtcccctaccaagtctactatatgttttggtggccatgtctgggttttgatataaggagtcaaggggtgatctccatatcagcagccagggcct

SEQ ID NO: 441371 - DNA, 140 bp, Artificial Sequence
  Synthetic
atacgccatgctgggtctcccatatagtagacttggtaggggacacctggcacaagctcccgattacgcagatctttgagattcccgaatcaatggacccatcagaaatactggatgacacgtacttgggagtcggccat

SEQ ID NO: 441372 - DNA, 140 bp, Artificial Sequence
  Synthetic
atggccgactcccaagtacgtgtcatccagtatttctgatgggtccattgattcgggaatctcaaagatctgcgtaatcgggagcttgtgccaggtgtcccctaccaagtctactatatgggagacccagcatggcgtat

SEQ ID NO: 441373 - DNA, 140 bp, Artificial Sequence
  Synthetic
atacgccatgctgggtctcccctgcacttgcggagcaacaggagggggggatcctcgaatatcagtgtctgtgcttccatcttttgaccagtcatttttctcgagaggctctctgaagggcgtacttgggagtcggccat

SEQ ID NO: 441374 - DNA, 140 bp, Artificial Sequence
  Synthetic
atggccgactcccaagtacgcccttcagagagcctctcgagaaaaatgactggtcaaaagatggaagcacagacactgatattcgaggatccccccctcctgttgctccgcaagtgcaggggagacccagcatggcgtat

SEQ ID NO: 441375 - DNA, 140 bp, Artificial Sequence
  Synthetic
aggccctggctgctgatatggccgcctgtcaatccccgggagtttttgaaatctatagacctaggaggattaccagaagaggacttgataatcggcctcaaacccaaggagcgagaattggaccttttgggacagcggtg

SEQ ID NO: 441376 - DNA, 140 bp, Artificial Sequence
  Synthetic
caccgctgtcccaaaaggtccaattctcgctccttgggtttgaggccgattatcaagtcctcttctggtaatcctcctaggtctatagatttcaaaaactcccggggattgacaggcggccatatcagcagccagggcct

SEQ ID NO: 441377 - DNA, 140 bp, Artificial Sequence
  Synthetic
atacgccatgctgggtctcctaccagaagaggacttgataatcggcctcaaacccaaggagcgagaattgaagattgaaggccgattctttgctctgatgtcatggaatttaagattgtacgtacttgggagtcggccat

SEQ ID NO: 441378 - DNA, 140 bp, Artificial Sequence
  Synthetic
atggccgactcccaagtacgtacaatcttaaattccatgacatcagagcaaagaatcggccttcaatcttcaattctcgctccttgggtttgaggccgattatcaagtcctcttctggtaggagacccagcatggcgtat

SEQ ID NO: 441379 - DNA, 140 bp, Artificial Sequence
  Synthetic
atacgccatgctgggtctccagtgttcaagagggtagcctgtaattctagcttgagtctgtcatctcactggatcaggttgatttacaagatagtgaagactaccagactcgttggcagccgtacttgggagtcggccat

SEQ ID NO: 441380 - DNA, 140 bp, Artificial Sequence
  Synthetic
atggccgactcccaagtacggctgccaacgagtctggtagtcttcactatcttgtaaatcaacctgatccagtgagatgacagactcaagctagaattacaggctaccctcttgaacactggagacccagcatggcgtat

SEQ ID NO: 441381 - DNA, 140 bp, Artificial Sequence
  Synthetic
aggccctggctgctgatatgacgcactgacaatgacggacaacttgaacaaggtgtttaaaaagttgatcgacagggtcactgggcaagggcttctggactattctagggttacatatgcgaccttttgggacagcggtg

SEQ ID NO: 441382 - DNA, 140 bp, Artificial Sequence
  Synthetic
caccgctgtcccaaaaggtcgcatatgtaaccctagaatagtccagaagcccttgcccagtgaccctgtcgatcaactttttaaacaccttgttcaagttgtccgtcattgtcagtgcgtcatatcagcagccagggcct

SEQ ID NO: 441383 - DNA, 140 bp, Artificial Sequence
  Synthetic
atacgccatgctgggtctccgacagggtcactgggcaagggcttctggactattctagggttacatatgcatttcacttggactacgagaagtggaacaatcatcaaagattggagtcaacgtacttgggagtcggccat

SEQ ID NO: 441384 - DNA, 140 bp, Artificial Sequence
  Synthetic
atggccgactcccaagtacgttgactccaatctttgatgattgttccacttctcgtagtccaagtgaaatgcatatgtaaccctagaatagtccagaagcccttgcccagtgaccctgtcggagacccagcatggcgtat

SEQ ID NO: 441385 - DNA, 140 bp, Artificial Sequence
  Synthetic
atacgccatgctgggtctccgttgcaaataagggcgagtgctagacaatgccatatccaaggcagaatctggtgcattaacatgaactctagagcatgtcaattgtggtctgatatgtcccgtacttgggagtcggccat

SEQ ID NO: 441386 - DNA, 140 bp, Artificial Sequence
  Synthetic
atggccgactcccaagtacgggacatatcagaccacaattgacatgctctagagttcatgttaatgcaccagattctgccttggatatggcattgtctagcactcgcccttatttgcaacggagacccagcatggcgtat

SEQ ID NO: 441387 - DNA, 140 bp, Artificial Sequence
  Synthetic
aggccctggctgctgatatgtcctcagaagcctgcacgtcccaagacttttgtgtgatgtatcttgaaaaaaacaagatcttgaatccgagcctctggctgtttgattgtttttttcatcgaccttttgggacagcggtg

SEQ ID NO: 441388 - DNA, 140 bp, Artificial Sequence
  Synthetic
caccgctgtcccaaaaggtcgatgaaaaaaacaatcaaacagccagaggctcggattcaagatcttgtttttttcaagatacatcacacaaaagtcttgggacgtgcaggcttctgaggacatatcagcagccagggcct

SEQ ID NO: 441389 - DNA, 140 bp, Artificial Sequence
  Synthetic
aggccctggctgctgatatgaatgctgccaagcttgatccggatgatgtgtgctcctacttagcagctgcaatgcaattcttcgaggggacatgccccgaagactggaatagctacgggagaccttttgggacagcggtg

SEQ ID NO: 441390 - DNA, 140 bp, Artificial Sequence
  Synthetic
caccgctgtcccaaaaggtctcccgtagctattccagtcttcggggcatgtcccctcgaagaattgcattgcagctgctaagtaggagcacacatcatccggatcaagcttggcagcattcatatcagcagccagggcct

SEQ ID NO: 441391 - DNA, 140 bp, Artificial Sequence
  Synthetic
aggccctggctgctgatatgccaaaccaccggtcaagagcccaggaaggagacaacatccactccttctcagagagagtgccagtcctcgaaagccaggatggcggctcaaactgcctctgaccttttgggacagcggtg

SEQ ID NO: 441392 - DNA, 140 bp, Artificial Sequence
  Synthetic
caccgctgtcccaaaaggtcagaggcagtttgagccgccatcctggctttcgaggactggcactctctctgagaaggagtggatgttgtctccttcctgggctcttgaccggtggtttggcatatcagcagccagggcct

SEQ ID NO: 441393 - DNA, 140 bp, Artificial Sequence
  Synthetic
atacgccatgctgggtctccctcctctatgagttagagagcatatcaaggaatgctctttcaatataccgagctatcgaggaaggagcgtccaaattggggctgatcatcaagaaggaagcgtacttgggagtcggccat

SEQ ID NO: 441394 - DNA, 140 bp, Artificial Sequence
  Synthetic
atggccgactcccaagtacgcttccttcttgatgatcagccccaatttggacgctccttcctcgatagctcggtatattgaaagagcattccttgatatgctctctaactcatagaggagggagacccagcatggcgtat

SEQ ID NO: 441395 - DNA, 140 bp, Artificial Sequence
  Synthetic
aggccctggctgctgatatgagaggcaacatattagtgcctgaatccaaaagatgggccagagtctcttgcatctccaacgaccaaatagtcaacctcgccaatataatgtcgacagtatgaccttttgggacagcggtg

SEQ ID NO: 441396 - DNA, 140 bp, Artificial Sequence
  Synthetic
caccgctgtcccaaaaggtcatactgtcgacattatattggcgaggttgactatttggtcgttggagatgcaagagactctggcccatcttttggattcaggcactaatatgttgcctctcatatcagcagccagggcct

SEQ ID NO: 441397 - DNA, 140 bp, Artificial Sequence
  Synthetic
atacgccatgctgggtctcccatctccaacgaccaaatagtcaacctcgccaatataatgtcgacagtatccaccaatgcgctgacagtggcccaacactctcaatcattgatcaaaccgcgtacttgggagtcggccat

SEQ ID NO: 441398 - DNA, 140 bp, Artificial Sequence
  Synthetic
atggccgactcccaagtacgcggtttgatcaatgattgagagtgttgggccactgtcagcgcattggtggatactgtcgacattatattggcgaggttgactatttggtcgttggagatgggagacccagcatggcgtat

SEQ ID NO: 441399 - DNA, 140 bp, Artificial Sequence
  Synthetic
atacgccatgctgggtctccactgacaagggaccccactgtctctgaacatgcgtctttagtcggtcttctcttgagtctgtataggttgagcaaaatatcaggacaaaacactggtaaccgtacttgggagtcggccat

SEQ ID NO: 441400 - DNA, 140 bp, Artificial Sequence
  Synthetic
atggccgactcccaagtacggttaccagtgttttgtcctgatattttgctcaacctatacagactcaagagaagaccgactaaagacgcatgttcagagacagtggggtcccttgtcagtggagacccagcatggcgtat

SEQ ID NO: 441401 - DNA, 140 bp, Artificial Sequence
  Synthetic
aggccctggctgctgatatggccgacaagctaaataaaatcatgcaagatgatttgaatcgctatgcatcctgctaaccgaactcttaaactcagtccctctagatgataaaatctgagagaccttttgggacagcggtg

SEQ ID NO: 441402 - DNA, 140 bp, Artificial Sequence
  Synthetic
caccgctgtcccaaaaggtctctcagattttatcatctagagggactgagtttaagagttcggttagcaggatgcatagcgattcaaatcatcttgcatgattttatttagcttgtcggccatatcagcagccagggcct

SEQ ID NO: 441403 - DNA, 140 bp, Artificial Sequence
  Synthetic
atacgccatgctgggtctccgggagagctttctcctagccatgtcaaggataatctatctagatccttctttgggaggggtgtctggaatgtctctcggaaggttccatatacgtcaattcgtacttgggagtcggccat

SEQ ID NO: 441404 - DNA, 140 bp, Artificial Sequence
  Synthetic
atggccgactcccaagtacgaattgacgtatatggaaccttccgagagacattccagacacccctcccaaagaaggatctagatagattatccttgacatggctaggagaaagctctcccggagacccagcatggcgtat

SEQ ID NO: 441405 - DNA, 140 bp, Artificial Sequence
  Synthetic
aggccctggctgctgatatgttttgttaaaattgtggaacaccatactttaatgacaactcacaaaatgtgtgctaattggagtactataccgaatttcagatttttagccgggacctatgaccttttgggacagcggtg

SEQ ID NO: 441406 - DNA, 140 bp, Artificial Sequence
  Synthetic
caccgctgtcccaaaaggtcataggtcccggctaaaaatctgaaattcggtatagtactccaattagcacacattttgtgagttgtcattaaagtatggtgttccacaattttaacaaaacatatcagcagccagggcct

SEQ ID NO: 441407 - DNA, 140 bp, Artificial Sequence
  Synthetic
aggccctggctgctgatatggctctcacgagccctggattcatgcgttgtgtcaagaggctgggaatccagatcttggagagagaacacttgaaagcttcactcgccttctagaagatccgaccttttgggacagcggtg

SEQ ID NO: 441408 - DNA, 140 bp, Artificial Sequence
  Synthetic
caccgctgtcccaaaaggtcggatcttctagaaggcgagtgaagctttcaagtgttctctctccaagatctggattcccagcctcttgacacaacgcatgaatccagggctcgtgagagccatatcagcagccagggcct

SEQ ID NO: 441409 - DNA, 140 bp, Artificial Sequence
  Synthetic
aggccctggctgctgatatgttccacaagaactttgaggaagagataagaagaatgttcgagccagggcaggagacagctgttcctcactcctatttcattcacttccgttcactaggctgaccttttgggacagcggtg

SEQ ID NO: 441410 - DNA, 140 bp, Artificial Sequence
  Synthetic
caccgctgtcccaaaaggtcagcctagtgaacggaagtgaatgaaataggagtgaggaacagctgtctcctgccctggctcgaacattcttcttatctcttcctcaaagttcttgtggaacatatcagcagccagggcct

SEQ ID NO: 441411 - DNA, 140 bp, Artificial Sequence
  Synthetic
aggccctggctgctgatatgaatcataggatgattgggttagttaaggtcgttgttggactagctttgtcgggagctccagtccctgaggggatgaactgggtatacaaactgaggagaagaccttttgggacagcggtg

SEQ ID NO: 441412 - DNA, 140 bp, Artificial Sequence
  Synthetic
caccgctgtcccaaaaggtcttctcctcagtttgtatacccagttcatcccctcagggactggagctcccgacaaagctagtccaacaacgaccttaactaacccaatcatcctatgattcatatcagcagccagggcct

SEQ ID NO: 441413 - DNA, 140 bp, Artificial Sequence
  Synthetic
aggccctggctgctgatatgattgcaaataagagtgagtgcaagacaatgtcatatccagggcaaagtctggtgtatcaacacgaactctagggcatgtcaattatggtctgacatgtctgaccttttgggacagcggtg

SEQ ID NO: 441414 - DNA, 140 bp, Artificial Sequence
  Synthetic
caccgctgtcccaaaaggtcagacatgtcagaccataattgacatgccctagagttcgtgttgatacaccagactttgccctggatatgacattgtcttgcactcactcttatttgcaatcatatcagcagccagggcct

SEQ ID NO: 441415 - DNA, 140 bp, Artificial Sequence
  Synthetic
aggccctggctgctgatatggcagatctactacgggagatctcttggggaagaaaagtcgtaggcacgacagttcctcacccttctgagatgttgggactgtttcccagatcctccatttgaccttttgggacagcggtg

SEQ ID NO: 441416 - DNA, 140 bp, Artificial Sequence
  Synthetic
caccgctgtcccaaaaggtcaaatggaggatctgggaaacagtcccaacatctcagaagggtgaggaactgtcgtgcctacgacttttcttccccaagagatctcccgtagtagatctgccatatcagcagccagggcct

SEQ ID NO: 441417 - DNA, 140 bp, Artificial Sequence
  Synthetic
atacgccatgctgggtctccacttctccggcgaaaccagaagtccagaagctgtttatactcgaatcatgatgaatggaggtcgactaaagaaatcgcatatacggaggtatgtctcagtcgtacttgggagtcggccat

SEQ ID NO: 441418 - DNA, 140 bp, Artificial Sequence
  Synthetic
atggccgactcccaagtacgactgagacatacctccgtatatgcgatttctttagtcgacctccattcatcatgattcgagtataaacagcttctggacttctggtttcgccggagaagtggagacccagcatggcgtat

SEQ ID NO: 441419 - DNA, 140 bp, Artificial Sequence
  Synthetic
atacgccatgctgggtctcccctgaatatgtcccgctgaaagaactcacgggcaagaagaacatgaggaacttctgcattaatggtgaggtcaaggtgtgcagtcccaacggctattcgtcgtacttgggagtcggccat

SEQ ID NO: 441420 - DNA, 140 bp, Artificial Sequence
  Synthetic
atggccgactcccaagtacgacgaatagccgttgggactgcacaccttgacctcaccattaatgcagaagttcctcatgttcttcttgcccgtgagttctttcagcgggacatattcaggggagacccagcatggcgtat

SEQ ID NO: 441421 - DNA, 140 bp, Artificial Sequence
  Synthetic
atacgccatgctgggtctccgttatggtaccattcaaccgctgcattttatcagagttaagttgattgcctttacattttgagcctcctagatgcgaaaaaaactattaacatccctcaacgtacttgggagtcggccat

SEQ ID NO: 441422 - DNA, 140 bp, Artificial Sequence
  Synthetic
atggccgactcccaagtacgttgagggatgttaatagtttttttcgcatctaggaggctcaaaatgtaaaggcaatcaacttaactctgataaaatgcagcggttgaatggtaccataacggagacccagcatggcgtat

SEQ ID NO: 441423 - DNA, 140 bp, Artificial Sequence
  Synthetic
aggccctggctgctgatatgaatcacagaatgatcggattagtcaaggtggtcattgggcttgctttatcaggagctcccgtccctgagggtatgaactgggtgtataaattgaggagaagaccttttgggacagcggtg

SEQ ID NO: 441424 - DNA, 140 bp, Artificial Sequence
  Synthetic
caccgctgtcccaaaaggtcttctcctcaatttatacacccagttcataccctcagggacgggagctcctgataaagcaagcccaatgaccaccttgactaatccgatcattctgtgattcatatcagcagccagggcct

SEQ ID NO: 441425 - DNA, 140 bp, Artificial Sequence
  Synthetic
aggccctggctgctgatatgccggtctggccgatcttgagatggccgaagagactgttgatctgatcaataaaaacatagaagacaatcaggctcatctccagggggaacccatagaagtgaccttttgggacagcggtg

SEQ ID NO: 441426 - DNA, 140 bp, Artificial Sequence
  Synthetic
caccgctgtcccaaaaggtcacttctatgggttccccctggagatgagcctgattgtcttctatgtttttattgatcagatcaacagtctcttcggccatctcaagatcggccagaccggcatatcagcagccagggcct

SEQ ID NO: 441427 - DNA, 140 bp, Artificial Sequence
  Synthetic
atacgccatgctgggtctccctgttttcaaaaggaccgggtcagccttgcataggttcaagtctgccagatacagtgaaggagggtattcctctgtttgccctaatctcctctctcatatcgtacttgggagtcggccat

SEQ ID NO: 441428 - DNA, 140 bp, Artificial Sequence
  Synthetic
atggccgactcccaagtacgatatgagagaggagattagggcaaacagaggaataccctccttcactgtatctggcagacttgaacctatgcaaggctgacccggtccttttgaaaacagggagacccagcatggcgtat

SEQ ID NO: 441429 - DNA, 140 bp, Artificial Sequence
  Synthetic
aggccctggctgctgatatgattgcagataagagtgagtgcaagacaatgtcatatccaaggtagggtatggtgtatcaacatgaattctagagcatgtcaattatggtctgacatgtctgaccttttgggacagcggtg

SEQ ID NO: 441430 - DNA, 140 bp, Artificial Sequence
  Synthetic
caccgctgtcccaaaaggtcagacatgtcagaccataattgacatgctctagaattcatgttgatacaccataccctaccttggatatgacattgtcttgcactcactcttatctgcaatcatatcagcagccagggcct

SEQ ID NO: 441431 - DNA, 140 bp, Artificial Sequence
  Synthetic
atacgccatgctgggtctcccttgcacaggcgttgtgacagaggcagagacctacactaactttgttggttatgtcaccaccacgttcaaaagaaagcatttccgcccgacaccagatgccgtacttgggagtcggccat

SEQ ID NO: 441432 - DNA, 140 bp, Artificial Sequence
  Synthetic
atggccgactcccaagtacggcatctggtgtcgggcggaaatgctttcttttgaacgtggtggtgacataaccaacaaagttagtgtaggtctctgcctctgtcacaacgcctgtgcaagggagacccagcatggcgtat

SEQ ID NO: 441433 - DNA, 140 bp, Artificial Sequence
  Synthetic
atacgccatgctgggtctcctggtgctctcatcccccaaggactgataccaaaggttgtggacaagccaactgatatctcagatgactctgtgcttgagtttaggcagaggccttagcaccgtacttgggagtcggccat

SEQ ID NO: 441434 - DNA, 140 bp, Artificial Sequence
  Synthetic
atggccgactcccaagtacggtgctaaggcctctgcctaaactcaagcacagagtcatctgagatatcagttggcttgtccacaacctttggtatcagtccttgggggatgagagcaccaggagacccagcatggcgtat

SEQ ID NO: 441435 - DNA, 140 bp, Artificial Sequence
  Synthetic
aggccctggctgctgatatggagctggtacagagagacaccaggctgagagactctacgtttcattggcatcttcggtgcaacaggtgtgtaaggcccatagatgagataacactggagagaccttttgggacagcggtg

SEQ ID NO: 441436 - DNA, 140 bp, Artificial Sequence
  Synthetic
caccgctgtcccaaaaggtctctccagtgttatctcatctatgggccttacacacctgttgcaccgaagatgccaatgaaacgtagagtctctcagcctggtgtctctctgtaccagctccatatcagcagccagggcct

SEQ ID NO: 441437 - DNA, 140 bp, Artificial Sequence
  Synthetic
aggccctggctgctgatatgagagagaaggccagtcttcgaaagcaaggatggcggctcaagctgcctctggccctccggcccttgaatggtctgctaccaatgaggaggatgatctatcgaccttttgggacagcggtg

SEQ ID NO: 441438 - DNA, 140 bp, Artificial Sequence
  Synthetic
caccgctgtcccaaaaggtcgatagatcatcctcctcattggtagcagaccattcaagggccggagggccagaggcagcttgagccgccatccttgctttcgaagactggccttctctctcatatcagcagccagggcct

SEQ ID NO: 441439 - DNA, 140 bp, Artificial Sequence
  Synthetic
aggccctggctgctgatatgggccgttccattgtgttttgggaaattccccatttacacgataccagacaaactcggtccctggagtcccattgatatacatcatctcagctgtccgaatgaccttttgggacagcggtg

SEQ ID NO: 441440 - DNA, 140 bp, Artificial Sequence
  Synthetic
caccgctgtcccaaaaggtcattcggacagctgagatgatgtatatcaatgggactccagggaccgagtttgtctggtatcgtgtaaatggggaatttcccaaaacacaatggaacggcccatatcagcagccagggcct

SEQ ID NO: 441441 - DNA, 140 bp, Artificial Sequence
  Synthetic
aggccctggctgctgatatgcaatagtagagggaagagagcatccaaggagagaaagacctgcggctttgtggatgaaagaggcctgtataagtctctaagaggctcatgcaaactcaaggaccttttgggacagcggtg

SEQ ID NO: 441442 - DNA, 140 bp, Artificial Sequence
  Synthetic
caccgctgtcccaaaaggtccttgagtttgcatgagcctcttagagacttatacaggcctctttcatccacaaagccgcaggtctttctctccttggatgctctcttccctctactattgcatatcagcagccagggcct

SEQ ID NO: 441443 - DNA, 140 bp, Artificial Sequence
  Synthetic
aggccctggctgctgatatgttgaagatgaacctcgatgatatagttaaggaggcaaaaaatgtgccaggcgtgacccgtttagctcatgacggatccaagctccccctgagatgtgtacgaccttttgggacagcggtg

SEQ ID NO: 441444 - DNA, 140 bp, Artificial Sequence
  Synthetic
caccgctgtcccaaaaggtcgtacacatctcagggggagcttggatccgtcatgagctaaacgggtcacgcctggcacattttttgcctccttaactatatcatcgaggttcatcttcaacatatcagcagccagggcct

SEQ ID NO: 441445 - DNA, 140 bp, Artificial Sequence
  Synthetic
atacgccatgctgggtctcccgtgacccgtttagctcatgacggatccaagctccccctgagatgtgtactgggatgggttgctttggccaattccaagaaattccaattgttagtagatcgtacttgggagtcggccat

SEQ ID NO: 441446 - DNA, 140 bp, Artificial Sequence
  Synthetic
atggccgactcccaagtacgatctactaacaattggaatttcttggaattggccaaagcaacccatcccagtacacatctcagggggagcttggatccgtcatgagctaaacgggtcacgggagacccagcatggcgtat

SEQ ID NO: 441447 - DNA, 140 bp, Artificial Sequence
  Synthetic
aggccctggctgctgatatgtttccatccctcagaaaatccccgccgcttacccgaccactatgaaagaaggcaacagatcgatcttatgttatctccaacatgtgctacgctatgagcggaccttttgggacagcggtg

SEQ ID NO: 441448 - DNA, 140 bp, Artificial Sequence
  Synthetic
caccgctgtcccaaaaggtccgctcatagcgtagcacatgttggagataacataagatcgatctgttgccttctttcatagtggtcgggtaagcggcggggattttctgagggatggaaacatatcagcagccagggcct

SEQ ID NO: 441449 - DNA, 140 bp, Artificial Sequence
  Synthetic
aggccctggctgctgatatgcaagtcagtaagtttcagacgtctcagtcatttaagaaaacttgtccctgggttcggaaaagcatataccataatcaacaagactttgatggaggctgaggaccttttgggacagcggtg

SEQ ID NO: 441450 - DNA, 140 bp, Artificial Sequence
  Synthetic
caccgctgtcccaaaaggtcctcagcctccatcaaagtcttgttgattatggtatatgcttttccgaacccagggacaagttttcttaaatgactgagacgtctgaaacttactgacttgcatatcagcagccagggcct

SEQ ID NO: 441451 - DNA, 140 bp, Artificial Sequence
  Synthetic
aggccctggctgctgatatgcatctcctactccagagggttgagagaaacttgtctaaaagtatgagggctaatctgcgacagatgagttccttgatgaggcaggttctgggtggccatggaccttttgggacagcggtg

SEQ ID NO: 441452 - DNA, 140 bp, Artificial Sequence
  Synthetic
caccgctgtcccaaaaggtccatggccacccagaacctgcctcatcaaggaactcatctgtcgcagattagccctcatacttttagacaagtttctctcaaccctctggagtaggagatgcatatcagcagccagggcct

SEQ ID NO: 441453 - DNA, 140 bp, Artificial Sequence
  Synthetic
aggccctggctgctgatatgtcaatggtataatattagggcctgacggccatgttctaatcccagagatgcaatcatccctcctccagcaacatatggagttattggaatcctcagttatgaccttttgggacagcggtg

SEQ ID NO: 441454 - DNA, 140 bp, Artificial Sequence
  Synthetic
caccgctgtcccaaaaggtcataactgaggattccaataactccatatgttgctggaggagggatgattgcatctctgggattagaacatggccgtcaggccctaatattataccattgacatatcagcagccagggcct

SEQ ID NO: 441455 - DNA, 140 bp, Artificial Sequence
  Synthetic
aggccctggctgctgatatgtcaggatcctgcggcacattctgagatcattcgacgagatatactctgggaatcataggatgattggattggtcaaagttgttattggactagctctgtcgaccttttgggacagcggtg

SEQ ID NO: 441456 - DNA, 140 bp, Artificial Sequence
  Synthetic
caccgctgtcccaaaaggtcgacagagctagtccaataacaactttgaccaatccaatcatcctatgattcccagagtatatctcgtcgaatgatctcagaatgtgccgcaggatcctgacatatcagcagccagggcct

SEQ ID NO: 441457 - DNA, 140 bp, Artificial Sequence
  Synthetic
aggccctggctgctgatatgaaccatgactggaaattatagccccaacaagaaagtgtcccgcaaagcaggatgttcagaatgggtttgctctgctcaacaggttgcagtctctacctcagaccttttgggacagcggtg

SEQ ID NO: 441458 - DNA, 140 bp, Artificial Sequence
  Synthetic
caccgctgtcccaaaaggtctgaggtagagactgcaacctgttgagcagagcaaacccattctgaacatcctgctttgcgggacactttcttgttggggctataatttccagtcatggttcatatcagcagccagggcct

SEQ ID NO: 441459 - DNA, 140 bp, Artificial Sequence
  Synthetic
aggccctggctgctgatatggtctcagaggttgacctgggtctcccgaactggggagagtatgtattactgagtgcagggaccctgattgccttgatgttgataattttcctaatgatatgaccttttgggacagcggtg

SEQ ID NO: 441460 - DNA, 140 bp, Artificial Sequence
  Synthetic
caccgctgtcccaaaaggtcatatcattaggaaaattatcaacatcaaggcaatcagggtccctgcactcagtaatacatactctccccagttcgggagacccaggtcaacctctgagaccatatcagcagccagggcct

SEQ ID NO: 441461 - DNA, 140 bp, Artificial Sequence
  Synthetic
aggccctggctgctgatatgttggaatactcacaggagatcacttgggatgatgatactgagttcgtcggattgcaaataagagtgagtgcaagacaatgtcatatccagggcagaatctgaccttttgggacagcggtg

SEQ ID NO: 441462 - DNA, 140 bp, Artificial Sequence
  Synthetic
caccgctgtcccaaaaggtcagattctgccctggatatgacattgtcttgcactcactcttatttgcaatccgacgaactcagtatcatcatcccaagtgatctcctgtgagtattccaacatatcagcagccagggcct

SEQ ID NO: 441463 - DNA, 140 bp, Artificial Sequence
  Synthetic
aggccctggctgctgatatggttccaaaatcccttgatctcgggcttgagagtggttcaatgggcaactggcgcccactacaaactcaaacctattctagatgatctcaatgttttccctgaccttttgggacagcggtg

SEQ ID NO: 441464 - DNA, 140 bp, Artificial Sequence
  Synthetic
caccgctgtcccaaaaggtcagggaaaacattgagatcatctagaataggtttgagtttgtagtgggcgccagttgcccattgaaccactctcaagcccgagatcaagggattttggaaccatatcagcagccagggcct

SEQ ID NO: 441465 - DNA, 140 bp, Artificial Sequence
  Synthetic
aggccctggctgctgatatgatgggaatcatataaaagtggggatgaagctagactgtgaaggctggtcatcctttcgacacttcgagttccgaagatcacctcccctttaagtttgcttgaccttttgggacagcggtg

SEQ ID NO: 441466 - DNA, 140 bp, Artificial Sequence
  Synthetic
caccgctgtcccaaaaggtcaagcaaacttaaaggggaggtgatcttcggaactcgaagtgtcgaaaggatgaccagccttcacagtctagcttcatccccacttttatatgattcccatcatatcagcagccagggcct

SEQ ID NO: 441467 - DNA, 140 bp, Artificial Sequence
  Synthetic
aggccctggctgctgatatgtgaatgatctgatggcttccggaacacatccactgcccccctcagcaatcatgagtgggggagatgacatcgtttccagggtgatagactttgactcgatgaccttttgggacagcggtg

SEQ ID NO: 441468 - DNA, 140 bp, Artificial Sequence
  Synthetic
caccgctgtcccaaaaggtcatcgagtcaaagtctatcaccctggaaacgatgtcatctcccccactcatgattgctgaggggggcagtggatgtgttccggaagccatcagatcattcacatatcagcagccagggcct

SEQ ID NO: 441469 - DNA, 140 bp, Artificial Sequence
  Synthetic
aggccctggctgctgatatgtttacattttgagcctcttggatgtgaaaaaaactattaacatccctcaaaaaacttaaggaaagatggatcctcaggcgcttttgttggtaccccttctgaccttttgggacagcggtg

SEQ ID NO: 441470 - DNA, 140 bp, Artificial Sequence
  Synthetic
caccgctgtcccaaaaggtcagaaggggtaccaacaaaagcgcctgaggatccatctttccttaagttttttgagggatgttaatagtttttttcacatccaagaggctcaaaatgtaaacatatcagcagccagggcct

SEQ ID NO: 441471 - DNA, 140 bp, Artificial Sequence
  Synthetic
aggccctggctgctgatatgctgggaaaaaccttccgacctgaggaacttggccacctggaaatacttccagtcagtccaaaaacaggtcaacatgtcttatgacctcatcatctgtgatgaccttttgggacagcggtg

SEQ ID NO: 441472 - DNA, 140 bp, Artificial Sequence
  Synthetic
caccgctgtcccaaaaggtcatcacagatgatgaggtcataagacatgttgacctgtttttggactgactggaagtatttccaggtggccaagttcctcaggtcggaaggtttttcccagcatatcagcagccagggcct

SEQ ID NO: 441473 - DNA, 140 bp, Artificial Sequence
  Synthetic
atacgccatgctgggtctccaatttggttgtagaggacgaaggatgcaccaacctgtcagggttctcctacatggagctcaaagttggatacatctcatccataaaagtgaacgggtttacgtacttgggagtcggccat

SEQ ID NO: 441474 - DNA, 140 bp, Artificial Sequence
  Synthetic
atggccgactcccaagtacgtaaacccgttcacttttatggatgagatgtatccaactttgagctccatgtaggagaaccctgacaggttggtgcatccttcgtcctctacaaccaaattggagacccagcatggcgtat

SEQ ID NO: 441475 - DNA, 140 bp, Artificial Sequence
  Synthetic
aggccctggctgctgatatgaatctgcctcccatgaaggacgcaagtaatagctcacaatcgtcttgcatctcagcgaagtatgtataattataaagagctgggtcctctaagcttttcagaccttttgggacagcggtg

SEQ ID NO: 441476 - DNA, 140 bp, Artificial Sequence
  Synthetic
caccgctgtcccaaaaggtctgaaaagcttagaggacccagctctttataattatacatacttcgctgagatgcaagacgattgtgagctattacttgcgtccttcatgggaggcagattcatatcagcagccagggcct

SEQ ID NO: 441477 - DNA, 140 bp, Artificial Sequence
  Synthetic
aggccctggctgctgatatgttcaattgcagcagccccaaaagtgagatgcagagagctcgttccttgaactatcaagatcttgtaaggggatttcctgaagaaatcatatcaaatccttgaccttttgggacagcggtg

SEQ ID NO: 441478 - DNA, 140 bp, Artificial Sequence
  Synthetic
caccgctgtcccaaaaggtcaaggatttgatatgatttcttcaggaaatccccttacaagatcttgatagttcaaggaacgagctctctgcatctcacttttggggctgctgcaattgaacatatcagcagccagggcct

SEQ ID NO: 441479 - DNA, 140 bp, Artificial Sequence
  Synthetic
atacgccatgctgggtctccctatcaagatcttgtaaggggatttcctgaagaaatcatatcaaatccttacaatgaaatgatcataaccctgattgacagcgatgtagaatctttcctacgtacttgggagtcggccat

SEQ ID NO: 441480 - DNA, 140 bp, Artificial Sequence
  Synthetic
atggccgactcccaagtacgtaggaaagattctacatcgctgtcaatcagggttatgatcatttcattgtaaggatttgatatgatttcttcaggaaatccccttacaagatcttgatagggagacccagcatggcgtat

SEQ ID NO: 441481 - DNA, 140 bp, Artificial Sequence
  Synthetic
atacgccatgctgggtctcccccatatgacaaatcccttcactcgagggtcttccctagtggaaagtgctcaggaataacggtgtcttctacctactgctcaactaaccacgattacacccgtacttgggagtcggccat

SEQ ID NO: 441482 - DNA, 140 bp, Artificial Sequence
  Synthetic
atggccgactcccaagtacgggtgtaatcgtggttagttgagcagtaggtagaagacaccgttattcctgagcactttccactagggaagaccctcgagtgaagggatttgtcatatgggggagacccagcatggcgtat

SEQ ID NO: 441483 - DNA, 140 bp, Artificial Sequence
  Synthetic
atacgccatgctgggtctcctatgtcaccaccacattcaagagaaaacactttcgcccaatgcccgatgcatgtagatccgcatacaattggaaaatggcaggcgatcctaggtatgaagcgtacttgggagtcggccat

SEQ ID NO: 441484 - DNA, 140 bp, Artificial Sequence
  Synthetic
atggccgactcccaagtacgcttcatacctaggatcgcctgccattttccaattgtatgcggatctacatgcatcgggcattgggcgaaagtgttttctcttgaatgtggtggtgacataggagacccagcatggcgtat

SEQ ID NO: 441485 - DNA, 140 bp, Artificial Sequence
  Synthetic
aggccctggctgctgatatgacgtttcaaaacctttaactgaccccttgttctatcctccatctgatcccaaaatcctgaggcacttcaacatatgttgcagcaccatgatgtatctgtcgaccttttgggacagcggtg

SEQ ID NO: 441486 - DNA, 140 bp, Artificial Sequence
  Synthetic
caccgctgtcccaaaaggtcgacagatacatcatggtgctgcaacatatgttgaagtgcctcaggattttgggatcagatggaggatagaacaaggggtcagttaaaggttttgaaacgtcatatcagcagccagggcct

SEQ ID NO: 441487 - DNA, 140 bp, Artificial Sequence
  Synthetic
atacgccatgctgggtctccgcatttggaaggtatttggccaacacgtattcctcttatttgcttttccatgtaatcacactatacatgaatgccctagactgggacgaagaaaaaaccacgtacttgggagtcggccat

SEQ ID NO: 441488 - DNA, 140 bp, Artificial Sequence
  Synthetic
atggccgactcccaagtacgtggttttttcttcgtcccagtctagggcattcatgtatagtgtgattacatggaaaagcaaataagaggaatacgtgttggccaaataccttccaaatgcggagacccagcatggcgtat

SEQ ID NO: 441489 - DNA, 140 bp, Artificial Sequence
  Synthetic
aggccctggctgctgatatgtatcagatctaggtcatctttgctagaatacagttgcttgtagaccggatgatcccgaaagcctacacatactacgactcgtgtatgatgtatcttgaaagaccttttgggacagcggtg

SEQ ID NO: 441490 - DNA, 140 bp, Artificial Sequence
  Synthetic
caccgctgtcccaaaaggtctttcaagatacatcatacacgagtcgtagtatgtgtaggctttcgggatcatccggtctacaagcaactgtattctagcaaagatgacctagatctgatacatatcagcagccagggcct

SEQ ID NO: 441491 - DNA, 140 bp, Artificial Sequence
  Synthetic
atacgccatgctgggtctccgatcccgaaagcctacacatactacgactcgtgtatgatgtatcttgaaaaaaacaagatcttgaatctgagcctctggttgcttgattgttttttttatcgtacttgggagtcggccat

SEQ ID NO: 441492 - DNA, 140 bp, Artificial Sequence
  Synthetic
atggccgactcccaagtacgataaaaaaaacaatcaagcaaccagaggctcagattcaagatcttgtttttttcaagatacatcatacacgagtcgtagtatgtgtaggctttcgggatcggagacccagcatggcgtat

SEQ ID NO: 441493 - DNA, 140 bp, Artificial Sequence
  Synthetic
atacgccatgctgggtctccggtgtatcaacatgaactcgagagcatgtcaactatggtctgacatgtctcttcagacacaaaggtctgaagaggacaaagactcttctctgcttctagacgtacttgggagtcggccat

SEQ ID NO: 441494 - DNA, 140 bp, Artificial Sequence
  Synthetic
atggccgactcccaagtacgtctagaagcagagaagagtctttgtcctcttcagacctttgtgtctgaagagacatgtcagaccatagttgacatgctctcgagttcatgttgatacaccggagacccagcatggcgtat

SEQ ID NO: 441495 - DNA, 140 bp, Artificial Sequence
  Synthetic
aggccctggctgctgatatgtcttgagtctgtacaggttgagcaagatatcaggacaaaacaccggtaactataagacaaacatcgcggataggatagagcagattttcgagaccgccccgaccttttgggacagcggtg

SEQ ID NO: 441496 - DNA, 140 bp, Artificial Sequence
  Synthetic
caccgctgtcccaaaaggtcggggcggtctcgaaaatctgctctatcctatccgcgatgtttgtcttatagttaccggtgttttgtcctgatatcttgctcaacctgtacagactcaagacatatcagcagccagggcct

SEQ ID NO: 441497 - DNA, 140 bp, Artificial Sequence
  Synthetic
aggccctggctgctgatatggttttcgtgtatggttgttacaggcattgggggcacccctatgtagattatcggaagggtctatcgaaactatatgatcaagttcacataaagaaagtgagaccttttgggacagcggtg

SEQ ID NO: 441498 - DNA, 140 bp, Artificial Sequence
  Synthetic
caccgctgtcccaaaaggtctcactttctttatgtgaacttgatcatatagtttcgatagacccttccgataatctacataggggtgcccccaatgcctgtaacaaccatacacgaaaaccatatcagcagccagggcct

SEQ ID NO: 441499 - DNA, 140 bp, Artificial Sequence
  Synthetic
aggccctggctgctgatatgtcttgattgcacgaaaaggagataaaatcaccccagattctcttgtggagataaagcgtactgatgtagaagggagttgggctctgacaggaggcttggagaccttttgggacagcggtg

SEQ ID NO: 441500 - DNA, 140 bp, Artificial Sequence
  Synthetic
caccgctgtcccaaaaggtctccaagcctcctgtcagagcccaactcccttctacatcagtacgctttatctccacaagagaatctggggtgattttatctccttttcgtgcaatcaagacatatcagcagccagggcct

SEQ ID NO: 441501 - DNA, 140 bp, Artificial Sequence
  Synthetic
aggccctggctgctgatatgtcaaaagtcatgagactttcattaatcatctcagttgatcaaactaggtcatgtagattctcataatacgggaaatcttctagcagtttcagtgaccaacgaccttttgggacagcggtg

SEQ ID NO: 441502 - DNA, 140 bp, Artificial Sequence
  Synthetic
caccgctgtcccaaaaggtcgttggtcactgaaactgctagaagatttcccgtattatgagaatctacatgacctagtttgatcaactgagatgattaatgaaagtctcatgacttttgacatatcagcagccagggcct

SEQ ID NO: 441503 - DNA, 140 bp, Artificial Sequence
  Synthetic
atacgccatgctgggtctccatgtagattctcataatacgggaaatcttctagcagtttcagtgaccaacggtgctttcattctcccagaactggtactaaaggttgtagacgggccgagcgtacttgggagtcggccat

SEQ ID NO: 441504 - DNA, 140 bp, Artificial Sequence
  Synthetic
atggccgactcccaagtacgctcggcccgtctacaacctttagtaccagttctgggagaatgaaagcaccgttggtcactgaaactgctagaagatttcccgtattatgagaatctacatggagacccagcatggcgtat

SEQ ID NO: 441505 - DNA, 140 bp, Artificial Sequence
  Synthetic
aggccctggctgctgatatgtataagacaaacattgcagataggatagagcagatcttcgagacagccccttttgttaaaatcgtggaacaccatactctgatgacaactcacaaaatgtgaccttttgggacagcggtg

SEQ ID NO: 441506 - DNA, 140 bp, Artificial Sequence
  Synthetic
caccgctgtcccaaaaggtcacattttgtgagttgtcatcagagtatggtgttccacgattttaacaaaaggggctgtctcgaagatctgctctatcctatctgcaatgtttgtcttatacatatcagcagccagggcct

SEQ ID NO: 441507 - DNA, 140 bp, Artificial Sequence
  Synthetic
atacgccatgctgggtctcccagagaaccgaggggggcctgttcctagcgagaaagttatcatcacggccttgtctaagccgcctgtcaatccccgagagtttttgaaatctatagacctcgtacttgggagtcggccat

SEQ ID NO: 441508 - DNA, 140 bp, Artificial Sequence
  Synthetic
atggccgactcccaagtacgaggtctatagatttcaaaaactctcggggattgacaggcggcttagacaaggccgtgatgataactttctcgctaggaacaggcccccctcggttctctgggagacccagcatggcgtat

SEQ ID NO: 441509 - DNA, 140 bp, Artificial Sequence
  Synthetic
aggccctggctgctgatatgtcaaagttctgactgcctttttgataggaactatacacttatgctgaaagaccttttcttatctcggttcaattctctgatgattttgctatccccccctgaccttttgggacagcggtg

SEQ ID NO: 441510 - DNA, 140 bp, Artificial Sequence
  Synthetic
caccgctgtcccaaaaggtcagggggggatagcaaaatcatcagagaattgaaccgagataagaaaaggtctttcagcataagtgtatagttcctatcaaaaaggcagtcagaactttgacatatcagcagccagggcct

SEQ ID NO: 441511 - DNA, 140 bp, Artificial Sequence
  Synthetic
aggccctggctgctgatatgacctgggagaggaattcttcgggaaagggacctttgaaagaagattctttagagatgagaaagaacttcgagaatatgaagaggccgagctgacgaagacgaccttttgggacagcggtg

SEQ ID NO: 441512 - DNA, 140 bp, Artificial Sequence
  Synthetic
caccgctgtcccaaaaggtcgtcttcgtcagctcggcctcttcatattctcgaagttctttctcatctctaaagaatcttctttcaaaggtccctttcccgaagaattcctctcccaggtcatatcagcagccagggcct

SEQ ID NO: 441513 - DNA, 140 bp, Artificial Sequence
  Synthetic
aggccctggctgctgatatgacttctccggtgaaactagaagtccggaagctgtttatactcgaatcataatgaatggaggtcggttgaagagatctcatatacggagatatgtctcagtgaccttttgggacagcggtg

SEQ ID NO: 441514 - DNA, 140 bp, Artificial Sequence
  Synthetic
caccgctgtcccaaaaggtcactgagacatatctccgtatatgagatctcttcaaccgacctccattcattatgattcgagtataaacagcttccggacttctagtttcaccggagaagtcatatcagcagccagggcct

SEQ ID NO: 441515 - DNA, 140 bp, Artificial Sequence
  Synthetic
aggccctggctgctgatatgagacaaccaggtcctatgtccgacatatatgttgtcacctgggctgtctcgagaggggctcctctatgagttggagagcatatcaaggaacgcactttcagaccttttgggacagcggtg

SEQ ID NO: 441516 - DNA, 140 bp, Artificial Sequence
  Synthetic
caccgctgtcccaaaaggtctgaaagtgcgttccttgatatgctctccaactcatagaggagcccctctcgagacagcccaggtgacaacatatatgtcggacataggacctggttgtctcatatcagcagccagggcct

SEQ ID NO: 441517 - DNA, 140 bp, Artificial Sequence
  Synthetic
aggccctggctgctgatatgaggaacatagaagacaatcaagctcatcttcagggagaacccatagaagtggataatctcccggaggacatgaggcgacttcacttagacgatggacaatgaccttttgggacagcggtg

SEQ ID NO: 441518 - DNA, 140 bp, Artificial Sequence
  Synthetic
caccgctgtcccaaaaggtcattgtccatcgtctaagtgaagtcgcctcatgtcctccgggagattatccacttctatgggttctccctgaagatgagcttgattgtcttctatgttcctcatatcagcagccagggcct

SEQ ID NO: 441519 - DNA, 140 bp, Artificial Sequence
  Synthetic
aggccctggctgctgatatgtacctgttatttagcccaatcttaaagggcagagtttacaagattctgagtgctgaaggggagagctttctcctagccatgtcgaggataatctatctaggaccttttgggacagcggtg

SEQ ID NO: 441520 - DNA, 140 bp, Artificial Sequence
  Synthetic
caccgctgtcccaaaaggtcctagatagattatcctcgacatggctaggagaaagctctccccttcagcactcagaatcttgtaaactctgccctttaagattgggctaaataacaggtacatatcagcagccagggcct

SEQ ID NO: 441521 - DNA, 140 bp, Artificial Sequence
  Synthetic
aggccctggctgctgatatgaccatcaacttccccaacccttcgggaaggtcttcagaggataaatcaacccagactactggccgagaattcaagagggaggcaacatccactccttctcgaccttttgggacagcggtg

SEQ ID NO: 441522 - DNA, 140 bp, Artificial Sequence
  Synthetic
caccgctgtcccaaaaggtcgagaaggagtggatgttgcctccctcttgaattctcggccagtagtctgggttgatttatcctctgaagaccttcccgaagggttggggaagttgatggtcatatcagcagccagggcct

SEQ ID NO: 441523 - DNA, 140 bp, Artificial Sequence
  Synthetic
atacgccatgctgggtctccctggttaagctcccacgagtcctggattcacgcgttgtgtcaagaggctgggaacccagatcttggagagagaacactcgagagctttactcgccttctacgtacttgggagtcggccat

SEQ ID NO: 441524 - DNA, 140 bp, Artificial Sequence
  Synthetic
atggccgactcccaagtacgtagaaggcgagtaaagctctcgagtgttctctctccaagatctgggttcccagcctcttgacacaacgcgtgaatccaggactcgtgggagcttaaccagggagacccagcatggcgtat

SEQ ID NO: 441525 - DNA, 140 bp, Artificial Sequence
  Synthetic
atacgccatgctgggtctccatctttgagattcctgaatcaatggacccgtcagaaatactggatgacaaatcacactctttcaccagaacgagactagcttcttggctgtcagagaacccgtacttgggagtcggccat

SEQ ID NO: 441526 - DNA, 140 bp, Artificial Sequence
  Synthetic
atggccgactcccaagtacgggttctctgacagccaagaagctagtctcgttctggtgaaagagtgtgatttgtcatccagtatttctgacgggtccattgattcaggaatctcaaagatggagacccagcatggcgtat

SEQ ID NO: 441527 - DNA, 140 bp, Artificial Sequence
  Synthetic
aggccctggctgctgatatgtgggatgggtcgctttggccaactcaaagaaattccaattgctagttgagcctgacaaactgggcaaaatcatgcaagacgatctgaatcgctatgcatcgaccttttgggacagcggtg

SEQ ID NO: 441528 - DNA, 140 bp, Artificial Sequence
  Synthetic
caccgctgtcccaaaaggtcgatgcatagcgattcagatcgtcttgcatgattttgcccagtttgtcaggctcaactagcaattggaatttctttgagttggccaaagcgacccatcccacatatcagcagccagggcct

SEQ ID NO: 441529 - DNA, 140 bp, Artificial Sequence
  Synthetic
atacgccatgctgggtctcccctgacaaactgggcaaaatcatgcaagacgatctgaatcgctatgcatcctgccaaccgagcctataagctcagttcttccagatagtcaaatctgagacgtacttgggagtcggccat

SEQ ID NO: 441530 - DNA, 140 bp, Artificial Sequence
  Synthetic
atggccgactcccaagtacgtctcagatttgactatctggaagaactgagcttataggctcggttggcaggatgcatagcgattcagatcgtcttgcatgattttgcccagtttgtcaggggagacccagcatggcgtat

SEQ ID NO: 441531 - DNA, 140 bp, Artificial Sequence
  Synthetic
aggccctggctgctgatatgaccagatgaggacttaataattggcctcaaaccaaaggaacgagaattgaagattgaaggtagattctttgctctaatgtcatggaatctgagattgtatgaccttttgggacagcggtg

SEQ ID NO: 441532 - DNA, 140 bp, Artificial Sequence
  Synthetic
caccgctgtcccaaaaggtcatacaatctcagattccatgacattagagcaaagaatctaccttcaatcttcaattctcgttcctttggtttgaggccaattattaagtcctcatctggtcatatcagcagccagggcct

SEQ ID NO: 441533 - DNA, 140 bp, Artificial Sequence
  Synthetic
aggccctggctgctgatatgacttctccagtgaaaccaggagtccagaagcagtttacacacgaatcatgatgaatggaggtagactaaaaagatcacacataaggaggtatgtctcagtgaccttttgggacagcggtg

SEQ ID NO: 441534 - DNA, 140 bp, Artificial Sequence
  Synthetic
caccgctgtcccaaaaggtcactgagacatacctccttatgtgtgatctttttagtctacctccattcatcatgattcgtgtgtaaactgcttctggactcctggtttcactggagaagtcatatcagcagccagggcct

SEQ ID NO: 441535 - DNA, 140 bp, Artificial Sequence
  Synthetic
aggccctggctgctgatatgtaaaagaatctataaactggttcattactagaaattccaacttggctcaaactctaattaggaacattacgtctctgacaggccctaacttccctctagagaccttttgggacagcggtg

SEQ ID NO: 441536 - DNA, 140 bp, Artificial Sequence
  Synthetic
caccgctgtcccaaaaggtctctagagggaagttagggcctgtcagagacgtaatgttcctaattagagtttgagccaagttggaatttctagtaatgaaccagtttatagattcttttacatatcagcagccagggcct

SEQ ID NO: 441537 - DNA, 140 bp, Artificial Sequence
  Synthetic
aggccctggctgctgatatgtttctagaacacatgagttttttcagaagtcctggatctattattcagatagatcagacctcattgggttatgggaggatcaaatatattgcttggatatgaccttttgggacagcggtg

SEQ ID NO: 441538 - DNA, 140 bp, Artificial Sequence
  Synthetic
caccgctgtcccaaaaggtcatatccaagcaatatatttgatcctcccataacccaatgaggtctgatctatctgaataatagatccaggacttctgaaaaaactcatgtgttctagaaacatatcagcagccagggcct

SEQ ID NO: 441539 - DNA, 140 bp, Artificial Sequence
  Synthetic
aggccctggctgctgatatggtccaacgggccaacctgctggaatggccaggacggtgggctggagggcttacggcagaagggctggagtctcgttagcctgttgatgatagatagagaagaccttttgggacagcggtg

SEQ ID NO: 441540 - DNA, 140 bp, Artificial Sequence
  Synthetic
caccgctgtcccaaaaggtcttctctatctatcatcaacaggctaacgagactccagcccttctgccgtaagccctccagcccaccgtcctggccattccagcaggttggcccgttggaccatatcagcagccagggcct

SEQ ID NO: 441541 - DNA, 140 bp, Artificial Sequence
  Synthetic
aggccctggctgctgatatgattgcaaataagagtgagtgcaagacaatgtcatatccagggtaggatctggtgtatcaacatgaactctagagcatgtcaactatggtctgacatgtctgaccttttgggacagcggtg

SEQ ID NO: 441542 - DNA, 140 bp, Artificial Sequence
  Synthetic
caccgctgtcccaaaaggtcagacatgtcagaccatagttgacatgctctagagttcatgttgatacaccagatcctaccctggatatgacattgtcttgcactcactcttatttgcaatcatatcagcagccagggcct

SEQ ID NO: 441543 - DNA, 140 bp, Artificial Sequence
  Synthetic
aggccctggctgctgatatgccagaatggtttctggggccgtgcctcatttccagaagcttcctgacatccgtctaagaccaggtgattttgaatctctaagtggtagagaaaagtctctgaccttttgggacagcggtg

SEQ ID NO: 441544 - DNA, 140 bp, Artificial Sequence
  Synthetic
caccgctgtcccaaaaggtcagagacttttctctaccacttagagattcaaaatcacctggtcttagacggatgtcaggaagcttctggaaatgaggcacggccccagaaaccattctggcatatcagcagccagggcct

SEQ ID NO: 441545 - DNA, 140 bp, Artificial Sequence
  Synthetic
aggccctggctgctgatatgtaaatcagtaagcttcagacgtctaagccacttgagaaaactagttcctgggtttgggaaggcatacaccatattcaacaaaaccctaatggaggccgatgaccttttgggacagcggtg

SEQ ID NO: 441546 - DNA, 140 bp, Artificial Sequence
  Synthetic
caccgctgtcccaaaaggtcatcggcctccattagggttttgttgaatatggtgtatgccttcccaaacccaggaactagttttctcaagtggcttagacgtctgaagcttactgatttacatatcagcagccagggcct

SEQ ID NO: 441547 - DNA, 140 bp, Artificial Sequence
  Synthetic
aggccctggctgctgatatgaaagtttcccctagagattacttgagagggctcgcaagaggagtcttgataggatcctcgatttgcttcttgacaagaatgacaaatatcaaccttaatagaccttttgggacagcggtg

SEQ ID NO: 441548 - DNA, 140 bp, Artificial Sequence
  Synthetic
caccgctgtcccaaaaggtctattaaggttgatatttgtcattcttgtcaagaagcaaatcgaggatcctatcaagactcctcttgcgagccctctcaagtaatctctaggggaaactttcatatcagcagccagggcct

SEQ ID NO: 441549 - DNA, 140 bp, Artificial Sequence
  Synthetic
aggccctggctgctgatatgaggatcctcgatttgcttcttgacaagaatgacaaatatcaaccttaatagacctcttgaattgatctcaggggtaatttcatatatcctcctgaggctagaccttttgggacagcggtg

SEQ ID NO: 441550 - DNA, 140 bp, Artificial Sequence
  Synthetic
caccgctgtcccaaaaggtctagcctcaggaggatatatgaaattacccctgagatcaattcaagaggtctattaaggttgatatttgtcattcttgtcaagaagcaaatcgaggatcctcatatcagcagccagggcct

SEQ ID NO: 441551 - DNA, 140 bp, Artificial Sequence
  Synthetic
aggccctggctgctgatatggacctcttgaattgatctcaggggtaatttcatatatcctcctgaggctagataatcacccatccttgtacataatgctcagagaaccgtctcttagagagaccttttgggacagcggtg

SEQ ID NO: 441552 - DNA, 140 bp, Artificial Sequence
  Synthetic
caccgctgtcccaaaaggtctctctaagagacggttctctgagcattatgtacaaggatgggtgattatctagcctcaggaggatatatgaaattacccctgagatcaattcaagaggtccatatcagcagccagggcct

SEQ ID NO: 441553 - DNA, 140 bp, Artificial Sequence
  Synthetic
atacgccatgctgggtctccatgtcacaaccactttcaaaagaaagcatttccgcccaacgccagatgcatgtagagccgcgtacaactggaagatggccggcgaccccagatatgaggacgtacttgggagtcggccat

SEQ ID NO: 441554 - DNA, 140 bp, Artificial Sequence
  Synthetic
atggccgactcccaagtacgtcctcatatctggggtcgccggccatcttccagttgtacgcggctctacatgcatctggcgttgggcggaaatgctttcttttgaaagtggttgtgacatggagacccagcatggcgtat

SEQ ID NO: 441555 - DNA, 140 bp, Artificial Sequence
  Synthetic
atacgccatgctgggtctccaatgcaattttttgagggaacatgccctgaggactggaccagttatggaatcctgattgcacgaaaaggagacaagatcacccctgattcccttgtagatcgtacttgggagtcggccat

SEQ ID NO: 441556 - DNA, 140 bp, Artificial Sequence
  Synthetic
atggccgactcccaagtacgatctacaagggaatcaggggtgatcttgtctccttttcgtgcaatcaggattccataactggtccagtcctcagggcatgttccctcaaaaaattgcattggagacccagcatggcgtat

SEQ ID NO: 441557 - DNA, 140 bp, Artificial Sequence
  Synthetic
aggccctggctgctgatatgccgtacgacaagtccctccactcaagggtcttccctagcgggaagtgcttgggaataacggtatcttccacctactgctcaactaatcatgattacaccggaccttttgggacagcggtg

SEQ ID NO: 441558 - DNA, 140 bp, Artificial Sequence
  Synthetic
caccgctgtcccaaaaggtccggtgtaatcatgattagttgagcagtaggtggaagataccgttattcccaagcacttcccgctagggaagacccttgagtggagggacttgtcgtacggcatatcagcagccagggcct

SEQ ID NO: 441559 - DNA, 140 bp, Artificial Sequence
  Synthetic
aggccctggctgctgatatgggatgagagaggctggtataagtcttggaagggagcatgtaaacttaagttatgtggagttcttggacttagacttatagatggaacatggatagcaatggaccttttgggacagcggtg

SEQ ID NO: 441560 - DNA, 140 bp, Artificial Sequence
  Synthetic
caccgctgtcccaaaaggtccattgctatccatgttccatctataagtctaagtccaagaactccacataacttaagtttacatgctcccttccaagacttataccagcctctctcatcccatatcagcagccagggcct

SEQ ID NO: 441561 - DNA, 140 bp, Artificial Sequence
  Synthetic
atacgccatgctgggtctcccaagacaggatgttcagaatgggtctgctctgcccaacaagttgcagtctccacctcagcaaacccagctcccgtctcagagcttgacgtcagggccctccgtacttgggagtcggccat

SEQ ID NO: 441562 - DNA, 140 bp, Artificial Sequence
  Synthetic
atggccgactcccaagtacggagggccctgacgtcaagctctgagacgggagctgggtttgctgaggtggagactgcaacttgttgggcagagcagacccattctgaacatcctgtcttgggagacccagcatggcgtat

SEQ ID NO: 441563 - DNA, 140 bp, Artificial Sequence
  Synthetic
atacgccatgctgggtctccttttcccgtccctctgtcttgtagttggggacgggtcaggggggatatcaagggcagttctcaacatgtttccagatgctaagcttgtgttcaacagcctcgtacttgggagtcggccat

SEQ ID NO: 441564 - DNA, 140 bp, Artificial Sequence
  Synthetic
atggccgactcccaagtacgaggctgttgaacacaagcttagcatctggaaacatgttgagaactgcccttgatatcccccctgacccgtccccaactacaagacagagggacgggaaaaggagacccagcatggcgtat

SEQ ID NO: 441565 - DNA, 140 bp, Artificial Sequence
  Synthetic
aggccctggctgctgatatgtactcccatccttcgatcagtcatttttttcacgaggtcccctaaagggatacttgggctcgtccacctctatgtcaacccagctattccatgcatgggagaccttttgggacagcggtg

SEQ ID NO: 441566 - DNA, 140 bp, Artificial Sequence
  Synthetic
caccgctgtcccaaaaggtctcccatgcatggaatagctgggttgacatagaggtggacgagcccaagtatccctttaggggacctcgtgaaaaaaatgactgatcgaaggatgggagtacatatcagcagccagggcct

SEQ ID NO: 441567 - DNA, 140 bp, Artificial Sequence
  Synthetic
atacgccatgctgggtctcccagcaatcatgagtggaggagatgacatcgtttccagagtgatagattttgactccatctgggagaaaccgtccgacctaagaaatttggccacctggagcgtacttgggagtcggccat

SEQ ID NO: 441568 - DNA, 140 bp, Artificial Sequence
  Synthetic
atggccgactcccaagtacgctccaggtggccaaatttcttaggtcggacggtttctcccagatggagtcaaaatctatcactctggaaacgatgtcatctcctccactcatgattgctgggagacccagcatggcgtat

SEQ ID NO: 441569 - DNA, 140 bp, Artificial Sequence
  Synthetic
aggccctggctgctgatatgtaatggtataatactggggcccgacggccatgttctaatcccagagatgcaatcatctctcctccagcaacatatggagttgttggagtcctcggtcatcgaccttttgggacagcggtg

SEQ ID NO: 441570 - DNA, 140 bp, Artificial Sequence
  Synthetic
caccgctgtcccaaaaggtcgatgaccgaggactccaacaactccatatgttgctggaggagagatgattgcatctctgggattagaacatggccgtcgggccccagtattataccattacatatcagcagccagggcct

SEQ ID NO: 441571 - DNA, 140 bp, Artificial Sequence
  Synthetic
aggccctggctgctgatatgttaatgtctgattttgcattgtctatagacggaccactttgcttggtcttcaaaacttacgggactatgctagtaaacccggactataaggctatccaacgaccttttgggacagcggtg

SEQ ID NO: 441572 - DNA, 140 bp, Artificial Sequence
  Synthetic
caccgctgtcccaaaaggtcgttggatagccttatagtccgggtttactagcatagtcccgtaagttttgaagaccaagcaaagtggtccgtctatagacaatgcaaaatcagacattaacatatcagcagccagggcct

SEQ ID NO: 441573 - DNA, 140 bp, Artificial Sequence
  Synthetic
aggccctggctgctgatatgtttcaggggtcgacctgggtctcccaaactgggggaagtacttgttaatgagtgtaggggtcttgattgccttgatgttgataatttttctaatgacatggaccttttgggacagcggtg

SEQ ID NO: 441574 - DNA, 140 bp, Artificial Sequence
  Synthetic
caccgctgtcccaaaaggtccatgtcattagaaaaattatcaacatcaaggcaatcaagacccctacactcattaacaagtacttcccccagtttgggagacccaggtcgacccctgaaacatatcagcagccagggcct

SEQ ID NO: 441575 - DNA, 140 bp, Artificial Sequence
  Synthetic
aggccctggctgctgatatgtgggagtcctataaaagtggaggcgatactagactgtgaggaccgtttatcctttcgacacctcagatcctgaaaatcaccttcccccgggggttggagggaccttttgggacagcggtg

SEQ ID NO: 441576 - DNA, 140 bp, Artificial Sequence
  Synthetic
caccgctgtcccaaaaggtccctccaacccccgggggaaggtgattttcaggatctgaggtgtcgaaaggataaacggtcctcacagtctagtatcgcctccacttttataggactcccacatatcagcagccagggcct

SEQ ID NO: 441577 - DNA, 140 bp, Artificial Sequence
  Synthetic
aggccctggctgctgatatgtgatttccctttggctgtacggtgctcactctgaatcaaacaggagccggaagtgtataacagacttggctcaattctattccaagtcttcccccatagagaccttttgggacagcggtg

SEQ ID NO: 441578 - DNA, 140 bp, Artificial Sequence
  Synthetic
caccgctgtcccaaaaggtctctatgggggaagacttggaatagaattgagccaagtctgttatacacttccggctcctgtttgattcagagtgagcaccgtacagccaaagggaaatcacatatcagcagccagggcct

SEQ ID NO: 441579 - DNA, 140 bp, Artificial Sequence
  Synthetic
atacgccatgctgggtctccccaggtgattttgaatctctaagtggtagagaaaagtctcgccatatagggtcagctcaaggactcttgtactcaatcttagtggcaattcacgactcagcgtacttgggagtcggccat

SEQ ID NO: 441580 - DNA, 140 bp, Artificial Sequence
  Synthetic
atggccgactcccaagtacgctgagtcgtgaattgccactaagattgagtacaagagtccttgagctgaccctatatggcgagacttttctctaccacttagagattcaaaatcacctggggagacccagcatggcgtat

SEQ ID NO: 441581 - DNA, 140 bp, Artificial Sequence
  Synthetic
aggccctggctgctgatatgcttttctagtccacaagatggtagacgatcttgagttgcagaggagaactctatctaaagtggctatcattatagccatcatgatagttttctccaacaggaccttttgggacagcggtg

SEQ ID NO: 441582 - DNA, 140 bp, Artificial Sequence
  Synthetic
caccgctgtcccaaaaggtcctgttggagaaaactatcatgatggctataatgatagccactttagatagagttctcctctgcaactcaagatcgtctaccatcttgtggactagaaaagcatatcagcagccagggcct

SEQ ID NO: 441583 - DNA, 140 bp, Artificial Sequence
  Synthetic
aggccctggctgctgatatggttatgtagattctcataatgagggaaatcttctcacagtttcagtgaccaacggtgctctcattctccaggaactgataccaaaggttgtaggcaggccgaccttttgggacagcggtg

SEQ ID NO: 441584 - DNA, 140 bp, Artificial Sequence
  Synthetic
caccgctgtcccaaaaggtcggcctgcctacaacctttggtatcagttcctggagaatgagagcaccgttggtcactgaaactgtgagaagatttccctcattatgagaatctacataaccatatcagcagccagggcct

SEQ ID NO: 441585 - DNA, 140 bp, Artificial Sequence
  Synthetic
aggccctggctgctgatatgcctagagattatttgagagggcttgcgagaggagtcttgataggatcctcgatttgcttcttgacaagaatgacaaatatcaacattaatagacctcttggaccttttgggacagcggtg

SEQ ID NO: 441586 - DNA, 140 bp, Artificial Sequence
  Synthetic
caccgctgtcccaaaaggtccaagaggtctattaatgttgatatttgtcattcttgtcaagaagcaaatcgaggatcctatcaagactcctctcgcaagccctctcaaataatctctaggcatatcagcagccagggcct

SEQ ID NO: 441587 - DNA, 140 bp, Artificial Sequence
  Synthetic
aggccctggctgctgatatgctcccatgaaggacataagcaatagctcatagccatcctgcatctctacaaagcgtgcataactagaaagggctgggtcatctaagcttttctgtcgagagaccttttgggacagcggtg

SEQ ID NO: 441588 - DNA, 140 bp, Artificial Sequence
  Synthetic
caccgctgtcccaaaaggtctctcgacagaaaagcttagatgacccagccctttctagttatgcacgctttgtagagatgcaggatggctatgagctattgcttatgtccttcatgggagcatatcagcagccagggcct

SEQ ID NO: 441589 - DNA, 140 bp, Artificial Sequence
  Synthetic
aggccctggctgctgatatgaaaaaactgtagattaaaagagcaactagcaacacttctcatcttgagacccacatcaaaatgctagatccaggagaagtctatgatgatcctattgatcgaccttttgggacagcggtg

SEQ ID NO: 441590 - DNA, 140 bp, Artificial Sequence
  Synthetic
caccgctgtcccaaaaggtcgatcaataggatcatcatagacttctcctggatctagcattttgatgtgggtctcaagatgagaagtgttgctagttgctcttttaatctacagttttttcatatcagcagccagggcct

SEQ ID NO: 441591 - DNA, 140 bp, Artificial Sequence
  Synthetic
aggccctggctgctgatatgaacctgcgacaaatgagttctttgatgaggcaggtgctgggtgggcacggagaagataccttagagtccgacgacgacattcaaagattgctaaaagactgaccttttgggacagcggtg

SEQ ID NO: 441592 - DNA, 140 bp, Artificial Sequence
  Synthetic
caccgctgtcccaaaaggtcagtcttttagcaatctttgaatgtcgtcgtcggactctaaggtatcttctccgtgcccacccagcacctgcctcatcaaagaactcatttgtcgcaggttcatatcagcagccagggcct

SEQ ID NO: 441593 - DNA, 140 bp, Artificial Sequence
  Synthetic
aggccctggctgctgatatgcctcctatcaaccccagagaattcttgaaatctatagaccttggaggattgccggatgaggatttgataattggcctcaaaccgaaagaaagggagctgagaccttttgggacagcggtg

SEQ ID NO: 441594 - DNA, 140 bp, Artificial Sequence
  Synthetic
caccgctgtcccaaaaggtctcagctccctttctttcggtttgaggccaattatcaaatcctcatccggcaatcctccaaggtctatagatttcaagaattctctggggttgataggaggcatatcagcagccagggcct

SEQ ID NO: 441595 - DNA, 140 bp, Artificial Sequence
  Synthetic
aggccctggctgctgatatgggagatgtataaccgatttggcccatttctattccaagtcatcccccatagagaagctgttaaattgtacgctagggaatagaggactgaggatacccccgaccttttgggacagcggtg

SEQ ID NO: 441596 - DNA, 140 bp, Artificial Sequence
  Synthetic
caccgctgtcccaaaaggtcgggggtatcctcagtcctctattccctagcgtacaatttaacagcttctctatgggggatgacttggaatagaaatgggccaaatcggttatacatctcccatatcagcagccagggcct

SEQ ID NO: 441597 - DNA, 140 bp, Artificial Sequence
  Synthetic
atacgccatgctgggtctccgagaagctgttaaattgtacgctagggaatagaggactgaggatacccccagagggggtgttgaattgccttgaaagggtcgactacgataaggcatttgcgtacttgggagtcggccat

SEQ ID NO: 441598 - DNA, 140 bp, Artificial Sequence
  Synthetic
atggccgactcccaagtacgcaaatgccttatcgtagtcgaccctttcaaggcaattcaacaccccctctgggggtatcctcagtcctctattccctagcgtacaatttaacagcttctcggagacccagcatggcgtat

SEQ ID NO: 441599 - DNA, 140 bp, Artificial Sequence
  Synthetic
aggccctggctgctgatatgcttaacatgtttccagatgctaagcttgtgttcaacagcctcttagaggtgaatgatctgatggcttccggaacacatccattgcctccttcagcaatcagaccttttgggacagcggtg

SEQ ID NO: 441600 - DNA, 140 bp, Artificial Sequence
  Synthetic
caccgctgtcccaaaaggtctgattgctgaaggaggcaatggatgtgttccggaagccatcagatcattcacctctaagaggctgttgaacacaagcttagcatctggaaacatgttaagcatatcagcagccagggcct

SEQ ID NO: 441601 - DNA, 140 bp, Artificial Sequence
  Synthetic
aggccctggctgctgatatgtataagacaaacattgcagataggatagagcagatttttgagactgccccttttgtcaaaattgtggaacaccatactctaatgacgactcacaaaatgtgaccttttgggacagcggtg

SEQ ID NO: 441602 - DNA, 140 bp, Artificial Sequence
  Synthetic
caccgctgtcccaaaaggtcacattttgtgagtcgtcattagagtatggtgttccacaattttgacaaaaggggcagtctcaaaaatctgctctatcctatctgcaatgtttgtcttatacatatcagcagccagggcct

SEQ ID NO: 441603 - DNA, 140 bp, Artificial Sequence
  Synthetic
atacgccatgctgggtctccaaaagttcaggcctcttattcattcattgggagactttcctgtatttataaaagacagggtgagtcagcttgaagggactttcggtcctagtgcgaagagcgtacttgggagtcggccat

SEQ ID NO: 441604 - DNA, 140 bp, Artificial Sequence
  Synthetic
atggccgactcccaagtacgctcttcgcactaggaccgaaagtcccttcaagctgactcaccctgtcttttataaatacaggaaagtctcccaatgaatgaataagaggcctgaacttttggagacccagcatggcgtat

SEQ ID NO: 441605 - DNA, 140 bp, Artificial Sequence
  Synthetic
aggccctggctgctgatatgggtctgtcgaaactctatgatcaagttcatattaagaaagtgatagacaagtcataccaggagtgtctagcaagcgacttagccaggaggatcctcagatgaccttttgggacagcggtg

SEQ ID NO: 441606 - DNA, 140 bp, Artificial Sequence
  Synthetic
caccgctgtcccaaaaggtcatctgaggatcctcctggctaagtcgcttgctagacactcctggtatgacttgtctatcactttcttaatatgaacttgatcatagagtttcgacagacccatatcagcagccagggcct

SEQ ID NO: 441607 - DNA, 140 bp, Artificial Sequence
  Synthetic
aggccctggctgctgatatggacatgtttttctcccggattgaacatctgtattcagctattagagtaggtacagttgtcactgcttatgaagactgctcagggctagtatcgtttacgggaccttttgggacagcggtg

SEQ ID NO: 441608 - DNA, 140 bp, Artificial Sequence
  Synthetic
caccgctgtcccaaaaggtcccgtaaacgatactagccctgagcagtcttcataagcagtgacaactgtacctactctaatagctgaatacagatgttcaatccgggagaaaaacatgtccatatcagcagccagggcct

SEQ ID NO: 441609 - DNA, 140 bp, Artificial Sequence
  Synthetic
aggccctggctgctgatatggacagttattgctgcatgcgctcctcatgagatgtcggttctagggggctatctaggagaggagttcttcgggaaaggaacattcgaaagaagattcttcgaccttttgggacagcggtg

SEQ ID NO: 441610 - DNA, 140 bp, Artificial Sequence
  Synthetic
caccgctgtcccaaaaggtcgaagaatcttctttcgaatgttcctttcccgaagaactcctctcctagatagccccctagaaccgacatctcatgaggagcgcatgcagcaataactgtccatatcagcagccagggcct

SEQ ID NO: 441611 - DNA, 140 bp, Artificial Sequence
  Synthetic
aggccctggctgctgatatgagagactgctgttcctcattcctatttcatccacttccgttcattaggcctaagtggaaagtcaccatactcatcaaatgcagttggtcacgtgttcaatgaccttttgggacagcggtg

SEQ ID NO: 441612 - DNA, 140 bp, Artificial Sequence
  Synthetic
caccgctgtcccaaaaggtcattgaacacgtgaccaactgcatttgatgagtatggtgactttccacttaggcctaatgaacggaagtggatgaaataggaatgaggaacagcagtctctcatatcagcagccagggcct

SEQ ID NO: 441613 - DNA, 140 bp, Artificial Sequence
  Synthetic
aggccctggctgctgatatgacatatagtagacttggtgggggatacctggcacaagctcccgatcacgcagatttttgaaattcccgaatcaatggacccatcagaaatactggatgacgaccttttgggacagcggtg

SEQ ID NO: 441614 - DNA, 140 bp, Artificial Sequence
  Synthetic
caccgctgtcccaaaaggtcgtcatccagtatttctgatgggtccattgattcgggaatttcaaaaatctgcgtgatcgggagcttgtgccaggtatcccccaccaagtctactatatgtcatatcagcagccagggcct

SEQ ID NO: 441615 - DNA, 140 bp, Artificial Sequence
  Synthetic
atacgccatgctgggtctccaaatcctgaggcacttcaacatttgttgcagtactatgatgtatctatctaccgctttaggcgacgtccctagcttcgcaagacttcacgacctgtataacgtacttgggagtcggccat

SEQ ID NO: 441616 - DNA, 140 bp, Artificial Sequence
  Synthetic
atggccgactcccaagtacgttatacaggtcgtgaagtcttgcgaagctagggacgtcgcctaaagcggtagatagatacatcatagtactgcaacaaatgttgaagtgcctcaggatttggagacccagcatggcgtat

SEQ ID NO: 441617 - DNA, 140 bp, Artificial Sequence
  Synthetic
atacgccatgctgggtctccaccgctttaggcgacgtccctagcttcgcaagacttcacgacctgtataacagacctataacttattacttcagaaagcaagtcattcgagggaatatttcgtacttgggagtcggccat

SEQ ID NO: 441618 - DNA, 140 bp, Artificial Sequence
  Synthetic
atggccgactcccaagtacgaaatattccctcgaatgacttgctttctgaagtaataagttataggtctgttatacaggtcgtgaagtcttgcgaagctagggacgtcgcctaaagcggtggagacccagcatggcgtat

SEQ ID NO: 441619 - DNA, 140 bp, Artificial Sequence
  Synthetic
atacgccatgctgggtctcccagacctataacttattacttcagaaagcaagtcattcgagggaatatttatctatcttggagttggtctgacgacacctcagtgttcaagagagtagcccgtacttgggagtcggccat

SEQ ID NO: 441620 - DNA, 140 bp, Artificial Sequence
  Synthetic
atggccgactcccaagtacgggctactctcttgaacactgaggtgtcgtcagaccaactccaagatagataaatattccctcgaatgacttgctttctgaagtaataagttataggtctgggagacccagcatggcgtat

SEQ ID NO: 441621 - DNA, 140 bp, Artificial Sequence
  Synthetic
aggccctggctgctgatatgatgaacggaggtcgactaaagagatcgcacataaggagatacgtttctgtcagctctaatcatcaagcccgtccaaactcatttgccgagtttctaaacagaccttttgggacagcggtg

SEQ ID NO: 441622 - DNA, 140 bp, Artificial Sequence
  Synthetic
caccgctgtcccaaaaggtctgtttagaaactcggcaaatgagtttggacgggcttgatgattagagctgacagaaacgtatctccttatgtgcgatctctttagtcgacctccgttcatcatatcagcagccagggcct

SEQ ID NO: 441623 - DNA, 140 bp, Artificial Sequence
  Synthetic
aggccctggctgctgatatgcgaaacatagaagacaatcaggctcatctccaaggggaacccatagaagtggacaatctccctgaggacatgaggcgacttcatttggacgatggtaaatgaccttttgggacagcggtg

SEQ ID NO: 441624 - DNA, 140 bp, Artificial Sequence
  Synthetic
caccgctgtcccaaaaggtcatttaccatcgtccaaatgaagtcgcctcatgtcctcagggagattgtccacttctatgggttccccttggagatgagcctgattgtcttctatgtttcgcatatcagcagccagggcct

SEQ ID NO: 441625 - DNA, 140 bp, Artificial Sequence
  Synthetic
atacgccatgctgggtctccgattcctcaagatatggtcgcagactgtagaggagattatatcctatgtcacggtcaactttcctaacccttcaggaaggtcttcagaggataaatcaaccgtacttgggagtcggccat

SEQ ID NO: 441626 - DNA, 140 bp, Artificial Sequence
  Synthetic
atggccgactcccaagtacggttgatttatcctctgaagaccttcctgaagggttaggaaagttgaccgtgacataggatataatctcctctacagtctgcgaccatatcttgaggaatcggagacccagcatggcgtat

SEQ ID NO: 441627 - DNA, 140 bp, Artificial Sequence
  Synthetic
aggccctggctgctgatatgattgcaaataagagtgagtgcaagacaatgtcatattcagggcagactctggtgtatcaacatgaactcgcgagcatgtcaactatggtctgacatgtctgaccttttgggacagcggtg

SEQ ID NO: 441628 - DNA, 140 bp, Artificial Sequence
  Synthetic
caccgctgtcccaaaaggtcagacatgtcagaccatagttgacatgctcgcgagttcatgttgatacaccagagtctgccctgaatatgacattgtcttgcactcactcttatttgcaatcatatcagcagccagggcct

SEQ ID NO: 441629 - DNA, 140 bp, Artificial Sequence
  Synthetic
aggccctggctgctgatatgcaggttctgtgtccgacatacatgctgtcgcctggattgtctcaagaggggctcctttatgagttagagagcatatcaaggaatgctctttcaatataccgaccttttgggacagcggtg

SEQ ID NO: 441630 - DNA, 140 bp, Artificial Sequence
  Synthetic
caccgctgtcccaaaaggtcggtatattgaaagagcattccttgatatgctctctaactcataaaggagcccctcttgagacaatccaggcgacagcatgtatgtcggacacagaacctgcatatcagcagccagggcct

SEQ ID NO: 441631 - DNA, 140 bp, Artificial Sequence
  Synthetic
atacgccatgctgggtctccagtagaggctgagatcgctcaccagattgctgaaagcttttccaagaagtacaagtttccctctcgatcctcagggatattcttgtataattttgagcagcgtacttgggagtcggccat

SEQ ID NO: 441632 - DNA, 140 bp, Artificial Sequence
  Synthetic
atggccgactcccaagtacgctgctcaaaattatacaagaatatccctgaggatcgagagggaaacttgtacttcttggaaaagctttcagcaatctggtgagcgatctcagcctctactggagacccagcatggcgtat

SEQ ID NO: 441633 - DNA, 140 bp, Artificial Sequence
  Synthetic
aggccctggctgctgatatgtggggtgggttgccttggccaattctaagaaattccaattgttagtcgaacccgacaaactaaataaaatcatgcaagatgatttgaatcgctatgcatcgaccttttgggacagcggtg

SEQ ID NO: 441634 - DNA, 140 bp, Artificial Sequence
  Synthetic
caccgctgtcccaaaaggtcgatgcatagcgattcaaatcatcttgcatgattttatttagtttgtcgggttcgactaacaattggaatttcttagaattggccaaggcaacccaccccacatatcagcagccagggcct

SEQ ID NO: 441635 - DNA, 140 bp, Artificial Sequence
  Synthetic
aggccctggctgctgatatggtgtgacccgtttagctcatgatggatctaaactccctctaagatgtgtactggggtgggttgctctggctaactctaagaagttccagctattagttgagaccttttgggacagcggtg

SEQ ID NO: 441636 - DNA, 140 bp, Artificial Sequence
  Synthetic
caccgctgtcccaaaaggtctcaactaatagctggaacttcttagagttagccagagcaacccaccccagtacacatcttagagggagtttagatccatcatgagctaaacgggtcacaccatatcagcagccagggcct

SEQ ID NO: 441637 - DNA, 140 bp, Artificial Sequence
  Synthetic
atacgccatgctgggtctcctgtggactttgatgatgtatgaagcatttttatagtatcagcgactaatggtgctctcaccctctaaggactggtaccaaaggttgtggacaagctgacccgtacttgggagtcggccat

SEQ ID NO: 441638 - DNA, 140 bp, Artificial Sequence
  Synthetic
atggccgactcccaagtacgggtcagcttgtccacaacctttggtaccagtccttagagggtgagagcaccattagtcgctgatactataaaaatgcttcatacatcatcaaagtccacaggagacccagcatggcgtat

SEQ ID NO: 441639 - DNA, 140 bp, Artificial Sequence
  Synthetic
aggccctggctgctgatatgctttctacgcaagatagtgaaaaactgtagggatgaggacactcaaaagtcctctcctgtgtcagctcccccagatgatgatgatctgtggcttcctcccgaccttttgggacagcggtg

SEQ ID NO: 441640 - DNA, 140 bp, Artificial Sequence
  Synthetic
caccgctgtcccaaaaggtcgggaggaagccacagatcatcatcatctgggggagctgacacaggagaggacttttgagtgtcctcatccctacagtttttcactatcttgcgtagaaagcatatcagcagccagggcct

SEQ ID NO: 441641 - DNA, 140 bp, Artificial Sequence
  Synthetic
aggccctggctgctgatatgccggaatatgtcccgctgaaggaactcacaagcaagaagaacatgaggaacttttgcatcaactgggaggtcaaagtgtgtagcccgaatggttactcgtgaccttttgggacagcggtg

SEQ ID NO: 441642 - DNA, 140 bp, Artificial Sequence
  Synthetic
caccgctgtcccaaaaggtcacgagtaaccattcgggctacacactttgacctcccagttgatgcaaaagttcctcatgttcttcttgcttgtgagttccttcagcgggacatattccggcatatcagcagccagggcct

SEQ ID NO: 441643 - DNA, 140 bp, Artificial Sequence
  Synthetic
aggccctggctgctgatatgtactcttcttaaaatctattgaacctctatttcctcgattcctcagtgagctctttagttcgtctttcttgggaatccccgagtcgatcatcggactgatgaccttttgggacagcggtg

SEQ ID NO: 441644 - DNA, 140 bp, Artificial Sequence
  Synthetic
caccgctgtcccaaaaggtcatcagtccgatgatcgactcggggattcccaagaaagacgaactaaagagctcactgaggaatcgaggaaatagaggttcaatagattttaagaagagtacatatcagcagccagggcct

SEQ ID NO: 441645 - DNA, 140 bp, Artificial Sequence
  Synthetic
atacgccatgctgggtctcctttcggagcatgcatctttggttggtcttctcttgagtctgtataggttgagcaaaatatctggacagaacaccggcaattacaagacaaacatcgcagacgtacttgggagtcggccat

SEQ ID NO: 441646 - DNA, 140 bp, Artificial Sequence
  Synthetic
atggccgactcccaagtacgtctgcgatgtttgtcttgtaattgccggtgttctgtccagatattttgctcaacctatacagactcaagagaagaccaaccaaagatgcatgctccgaaaggagacccagcatggcgtat

SEQ ID NO: 441647 - DNA, 140 bp, Artificial Sequence
  Synthetic
atacgccatgctgggtctccatcatactttgatgacaacccacaaaatgtgcgctaactggagtaccataccgaacttcagattcctagccgggacctatgacatgtttttctcccggatcgtacttgggagtcggccat

SEQ ID NO: 441648 - DNA, 140 bp, Artificial Sequence
  Synthetic
atggccgactcccaagtacgatccgggagaaaaacatgtcataggtcccggctaggaatctgaagttcggtatggtactccagttagcgcacattttgtgggttgtcatcaaagtatgatggagacccagcatggcgtat

SEQ ID NO: 441649 - DNA, 140 bp, Artificial Sequence
  Synthetic
aggccctggctgctgatatgccgaacttcagattcctagccgggacctatgacatgtttttctcccggattgaacatctatattcagcgattagagtgggcacagttgtcactgcttatggaccttttgggacagcggtg

SEQ ID NO: 441650 - DNA, 140 bp, Artificial Sequence
  Synthetic
caccgctgtcccaaaaggtccataagcagtgacaactgtgcccactctaatcgctgaatatagatgttcaatccgggagaaaaacatgtcataggtcccggctaggaatctgaagttcggcatatcagcagccagggcct

SEQ ID NO: 441651 - DNA, 140 bp, Artificial Sequence
  Synthetic
aggccctggctgctgatatgagcttggtccctggagcccgattgacatacatcatctcagctgtccaaacaacttggttgtagaggacgaaggatgcaccaacctgtcggagttctcctagaccttttgggacagcggtg

SEQ ID NO: 441652 - DNA, 140 bp, Artificial Sequence
  Synthetic
caccgctgtcccaaaaggtctaggagaactccgacaggttggtgcatccttcgtcctctacaaccaagttgtttggacagctgagatgatgtatgtcaatcgggctccagggaccaagctcatatcagcagccagggcct

SEQ ID NO: 441653 - DNA, 140 bp, Artificial Sequence
  Synthetic
atacgccatgctgggtctcctcatcaaatgcagttggtcatgtgttcaacctcattcactttgttggatgttatatgggtcaggtgagatctctgaatgcaacagtgattgccacatgtgcgtacttgggagtcggccat

SEQ ID NO: 441654 - DNA, 140 bp, Artificial Sequence
  Synthetic
atggccgactcccaagtacgcacatgtggcaatcactgttgcattcagagatctcacctgacccatataacatccaacaaagtgaatgaggttgaacacatgaccaactgcatttgatgaggagacccagcatggcgtat

SEQ ID NO: 441655 - DNA, 140 bp, Artificial Sequence
  Synthetic
atacgccatgctgggtctccccccacatgagatgtctgttcttgggggttatttgggggaggagttttttggaaaagggacttttgagagaagattcttcagggacgagaaagaacttcacgtacttgggagtcggccat

SEQ ID NO: 441656 - DNA, 140 bp, Artificial Sequence
  Synthetic
atggccgactcccaagtacgtgaagttctttctcgtccctgaagaatcttctctcaaaagtcccttttccaaaaaactcctcccccaaataacccccaagaacagacatctcatgtggggggagacccagcatggcgtat

SEQ ID NO: 441657 - DNA, 140 bp, Artificial Sequence
  Synthetic
aggccctggctgctgatatgcccatacgacaaatcccttcactcgagggtcttccctagcggaaagtgctcgggaataacggtgtcttctacctactgctcaactaaccatgattacaccgaccttttgggacagcggtg

SEQ ID NO: 441658 - DNA, 140 bp, Artificial Sequence
  Synthetic
caccgctgtcccaaaaggtcggtgtaatcatggttagttgagcagtaggtagaagacaccgttattcccgagcactttccgctagggaagaccctcgagtgaagggatttgtcgtatgggcatatcagcagccagggcct

SEQ ID NO: 441659 - DNA, 140 bp, Artificial Sequence
  Synthetic
atacgccatgctgggtctccaagatcacacataaggaggtatgtctcagtcagctccaatcatcaagctcgccccaactcattcgccgagtttttaaacaagacatactcgagtgattcgcgtacttgggagtcggccat

SEQ ID NO: 441660 - DNA, 140 bp, Artificial Sequence
  Synthetic
atggccgactcccaagtacgcgaatcactcgagtatgtcttgtttaaaaactcggcgaatgagttggggcgagcttgatgattggagctgactgagacatacctccttatgtgtgatcttggagacccagcatggcgtat

SEQ ID NO: 441661 - DNA, 140 bp, Artificial Sequence
  Synthetic
aggccctggctgctgatatggttcggaaaagcatacaccatattcaataagaccttgatggaggctgatgctcactacaaatcggtccggacttggaacgagatcatcccctctaaaggggaccttttgggacagcggtg

SEQ ID NO: 441662 - DNA, 140 bp, Artificial Sequence
  Synthetic
caccgctgtcccaaaaggtcccctttagaggggatgatctcgttccaagtccggaccgatttgtagtgagcatcagcctccatcaaggtcttattgaatatggtgtatgcttttccgaaccatatcagcagccagggcct

SEQ ID NO: 441663 - DNA, 140 bp, Artificial Sequence
  Synthetic
aggccctggctgctgatatgtagatgaaagaggcttatataagtctctcaaaggagcatgcaaactcaagttatgtggagttcttgggctcagacttatggatggaacatgggtcgcaatgaccttttgggacagcggtg

SEQ ID NO: 441664 - DNA, 140 bp, Artificial Sequence
  Synthetic
caccgctgtcccaaaaggtcattgcgacccatgttccatccataagtctgagcccaagaactccacataacttgagtttgcatgctcctttgagagacttatataagcctctttcatctacatatcagcagccagggcct

SEQ ID NO: 441665 - DNA, 140 bp, Artificial Sequence
  Synthetic
aggccctggctgctgatatgaggcaacagatcgatcttatgttatctccaacatgtgctacgctatgagcgagaggtaatcacagcgtctcctgagaatgactggctgtggatattctcagaccttttgggacagcggtg

SEQ ID NO: 441666 - DNA, 140 bp, Artificial Sequence
  Synthetic
caccgctgtcccaaaaggtctgagaatatccacagccagtcattctcaggagacgctgtgattacctctcgctcatagcgtagcacatgttggagataacataagatcgatctgttgcctcatatcagcagccagggcct

SEQ ID NO: 441667 - DNA, 140 bp, Artificial Sequence
  Synthetic
aggccctggctgctgatatggtgtttaagagttggagagaggtgtcatcctcatgtgaacggggtgttttttaatggtataatactagggcctgacggccatgttctaatcccggaaatggaccttttgggacagcggtg

SEQ ID NO: 441668 - DNA, 140 bp, Artificial Sequence
  Synthetic
caccgctgtcccaaaaggtccatttccgggattagaacatggccgtcaggccctagtattataccattaaaaaacaccccgttcacatgaggatgacacctctctccaactcttaaacaccatatcagcagccagggcct

SEQ ID NO: 441669 - DNA, 140 bp, Artificial Sequence
  Synthetic
aggccctggctgctgatatgataatctgcgacaaatgagttctttgatgaggcaggttctgggtggacacggagaagacactttagagtcagatgacgacattcaacgattgctaaaggagaccttttgggacagcggtg

SEQ ID NO: 441670 - DNA, 140 bp, Artificial Sequence
  Synthetic
caccgctgtcccaaaaggtctcctttagcaatcgttgaatgtcgtcatctgactctaaagtgtcttctccgtgtccacccagaacctgcctcatcaaagaactcatttgtcgcagattatcatatcagcagccagggcct

SEQ ID NO: 441671 - DNA, 140 bp, Artificial Sequence
  Synthetic
atacgccatgctgggtctccgataaggtgggtcaacttgaaggaacatttggccctagtgcaaaaaggttcttcaaggttctggatcaattcgacaacatacacgacttagtctttgtatcgtacttgggagtcggccat

SEQ ID NO: 441672 - DNA, 140 bp, Artificial Sequence
  Synthetic
atggccgactcccaagtacgatacaaagactaagtcgtgtatgttgtcgaattgatccagaaccttgaagaacctttttgcactagggccaaatgttccttcaagttgacccaccttatcggagacccagcatggcgtat

SEQ ID NO: 441673 - DNA, 140 bp, Artificial Sequence
  Synthetic
aggccctggctgctgatatgatgaggctgaggattttgttgaagttcacctccctgatgtgcataaacaggtctcaggggttgacctgggcctcccgaactgggggaagtatgtattagtgaccttttgggacagcggtg

SEQ ID NO: 441674 - DNA, 140 bp, Artificial Sequence
  Synthetic
caccgctgtcccaaaaggtcactaatacatacttcccccagttcgggaggcccaggtcaacccctgagacctgtttatgcacatcagggaggtgaacttcaacaaaatcctcagcctcatcatatcagcagccagggcct

SEQ ID NO: 441675 - DNA, 140 bp, Artificial Sequence
  Synthetic
aggccctggctgctgatatggaaccatgactggaaattacagccctaacaagaaggtgtcccgcaaagcaggatgttcagaatgggtctgctctgctcaacaggttgcagtatccacctcgaccttttgggacagcggtg

SEQ ID NO: 441676 - DNA, 140 bp, Artificial Sequence
  Synthetic
caccgctgtcccaaaaggtcgaggtggatactgcaacctgttgagcagagcagacccattctgaacatcctgctttgcgggacaccttcttgttagggctgtaatttccagtcatggttccatatcagcagccagggcct

SEQ ID NO: 441677 - DNA, 140 bp, Artificial Sequence
  Synthetic
atacgccatgctgggtctccccggaatatgttccgttgaaggagctagcgggcaagaagaatatgagaaacttttgcgttaatggagaagtcaaggtgtgtagcccgaacggctattcatcgtacttgggagtcggccat

SEQ ID NO: 441678 - DNA, 140 bp, Artificial Sequence
  Synthetic
atggccgactcccaagtacgatgaatagccgttcgggctacacaccttgacttctccattaacgcaaaagtttctcatattcttcttgcccgctagctccttcaacggaacatattccggggagacccagcatggcgtat

SEQ ID NO: 441679 - DNA, 140 bp, Artificial Sequence
  Synthetic
aggccctggctgctgatatgacagggaggaaggtgtcggtcacctcccaaagcgggaaggtcatatcttcgtgggagtcatataaaagtggaggtgagaccagactgtgaaagctgacaagaccttttgggacagcggtg

SEQ ID NO: 441680 - DNA, 140 bp, Artificial Sequence
  Synthetic
caccgctgtcccaaaaggtcttgtcagctttcacagtctggtctcacctccacttttatatgactcccacgaagatatgaccttcccgctttgggaggtgaccgacaccttcctccctgtcatatcagcagccagggcct

SEQ ID NO: 441681 - DNA, 140 bp, Artificial Sequence
  Synthetic
aggccctggctgctgatatggttgtagaagagtcagtcgaccagaatctacgcaacgcagtctcggaaggacagggaggaaggtgtcggtcacttcccaaagcgggaaggtcatatcttcgaccttttgggacagcggtg

SEQ ID NO: 441682 - DNA, 140 bp, Artificial Sequence
  Synthetic
caccgctgtcccaaaaggtcgaagatatgaccttcccgctttgggaagtgaccgacaccttcctccctgtccttccgagactgcgttgcgtagattctggtcgactgactcttctacaaccatatcagcagccagggcct

SEQ ID NO: 441683 - DNA, 140 bp, Artificial Sequence
  Synthetic
aggccctggctgctgatatgttcaagagtcatgagactttcattaatcatctcagtcgattagaaatggtcatgtagattctcataatacgggaaatcttctggcagtttcagtgaccaagaccttttgggacagcggtg

SEQ ID NO: 441684 - DNA, 140 bp, Artificial Sequence
  Synthetic
caccgctgtcccaaaaggtcttggtcactgaaactgccagaagatttcccgtattatgagaatctacatgaccatttctaatcgactgagatgattaatgaaagtctcatgactcttgaacatatcagcagccagggcct

SEQ ID NO: 441685 - DNA, 140 bp, Artificial Sequence
  Synthetic
aggccctggctgctgatatggaagctgttgaattgcacacttggaaatagaggactaagaatccctccagagggggtgttaagttgtcttgaaagagttgactatgataaggcatttggagaccttttgggacagcggtg

SEQ ID NO: 441686 - DNA, 140 bp, Artificial Sequence
  Synthetic
caccgctgtcccaaaaggtctccaaatgccttatcatagtcaactctttcaagacaacttaacaccccctctggagggattcttagtcctctatttccaagtgtgcaattcaacagcttccatatcagcagccagggcct

SEQ ID NO: 441687 - DNA, 140 bp, Artificial Sequence
  Synthetic
aggccctggctgctgatatgattttctgatagcagattcaacatggattaattgagaaaggcaatctgccttccatgatgaacacaagcaatagatcataatcatcttacatctctgcaagaccttttgggacagcggtg

SEQ ID NO: 441688 - DNA, 140 bp, Artificial Sequence
  Synthetic
caccgctgtcccaaaaggtcttgcagagatgtaagatgattatgatctattgcttgtgttcatcatggaaggcagattgcctttctcaattaatccatgttgaatctgctatcagaaaatcatatcagcagccagggcct

SEQ ID NO: 441689 - DNA, 140 bp, Artificial Sequence
  Synthetic
aggccctggctgctgatatgcacatcaagatgctagatccaggagaggtctatgatgaccccatagatccagtcgaatcagaggctgaacccagaggagcccccacagtccccaacatttgaccttttgggacagcggtg

SEQ ID NO: 441690 - DNA, 140 bp, Artificial Sequence
  Synthetic
caccgctgtcccaaaaggtcaaatgttggggactgtgggggctcctctgggttcagcctctgattcgactggatctatggggtcatcatagacctctcctggatctagcatcttgatgtgcatatcagcagccagggcct

SEQ ID NO: 441691 - DNA, 140 bp, Artificial Sequence
  Synthetic
aggccctggctgctgatatgtgaggaactctgattacaatctcaactcccctttaatagaagaccctgccagactaatgctagaatggttgaaaacagggaatagaccttaccgaatgacgaccttttgggacagcggtg

SEQ ID NO: 441692 - DNA, 140 bp, Artificial Sequence
  Synthetic
caccgctgtcccaaaaggtcgtcattcggtaaggtctattccctgttttcaaccattctagcattagtctggcagggtcttctattaaaggggagttgagattgtaatcagagttcctcacatatcagcagccagggcct

SEQ ID NO: 441693 - DNA, 140 bp, Artificial Sequence
  Synthetic
atacgccatgctgggtctccatgcatgtcgagctgcttacaactggaagatggccggtgaccccagatatgaagaatctctgcacaatccgtacccggactaccactggctcagaaccgtcgtacttgggagtcggccat

SEQ ID NO: 441694 - DNA, 140 bp, Artificial Sequence
  Synthetic
atggccgactcccaagtacgacggttctgagccagtggtagtccgggtacggattgtgcagagattcttcatatctggggtcaccggccatcttccagttgtaagcagctcgacatgcatggagacccagcatggcgtat

SEQ ID NO: 441695 - DNA, 140 bp, Artificial Sequence
  Synthetic
atacgccatgctgggtctccggaggataaagattcttcagtgcttctggaatagtctaattacatcctaaaaattcctcaattgtttacctctggaggagagagcacatgggcttgactccgtacttgggagtcggccat

SEQ ID NO: 441696 - DNA, 140 bp, Artificial Sequence
  Synthetic
atggccgactcccaagtacggagtcaagcccatgtgctctctcctccagaggtaaacaattgaggaatttttaggatgtaattagactattccagaagcactgaagaatctttatcctccggagacccagcatggcgtat

SEQ ID NO: 441697 - DNA, 140 bp, Artificial Sequence
  Synthetic
aggccctggctgctgatatgaaattcctcaattgtttacctctggaggagagagcacatgggcttgactccaaccctcgggagcaatagaacaaaaatatgttatggtgccgttgaatcggaccttttgggacagcggtg

SEQ ID NO: 441698 - DNA, 140 bp, Artificial Sequence
  Synthetic
caccgctgtcccaaaaggtccgattcaacggcaccataacatatttttgttctattgctcccgagggttggagtcaagcccatgtgctctctcctccagaggtaaacaattgaggaatttcatatcagcagccagggcct

SEQ ID NO: 441699 - DNA, 140 bp, Artificial Sequence
  Synthetic
aggccctggctgctgatatgcaaaattctgaggcacttcaacatatgttgcagtactatgatgtatctatcgacagctttaggcgatgtccctagtttcgcaaaactccacgacttgtatgaccttttgggacagcggtg

SEQ ID NO: 441700 - DNA, 140 bp, Artificial Sequence
  Synthetic
caccgctgtcccaaaaggtcatacaagtcgtggagttttgcgaaactagggacatcgcctaaagctgtcgatagatacatcatagtactgcaacatatgttgaagtgcctcagaattttgcatatcagcagccagggcct

SEQ ID NO: 441701 - DNA, 140 bp, Artificial Sequence
  Synthetic
atacgccatgctgggtctcctatggctgttataggcattgggggcatccttatatagattatagaaagggtctgtcaaagttatatgatcaggttcatatcaagaaggtgatagacaagtcgtacttgggagtcggccat

SEQ ID NO: 441702 - DNA, 140 bp, Artificial Sequence
  Synthetic
atggccgactcccaagtacgacttgtctatcaccttcttgatatgaacctgatcatataactttgacagaccctttctataatctatataaggatgcccccaatgcctataacagccataggagacccagcatggcgtat

SEQ ID NO: 441703 - DNA, 140 bp, Artificial Sequence
  Synthetic
aggccctggctgctgatatggtcgcactctttcaccagaacaagactagcttcctggctatcagagaacagaggggggcctgttcctagtgagaaggtcattatcacagctctgtccaaggaccttttgggacagcggtg

SEQ ID NO: 441704 - DNA, 140 bp, Artificial Sequence
  Synthetic
caccgctgtcccaaaaggtccttggacagagctgtgataatgaccttctcactaggaacaggcccccctctgttctctgatagccaggaagctagtcttgttctggtgaaagagtgcgaccatatcagcagccagggcct

SEQ ID NO: 441705 - DNA, 140 bp, Artificial Sequence
  Synthetic
aggccctggctgctgatatgtaatcccgggagcccatacataccgatactcgtatataatgtatcttgaaaaaaacaagatcttgaatccgagcctctggttgtttgattgttttttttagaccttttgggacagcggtg

SEQ ID NO: 441706 - DNA, 140 bp, Artificial Sequence
  Synthetic
caccgctgtcccaaaaggtctaaaaaaaacaatcaaacaaccagaggctcggattcaagatcttgtttttttcaagatacattatatacgagtatcggtatgtatgggctcccgggattacatatcagcagccagggcct

SEQ ID NO: 441707 - DNA, 140 bp, Artificial Sequence
  Synthetic
aggccctggctgctgatatgttgccggggatcaggtcttgtccatgtgcgggaactccggctatgaagtcatcaaaatactggagccatacgtcgtgaacagcctagtccagagggcagagaccttttgggacagcggtg

SEQ ID NO: 441708 - DNA, 140 bp, Artificial Sequence
  Synthetic
caccgctgtcccaaaaggtctctgccctctggactaggctgttcacgacgtatggctccagtattttgatgacttcatagccggagttcccgcacatggacaagacctgatccccggcaacatatcagcagccagggcct

SEQ ID NO: 441709 - DNA, 140 bp, Artificial Sequence
  Synthetic
aggccctggctgctgatatggaagtttaggcctctcattcactctttgggagactttcctatatttataagagacaaggtgaatcagctcgaagggacttttggtcccagcgcaaaaagggaccttttgggacagcggtg

SEQ ID NO: 441710 - DNA, 140 bp, Artificial Sequence
  Synthetic
caccgctgtcccaaaaggtccctttttgcgctgggaccaaaagtcccttcgagctgattcaccttgtctcttataaatataggaaagtctcccaaagagtgaatgagaggcctaaacttccatatcagcagccagggcct

SEQ ID NO: 441711 - DNA, 140 bp, Artificial Sequence
  Synthetic
aggccctggctgctgatatgcacagttgtcactgcttatgaagactgctcagggctggtatcgtttacagggttcataaaacagattaatctcaccgcaagagaagcaatactatatttcgaccttttgggacagcggtg

SEQ ID NO: 441712 - DNA, 140 bp, Artificial Sequence
  Synthetic
caccgctgtcccaaaaggtcgaaatatagtattgcttctcttgcggtgagattaatctgttttatgaaccctgtaaacgataccagccctgagcagtcttcataagcagtgacaactgtgcatatcagcagccagggcct

SEQ ID NO: 441713 - DNA, 140 bp, Artificial Sequence
  Synthetic
atacgccatgctgggtctcctggggggagtttctggaatgtctctaggaaggttccacatacgtcagttctcagatcccgtttcagaagggttgtccttctggagagaaatctggctaagcgtacttgggagtcggccat

SEQ ID NO: 441714 - DNA, 140 bp, Artificial Sequence
  Synthetic
atggccgactcccaagtacgcttagccagatttctctccagaaggacaacccttctgaaacgggatctgagaactgacgtatgtggaaccttcctagagacattccagaaactccccccaggagacccagcatggcgtat

SEQ ID NO: 441715 - DNA, 140 bp, Artificial Sequence
  Synthetic
aggccctggctgctgatatgtgagggactttctgcttatgtcagtgcaggcagtctttcactacttgttgttccgccccatcttaaagggtagagtctacaaaattctatgtgctgaggggaccttttgggacagcggtg

SEQ ID NO: 441716 - DNA, 140 bp, Artificial Sequence
  Synthetic
caccgctgtcccaaaaggtcccctcagcacatagaattttgtagactctaccctttaagatggggcggaacaacaagtagtgaaagactgcctgcactgacataagcagaaagtccctcacatatcagcagccagggcct

SEQ ID NO: 441717 - DNA, 140 bp, Artificial Sequence
  Synthetic
aggccctggctgctgatatgtcagatcctgtctcagaggggttgtccttctggagagagatctggctgagctctcacgaatcttggattcacgccttgtgtcaggaggcagggaaccctggaccttttgggacagcggtg

SEQ ID NO: 441718 - DNA, 140 bp, Artificial Sequence
  Synthetic
caccgctgtcccaaaaggtccagggttccctgcctcctgacacaaggcgtgaatccaagattcgtgagagctcagccagatctctctccagaaggacaacccctctgagacaggatctgacatatcagcagccagggcct

SEQ ID NO: 441719 - DNA, 140 bp, Artificial Sequence
  Synthetic
atacgccatgctgggtctccaccttcccaagacgggaaagtcatatcttcatgggagttgtacaagagtggaggcgagaccaggctgtgagggcaggtcatcccctccataccttgcgttcgtacttgggagtcggccat

SEQ ID NO: 441720 - DNA, 140 bp, Artificial Sequence
  Synthetic
atggccgactcccaagtacgaacgcaaggtatggaggggatgacctgccctcacagcctggtctcgcctccactcttgtacaactcccatgaagatatgactttcccgtcttgggaaggtggagacccagcatggcgtat

SEQ ID NO: 441721 - DNA, 140 bp, Artificial Sequence
  Synthetic
aggccctggctgctgatatgctcctctatgagttagagagcatatcgaggaatgcactttcaatataccgggctatcgaggaaggagcatctaaactggggctgatcattaagaaggaaggaccttttgggacagcggtg

SEQ ID NO: 441722 - DNA, 140 bp, Artificial Sequence
  Synthetic
caccgctgtcccaaaaggtccttccttcttaatgatcagccccagtttagatgctccttcctcgatagcccggtatattgaaagtgcattcctcgatatgctctctaactcatagaggagcatatcagcagccagggcct

SEQ ID NO: 441723 - DNA, 140 bp, Artificial Sequence
  Synthetic
atacgccatgctgggtctcccatctctaacgaccaaatagtcaacctcgccaatataatgtcgacagtgtccaccaacgcgctaacagtagcacagcactctcaatctttgatcaaaccgcgtacttgggagtcggccat

SEQ ID NO: 441724 - DNA, 140 bp, Artificial Sequence
  Synthetic
atggccgactcccaagtacgcggtttgatcaaagattgagagtgctgtgctactgttagcgcgttggtggacactgtcgacattatattggcgaggttgactatttggtcgttagagatgggagacccagcatggcgtat

SEQ ID NO: 441725 - DNA, 140 bp, Artificial Sequence
  Synthetic
aggccctggctgctgatatgggggaggtttatgatgaccccattgatccgattgagtcagaggctgagccgagagggaaccccaccatccccaacatcttaagaaactctgactacaaccgaccttttgggacagcggtg

SEQ ID NO: 441726 - DNA, 140 bp, Artificial Sequence
  Synthetic
caccgctgtcccaaaaggtcggttgtagtcagagtttcttaagatgttggggatggtggggttccctctcggctcagcctctgactcaatcggatcaatggggtcatcataaacctcccccatatcagcagccagggcct

SEQ ID NO: 441727 - DNA, 140 bp, Artificial Sequence
  Synthetic
aggccctggctgctgatatggggagagctttctcttagccatgtcgaggataatctatttagatccttctttaggaggggtgtccggaatgtctcttggaaggttccacatacgtcagttgaccttttgggacagcggtg

SEQ ID NO: 441728 - DNA, 140 bp, Artificial Sequence
  Synthetic
caccgctgtcccaaaaggtcaactgacgtatgtggaaccttccaagagacattccggacacccctcctaaagaaggatctaaatagattatcctcgacatggctaagagaaagctctccccatatcagcagccagggcct

SEQ ID NO: 441729 - DNA, 140 bp, Artificial Sequence
  Synthetic
atacgccatgctgggtctcctgtggagggaattgacatcagttgatatgggaaaggacttggtcaagtttaaagatcagatatggggacttctgattgtgactaaagacttcatatattccgtacttgggagtcggccat

SEQ ID NO: 441730 - DNA, 140 bp, Artificial Sequence
  Synthetic
atggccgactcccaagtacggaatatatgaagtctttagtcacaatcagaagtccccatatctgatctttaaacttgaccaagtcctttcccatatcaactgatgtcaattccctccacaggagacccagcatggcgtat

SEQ ID NO: 441731 - DNA, 140 bp, Artificial Sequence
  Synthetic
aggccctggctgctgatatggctctcacgagtcctggattcacgcgttgtgtcaagaggccgggaacccagatctcggagagcgaacactcgacagtttcactcgtcttctagaggatccgaccttttgggacagcggtg

SEQ ID NO: 441732 - DNA, 140 bp, Artificial Sequence
  Synthetic
caccgctgtcccaaaaggtcggatcctctagaagacgagtgaaactgtcgagtgttcgctctccgagatctgggttcccggcctcttgacacaacgcgtgaatccaggactcgtgagagccatatcagcagccagggcct

SEQ ID NO: 441733 - DNA, 140 bp, Artificial Sequence
  Synthetic
aggccctggctgctgatatgtccgtaagtacagacaccatgtctgatttgacccaggacgggaagaactatgatttcatgttccagcccttgatgctttatgcgcagacatggacatccggaccttttgggacagcggtg

SEQ ID NO: 441734 - DNA, 140 bp, Artificial Sequence
  Synthetic
caccgctgtcccaaaaggtccggatgtccatgtctgcgcataaagcatcaagggctggaacatgaaatcatagttcttcccgtcctgggtcaaatcagacatggtgtctgtacttacggacatatcagcagccagggcct

SEQ ID NO: 441735 - DNA, 140 bp, Artificial Sequence
  Synthetic
aggccctggctgctgatatgtcagttctattccaagtcttcccccatagagagactgttaaactgcacactcggaaatagagggctgagaatccccccagaaggggtcctaagttgtcttgaccttttgggacagcggtg

SEQ ID NO: 441736 - DNA, 140 bp, Artificial Sequence
  Synthetic
caccgctgtcccaaaaggtcaagacaacttaggaccccttctggggggattctcagccctctatttccgagtgtgcagtttaacagtctctctatgggggaagacttggaatagaactgacatatcagcagccagggcct

SEQ ID NO: 441737 - DNA, 140 bp, Artificial Sequence
  Synthetic
aggccctggctgctgatatgtacaagacaaacatcgcggatagaatagagcagattttcgagacagccccctttgcaaagattgtagaacatcatactttgatgacgacccacaaaatgtgaccttttgggacagcggtg

SEQ ID NO: 441738 - DNA, 140 bp, Artificial Sequence
  Synthetic
caccgctgtcccaaaaggtcacattttgtgggtcgtcatcaaagtatgatgttctacaatctttgcaaagggggctgtctcgaaaatctgctctattctatccgcgatgtttgtcttgtacatatcagcagccagggcct

SEQ ID NO: 441739 - DNA, 140 bp, Artificial Sequence
  Synthetic
aggccctggctgctgatatgcctgatatctcagctgtgtcagctatatatcgcaggagatcacgtcttgtccatgtgcgggaactctggttatgaagtcatcaaaatattggagccatacgaccttttgggacagcggtg

SEQ ID NO: 441740 - DNA, 140 bp, Artificial Sequence
  Synthetic
caccgctgtcccaaaaggtcgtatggctccaatattttgatgacttcataaccagagttcccgcacatggacaagacgtgatctcctgcgatatatagctgacacagctgagatatcaggcatatcagcagccagggcct

SEQ ID NO: 441741 - DNA, 140 bp, Artificial Sequence
  Synthetic
aggccctggctgctgatatgggtgtatcaacatgaactcgagagcatgtcaactatggtctgacatgtctcttcagacacaaaggtctgaagaggacaaggactcttctctgcttctagagaccttttgggacagcggtg

SEQ ID NO: 441742 - DNA, 140 bp, Artificial Sequence
  Synthetic
caccgctgtcccaaaaggtctctagaagcagagaagagtccttgtcctcttcagacctttgtgtctgaagagacatgtcagaccatagttgacatgctctcgagttcatgttgatacacccatatcagcagccagggcct

SEQ ID NO: 441743 - DNA, 140 bp, Artificial Sequence
  Synthetic
aggccctggctgctgatatggagttggtacagagagacacaaggctgagagactctacttttcactggcaccttcggtgcaacaggtgtgtgaggccaatagacgacataacactggagagaccttttgggacagcggtg

SEQ ID NO: 441744 - DNA, 140 bp, Artificial Sequence
  Synthetic
caccgctgtcccaaaaggtctctccagtgttatgtcgtctattggcctcacacacctgttgcaccgaaggtgccagtgaaaagtagagtctctcagccttgtgtctctctgtaccaactccatatcagcagccagggcct

SEQ ID NO: 441745 - DNA, 140 bp, Artificial Sequence
  Synthetic
aggccctggctgctgatatgcttcagttcttctttcttggggattccagagtcaatcattgggttgatacaaaactcccgaacaatacgaagacaatttcggaggagtctatcaagaacagaccttttgggacagcggtg

SEQ ID NO: 441746 - DNA, 140 bp, Artificial Sequence
  Synthetic
caccgctgtcccaaaaggtctgttcttgatagactcctccgaaattgtcttcgtattgttcgggagttttgtatcaacccaatgattgactctggaatccccaagaaagaagaactgaagcatatcagcagccagggcct

SEQ ID NO: 441747 - DNA, 140 bp, Artificial Sequence
  Synthetic
atacgccatgctgggtctccgagaaggtcattattacggctctttccaaacctcctgtcaaccccagagagttcctgaaatctatagaccttggaggactgccggacgaagatttgataacgtacttgggagtcggccat

SEQ ID NO: 441748 - DNA, 140 bp, Artificial Sequence
  Synthetic
atggccgactcccaagtacgttatcaaatcttcgtccggcagtcctccaaggtctatagatttcaggaactctctggggttgacaggaggtttggaaagagccgtaataatgaccttctcggagacccagcatggcgtat

SEQ ID NO: 441749 - DNA, 140 bp, Artificial Sequence
  Synthetic
atacgccatgctgggtctccagggatgagaaagaacttcaggaatatgaggcagctgaagcaacgaagactgaaatagccttggcggatgacggaacagtcaattctgatgatgaggactcgtacttgggagtcggccat

SEQ ID NO: 441750 - DNA, 140 bp, Artificial Sequence
  Synthetic
atggccgactcccaagtacgagtcctcatcatcagaattgactgttccgtcatccgccaaggctatttcagtcttcgttgcttcagctgcctcatattcctgaagttctttctcatccctggagacccagcatggcgtat

SEQ ID NO: 441751 - DNA, 140 bp, Artificial Sequence
  Synthetic
atacgccatgctgggtctcccttcagacacaaaggtctgaggaggacaaagactcttctctacttctagaataatcagactatgtcccgcaagtttattacttgtttacctctggaggagcgtacttgggagtcggccat

SEQ ID NO: 441752 - DNA, 140 bp, Artificial Sequence
  Synthetic
atggccgactcccaagtacgctcctccagaggtaaacaagtaataaacttgcgggacatagtctgattattctagaagtagagaagagtctttgtcctcctcagacctttgtgtctgaagggagacccagcatggcgtat

SEQ ID NO: 441753 - DNA, 140 bp, Artificial Sequence
  Synthetic
aggccctggctgctgatatgtaacttgcgacaaatgagttccttgatgaggcaagtgctgggtgggcatggagaggatacattggaatcagatgacgacattcaacgattactaaaagacgaccttttgggacagcggtg

SEQ ID NO: 441754 - DNA, 140 bp, Artificial Sequence
  Synthetic
caccgctgtcccaaaaggtcgtcttttagtaatcgttgaatgtcgtcatctgattccaatgtatcctctccatgcccacccagcacttgcctcatcaaggaactcatttgtcgcaagttacatatcagcagccagggcct

SEQ ID NO: 441755 - DNA, 140 bp, Artificial Sequence
  Synthetic
aggccctggctgctgatatggatgttcagaatgggtatgctctgctcaacaggttgcagtctccacctcagccaacccggcccctgtctcagagcttgacataagggccctctctaagaggaccttttgggacagcggtg

SEQ ID NO: 441756 - DNA, 140 bp, Artificial Sequence
  Synthetic
caccgctgtcccaaaaggtcctcttagagagggcccttatgtcaagctctgagacaggggccgggttggctgaggtggagactgcaacctgttgagcagagcatacccattctgaacatccatatcagcagccagggcct

SEQ ID NO: 441757 - DNA, 140 bp, Artificial Sequence
  Synthetic
aggccctggctgctgatatgtccctctgtctggtagttggggacggttcaggagggatctccagggcagtcctcaacatgtttccagatgctaaacttgtatttaacagcctattggagggaccttttgggacagcggtg

SEQ ID NO: 441758 - DNA, 140 bp, Artificial Sequence
  Synthetic
caccgctgtcccaaaaggtccctccaataggctgttaaatacaagtttagcatctggaaacatgttgaggactgccctggagatccctcctgaaccgtccccaactaccagacagagggacatatcagcagccagggcct

SEQ ID NO: 441759 - DNA, 140 bp, Artificial Sequence
  Synthetic
atacgccatgctgggtctccagacaaggtgaatcaacttgaggggacgtttggtcctagtgcgaagagattctttaaagtcttggatcaattcgacaatatacatgatttggtctttgtacgtacttgggagtcggccat

SEQ ID NO: 441760 - DNA, 140 bp, Artificial Sequence
  Synthetic
atggccgactcccaagtacgtacaaagaccaaatcatgtatattgtcgaattgatccaagactttaaagaatctcttcgcactaggaccaaacgtcccctcaagttgattcaccttgtctggagacccagcatggcgtat

SEQ ID NO: 441761 - DNA, 140 bp, Artificial Sequence
  Synthetic
aggccctggctgctgatatgtgaatgatttgatggcttccggaacacatccactgcctccctcagcaattatgagtggaggagatgacatcgtatccagagtgatagactttgactcaatgaccttttgggacagcggtg

SEQ ID NO: 441762 - DNA, 140 bp, Artificial Sequence
  Synthetic
caccgctgtcccaaaaggtcattgagtcaaagtctatcactctggatacgatgtcatctcctccactcataattgctgagggaggcagtggatgtgttccggaagccatcaaatcattcacatatcagcagccagggcct

SEQ ID NO: 441763 - DNA, 140 bp, Artificial Sequence
  Synthetic
atacgccatgctgggtctccgttgtctttctggagagagatctggctaagctctaatgagtcttggattcatgcgctgtgtcaagaagcaggaaacccagatctgggagagaggactctgcgtacttgggagtcggccat

SEQ ID NO: 441764 - DNA, 140 bp, Artificial Sequence
  Synthetic
atggccgactcccaagtacgcagagtcctctctcccagatctgggtttcctgcttcttgacacagcgcatgaatccaagactcattagagcttagccagatctctctccagaaagacaacggagacccagcatggcgtat

SEQ ID NO: 441765 - DNA, 140 bp, Artificial Sequence
  Synthetic
atacgccatgctgggtctccggttcataaagcagataaatctcactgcaagagaggcaatactatatttcttccataagaactttgaggaagagataagaagaatgttcgaaccggggcacgtacttgggagtcggccat

SEQ ID NO: 441766 - DNA, 140 bp, Artificial Sequence
  Synthetic
atggccgactcccaagtacgtgccccggttcgaacattcttcttatctcttcctcaaagttcttatggaagaaatatagtattgcctctcttgcagtgagatttatctgctttatgaaccggagacccagcatggcgtat

SEQ ID NO: 441767 - DNA, 140 bp, Artificial Sequence
  Synthetic
aggccctggctgctgatatgatgatgaggtagacaaagtggagaactcagagtttagagaagcgatcctcttgtccaagacccatagggataattttatacttttcttgaagtctgttgagaccttttgggacagcggtg

SEQ ID NO: 441768 - DNA, 140 bp, Artificial Sequence
  Synthetic
caccgctgtcccaaaaggtctcaacagacttcaagaaaagtataaaattatccctatgggtcttggacaagaggatcgcttctctaaactctgagttctccactttgtctacctcatcatcatatcagcagccagggcct

SEQ ID NO: 441769 - DNA, 140 bp, Artificial Sequence
  Synthetic
aggccctggctgctgatatgtgagtggaaagtctccttattcatcaaatgcagttggtcacgtgttcaatctcattcactttgttggatgctatatgggtcaggtcaggtctcttaatgcgaccttttgggacagcggtg

SEQ ID NO: 441770 - DNA, 140 bp, Artificial Sequence
  Synthetic
caccgctgtcccaaaaggtcgcattaagagacctgacctgacccatatagcatccaacaaagtgaatgagattgaacacgtgaccaactgcatttgatgaataaggagactttccactcacatatcagcagccagggcct

SEQ ID NO: 441771 - DNA, 140 bp, Artificial Sequence
  Synthetic
atacgccatgctgggtctccgcggcagaagggctggagtctggttagcttattaatgatagatcgtgaatctcagaccaggaacacaagaactaagatactagcccagggggacaaccagcgtacttgggagtcggccat

SEQ ID NO: 441772 - DNA, 140 bp, Artificial Sequence
  Synthetic
atggccgactcccaagtacgctggttgtccccctgggctagtatcttagttcttgtgttcctggtctgagattcacgatctatcattaataagctaaccagactccagcccttctgccgcggagacccagcatggcgtat

SEQ ID NO: 441773 - DNA, 140 bp, Artificial Sequence
  Synthetic
aggccctggctgctgatatgagtagctatcattatagccatcatgatagttttctccaatagagtctttaacgtttccaaacctttgactgatcctttattctatccaccatctgatcccgaccttttgggacagcggtg

SEQ ID NO: 441774 - DNA, 140 bp, Artificial Sequence
  Synthetic
caccgctgtcccaaaaggtcgggatcagatggtggatagaataaaggatcagtcaaaggtttggaaacgttaaagactctattggagaaaactatcatgatggctataatgatagctactcatatcagcagccagggcct

SEQ ID NO: 441775 - DNA, 140 bp, Artificial Sequence
  Synthetic
atacgccatgctgggtctccgagggggaaatcctcgaatatcagtgtctgtgctcccatcttttgatcagtcatttttttcgagaggccctctgaagggatacctgggctcatccacttccgtacttgggagtcggccat

SEQ ID NO: 441776 - DNA, 140 bp, Artificial Sequence
  Synthetic
atggccgactcccaagtacggaagtggatgagcccaggtatcccttcagagggcctctcgaaaaaaatgactgatcaaaagatgggagcacagacactgatattcgaggatttccccctcggagacccagcatggcgtat

SEQ ID NO: 441777 - DNA, 140 bp, Artificial Sequence
  Synthetic
aggccctggctgctgatatgaaaatcctggggcacttcaatatatgctgcagtactatgatgtatctatctaccgctttaggagacgtccctagcttcgcgaggcttcatgacctgtacagaccttttgggacagcggtg

SEQ ID NO: 441778 - DNA, 140 bp, Artificial Sequence
  Synthetic
caccgctgtcccaaaaggtctgtacaggtcatgaagcctcgcgaagctagggacgtctcctaaagcggtagatagatacatcatagtactgcagcatatattgaagtgccccaggattttcatatcagcagccagggcct

SEQ ID NO: 441779 - DNA, 140 bp, Artificial Sequence
  Synthetic
atacgccatgctgggtctcccatgtcgacccagctattccacgcctgggagaaagtcactaatgttcatgtggtgaaaagagccctgtcactcaaggaatctataaattggttcattacacgtacttgggagtcggccat

SEQ ID NO: 441780 - DNA, 140 bp, Artificial Sequence
  Synthetic
atggccgactcccaagtacgtgtaatgaaccaatttatagattccttgagtgacagggctcttttcaccacatgaacattagtgactttctcccaggcgtggaatagctgggtcgacatgggagacccagcatggcgtat

SEQ ID NO: 441781 - DNA, 140 bp, Artificial Sequence
  Synthetic
atacgccatgctgggtctccctgtaattctagcttgagtctgtcatctcactggatcaggttgatttacaagatagtgaagactaccagactcgttggcagcatcaaggacctatctggacgtacttgggagtcggccat

SEQ ID NO: 441782 - DNA, 140 bp, Artificial Sequence
  Synthetic
atggccgactcccaagtacgtccagataggtccttgatgctgccaacgagtctggtagtcttcactatcttgtaaatcaacctgatccagtgagatgacagactcaagctagaattacagggagacccagcatggcgtat

SEQ ID NO: 441783 - DNA, 140 bp, Artificial Sequence
  Synthetic
aggccctggctgctgatatgtctgtttgtccaaatctcctctctcacatctctgtcagcacagacacgatgtcagacttgactcatgatgggagaaactatgactttatgtttcaaccgtgaccttttgggacagcggtg

SEQ ID NO: 441784 - DNA, 140 bp, Artificial Sequence
  Synthetic
caccgctgtcccaaaaggtcacggttgaaacataaagtcatagtttctcccatcatgagtcaagtctgacatcgtgtctgtgctgacagagatgtgagagaggagatttggacaaacagacatatcagcagccagggcct

SEQ ID NO: 441785 - DNA, 140 bp, Artificial Sequence
  Synthetic
aggccctggctgctgatatgtaccttggctcgtccacttccatgtccactcagctattccacgcttgggagaaagtcaccaatgttcatgtagtgaaaagagccctgtcactcaaagaatgaccttttgggacagcggtg

SEQ ID NO: 441786 - DNA, 140 bp, Artificial Sequence
  Synthetic
caccgctgtcccaaaaggtcattctttgagtgacagggctcttttcactacatgaacattggtgactttctcccaagcgtggaatagctgagtggacatggaagtggacgagccaaggtacatatcagcagccagggcct

SEQ ID NO: 441787 - DNA, 140 bp, Artificial Sequence
  Synthetic
aggccctggctgctgatatgattcccggacgcctgtacacgataagacccttgtatgatatatcttgaaaaaaacaagatcttgaatcagagcctctggttgcttgattgtttttttcatgaccttttgggacagcggtg

SEQ ID NO: 441788 - DNA, 140 bp, Artificial Sequence
  Synthetic
caccgctgtcccaaaaggtcatgaaaaaaacaatcaagcaaccagaggctctgattcaagatcttgtttttttcaagatatatcatacaagggtcttatcgtgtacaggcgtccgggaatcatatcagcagccagggcct

SEQ ID NO: 441789 - DNA, 140 bp, Artificial Sequence
  Synthetic
aggccctggctgctgatatgtcgctggggatcaagtcttgtcaatgtgtgggaactctggctatgaagtcatcaaaatattagagccatatgtagtgaatagcttagtccagagagcagagaccttttgggacagcggtg

SEQ ID NO: 441790 - DNA, 140 bp, Artificial Sequence
  Synthetic
caccgctgtcccaaaaggtctctgctctctggactaagctattcactacatatggctctaatattttgatgacttcatagccagagttcccacacattgacaagacttgatccccagcgacatatcagcagccagggcct

SEQ ID NO: 441791 - DNA, 140 bp, Artificial Sequence
  Synthetic
aggccctggctgctgatatgcctgctgaccaactttaccactcaggcccgtcagacaattaagcttgagttattctgaattcgacatgaaaaaaacaggcaacaccactgataaaatgaagaccttttgggacagcggtg

SEQ ID NO: 441792 - DNA, 140 bp, Artificial Sequence
  Synthetic
caccgctgtcccaaaaggtcttcattttatcagtggtgttgcctgtttttttcatgtcgaattcagaataactcaagcttaattgtctgacgggcctgagtggtaaagttggtcagcaggcatatcagcagccagggcct

SEQ ID NO: 441793 - DNA, 140 bp, Artificial Sequence
  Synthetic
atacgccatgctgggtctcccaggcttggctgatctggagatggcagaggaaactgtagatctagttgccaagaacatcgaagataatcaagctcatctccaaggagaacccatagaggtcgtacttgggagtcggccat

SEQ ID NO: 441794 - DNA, 140 bp, Artificial Sequence
  Synthetic
atggccgactcccaagtacgacctctatgggttctccttggagatgagcttgattatcttcgatgttcttggcaactagatctacagtttcctctgccatctccagatcagccaagcctgggagacccagcatggcgtat

SEQ ID NO: 441795 - DNA, 140 bp, Artificial Sequence
  Synthetic
atacgccatgctgggtctcctcatacatcctcttgaggctggacaatcacccatccttgtacataatgctcagagaaccatctcttagaggagagatattttctattccccaaaaagttccgtacttgggagtcggccat

SEQ ID NO: 441796 - DNA, 140 bp, Artificial Sequence
  Synthetic
atggccgactcccaagtacggaactttttggggaatagaaaatatctctcctctaagagatggttctctgagcattatgtacaaggatgggtgattgtccagcctcaagaggatgtatgaggagacccagcatggcgtat

SEQ ID NO: 441797 - DNA, 140 bp, Artificial Sequence
  Synthetic
aggccctggctgctgatatggagaccaccccttgactccttacatcaaaacccaaacatggccacccaaacacatagtagacttggtgggggatacttggcacaagctcccgatcacgcagaccttttgggacagcggtg

SEQ ID NO: 441798 - DNA, 140 bp, Artificial Sequence
  Synthetic
caccgctgtcccaaaaggtctgcgtgatcgggagcttgtgccaagtatcccccaccaagtctactatgtgtttgggtggccatgtttgggttttgatgtaaggagtcaaggggtggtctccatatcagcagccagggcct

SEQ ID NO: 441799 - DNA, 140 bp, Artificial Sequence
  Synthetic
atacgccatgctgggtctccccgctgcttacccgaccacgatgaaagaaggtaacagatctattttgtgctatctccaacacgtgttgcgctacgaacgagaggcaatcacagcatctcccgtacttgggagtcggccat

SEQ ID NO: 441800 - DNA, 140 bp, Artificial Sequence
  Synthetic
atggccgactcccaagtacgggagatgctgtgattgcctctcgttcgtagcgcaacacgtgttggagatagcacaaaatagatctgttaccttctttcatcgtggtcgggtaagcagcggggagacccagcatggcgtat

SEQ ID NO: 441801 - DNA, 140 bp, Artificial Sequence
  Synthetic
aggccctggctgctgatatgccgaggggggcctgttcctagcgaaaaagtcatcatcacagccctgtctaagccgcctatcaatccccgagagtttttgaaatctatagacctcggaggagaccttttgggacagcggtg

SEQ ID NO: 441802 - DNA, 140 bp, Artificial Sequence
  Synthetic
caccgctgtcccaaaaggtctcctccgaggtctatagatttcaaaaactctcggggattgataggcggcttagacagggctgtgatgatgactttttcgctaggaacaggcccccctcggcatatcagcagccagggcct

SEQ ID NO: 441803 - DNA, 140 bp, Artificial Sequence
  Synthetic
aggccctggctgctgatatggaacacatccgttgcccccctcagcaatcatgagcggaggagatgacatcatctctagggtaattgactttgactccatctgggagaaaccttctgacttgaccttttgggacagcggtg

SEQ ID NO: 441804 - DNA, 140 bp, Artificial Sequence
  Synthetic
caccgctgtcccaaaaggtcaagtcagaaggtttctcccagatggagtcaaagtcaattaccctagagatgatgtcatctcctccgctcatgattgctgaggggggcaacggatgtgttccatatcagcagccagggcct

SEQ ID NO: 441805 - DNA, 140 bp, Artificial Sequence
  Synthetic
aggccctggctgctgatatgaggttctatgtccgacatatatgctatcgcctgggctttctcaagaagggctcctctacgagttagagagcatatcaaggaatgctctttcaatataccggaccttttgggacagcggtg

SEQ ID NO: 441806 - DNA, 140 bp, Artificial Sequence
  Synthetic
caccgctgtcccaaaaggtccggtatattgaaagagcattccttgatatgctctctaactcgtagaggagcccttcttgagaaagcccaggcgatagcatatatgtcggacatagaacctcatatcagcagccagggcct

SEQ ID NO: 441807 - DNA, 140 bp, Artificial Sequence
  Synthetic
aggccctggctgctgatatgatcctgcgaaactgatgttagaatggctgaaaacagggaatagaccttatcggatgactttgacagacaattgttccaggtcttacaaagttctgaaagagaccttttgggacagcggtg

SEQ ID NO: 441808 - DNA, 140 bp, Artificial Sequence
  Synthetic
caccgctgtcccaaaaggtctctttcagaactttgtaagacctggaacaattgtctgtcaaagtcatccgataaggtctattccctgttttcagccattctaacatcagtttcgcaggatcatatcagcagccagggcct

SEQ ID NO: 441809 - DNA, 140 bp, Artificial Sequence
  Synthetic
aggccctggctgctgatatgatttccagatgagatcatatccaatccttacaatgaaatgatcataactctgattgatagtgatgtagaatctttcctggttcacaagatggtagatgatgaccttttgggacagcggtg

SEQ ID NO: 441810 - DNA, 140 bp, Artificial Sequence
  Synthetic
caccgctgtcccaaaaggtcatcatctaccatcttgtgaaccaggaaagattctacatcactatcaatcagagttatgatcatttcattgtaaggattggatatgatctcatctggaaatcatatcagcagccagggcct

SEQ ID NO: 441811 - DNA, 140 bp, Artificial Sequence
  Synthetic
aggccctggctgctgatatgaacctgagacagatgggttctctgatgaggcaggtgctaggggggcacggagaagacatcttagagtcagatgatgacattcagcgattactaaaagactgaccttttgggacagcggtg

SEQ ID NO: 441812 - DNA, 140 bp, Artificial Sequence
  Synthetic
caccgctgtcccaaaaggtcagtcttttagtaatcgctgaatgtcatcatctgactctaagatgtcttctccgtgcccccctagcacctgcctcatcagagaacccatctgtctcaggttcatatcagcagccagggcct

SEQ ID NO: 441813 - DNA, 140 bp, Artificial Sequence
  Synthetic
aggccctggctgctgatatgttgtcggaaggatagaagacctgtctggggaggtagagaggcaccttcgagggtacaacaggtggattactctagatgacattagatccagatcatctctgaccttttgggacagcggtg

SEQ ID NO: 441814 - DNA, 140 bp, Artificial Sequence
  Synthetic
caccgctgtcccaaaaggtcagagatgatctggatctaatgtcatctagagtaatccacctgttgtaccctcgaaggtgcctctctacctccccagacaggtcttctatccttccgacaacatatcagcagccagggcct

SEQ ID NO: 441815 - DNA, 140 bp, Artificial Sequence
  Synthetic
aggccctggctgctgatatgtttagaagagtccttctacaactcagagatccacgggattaataggatgacccagacacctcaaagggttgggagggtgtggccttgctcttcagagagggaccttttgggacagcggtg

SEQ ID NO: 441816 - DNA, 140 bp, Artificial Sequence
  Synthetic
caccgctgtcccaaaaggtccctctctgaagagcaaggccacaccctcccaaccctttgaggtgtctgggtcatcctattaatcccgtggatctctgagttgtagaaggactcttctaaacatatcagcagccagggcct

SEQ ID NO: 441817 - DNA, 140 bp, Artificial Sequence
  Synthetic
aggccctggctgctgatatggcagatctacttcgggagatctcttggggaaggaaagtcgtaggtacgacagttcctcacccttctgagatgttgggattgcttcccaaatcctccatttgaccttttgggacagcggtg

SEQ ID NO: 441818 - DNA, 140 bp, Artificial Sequence
  Synthetic
caccgctgtcccaaaaggtcaaatggaggatttgggaagcaatcccaacatctcagaagggtgaggaactgtcgtacctacgactttccttccccaagagatctcccgaagtagatctgccatatcagcagccagggcct

SEQ ID NO: 441819 - DNA, 140 bp, Artificial Sequence
  Synthetic
aggccctggctgctgatatgaagcaaaaatgtaacacccctacaatggatgccgacaagattgtattcaaagtcaataataaggtggtctctctgaagcctgaaattatcgtggaccaatgaccttttgggacagcggtg

SEQ ID NO: 441820 - DNA, 140 bp, Artificial Sequence
  Synthetic
caccgctgtcccaaaaggtcattggtccacgataatttcaggcttcagagagaccaccttattattgactttgaatacaatcttgtcggcatccattgtaggggtgttacatttttgcttcatatcagcagccagggcct

SEQ ID NO: 441821 - DNA, 140 bp, Artificial Sequence
  Synthetic
atacgccatgctgggtctccagattgaaggccgattttttgccttaatgtcctggaatttaaggctatacttcgttattacagagaagctcctggccaattatatattaccactctttgacgtacttgggagtcggccat

SEQ ID NO: 441822 - DNA, 140 bp, Artificial Sequence
  Synthetic
atggccgactcccaagtacgtcaaagagtggtaatatataattggccaggagcttctctgtaataacgaagtatagccttaaattccaggacattaaggcaaaaaatcggccttcaatctggagacccagcatggcgtat

SEQ ID NO: 441823 - DNA, 140 bp, Artificial Sequence
  Synthetic
aggccctggctgctgatatgctctcaggtctttgatttcccggatgtttcgaaaagaatatctagaatggtctccggagctgtgcctcattttcggaaacttcctgacattcgtctgagagaccttttgggacagcggtg

SEQ ID NO: 441824 - DNA, 140 bp, Artificial Sequence
  Synthetic
caccgctgtcccaaaaggtctctcagacgaatgtcaggaagtttccgaaaatgaggcacagctccggagaccattctagatattcttttcgaaacatccgggaaatcaaagacctgagagcatatcagcagccagggcct

SEQ ID NO: 441825 - DNA, 140 bp, Artificial Sequence
  Synthetic
aggccctggctgctgatatgtcccataatagcagactcaacatgagttgattgagaaaggcaatctgcctccaatgaaggacataagcaatagctcacgattatcttgcatctcagcaaagaccttttgggacagcggtg

SEQ ID NO: 441826 - DNA, 140 bp, Artificial Sequence
  Synthetic
caccgctgtcccaaaaggtctttgctgagatgcaagataatcgtgagctattgcttatgtccttcattggaggcagattgcctttctcaatcaactcatgttgagtctgctattatgggacatatcagcagccagggcct

SEQ ID NO: 441827 - DNA, 140 bp, Artificial Sequence
  Synthetic
atacgccatgctgggtctccgactttcaaatggatgaggcagaggatcctgccctcttgtttcagtcgtacctggacaatgttggaattcaaatagtcagacaaatgaagtcaggggggacgtacttgggagtcggccat

SEQ ID NO: 441828 - DNA, 140 bp, Artificial Sequence
  Synthetic
atggccgactcccaagtacgtcccccctgacttcatttgtctgactatttgaattccaacattgtccaggtacgactgaaacaagagggcaggatcctctgcctcatccatttgaaagtcggagacccagcatggcgtat

SEQ ID NO: 441829 - DNA, 140 bp, Artificial Sequence
  Synthetic
aggccctggctgctgatatgaaccatgaccggaaattacagccccaataagaaagtgtctcgcaaggcaggatgttcggaatgggtctgctctgctcaacaggttgcagtatctacctcagaccttttgggacagcggtg

SEQ ID NO: 441830 - DNA, 140 bp, Artificial Sequence
  Synthetic
caccgctgtcccaaaaggtctgaggtagatactgcaacctgttgagcagagcagacccattccgaacatcctgccttgcgagacactttcttattggggctgtaatttccggtcatggttcatatcagcagccagggcct

SEQ ID NO: 441831 - DNA, 140 bp, Artificial Sequence
  Synthetic
aggccctggctgctgatatgacaagatagtgaagactaccagactcattggcagcataaaagacctatcaggagaggtagaacgacatcttcataggtataacagatggatcaccctcgagaccttttgggacagcggtg

SEQ ID NO: 441832 - DNA, 140 bp, Artificial Sequence
  Synthetic
caccgctgtcccaaaaggtctcgagggtgatccatctgttatacctatgaagatgtcgttctacctctcctgataggtcttttatgctgccaatgagtctggtagtcttcactatcttgtcatatcagcagccagggcct

SEQ ID NO: 441833 - DNA, 140 bp, Artificial Sequence
  Synthetic
atacgccatgctgggtctccttcacaagatggtagatgatctagagttacagcgaggaactttgtctaaagtttctattattatagccatcgtgatagtcttctccaatagggtgttcaacgtacttgggagtcggccat

SEQ ID NO: 441834 - DNA, 140 bp, Artificial Sequence
  Synthetic
atggccgactcccaagtacgttgaacaccctattggagaagactatcacgatggctataataatagaaactttagacaaagttcctcgctgtaactctagatcatctaccatcttgtgaaggagacccagcatggcgtat

SEQ ID NO: 441835 - DNA, 140 bp, Artificial Sequence
  Synthetic
aggccctggctgctgatatgcctatgaaggacacaagcaatagatcacgatcatctcgcatcttagcaaagcgtgcataattacaaagggctgggtcatctaagcttttcagccgagaaagaccttttgggacagcggtg

SEQ ID NO: 441836 - DNA, 140 bp, Artificial Sequence
  Synthetic
caccgctgtcccaaaaggtctttctcggctgaaaagcttagatgacccagccctttgtaattatgcacgctttgctaagatgcgagatgatcgtgatctattgcttgtgtccttcataggcatatcagcagccagggcct

SEQ ID NO: 441837 - DNA, 140 bp, Artificial Sequence
  Synthetic
aggccctggctgctgatatgagagcattcccctcagtcacagggtttataactcaagtaacctcgtccttttcatctgagctatacctccgattctccaaacgagggaagtttttcagaggaccttttgggacagcggtg

SEQ ID NO: 441838 - DNA, 140 bp, Artificial Sequence
  Synthetic
caccgctgtcccaaaaggtcctctgaaaaacttccctcgtttggagaatcggaggtatagctcagatgaaaaggacgaggttacttgagttataaaccctgtgactgaggggaatgctctcatatcagcagccagggcct

SEQ ID NO: 441839 - DNA, 140 bp, Artificial Sequence
  Synthetic
atacgccatgctgggtctccattggaaataagagtaagtgcaagacaatgccatattcaaggcaggatttggtgtattaacatgaactctcgagcatgtcagctatggtctgacctatcccgtacttgggagtcggccat

SEQ ID NO: 441840 - DNA, 140 bp, Artificial Sequence
  Synthetic
atggccgactcccaagtacgggataggtcagaccatagctgacatgctcgagagttcatgttaatacaccaaatcctgccttgaatatggcattgtcttgcacttactcttatttccaatggagacccagcatggcgtat

SEQ ID NO: 441841 - DNA, 140 bp, Artificial Sequence
  Synthetic
aggccctggctgctgatatgccatctttgtacataatgctcagagagccatctcttagaggagagatattttctattccccagaaagttcctgctgcttacccgaccacgatgaaagaaggaccttttgggacagcggtg

SEQ ID NO: 441842 - DNA, 140 bp, Artificial Sequence
  Synthetic
caccgctgtcccaaaaggtccttctttcatcgtggtcgggtaagcagcaggaactttctggggaatagaaaatatctctcctctaagagatggctctctgagcattatgtacaaagatggcatatcagcagccagggcct

SEQ ID NO: 441843 - DNA, 140 bp, Artificial Sequence
  Synthetic
atacgccatgctgggtctcccctatgaaggacagaagcaatagatcactatcaccttgcatctcagcaaagtgtgtacaattataaagggctgggtcatctacacttttcagtcgagaaacgtacttgggagtcggccat

SEQ ID NO: 441844 - DNA, 140 bp, Artificial Sequence
  Synthetic
atggccgactcccaagtacgtttctcgactgaaaagtgtagatgacccagccctttataattgtacacactttgctgagatgcaaggtgatagtgatctattgcttctgtccttcataggggagacccagcatggcgtat

SEQ ID NO: 441845 - DNA, 140 bp, Artificial Sequence
  Synthetic
atacgccatgctgggtctccgaatgatttgatggcgtcaggaacacatccgttgcccccttcagcaatcatgagcggaggagatgatatcatatccagagtgattgactttgattccatccgtacttgggagtcggccat

SEQ ID NO: 441846 - DNA, 140 bp, Artificial Sequence
  Synthetic
atggccgactcccaagtacggatggaatcaaagtcaatcactctggatatgatatcatctcctccgctcatgattgctgaagggggcaacggatgtgttcctgacgccatcaaatcattcggagacccagcatggcgtat

SEQ ID NO: 441847 - DNA, 140 bp, Artificial Sequence
  Synthetic
atacgccatgctgggtctccatatgttatggtgccgttgaatcgctgcattttatcagagtcaaatctataacctttacattttaagcttctcggatgtgaaaaaaactattaacatccccgtacttgggagtcggccat

SEQ ID NO: 441848 - DNA, 140 bp, Artificial Sequence
  Synthetic
atggccgactcccaagtacggggatgttaatagtttttttcacatccgagaagcttaaaatgtaaaggttatagatttgactctgataaaatgcagcgattcaacggcaccataacatatggagacccagcatggcgtat

SEQ ID NO: 441849 - DNA, 140 bp, Artificial Sequence
  Synthetic
aggccctggctgctgatatgatggatgccgacaagattgtattcaaagttaacaatcaggtggtctctctgaagcccgagattatcgtggaccaatatgagtacaagtaccctgctatcagaccttttgggacagcggtg

SEQ ID NO: 441850 - DNA, 140 bp, Artificial Sequence
  Synthetic
caccgctgtcccaaaaggtctgatagcagggtacttgtactcatattggtccacgataatctcgggcttcagagagaccacctgattgttaactttgaatacaatcttgtcggcatccatcatatcagcagccagggcct

SEQ ID NO: 441851 - DNA, 140 bp, Artificial Sequence
  Synthetic
aggccctggctgctgatatgtgatgatgtgtgctcctatttggccgccgcaatgcatctcttcgagggagtgtgtcctgatgactggacgagctatggaatccttatagctcggagaggggaccttttgggacagcggtg

SEQ ID NO: 441852 - DNA, 140 bp, Artificial Sequence
  Synthetic
caccgctgtcccaaaaggtcccctctccgagctataaggattccatagctcgtccagtcatcaggacacactccctcgaagagatgcattgcggcggccaaataggagcacacatcatcacatatcagcagccagggcct

SEQ ID NO: 441853 - DNA, 140 bp, Artificial Sequence
  Synthetic
aggccctggctgctgatatgcttacatggaactgaaggtggggtacatctctgccataaaggtgaatgggttcacttgtactggtgtcgtgacagaagccgagacctacaccaactttgtgaccttttgggacagcggtg

SEQ ID NO: 441854 - DNA, 140 bp, Artificial Sequence
  Synthetic
caccgctgtcccaaaaggtcacaaagttggtgtaggtctcggcttctgtcacgacaccagtacaagtgaacccattcacctttatggcagagatgtaccccaccttcagttccatgtaagcatatcagcagccagggcct

SEQ ID NO: 441855 - DNA, 140 bp, Artificial Sequence
  Synthetic
aggccctggctgctgatatgttccagagcacgcatctttggttggtcttcttttgagtctgtacaggctgagcaagatatctggacagaacactggcaactacaagacaaacattgcagagaccttttgggacagcggtg

SEQ ID NO: 441856 - DNA, 140 bp, Artificial Sequence
  Synthetic
caccgctgtcccaaaaggtctctgcaatgtttgtcttgtagttgccagtgttctgtccagatatcttgctcagcctgtacagactcaaaagaagaccaaccaaagatgcgtgctctggaacatatcagcagccagggcct

SEQ ID NO: 441857 - DNA, 140 bp, Artificial Sequence
  Synthetic
aggccctggctgctgatatgccaaacttcagatttttggctggaacctacgacatgtttttctcccggattgagcatctgtattcagcgatcagagtaggaacagttgtcactgcctatggaccttttgggacagcggtg

SEQ ID NO: 441858 - DNA, 140 bp, Artificial Sequence
  Synthetic
caccgctgtcccaaaaggtccataggcagtgacaactgttcctactctgatcgctgaatacagatgctcaatccgggagaaaaacatgtcgtaggttccagccaaaaatctgaagtttggcatatcagcagccagggcct

SEQ ID NO: 441859 - DNA, 140 bp, Artificial Sequence
  Synthetic
aggccctggctgctgatatgggagataagaagaatgtttgagccgggacaagaaactgcagttcctcactcctatttcatccatttccgctcattaggcctgagcgggaagtccccgtacgaccttttgggacagcggtg

SEQ ID NO: 441860 - DNA, 140 bp, Artificial Sequence
  Synthetic
caccgctgtcccaaaaggtcgtacggggacttcccgctcaggcctaatgagcggaaatggatgaaataggagtgaggaactgcagtttcttgtcccggctcaaacattcttcttatctcccatatcagcagccagggcct

SEQ ID NO: 441861 - DNA, 140 bp, Artificial Sequence
  Synthetic
atacgccatgctgggtctccccggaatatgttccattgaaggaactctcgggtaagaaaaacatgagaaacttttgtataaatggagaggtcaaagtgtgtagtccgaatggctattcatcgtacttgggagtcggccat

SEQ ID NO: 441862 - DNA, 140 bp, Artificial Sequence
  Synthetic
atggccgactcccaagtacgatgaatagccattcggactacacactttgacctctccatttatacaaaagtttctcatgtttttcttacccgagagttccttcaatggaacatattccggggagacccagcatggcgtat

SEQ ID NO: 441863 - DNA, 140 bp, Artificial Sequence
  Synthetic
atacgccatgctgggtctccaatctacatgactttcactcagatgagatagaacatcttgtcgtggaggagttggtcaagaagagggaagaatgtctggatgcactggagtccatcatgacgtacttgggagtcggccat

SEQ ID NO: 441864 - DNA, 140 bp, Artificial Sequence
  Synthetic
atggccgactcccaagtacgtcatgatggactccagtgcatccagacattcttccctcttcttgaccaactcctccacgacaagatgttctatctcatctgagtgaaagtcatgtagattggagacccagcatggcgtat

SEQ ID NO: 441865 - DNA, 140 bp, Artificial Sequence
  Synthetic
aggccctggctgctgatatgccccgcacgagatgtccgtccttgggggctatttaggcgaggagttttttggaaaggggacttttgagagaaggttcttcagagacgagaaagaactccagaccttttgggacagcggtg

SEQ ID NO: 441866 - DNA, 140 bp, Artificial Sequence
  Synthetic
caccgctgtcccaaaaggtctggagttctttctcgtctctgaagaaccttctctcaaaagtcccctttccaaaaaactcctcgcctaaatagcccccaaggacggacatctcgtgcggggcatatcagcagccagggcct

SEQ ID NO: 441867 - DNA, 140 bp, Artificial Sequence
  Synthetic
aggccctggctgctgatatgagtcctgaagcagtttacacccgaatcatgatgaatggaggcagactgaaaaggtcacatataaggaggtatgtctcagtaagctccaatcatcaagcccgaccttttgggacagcggtg

SEQ ID NO: 441868 - DNA, 140 bp, Artificial Sequence
  Synthetic
caccgctgtcccaaaaggtcgggcttgatgattggagcttactgagacatacctccttatatgtgaccttttcagtctgcctccattcatcatgattcgggtgtaaactgcttcaggactcatatcagcagccagggcct

SEQ ID NO: 441869 - DNA, 140 bp, Artificial Sequence
  Synthetic
atacgccatgctgggtctccttctctatgaattagagagtatatcgagaaatgcgctctccatatatcgagctattgaggaaggagcgtccaaactgggattaatcatcaagaaggaggacgtacttgggagtcggccat

SEQ ID NO: 441870 - DNA, 140 bp, Artificial Sequence
  Synthetic
atggccgactcccaagtacgtcctccttcttgatgattaatcccagtttggacgctccttcctcaatagctcgatatatggagagcgcatttctcgatatactctctaattcatagagaaggagacccagcatggcgtat

SEQ ID NO: 441871 - DNA, 140 bp, Artificial Sequence
  Synthetic
aggccctggctgctgatatgtcatgaaaaaaaccaacacccctcctgttgaaccacctcagacatgagcaaaattttcgtaaacccaagtgcaattagggcgggcctggctgatctggaagaccttttgggacagcggtg

SEQ ID NO: 441872 - DNA, 140 bp, Artificial Sequence
  Synthetic
caccgctgtcccaaaaggtcttccagatcagccaggcccgccctaattgcacttgggtttacgaaaattttgctcatgtctgaggtggttcaacaggaggggtgttggtttttttcatgacatatcagcagccagggcct

SEQ ID NO: 441873 - DNA, 140 bp, Artificial Sequence
  Synthetic
aggccctggctgctgatatgccttttagaggtttgtaggtactaagacccttagacgatgcacctagaaaaaaacaagactctgaatcagaacctctgattgtttgattatttttttgtcgaccttttgggacagcggtg

SEQ ID NO: 441874 - DNA, 140 bp, Artificial Sequence
  Synthetic
caccgctgtcccaaaaggtcgacaaaaaaataatcaaacaatcagaggttctgattcagagtcttgtttttttctaggtgcatcgtctaagggtcttagtacctacaaacctctaaaaggcatatcagcagccagggcct

SEQ ID NO: 441875 - DNA, 140 bp, Artificial Sequence
  Synthetic
aggccctggctgctgatatgtaaggcggctccaattggacgatgagaagccatctggcttcggcggggtcaccaaagtagaggacagtatatttcaggaggactttcggatggacgaagggaccttttgggacagcggtg

SEQ ID NO: 441876 - DNA, 140 bp, Artificial Sequence
  Synthetic
caccgctgtcccaaaaggtcccttcgtccatccgaaagtcctcctgaaatatactgtcctctactttggtgaccccgccgaagccagatggcttctcatcgtccaattggagccgccttacatatcagcagccagggcct

SEQ ID NO: 441877 - DNA, 140 bp, Artificial Sequence
  Synthetic
atacgccatgctgggtctccatctctaacgaccaaatagtcaacctcgctaatataatgtcaacagtgtctaccaatgctctgactgttgctcaacactctcagtcgttgattaaaccgacgtacttgggagtcggccat

SEQ ID NO: 441878 - DNA, 140 bp, Artificial Sequence
  Synthetic
atggccgactcccaagtacgtcggtttaatcaacgactgagagtgttgagcaacagtcagagcattggtagacactgttgacattatattagcgaggttgactatttggtcgttagagatggagacccagcatggcgtat

SEQ ID NO: 441879 - DNA, 140 bp, Artificial Sequence
  Synthetic
atacgccatgctgggtctccgtacaagtacccggctatcaaggacctgaagaaacccagcataaccctagggaaagctcctgacctaaacaaagcatacaagtctgtcttatcgggcatgcgtacttgggagtcggccat

SEQ ID NO: 441880 - DNA, 140 bp, Artificial Sequence
  Synthetic
atggccgactcccaagtacgcatgcccgataagacagacttgtatgctttgtttaggtcaggagctttccctagggttatgctgggtttcttcaggtccttgatagccgggtacttgtacggagacccagcatggcgtat

SEQ ID NO: 441881 - DNA, 140 bp, Artificial Sequence
  Synthetic
aggccctggctgctgatatgcgaaccgtcgaggagatcatatcctatgtcacggtcaacttccccaatccatcgaggagatcttcagaggacaaagccacccagactgccggccgggagcgaccttttgggacagcggtg

SEQ ID NO: 441882 - DNA, 140 bp, Artificial Sequence
  Synthetic
caccgctgtcccaaaaggtcgctcccggccggcagtctgggtggctttgtcctctgaagatctcctcgatggattggggaagttgaccgtgacataggatatgatctcctcgacggttcgcatatcagcagccagggcct

SEQ ID NO: 441883 - DNA, 140 bp, Artificial Sequence
  Synthetic
atacgccatgctgggtctccagcagatctactcagggagatctcgtggggaaggaaagtggtaggcacgacagttcctcacccttctgagatgttggggttgcttcccaaatcctccattcgtacttgggagtcggccat

SEQ ID NO: 441884 - DNA, 140 bp, Artificial Sequence
  Synthetic
atggccgactcccaagtacgaatggaggatttgggaagcaaccccaacatctcagaagggtgaggaactgtcgtgcctaccactttccttccccacgagatctccctgagtagatctgctggagacccagcatggcgtat

SEQ ID NO: 441885 - DNA, 140 bp, Artificial Sequence
  Synthetic
atacgccatgctgggtctcctcctgattgcacgaaaaggggacaagatcactccagattctcttgtggagataaaacgtactgatgtagaggggaattgggctctgacaggagggatggacgtacttgggagtcggccat

SEQ ID NO: 441886 - DNA, 140 bp, Artificial Sequence
  Synthetic
atggccgactcccaagtacgtccatccctcctgtcagagcccaattcccctctacatcagtacgttttatctccacaagagaatctggagtgatcttgtccccttttcgtgcaatcaggaggagacccagcatggcgtat

SEQ ID NO: 441887 - DNA, 140 bp, Artificial Sequence
  Synthetic
aggccctggctgctgatatggtccgcggccaacaaagaagatgacccatctgtggaggctgaaattgctcatcaaattgctgagagcttctctaagaagtacaaattcccctcccggtcagaccttttgggacagcggtg

SEQ ID NO: 441888 - DNA, 140 bp, Artificial Sequence
  Synthetic
caccgctgtcccaaaaggtctgaccgggaggggaatttgtacttcttagagaagctctcagcaatttgatgagcaatttcagcctccacagatgggtcatcttctttgttggccgcggaccatatcagcagccagggcct

SEQ ID NO: 441889 - DNA, 140 bp, Artificial Sequence
  Synthetic
atacgccatgctgggtctcctacaaaacaaacattgcagataggatagagcaaattttcgagacagcccctttcgtcaagatcgtggaacaccacactttaatgacaactcacaagatgtcgtacttgggagtcggccat

SEQ ID NO: 441890 - DNA, 140 bp, Artificial Sequence
  Synthetic
atggccgactcccaagtacgacatcttgtgagttgtcattaaagtgtggtgttccacgatcttgacgaaaggggctgtctcgaaaatttgctctatcctatctgcaatgtttgttttgtaggagacccagcatggcgtat

SEQ ID NO: 441891 - DNA, 140 bp, Artificial Sequence
  Synthetic
aggccctggctgctgatatgatggatccaaaatccctctgagatgtgtgctagggtgggttgccctagccaaatccaagaagttccagctgttagttgaacccgacaagctgaataaaatgaccttttgggacagcggtg

SEQ ID NO: 441892 - DNA, 140 bp, Artificial Sequence
  Synthetic
caccgctgtcccaaaaggtcattttattcagcttgtcgggttcaactaacagctggaacttcttggatttggctagggcaacccaccctagcacacatctcagagggattttggatccatcatatcagcagccagggcct

SEQ ID NO: 441893 - DNA, 140 bp, Artificial Sequence
  Synthetic
aggccctggctgctgatatgactatgacaggaagttacagccccaacaagaggatgtcacgcaaagctgggggttcagagtgggtatgctctgctcagcaggttgcagtttcaacatcaggaccttttgggacagcggtg

SEQ ID NO: 441894 - DNA, 140 bp, Artificial Sequence
  Synthetic
caccgctgtcccaaaaggtcctgatgttgaaactgcaacctgctgagcagagcatacccactctgaacccccagctttgcgtgacatcctcttgttggggctgtaacttcctgtcatagtcatatcagcagccagggcct

SEQ ID NO: 441895 - DNA, 140 bp, Artificial Sequence
  Synthetic
aggccctggctgctgatatgaaaaacagacaacaccactgataaaatgaactttctacgcaagatagtgaagaactgtagagatgagaacgcccagaagccctcttttgtgtcggctcctgaccttttgggacagcggtg

SEQ ID NO: 441896 - DNA, 140 bp, Artificial Sequence
  Synthetic
caccgctgtcccaaaaggtcaggagccgacacaaaagagggcttctgggcgttctcatctctacagttcttcactatcttgcgtagaaagttcattttatcagtggtgttgtctgtttttcatatcagcagccagggcct

SEQ ID NO: 441897 - DNA, 140 bp, Artificial Sequence
  Synthetic
atacgccatgctgggtctccggagaccgccgttcctcactcttatttcatccactttcgttcactgggcttgagcgggaagtccccgtattcatcaaatgcagtcggccacgtgtttaatcgtacttgggagtcggccat

SEQ ID NO: 441898 - DNA, 140 bp, Artificial Sequence
  Synthetic
atggccgactcccaagtacgattaaacacgtggccgactgcatttgatgaatacggggacttcccgctcaagcccagtgaacgaaagtggatgaaataagagtgaggaacggcggtctccggagacccagcatggcgtat

SEQ ID NO: 441899 - DNA, 140 bp, Artificial Sequence
  Synthetic
aggccctggctgctgatatgtcaaggtgtgtagtccgaatggctattcattcaggattttgcggcacattttgaagtcattcgacgagatatattctggaaatcaaagaatgatcgggttgaccttttgggacagcggtg

SEQ ID NO: 441900 - DNA, 140 bp, Artificial Sequence
  Synthetic
caccgctgtcccaaaaggtcaacccgatcattctttgatttccagaatatatctcgtcgaatgacttcaaaatgtgccgcaaaatcctgaatgaatagccattcggactacacaccttgacatatcagcagccagggcct

SEQ ID NO: 441901 - DNA, 140 bp, Artificial Sequence
  Synthetic
atacgccatgctgggtctccattttttaggtgaaattagaagtttggaagttgtttatatttgaattataatgaatggaggttgattgaagagattgtatatatggagatatgttttagtcgtacttgggagtcggccat

SEQ ID NO: 441902 - DNA, 140 bp, Artificial Sequence
  Synthetic
atggccgactcccaagtacgactaaaacatatctccatatatacaatctcttcaatcaacctccattcattataattcaaatataaacaacttccaaacttctaatttcacctaaaaaatggagacccagcatggcgtat

SEQ ID NO: 441903 - DNA, 140 bp, Artificial Sequence
  Synthetic
atacgccatgctgggtctccatttgggggaggagttttttggaaaagggacattcgaaagaagattcttcagagatgagaaagaactccaagaatacgaggcagctgaattgactaagaccgtacttgggagtcggccat

SEQ ID NO: 441904 - DNA, 140 bp, Artificial Sequence
  Synthetic
atggccgactcccaagtacggtcttagtcaattcagctgcctcgtattcttggagttctttctcatctctgaagaatcttctttcgaatgtcccttttccaaaaaactcctcccccaaatggagacccagcatggcgtat

SEQ ID NO: 441905 - DNA, 140 bp, Artificial Sequence
  Synthetic
aggccctggctgctgatatggattctaggggccctctagagggagaagagttggaatactctcaagagatcacttgggatgacgatacagagtttgtcggattagaaataagagtgagtggaccttttgggacagcggtg

SEQ ID NO: 441906 - DNA, 140 bp, Artificial Sequence
  Synthetic
caccgctgtcccaaaaggtccactcactcttatttctaatccgacaaactctgtatcgtcatcccaagtgatctcttgagagtattccaactcttctccctctagagggcccctagaatccatatcagcagccagggcct

SEQ ID NO: 441907 - DNA, 140 bp, Artificial Sequence
  Synthetic
atacgccatgctgggtctccatgaatggaggccgattaaagagatcacacatcaggagatatgtttcagtcagttccaatcatcaagcccgcccaaactcattcgctgagtttctaaacacgtacttgggagtcggccat

SEQ ID NO: 441908 - DNA, 140 bp, Artificial Sequence
  Synthetic
atggccgactcccaagtacgtgtttagaaactcagcgaatgagtttgggcgggcttgatgattggaactgactgaaacatatctcctgatgtgtgatctctttaatcggcctccattcatggagacccagcatggcgtat

SEQ ID NO: 441909 - DNA, 140 bp, Artificial Sequence
  Synthetic
aggccctggctgctgatatgcagttccaatcatcaagcccgcccaaactcattcgctgagtttctaaacaagacatattctaacgactcatgaggagttgaacgacaagattgcaaaaacgaccttttgggacagcggtg

SEQ ID NO: 441910 - DNA, 140 bp, Artificial Sequence
  Synthetic
caccgctgtcccaaaaggtcgtttttgcaatcttgtcgttcaactcctcatgagtcgttagaatatgtcttgtttagaaactcagcgaatgagtttgggcgggcttgatgattggaactgcatatcagcagccagggcct

SEQ ID NO: 441911 - DNA, 140 bp, Artificial Sequence
  Synthetic
aggccctggctgctgatatgggaggacaaagactcctcagtgctgctggaatagtcacactacatcctaaagattcctcaattacttacctctggaggagagaacacacgggcttgactcgaccttttgggacagcggtg

SEQ ID NO: 441912 - DNA, 140 bp, Artificial Sequence
  Synthetic
caccgctgtcccaaaaggtcgagtcaagcccgtgtgttctctcctccagaggtaagtaattgaggaatctttaggatgtagtgtgactattccagcagcactgaggagtctttgtcctcccatatcagcagccagggcct

SEQ ID NO: 441913 - DNA, 140 bp, Artificial Sequence
  Synthetic
atacgccatgctgggtctccctggtctagctgatctcgagatggccgaggagactgtggatctaatcaacagaaatatagaagataatcaggctcatctccagggagaacccatagaggtcgtacttgggagtcggccat

SEQ ID NO: 441914 - DNA, 140 bp, Artificial Sequence
  Synthetic
atggccgactcccaagtacgacctctatgggttctccctggagatgagcctgattatcttctatatttctgttgattagatccacagtctcctcggccatctcgagatcagctagaccagggagacccagcatggcgtat

SEQ ID NO: 441915 - DNA, 140 bp, Artificial Sequence
  Synthetic
aggccctggctgctgatatggatgtgaaaaaaactattaacatctctcaaaagatctaaggaaggatgattcctcagattcttctgtttgtgcttctcatgatcttctcgccgtgttctggaccttttgggacagcggtg

SEQ ID NO: 441916 - DNA, 140 bp, Artificial Sequence
  Synthetic
caccgctgtcccaaaaggtccagaacacggcgagaagatcatgagaagcacaaacagaagaatctgaggaatcatccttccttagatcttttgagagatgttaatagtttttttcacatccatatcagcagccagggcct

SEQ ID NO: 441917 - DNA, 140 bp, Artificial Sequence
  Synthetic
aggccctggctgctgatatgtgtatacggctgttacaggcattgggggcatccttacatagattatagaaagggtttgtcgaagctatatgatcaagtccacatcaagaaggtgatagatgaccttttgggacagcggtg

SEQ ID NO: 441918 - DNA, 140 bp, Artificial Sequence
  Synthetic
caccgctgtcccaaaaggtcatctatcaccttcttgatgtggacttgatcatatagcttcgacaaaccctttctataatctatgtaaggatgcccccaatgcctgtaacagccgtatacacatatcagcagccagggcct

SEQ ID NO: 441919 - DNA, 140 bp, Artificial Sequence
  Synthetic
aggccctggctgctgatatgcccagagactacttgagggggctcgcgagaggagtcttgatagggtcttcgatttgcttcttaacaagaatgacaaacatcaacatcaacagacctctcggaccttttgggacagcggtg

SEQ ID NO: 441920 - DNA, 140 bp, Artificial Sequence
  Synthetic
caccgctgtcccaaaaggtccgagaggtctgttgatgttgatgtttgtcattcttgttaagaagcaaatcgaagaccctatcaagactcctctcgcgagccccctcaagtagtctctgggcatatcagcagccagggcct

SEQ ID NO: 441921 - DNA, 140 bp, Artificial Sequence
  Synthetic
atacgccatgctgggtctccgacttccaaatggatgaaggggaggatcctgccctcttgttccagtcatatctggacaatgtcggagtccagatagttagacaaatgagatcaggagagccgtacttgggagtcggccat

SEQ ID NO: 441922 - DNA, 140 bp, Artificial Sequence
  Synthetic
atggccgactcccaagtacggctctcctgatctcatttgtctaactatctggactccgacattgtccagatatgactggaacaagagggcaggatcctccccttcatccatttggaagtcggagacccagcatggcgtat

SEQ ID NO: 441923 - DNA, 140 bp, Artificial Sequence
  Synthetic
aggccctggctgctgatatgagggtgtaccagtctatcggggttctcttatatggagctgaaggtgggatacatttccgccataagagtaaacgggttcacttgtaccggtgtcgtgacagaccttttgggacagcggtg

SEQ ID NO: 441924 - DNA, 140 bp, Artificial Sequence
  Synthetic
caccgctgtcccaaaaggtctgtcacgacaccggtacaagtgaacccgtttactcttatggcggaaatgtatcccaccttcagctccatataagagaaccccgatagactggtacaccctcatatcagcagccagggcct

SEQ ID NO: 441925 - DNA, 140 bp, Artificial Sequence
  Synthetic
atacgccatgctgggtctcccgagggaccaccccctgactccttatattaaaacccagacatggcctcccaaacatatagtagatttggtgggcgacacctggcacaagctcccgatcaccgtacttgggagtcggccat

SEQ ID NO: 441926 - DNA, 140 bp, Artificial Sequence
  Synthetic
atggccgactcccaagtacggtgatcgggagcttgtgccaggtgtcgcccaccaaatctactatatgtttgggaggccatgtctgggttttaatataaggagtcagggggtggtccctcgggagacccagcatggcgtat

SEQ ID NO: 441927 - DNA, 140 bp, Artificial Sequence
  Synthetic
atacgccatgctgggtctccccaaactgccatccgagagctcaagaaagagacaacatctatgtcttctcaaaaagaaagtcaaccttcaaaaacccgaatggcggctcaggctgcctctcgtacttgggagtcggccat

SEQ ID NO: 441928 - DNA, 140 bp, Artificial Sequence
  Synthetic
atggccgactcccaagtacgagaggcagcctgagccgccattcgggtttttgaaggttgactttctttttgagaagacatagatgttgtctctttcttgagctctcggatggcagtttggggagacccagcatggcgtat

SEQ ID NO: 441929 - DNA, 140 bp, Artificial Sequence
  Synthetic
aggccctggctgctgatatgggaagatggccggagatcctagatatgaggagtctcttcaaaatccttatcccgattaccattggctgaggactgtaaaaacagctaaagagtccctcgtgaccttttgggacagcggtg

SEQ ID NO: 441930 - DNA, 140 bp, Artificial Sequence
  Synthetic
caccgctgtcccaaaaggtcacgagggactctttagctgtttttacagtcctcagccaatggtaatcgggataaggattttgaagagactcctcatatctaggatctccggccatcttcccatatcagcagccagggcct

SEQ ID NO: 441931 - DNA, 140 bp, Artificial Sequence
  Synthetic
atacgccatgctgggtctccttgaaaatgaaccttgatgacatagtcaaagagtcaaaaaatgtgccaggggtaactcgtctggcccatgacggatccaaactccctttaagatgtgtaccgtacttgggagtcggccat

SEQ ID NO: 441932 - DNA, 140 bp, Artificial Sequence
  Synthetic
atggccgactcccaagtacggtacacatcttaaagggagtttggatccgtcatgggccagacgagttacccctggcacattttttgactctttgactatgtcatcaaggttcattttcaaggagacccagcatggcgtat

SEQ ID NO: 441933 - DNA, 140 bp, Artificial Sequence
  Synthetic
aggccctggctgctgatatgggtaactcgtctggcccatgacggatccaaactccctttaagatgtgtactggggtgggttgctctggccaattctaaaaagttccagttgttggtcgaggaccttttgggacagcggtg

SEQ ID NO: 441934 - DNA, 140 bp, Artificial Sequence
  Synthetic
caccgctgtcccaaaaggtcctcgaccaacaactggaactttttagaattggccagagcaacccaccccagtacacatcttaaagggagtttggatccgtcatgggccagacgagttacccatatcagcagccagggcct

SEQ ID NO: 441935 - DNA, 140 bp, Artificial Sequence
  Synthetic
aggccctggctgctgatatgcaggctcatggatggaacatgggccacaattcagccatcagaagagaccaagtggtgcccctctgatcaattggtaaatctacatgacttccactcggatgaccttttgggacagcggtg

SEQ ID NO: 441936 - DNA, 140 bp, Artificial Sequence
  Synthetic
caccgctgtcccaaaaggtcatccgagtggaagtcatgtagatttaccaattgatcagaggggcaccacttggtctcttctgatggctgaattgtggcccatgttccatccatgagcctgcatatcagcagccagggcct

SEQ ID NO: 441937 - DNA, 140 bp, Artificial Sequence
  Synthetic
atacgccatgctgggtctccccgttctagactcaacatgaaaaaaacaggtaacaccactgataaaatgaactttctccgcaagatcgtgaaaaattgcagggatgaggacatccaaaagcgtacttgggagtcggccat

SEQ ID NO: 441938 - DNA, 140 bp, Artificial Sequence
  Synthetic
atggccgactcccaagtacgcttttggatgtcctcatccctgcaatttttcacgatcttgcggagaaagttcattttatcagtggtgttacctgtttttttcatgttgagtctagaacggggagacccagcatggcgtat

SEQ ID NO: 441939 - DNA, 140 bp, Artificial Sequence
  Synthetic
aggccctggctgctgatatgactttctccgcaagatcgtgaaaaattgcagggatgaggacatccaaaagccctcgcccgtgtctgcccctccggatgacgatgatctgtggttgcctccgaccttttgggacagcggtg

SEQ ID NO: 441940 - DNA, 140 bp, Artificial Sequence
  Synthetic
caccgctgtcccaaaaggtcggaggcaaccacagatcatcgtcatccggaggggcagacacgggcgagggcttttggatgtcctcatccctgcaatttttcacgatcttgcggagaaagtcatatcagcagccagggcct

SEQ ID NO: 441941 - DNA, 140 bp, Artificial Sequence
  Synthetic
aggccctggctgctgatatggtctcagccatctgagaaaactcgtcccagggtttggaaaggcctataccatattcaataagactttaatggaagccgatgctcactacaaatcgatccggaccttttgggacagcggtg

SEQ ID NO: 441942 - DNA, 140 bp, Artificial Sequence
  Synthetic
caccgctgtcccaaaaggtccggatcgatttgtagtgagcatcggcttccattaaagtcttattgaatatggtataggcctttccaaaccctgggacgagttttctcagatggctgagaccatatcagcagccagggcct

SEQ ID NO: 441943 - DNA, 140 bp, Artificial Sequence
  Synthetic
atacgccatgctgggtctcctttaggatcctgcggcatatcctgaaatcgttcgacgagatatactccgggaatcatagaatgatcgggttagtcaaggttgttattggacttgccctatcgtacttgggagtcggccat

SEQ ID NO: 441944 - DNA, 140 bp, Artificial Sequence
  Synthetic
atggccgactcccaagtacgatagggcaagtccaataacaaccttgactaacccgatcattctatgattcccggagtatatctcgtcgaacgatttcaggatatgccgcaggatcctaaaggagacccagcatggcgtat

SEQ ID NO: 441945 - DNA, 140 bp, Artificial Sequence
  Synthetic
atacgccatgctgggtctccactaccctaaatataaaaggaggggctagtccaaccattcttctcaaggatgcaatcagaaaggccctgtatgatgaagtagataaggtggagaactccgcgtacttgggagtcggccat

SEQ ID NO: 441946 - DNA, 140 bp, Artificial Sequence
  Synthetic
atggccgactcccaagtacgcggagttctccaccttatctacttcatcatacagggcctttctgattgcatccttgagaagaatggttggactagcccctccttttatatttagggtagtggagacccagcatggcgtat

SEQ ID NO: 441947 - DNA, 140 bp, Artificial Sequence
  Synthetic
aggccctggctgctgatatgccagacgggaatgtcctgatccctgagatgcaatcgtctttactccaacaacatatggagctgttggagtcctctgtaatccccctaatacatcctttaggaccttttgggacagcggtg

SEQ ID NO: 441948 - DNA, 140 bp, Artificial Sequence
  Synthetic
caccgctgtcccaaaaggtcctaaaggatgtattagggggattacagaggactccaacagctccatatgttgttggagtaaagacgattgcatctcagggatcaggacattcccgtctggcatatcagcagccagggcct

SEQ ID NO: 441949 - DNA, 140 bp, Artificial Sequence
  Synthetic
aggccctggctgctgatatggaggcaacatattggtgcctgagtccaaaagatgggccagagtttcttgcatctctaacgaccagatagtcaacctcgccaatataatgtcgacagtgtcgaccttttgggacagcggtg

SEQ ID NO: 441950 - DNA, 140 bp, Artificial Sequence
  Synthetic
caccgctgtcccaaaaggtcgacactgtcgacattatattggcgaggttgactatctggtcgttagagatgcaagaaactctggcccatcttttggactcaggcaccaatatgttgcctccatatcagcagccagggcct

SEQ ID NO: 441951 - DNA, 140 bp, Artificial Sequence
  Synthetic
atacgccatgctgggtctccattggaatactctcaggagatcacctgggatgatgacacggagtttgtcggactgcagataagggttagtgcgagacaatgccatatccaaggcaggatccgtacttgggagtcggccat

SEQ ID NO: 441952 - DNA, 140 bp, Artificial Sequence
  Synthetic
atggccgactcccaagtacggatcctgccttggatatggcattgtctcgcactaacccttatctgcagtccgacaaactccgtgtcatcatcccaggtgatctcctgagagtattccaatggagacccagcatggcgtat

SEQ ID NO: 441953 - DNA, 140 bp, Artificial Sequence
  Synthetic
aggccctggctgctgatatgtctcccaggatgggggaaatatgtactcatgagtgcaggtgttctggtagcgctaataataacaatcttcttaatgacgtgttgcagaggagcggatagagaccttttgggacagcggtg

SEQ ID NO: 441954 - DNA, 140 bp, Artificial Sequence
  Synthetic
caccgctgtcccaaaaggtctctatccgctcctctgcaacacgtcattaagaagattgttattattagcgctaccagaacacctgcactcatgagtacatatttcccccatcctgggagacatatcagcagccagggcct

SEQ ID NO: 441955 - DNA, 140 bp, Artificial Sequence
  Synthetic
atacgccatgctgggtctccaataatcagattatatcccacaagtttatcacttgtttacctctggaggagagaacatacgggcttgactccaacctttgggagcaatagaacaaaaaaccgtacttgggagtcggccat

SEQ ID NO: 441956 - DNA, 140 bp, Artificial Sequence
  Synthetic
atggccgactcccaagtacggttttttgttctattgctcccaaaggttggagtcaagcccgtatgttctctcctccagaggtaaacaagtgataaacttgtgggatataatctgattattggagacccagcatggcgtat

SEQ ID NO: 441957 - DNA, 140 bp, Artificial Sequence
  Synthetic
aggccctggctgctgatatggaggagagaccaagttgtgaccaagttgtgagagcaagtcatccctaccataactagtgctcaaaaagttgcctctcttcaagatttgggggagtcttttgaccttttgggacagcggtg

SEQ ID NO: 441958 - DNA, 140 bp, Artificial Sequence
  Synthetic
caccgctgtcccaaaaggtcaaaagactcccccaaatcttgaagagaggcaactttttgagcactagttatggtagggatgacttgctctcacaacttggtcacaacttggtctctcctccatatcagcagccagggcct

SEQ ID NO: 441959 - DNA, 140 bp, Artificial Sequence
  Synthetic
atacgccatgctgggtctccaaaagacttaggggaaaatggtcccgcaggcccttttgtttgtgcctcttctggtgttctcattgtgtttcgggaagttccccatttacacgataccagacgtacttgggagtcggccat

SEQ ID NO: 441960 - DNA, 140 bp, Artificial Sequence
  Synthetic
atggccgactcccaagtacgtctggtatcgtgtaaatggggaacttcccgaaacacaatgagaacaccagaagaggcacaaacaaaagggcctgcgggaccattttcccctaagtcttttggagacccagcatggcgtat

SEQ ID NO: 441961 - DNA, 140 bp, Artificial Sequence
  Synthetic
aggccctggctgctgatatgaccgccttgggggatgtgcccagctttgcgagacttcatgacctgtacaacagaccgataatttattatttcaagaagcaagttatccgagggaacatttgaccttttgggacagcggtg

SEQ ID NO: 441962 - DNA, 140 bp, Artificial Sequence
  Synthetic
caccgctgtcccaaaaggtcaaatgttccctcggataacttgcttcttgaaataataaattatcggtctgttgtacaggtcatgaagtctcgcaaagctgggcacatcccccaaggcggtcatatcagcagccagggcct

SEQ ID NO: 441963 - DNA, 140 bp, Artificial Sequence
  Synthetic
atacgccatgctgggtctcccaagcttggtccatggagtcccattgatatacatcatctcagctgtccaaacaatctggttgtagaggatgaaggatgcaccaacctatcaggattctcccgtacttgggagtcggccat

SEQ ID NO: 441964 - DNA, 140 bp, Artificial Sequence
  Synthetic
atggccgactcccaagtacgggagaatcctgataggttggtgcatccttcatcctctacaaccagattgtttggacagctgagatgatgtatatcaatgggactccatggaccaagcttgggagacccagcatggcgtat

SEQ ID NO: 441965 - DNA, 140 bp, Artificial Sequence
  Synthetic
atacgccatgctgggtctccgttatgtcactaccacgttcagaagaaagcacttccgcccaacacccgatgcgtgtagggccgcatacaactggaaaatggctggcgaccccagatatgacgtacttgggagtcggccat

SEQ ID NO: 441966 - DNA, 140 bp, Artificial Sequence
  Synthetic
atggccgactcccaagtacgtcatatctggggtcgccagccattttccagttgtatgcggccctacacgcatcgggtgttgggcggaagtgctttcttctgaacgtggtagtgacataacggagacccagcatggcgtat

SEQ ID NO: 441967 - DNA, 140 bp, Artificial Sequence
  Synthetic
atacgccatgctgggtctccgacccatatgacaaatcccttcactcgagagtttttcccggcggaaagtgctcaggaataacagtatcttctacttactgctcaacgaaccacgattacacgtacttgggagtcggccat

SEQ ID NO: 441968 - DNA, 140 bp, Artificial Sequence
  Synthetic
atggccgactcccaagtacgtgtaatcgtggttcgttgagcagtaagtagaagatactgttattcctgagcactttccgccgggaaaaactctcgagtgaagggatttgtcatatgggtcggagacccagcatggcgtat

SEQ ID NO: 441969 - DNA, 140 bp, Artificial Sequence
  Synthetic
atacgccatgctgggtctccccatctggatgcctgagaatccaagactcgggacatcttgtgacatcttcgtcaacagcagagggaagagggcgtccaaggggggcaagacctgtgggttcgtacttgggagtcggccat

SEQ ID NO: 441970 - DNA, 140 bp, Artificial Sequence
  Synthetic
atggccgactcccaagtacgaacccacaggtcttgccccccttggacgccctcttccctctgctgttgacgaagatgtcacaagatgtcccgagtcttggattctcaggcatccagatggggagacccagcatggcgtat

SEQ ID NO: 441971 - DNA, 140 bp, Artificial Sequence
  Synthetic
atacgccatgctgggtctcccttcagctcttccttcctggggattcctgaatcgattattgggctgatccaaaattctagaacgataagaagacagtttaggaagaacctctctagaacccgtacttgggagtcggccat

SEQ ID NO: 441972 - DNA, 140 bp, Artificial Sequence
  Synthetic
atggccgactcccaagtacgggttctagagaggttcttcctaaactgtcttcttatcgttctagaattttggatcagcccaataatcgattcaggaatccccaggaaggaagagctgaagggagacccagcatggcgtat

SEQ ID NO: 441973 - DNA, 140 bp, Artificial Sequence
  Synthetic
aggccctggctgctgatatgggatctctcaaggttgggggagccgcagcgcaatctatgatttccctttggttatgcaacgcccactctgaatcaaacaggagccggaaatgtattgccggaccttttgggacagcggtg

SEQ ID NO: 441974 - DNA, 140 bp, Artificial Sequence
  Synthetic
caccgctgtcccaaaaggtccggcaatacatttccggctcctgtttgattcagagtgggcgttgcataaccaaagggaaatcatagattgcgctgcggctcccccaaccttgagagatcccatatcagcagccagggcct

SEQ ID NO: 441975 - DNA, 140 bp, Artificial Sequence
  Synthetic
aggccctggctgctgatatggagaatcccaaaccaggaacacaagaaccaagatattagctcaaggggacaaccaggttctatgtccgacctatatgttgtcgccaggactatctcaagagaccttttgggacagcggtg

SEQ ID NO: 441976 - DNA, 140 bp, Artificial Sequence
  Synthetic
caccgctgtcccaaaaggtctcttgagatagtcctggcgacaacatataggtcggacatagaacctggttgtccccttgagctaatatcttggttcttgtgttcctggtttgggattctccatatcagcagccagggcct

SEQ ID NO: 441977 - DNA, 140 bp, Artificial Sequence
  Synthetic
atacgccatgctgggtctccattcagacgtcagatgagaccaaatggtgcccccctgatcagttagtaaatctacatgactttcgctcagatgaaatcgaacatcttgtcgtggaagagccgtacttgggagtcggccat

SEQ ID NO: 441978 - DNA, 140 bp, Artificial Sequence
  Synthetic
atggccgactcccaagtacggctcttccacgacaagatgttcgatttcatctgagcgaaagtcatgtagatttactaactgatcaggggggcaccatttggtctcatctgacgtctgaatggagacccagcatggcgtat

SEQ ID NO: 441979 - DNA, 140 bp, Artificial Sequence
  Synthetic
atacgccatgctgggtctcctggtcaagaaaagagaagagtgcctagacgcgctggagtccatcatgaccaccaagtctgtaagtttcagacgtctcagtcacctgaggaaactcgtccccgtacttgggagtcggccat

SEQ ID NO: 441980 - DNA, 140 bp, Artificial Sequence
  Synthetic
atggccgactcccaagtacggggacgagtttcctcaggtgactgagacgtctgaaacttacagacttggtggtcatgatggactccagcgcgtctaggcactcttctcttttcttgaccaggagacccagcatggcgtat

SEQ ID NO: 441981 - DNA, 140 bp, Artificial Sequence
  Synthetic
atacgccatgctgggtctccgggtgtttaagagtaggaggaagatgtcatcctcatgtgaatggggtattttttaatggtataatattgggccctgatggccatgttctgatcccagagacgtacttgggagtcggccat

SEQ ID NO: 441982 - DNA, 140 bp, Artificial Sequence
  Synthetic
atggccgactcccaagtacgtctctgggatcagaacatggccatcagggcccaatattataccattaaaaaataccccattcacatgaggatgacatcttcctcctactcttaaacacccggagacccagcatggcgtat

SEQ ID NO: 441983 - DNA, 140 bp, Artificial Sequence
  Synthetic
aggccctggctgctgatatgattcaactgtagcagccccaagagtgagatgcagagagctcgctctttaaattaccaagatcttgtaagaggattccctgaggagattatatctaaccctgaccttttgggacagcggtg

SEQ ID NO: 441984 - DNA, 140 bp, Artificial Sequence
  Synthetic
caccgctgtcccaaaaggtcagggttagatataatctcctcagggaatcctcttacaagatcttggtaatttaaagagcgagctctctgcatctcactcttggggctgctacagttgaatcatatcagcagccagggcct

SEQ ID NO: 441985 - DNA, 140 bp, Artificial Sequence
  Synthetic
atacgccatgctgggtctcctgatgaggcggaagactttgttgaggttcaccttccggatgtgcacaaactgatctcaggggtcgaccttggtcttcccagctggggaaagtatgtgttgcgtacttgggagtcggccat

SEQ ID NO: 441986 - DNA, 140 bp, Artificial Sequence
  Synthetic
atggccgactcccaagtacgcaacacatactttccccagctgggaagaccaaggtcgacccctgagatcagtttgtgcacatccggaaggtgaacctcaacaaagtcttccgcctcatcaggagacccagcatggcgtat

SEQ ID NO: 441987 - DNA, 140 bp, Artificial Sequence
  Synthetic
atacgccatgctgggtctccaagaccaggtgatttcgaatctctaagtggtaaggagaagtcgcgccatatagggtcggcccaagggctcttgtattcaatcttggttgcgatccatgaccgtacttgggagtcggccat

SEQ ID NO: 441988 - DNA, 140 bp, Artificial Sequence
  Synthetic
atggccgactcccaagtacggtcatggatcgcaaccaagattgaatacaagagcccttgggccgaccctatatggcgcgacttctccttaccacttagagattcgaaatcacctggtcttggagacccagcatggcgtat

SEQ ID NO: 441989 - DNA, 140 bp, Artificial Sequence
  Synthetic
atacgccatgctgggtctccgggcagggaggaaagtatctgtcacctcccagaacgggagggtcatatcctcctgggagtcatataaaaacggaggtgaaaccaggctgtgatggcaggtcgtacttgggagtcggccat

SEQ ID NO: 441990 - DNA, 140 bp, Artificial Sequence
  Synthetic
atggccgactcccaagtacgacctgccatcacagcctggtttcacctccgtttttatatgactcccaggaggatatgaccctcccgttctgggaggtgacagatactttcctccctgcccggagacccagcatggcgtat

SEQ ID NO: 441991 - DNA, 140 bp, Artificial Sequence
  Synthetic
aggccctggctgctgatatgtcctgggagtcatataaaaacggaggtgaaaccaggctgtgatggcaggtcatctcttctgtacttcgggtccggaggatcaccgcctcttggggttagggaccttttgggacagcggtg

SEQ ID NO: 441992 - DNA, 140 bp, Artificial Sequence
  Synthetic
caccgctgtcccaaaaggtccctaaccccaagaggcggtgatcctccggacccgaagtacagaagagatgacctgccatcacagcctggtttcacctccgtttttatatgactcccaggacatatcagcagccagggcct

SEQ ID NO: 441993 - DNA, 140 bp, Artificial Sequence
  Synthetic
aggccctggctgctgatatgactccaagtggtatcttgatttacggcttctctcgagggaccatcccttgattccctatattagaacccaaacatggcctcccaaacatatagtcgatctgaccttttgggacagcggtg

SEQ ID NO: 441994 - DNA, 140 bp, Artificial Sequence
  Synthetic
caccgctgtcccaaaaggtcagatcgactatatgtttgggaggccatgtttgggttctaatatagggaatcaagggatggtccctcgagagaagccgtaaatcaagataccacttggagtcatatcagcagccagggcct

SEQ ID NO: 441995 - DNA, 140 bp, Artificial Sequence
  Synthetic
aggccctggctgctgatatgtcaggtagagtgtaatattctgggaaatcttctagcagtttctgtgaccaacggtgctttcattcttcaagaactgataccaaaggttgtggacaggccggaccttttgggacagcggtg

SEQ ID NO: 441996 - DNA, 140 bp, Artificial Sequence
  Synthetic
caccgctgtcccaaaaggtccggcctgtccacaacctttggtatcagttcttgaagaatgaaagcaccgttggtcacagaaactgctagaagatttcccagaatattacactctacctgacatatcagcagccagggcct

SEQ ID NO: 441997 - DNA, 140 bp, Artificial Sequence
  Synthetic
aggccctggctgctgatatgtcatccgagctgtacctcagattctctaaacggggaaagttctttcgggatgcagaatacttaacctcctctactctgcgggaaatgagcctcgtgttgtgaccttttgggacagcggtg

SEQ ID NO: 441998 - DNA, 140 bp, Artificial Sequence
  Synthetic
caccgctgtcccaaaaggtcacaacacgaggctcatttcccgcagagtagaggaggttaagtattctgcatcccgaaagaactttccccgtttagagaatctgaggtacagctcggatgacatatcagcagccagggcct

SEQ ID NO: 441999 - DNA, 140 bp, Artificial Sequence
  Synthetic
aggccctggctgctgatatgactagaacaagactcgcatcatggctgtcagagaacagaggagggccggttcccagcgagaaggtcattattacagctctctctaaacctcctgtcaaccgaccttttgggacagcggtg

SEQ ID NO: 442000 - DNA, 140 bp, Artificial Sequence
  Synthetic
caccgctgtcccaaaaggtcggttgacaggaggtttagagagagctgtaataatgaccttctcgctgggaaccggccctcctctgttctctgacagccatgatgcgagtcttgttctagtcatatcagcagccagggcct

SEQ ID NO: 442001 - DNA, 140 bp, Artificial Sequence
  Synthetic
atacgccatgctgggtctccctcctatgaaggacacaagcaatagatcacaatcatctcgcatcttagcaaagcgtgcataattacaaagggctgggtcatctaagcttttcagccgagacgtacttgggagtcggccat

SEQ ID NO: 442002 - DNA, 140 bp, Artificial Sequence
  Synthetic
atggccgactcccaagtacgtctcggctgaaaagcttagatgacccagccctttgtaattatgcacgctttgctaagatgcgagatgattgtgatctattgcttgtgtccttcataggagggagacccagcatggcgtat

SEQ ID NO: 442003 - DNA, 140 bp, Artificial Sequence
  Synthetic
atacgccatgctgggtctcctatcaccatgatgctcgatccaggagaagtctacgatgaccctgttgatccgattgagtcagaggctgagcctagaggaacctccactgtacctaacatacgtacttgggagtcggccat

SEQ ID NO: 442004 - DNA, 140 bp, Artificial Sequence
  Synthetic
atggccgactcccaagtacgtatgttaggtacagtggaggttcctctaggctcagcctctgactcaatcggatcaacagggtcatcgtagacttctcctggatcgagcatcatggtgataggagacccagcatggcgtat

SEQ ID NO: 442005 - DNA, 140 bp, Artificial Sequence
  Synthetic
aggccctggctgctgatatgacagacaatttaaacaaggtgttcaaaaagctgatcgacagagtaactggacagggactgttagactattccagggttacatacgccttccacctggactgaccttttgggacagcggtg

SEQ ID NO: 442006 - DNA, 140 bp, Artificial Sequence
  Synthetic
caccgctgtcccaaaaggtcagtccaggtggaaggcgtatgtaaccctggaatagtctaacagtccctgtccagttactctgtcgatcagctttttgaacaccttgtttaaattgtctgtcatatcagcagccagggcct

SEQ ID NO: 442007 - DNA, 140 bp, Artificial Sequence
  Synthetic
atacgccatgctgggtctccccctaacagataactgttctagatcttataaggttctgaaagattacttcaagaaggttgatctgggcgctctcaaagtgggcggaactgcagcacaatccgtacttgggagtcggccat

SEQ ID NO: 442008 - DNA, 140 bp, Artificial Sequence
  Synthetic
atggccgactcccaagtacggattgtgctgcagttccgcccactttgagagcgcccagatcaaccttcttgaagtaatctttcagaaccttataagatctagaacagttatctgttagggggagacccagcatggcgtat

SEQ ID NO: 442009 - DNA, 140 bp, Artificial Sequence
  Synthetic
atacgccatgctgggtctcctatgatttctctttggttatatggtgctcactccgaatcaaacagaagtcggaggtgcataactgacctggcccacttctattctaaatcttcccccatacgtacttgggagtcggccat

SEQ ID NO: 442010 - DNA, 140 bp, Artificial Sequence
  Synthetic
atggccgactcccaagtacgtatgggggaagatttagaatagaagtgggccaggtcagttatgcacctccgacttctgtttgattcggagtgagcaccatataaccaaagagaaatcataggagacccagcatggcgtat

SEQ ID NO: 442011 - DNA, 140 bp, Artificial Sequence
  Synthetic
atacgccatgctgggtctccggaggtatttagccaatacatattcttcttacttgttcttccatgtaatcaccctatacatgaatgccttagactgggatgaggaaaagaccattctggccgtacttgggagtcggccat

SEQ ID NO: 442012 - DNA, 140 bp, Artificial Sequence
  Synthetic
atggccgactcccaagtacggccagaatggtcttttcctcatcccagtctaaggcattcatgtatagggtgattacatggaagaacaagtaagaagaatatgtattggctaaatacctccggagacccagcatggcgtat

SEQ ID NO: 442013 - DNA, 140 bp, Artificial Sequence
  Synthetic
aggccctggctgctgatatgcttctgtatcaacggagaggttaaagtgtgcagcccgaatggttactcattcaggatcttgagacacattctgagatcattcgacgagatatactctggggaccttttgggacagcggtg

SEQ ID NO: 442014 - DNA, 140 bp, Artificial Sequence
  Synthetic
caccgctgtcccaaaaggtccccagagtatatctcgtcgaatgatctcagaatgtgtctcaagatcctgaatgagtaaccattcgggctgcacactttaacctctccgttgatacagaagcatatcagcagccagggcct

SEQ ID NO: 442015 - DNA, 140 bp, Artificial Sequence
  Synthetic
atacgccatgctgggtctcctctcaaagttctaattgtctttttgaccggaactatacgcttatgttgaaagatctttttttgtctcgtttcaactccttgatgattttgctttctcccccgtacttgggagtcggccat

SEQ ID NO: 442016 - DNA, 140 bp, Artificial Sequence
  Synthetic
atggccgactcccaagtacgggggagaaagcaaaatcatcaaggagttgaaacgagacaaaaaaagatctttcaacataagcgtatagttccggtcaaaaagacaattagaactttgagaggagacccagcatggcgtat

SEQ ID NO: 442017 - DNA, 140 bp, Artificial Sequence
  Synthetic
aggccctggctgctgatatggctcatgtcagtgcaggctgtctttcattacttgctgtttagccccatcttgaaaggtagagtttacaaggtcctgagtgctgagggggacaattttctcgaccttttgggacagcggtg

SEQ ID NO: 442018 - DNA, 140 bp, Artificial Sequence
  Synthetic
caccgctgtcccaaaaggtcgagaaaattgtccccctcagcactcaggaccttgtaaactctacctttcaagatggggctaaacagcaagtaatgaaagacagcctgcactgacatgagccatatcagcagccagggcct

SEQ ID NO: 442019 - DNA, 140 bp, Artificial Sequence
  Synthetic
atacgccatgctgggtctcccaatgaaatgatcataactctgatcgacagtgatgtagaatctttcctggttcacaagatggtagatgatctagagttgcagcgaggaactttgtccaaacgtacttgggagtcggccat

SEQ ID NO: 442020 - DNA, 140 bp, Artificial Sequence
  Synthetic
atggccgactcccaagtacgtttggacaaagttcctcgctgcaactctagatcatctaccatcttgtgaaccaggaaagattctacatcactgtcgatcagagttatgatcatttcattgggagacccagcatggcgtat

SEQ ID NO: 442021 - DNA, 140 bp, Artificial Sequence
  Synthetic
atacgccatgctgggtctccagagataaagtgagtcaacttgaagggacgttcggtcctagtgcaaaaaggttttttagagttctggatcaattcgacaacatacatgacttggtttttgcgtacttgggagtcggccat

SEQ ID NO: 442022 - DNA, 140 bp, Artificial Sequence
  Synthetic
atggccgactcccaagtacgcaaaaaccaagtcatgtatgttgtcgaattgatccagaactctaaaaaacctttttgcactaggaccgaacgtcccttcaagttgactcactttatctctggagacccagcatggcgtat

SEQ ID NO: 442023 - DNA, 140 bp, Artificial Sequence
  Synthetic
atacgccatgctgggtctcccccatatgacaaatcccttcattcaagagttttccctggtgggaaatgtttggggataacaatctcttccacctactgctcaactaaccatgactatactcgtacttgggagtcggccat

SEQ ID NO: 442024 - DNA, 140 bp, Artificial Sequence
  Synthetic
atggccgactcccaagtacgagtatagtcatggttagttgagcagtaggtggaagagattgttatccccaaacatttcccaccagggaaaactcttgaatgaagggatttgtcatatgggggagacccagcatggcgtat

SEQ ID NO: 442025 - DNA, 140 bp, Artificial Sequence
  Synthetic
aggccctggctgctgatatgcagaagggctgtccttttggagagagatctggctcagttccaatgagtcttggatccatgcgctatgtcaagaggcagggaacccagatcttggagagaggaccttttgggacagcggtg

SEQ ID NO: 442026 - DNA, 140 bp, Artificial Sequence
  Synthetic
caccgctgtcccaaaaggtcctctctccaagatctgggttccctgcctcttgacatagcgcatggatccaagactcattggaactgagccagatctctctccaaaaggacagcccttctgcatatcagcagccagggcct

SEQ ID NO: 442027 - DNA, 140 bp, Artificial Sequence
  Synthetic
atacgccatgctgggtctccccgcctgtcaatccccgagagtttttgaaatctatagacctcggaggactgccagatgaggacttgataattggcctcaagccgaaggaacgagaactgacgtacttgggagtcggccat

SEQ ID NO: 442028 - DNA, 140 bp, Artificial Sequence
  Synthetic
atggccgactcccaagtacgtcagttctcgttccttcggcttgaggccaattatcaagtcctcatctggcagtcctccgaggtctatagatttcaaaaactctcggggattgacaggcggggagacccagcatggcgtat

SEQ ID NO: 442029 - DNA, 140 bp, Artificial Sequence
  Synthetic
atacgccatgctgggtctccgtcttaccaggagtgtttggcaagcgacctggccagaaggatccttcggtggggatttgacaagtactccaagtggtatcttgactcgcgacttcttgctcgtacttgggagtcggccat

SEQ ID NO: 442030 - DNA, 140 bp, Artificial Sequence
  Synthetic
atggccgactcccaagtacgagcaagaagtcgcgagtcaagataccacttggagtacttgtcaaatccccaccgaaggatccttctggccaggtcgcttgccaaacactcctggtaagacggagacccagcatggcgtat

SEQ ID NO: 442031 - DNA, 140 bp, Artificial Sequence
  Synthetic
aggccctggctgctgatatggctttgtatgatgaggttgacaaggtagagaactccgagttcagagaggcgatcctcttgtccaaaacccatagggacaactttattctcttcttgaagtgaccttttgggacagcggtg

SEQ ID NO: 442032 - DNA, 140 bp, Artificial Sequence
  Synthetic
caccgctgtcccaaaaggtcacttcaagaagagaataaagttgtccctatgggttttggacaagaggatcgcctctctgaactcggagttctctaccttgtcaacctcatcatacaaagccatatcagcagccagggcct

SEQ ID NO: 442033 - DNA, 140 bp, Artificial Sequence
  Synthetic
atacgccatgctgggtctccagatatttgagatccctgaatccatggacccatcagagatattggacgacaaatcacattcctttaccaggaccagactggcctcttggctgtctgagaacgtacttgggagtcggccat

SEQ ID NO: 442034 - DNA, 140 bp, Artificial Sequence
  Synthetic
atggccgactcccaagtacgttctcagacagccaagaggccagtctggtcctggtaaaggaatgtgatttgtcgtccaatatctctgatgggtccatggattcagggatctcaaatatctggagacccagcatggcgtat

SEQ ID NO: 442035 - DNA, 140 bp, Artificial Sequence
  Synthetic
aggccctggctgctgatatggataagaagacagttcaggagaagtctctcaagaacactagaagagtccttctataactctgaaatccacgggatcaaccggatgactcagactccccaagaccttttgggacagcggtg

SEQ ID NO: 442036 - DNA, 140 bp, Artificial Sequence
  Synthetic
caccgctgtcccaaaaggtcttggggagtctgagtcatccggttgatcccgtggatttcagagttatagaaggactcttctagtgttcttgagagacttctcctgaactgtcttcttatccatatcagcagccagggcct

SEQ ID NO: 442037 - DNA, 140 bp, Artificial Sequence
  Synthetic
atacgccatgctgggtctccttgcctgatgaagacttgataattggcctcaagccaaaagagagagagctgaagattgaaggtcgattttttgctttgatgtcttggaatctaagattgtcgtacttgggagtcggccat

SEQ ID NO: 442038 - DNA, 140 bp, Artificial Sequence
  Synthetic
atggccgactcccaagtacgacaatcttagattccaagacatcaaagcaaaaaatcgaccttcaatcttcagctctctctcttttggcttgaggccaattatcaagtcttcatcaggcaaggagacccagcatggcgtat

SEQ ID NO: 442039 - DNA, 140 bp, Artificial Sequence
  Synthetic
aggccctggctgctgatatgagagatctcgtgggggaggagggtggtaggtacaacagtccctcacccctccgagatgctggggctacttccaaagtcctcaatttcatgcaattgcggagaccttttgggacagcggtg

SEQ ID NO: 442040 - DNA, 140 bp, Artificial Sequence
  Synthetic
caccgctgtcccaaaaggtctccgcaattgcatgaaattgaggactttggaagtagccccagcatctcggaggggtgagggactgttgtacctaccaccctcctcccccacgagatctctcatatcagcagccagggcct

SEQ ID NO: 442041 - DNA, 140 bp, Artificial Sequence
  Synthetic
atacgccatgctgggtctccgatgcactaactatgaccgataacctgaacaaggtgttcaaaaagttgattgatagagttactggtcaagggcttttggattattcgagagttacttatgcgtacttgggagtcggccat

SEQ ID NO: 442042 - DNA, 140 bp, Artificial Sequence
  Synthetic
atggccgactcccaagtacgcataagtaactctcgaataatccaaaagcccttgaccagtaactctatcaatcaactttttgaacaccttgttcaggttatcggtcatagttagtgcatcggagacccagcatggcgtat

SEQ ID NO: 442043 - DNA, 140 bp, Artificial Sequence
  Synthetic
atacgccatgctgggtctcccaatagtagagggaagagagcatccaaagggagtaagacctgcggctttgtagatgaaagaggcctgtataagtctctaaaaggagcatgcaaactcaagcgtacttgggagtcggccat

SEQ ID NO: 442044 - DNA, 140 bp, Artificial Sequence
  Synthetic
atggccgactcccaagtacgcttgagtttgcatgctccttttagagacttatacaggcctctttcatctacaaagccgcaggtcttactccctttggatgctctcttccctctactattgggagacccagcatggcgtat

SEQ ID NO: 442045 - DNA, 140 bp, Artificial Sequence
  Synthetic
atacgccatgctgggtctcccttttcacttggattatgagaagtggaacaatcatcaaaggttggaatctacagaagatgttttttctgttttagatcaggtgtttggattgaaacgggtcgtacttgggagtcggccat

SEQ ID NO: 442046 - DNA, 140 bp, Artificial Sequence
  Synthetic
atggccgactcccaagtacgacccgtttcaatccaaacacctgatctaaaacagaaaaaacatcttctgtagattccaacctttgatgattgttccacttctcataatccaagtgaaaagggagacccagcatggcgtat

SEQ ID NO: 442047 - DNA, 140 bp, Artificial Sequence
  Synthetic
atacgccatgctgggtctccaactgacaagggaccccactgtctctgagcatgcatctttagtcggtcttctcttgagtctgtataggttgagcaaaatatcaggacaaaacaccggtaacgtacttgggagtcggccat

SEQ ID NO: 442048 - DNA, 140 bp, Artificial Sequence
  Synthetic
atggccgactcccaagtacgttaccggtgttttgtcctgatattttgctcaacctatacagactcaagagaagaccgactaaagatgcatgctcagagacagtggggtcccttgtcagttggagacccagcatggcgtat

SEQ ID NO: 442049 - DNA, 140 bp, Artificial Sequence
  Synthetic
atacgccatgctgggtctccatgtccaatggcccgacttgctggaacggccaagatggtgggctggaggggttacgacaaaaaggctggagtctggtcagcttgttaatgatagatagagcgtacttgggagtcggccat

SEQ ID NO: 442050 - DNA, 140 bp, Artificial Sequence
  Synthetic
atggccgactcccaagtacgctctatctatcattaacaagctgaccagactccagcctttttgtcgtaacccctccagcccaccatcttggccgttccagcaagtcgggccattggacatggagacccagcatggcgtat

SEQ ID NO: 442051 - DNA, 140 bp, Artificial Sequence
  Synthetic
aggccctggctgctgatatggttacgacaaaaaggctggagtctggtcagcttgttaatgatagatagagaatcccagactaggaacacaagaaccaagatactggctcaaggagataatgaccttttgggacagcggtg

SEQ ID NO: 442052 - DNA, 140 bp, Artificial Sequence
  Synthetic
caccgctgtcccaaaaggtcattatctccttgagccagtatcttggttcttgtgttcctagtctgggattctctatctatcattaacaagctgaccagactccagcctttttgtcgtaaccatatcagcagccagggcct

SEQ ID NO: 442053 - DNA, 140 bp, Artificial Sequence
  Synthetic
atacgccatgctgggtctcccgtcttcaagagaacagggtcagctctgcacaggttcaagtcagctaggtacagtgaagggggttattcctctgtctgtcccaatctcctctctcatattcgtacttgggagtcggccat

SEQ ID NO: 442054 - DNA, 140 bp, Artificial Sequence
  Synthetic
atggccgactcccaagtacgaatatgagagaggagattgggacagacagaggaataacccccttcactgtacctagctgacttgaacctgtgcagagctgaccctgttctcttgaagacgggagacccagcatggcgtat

SEQ ID NO: 442055 - DNA, 140 bp, Artificial Sequence
  Synthetic
atacgccatgctgggtctccgggaattgaagattgaaggttgattttttgttttaatgttatggaatttaagattgtattttgttattattgaaaaatttttggttaattatattttgttcgtacttgggagtcggccat

SEQ ID NO: 442056 - DNA, 140 bp, Artificial Sequence
  Synthetic
atggccgactcccaagtacgaacaaaatataattaaccaaaaatttttcaataataacaaaatacaatcttaaattccataacattaaaacaaaaaatcaaccttcaatcttcaattcccggagacccagcatggcgtat

SEQ ID NO: 442057 - DNA, 140 bp, Artificial Sequence
  Synthetic
atacgccatgctgggtctccgcatctccaatgaccaaatagtaaacctcgctaatataatgtcgacagtctctaccaacgctttaactgtagctcaacactcccaatctttgatcaagcccgtacttgggagtcggccat

SEQ ID NO: 442058 - DNA, 140 bp, Artificial Sequence
  Synthetic
atggccgactcccaagtacgggcttgatcaaagattgggagtgttgagctacagttaaagcgttggtagagactgtcgacattatattagcgaggtttactatttggtcattggagatgcggagacccagcatggcgtat

SEQ ID NO: 442059 - DNA, 140 bp, Artificial Sequence
  Synthetic
atacgccatgctgggtctccatgagggattttttgctcatgtcagtgcaagctgtcttccattacttgctatttagccccatcctaaaaggcagagtttacaaaatccttagtgctgaagcgtacttgggagtcggccat

SEQ ID NO: 442060 - DNA, 140 bp, Artificial Sequence
  Synthetic
atggccgactcccaagtacgcttcagcactaaggattttgtaaactctgccttttaggatggggctaaatagcaagtaatggaagacagcttgcactgacatgagcaaaaaatccctcatggagacccagcatggcgtat

SEQ ID NO: 442061 - DNA, 140 bp, Artificial Sequence
  Synthetic
atacgccatgctgggtctccggagacaattttctcctagctatgtcgagaataatctatctagacccttctttgggaggagtgtctggaatgtctctggggaggtttcatatacgtcagtcgtacttgggagtcggccat

SEQ ID NO: 442062 - DNA, 140 bp, Artificial Sequence
  Synthetic
atggccgactcccaagtacgactgacgtatatgaaacctccccagagacattccagacactcctcccaaagaagggtctagatagattattctcgacatagctaggagaaaattgtctccggagacccagcatggcgtat

SEQ ID NO: 442063 - DNA, 140 bp, Artificial Sequence
  Synthetic
atacgccatgctgggtctcctgaatccaaaagatgggcccgagtctcttgcatctctaacgaccaaatagtcaacctcgccaatataatgtcgacagtatccaccaatgcgctgacagtgcgtacttgggagtcggccat

SEQ ID NO: 442064 - DNA, 140 bp, Artificial Sequence
  Synthetic
atggccgactcccaagtacgcactgtcagcgcattggtggatactgtcgacattatattggcgaggttgactatttggtcgttagagatgcaagagactcgggcccatcttttggattcaggagacccagcatggcgtat

SEQ ID NO: 442065 - DNA, 140 bp, Artificial Sequence
  Synthetic
atacgccatgctgggtctccggatctcggagagagaacacttgagagcttcactcgccttctagaggatcctaccactttgaatattaagggaggagctagtcccaccatcttactcaagcgtacttgggagtcggccat

SEQ ID NO: 442066 - DNA, 140 bp, Artificial Sequence
  Synthetic
atggccgactcccaagtacgcttgagtaagatggtgggactagctcctcccttaatattcaaagtggtaggatcctctagaaggcgagtgaagctctcaagtgttctctctccgagatccggagacccagcatggcgtat

SEQ ID NO: 442067 - DNA, 140 bp, Artificial Sequence
  Synthetic
atacgccatgctgggtctcccatctccggagaacgactggttgtggatcttctctgactttagaagctccaagatgacatatctgactctcatcacctaccagtctcatcttttgcttcacgtacttgggagtcggccat

SEQ ID NO: 442068 - DNA, 140 bp, Artificial Sequence
  Synthetic
atggccgactcccaagtacgtgaagcaaaagatgagactggtaggtgatgagagtcagatatgtcatcttggagcttctaaagtcagagaagatccacaaccagtcgttctccggagatgggagacccagcatggcgtat

SEQ ID NO: 442069 - DNA, 140 bp, Artificial Sequence
  Synthetic
atacgccatgctgggtctccgatgctatcaggaaagcattgtacgatgaggtggacaaggtggaaaactctgaatttagagaggcaatcctcttgtccaagactcatagggataactttacgtacttgggagtcggccat

SEQ ID NO: 442070 - DNA, 140 bp, Artificial Sequence
  Synthetic
atggccgactcccaagtacgtaaagttatccctatgagtcttggacaagaggattgcctctctaaattcagagttttccaccttgtccacctcatcgtacaatgctttcctgatagcatcggagacccagcatggcgtat

SEQ ID NO: 442071 - DNA, 140 bp, Artificial Sequence
  Synthetic
aggccctggctgctgatatggagtcagatgaagacattcaaaggctgttaaaagactctttacgtagaacaaggtgggtggatcaggaggtgcgtcatgcagcaaggactatgaccggaggaccttttgggacagcggtg

SEQ ID NO: 442072 - DNA, 140 bp, Artificial Sequence
  Synthetic
caccgctgtcccaaaaggtcctccggtcatagtccttgctgcatgacgcacctcctgatccacccaccttgttctacgtaaagagtcttttaacagcctttgaatgtcttcatctgactccatatcagcagccagggcct

SEQ ID NO: 442073 - DNA, 140 bp, Artificial Sequence
  Synthetic
atacgccatgctgggtctccacagaattcccggacgataagaaaacagtttaggaagagtctctcgaggaccctagaagagtccttttacaactcggagatccatgggatcaaccggatgcgtacttgggagtcggccat

SEQ ID NO: 442074 - DNA, 140 bp, Artificial Sequence
  Synthetic
atggccgactcccaagtacgcatccggttgatcccatggatctccgagttgtaaaaggactcttctagggtcctcgagagactcttcctaaactgttttcttatcgtccgggaattctgtggagacccagcatggcgtat

SEQ ID NO: 442075 - DNA, 140 bp, Artificial Sequence
  Synthetic
aggccctggctgctgatatgtgcctcagagttggacatcagggccctgtctagaagacttcaaaacccattaatctccggcctgagagtggttcaatgggcgacaggagctcattataaggaccttttgggacagcggtg

SEQ ID NO: 442076 - DNA, 140 bp, Artificial Sequence
  Synthetic
caccgctgtcccaaaaggtccttataatgagctcctgtcgcccattgaaccactctcaggccggagattaatgggttttgaagtcttctagacagggccctgatgtccaactctgaggcacatatcagcagccagggcct

SEQ ID NO: 442077 - DNA, 140 bp, Artificial Sequence
  Synthetic
atacgccatgctgggtctcccggttccccacccttctgaaatgttggggttacttcccaagtcctccatttcttgcacttgtggaacaacaggaggaggcaatcctagagtttcagtgtccgtacttgggagtcggccat

SEQ ID NO: 442078 - DNA, 140 bp, Artificial Sequence
  Synthetic
atggccgactcccaagtacggacactgaaactctaggattgcctcctcctgttgttccacaagtgcaagaaatggaggacttgggaagtaaccccaacatttcagaagggtggggaaccgggagacccagcatggcgtat

SEQ ID NO: 442079 - DNA, 140 bp, Artificial Sequence
  Synthetic
aggccctggctgctgatatgtcttgcacttgtggaacaacaggaggaggcaatcctagagtttcagtgtctgtgctcccgtccttcgatcaatcatttttttcacgaggccccctaaagggaccttttgggacagcggtg

SEQ ID NO: 442080 - DNA, 140 bp, Artificial Sequence
  Synthetic
caccgctgtcccaaaaggtccctttagggggcctcgtgaaaaaaatgattgatcgaaggacgggagcacagacactgaaactctaggattgcctcctcctgttgttccacaagtgcaagacatatcagcagccagggcct

SEQ ID NO: 442081 - DNA, 140 bp, Artificial Sequence
  Synthetic
atacgccatgctgggtctccatcaagaagagagaagaatgtctagatgcactagagtccatcatgaccaccaaatcagtaagcttcagacgtctcagcaacttgagaaaacttgtccctgcgtacttgggagtcggccat

SEQ ID NO: 442082 - DNA, 140 bp, Artificial Sequence
  Synthetic
atggccgactcccaagtacgcagggacaagttttctcaagttgctgagacgtctgaagcttactgatttggtggtcatgatggactctagtgcatctagacattcttctctcttcttgatggagacccagcatggcgtat

SEQ ID NO: 442083 - DNA, 140 bp, Artificial Sequence
  Synthetic
aggccctggctgctgatatgcagatgccaggcttgtattcaacagcttattagaagtgaacgacctgatggcgtcggggacacacccgttgcccccctcagcaattatgagtggaggagagaccttttgggacagcggtg

SEQ ID NO: 442084 - DNA, 140 bp, Artificial Sequence
  Synthetic
caccgctgtcccaaaaggtctctcctccactcataattgctgaggggggcaacgggtgtgtccccgacgccatcaggtcgttcacttctaataagctgttgaatacaagcctggcatctgcatatcagcagccagggcct

SEQ ID NO: 442085 - DNA, 140 bp, Artificial Sequence
  Synthetic
atacgccatgctgggtctccatccataaactggttcatcacaagaaactccaatttggctcaaactctgattaggaacattgtgtccctgacaggtcctgatttccctctggaagaagcccgtacttgggagtcggccat

SEQ ID NO: 442086 - DNA, 140 bp, Artificial Sequence
  Synthetic
atggccgactcccaagtacgggcttcttccagagggaaatcaggacctgtcagggacacaatgttcctaatcagagtttgagccaaattggagtttcttgtgatgaaccagtttatggatggagacccagcatggcgtat

SEQ ID NO: 442087 - DNA, 140 bp, Artificial Sequence
  Synthetic
aggccctggctgctgatatgttaggaacattgtgtccctgacaggtcctgatttccctctggaagaagccccagttttcaaaagaacagggtcggccttacataggttcaagtccgccaggaccttttgggacagcggtg

SEQ ID NO: 442088 - DNA, 140 bp, Artificial Sequence
  Synthetic
caccgctgtcccaaaaggtcctggcggacttgaacctatgtaaggccgaccctgttcttttgaaaactggggcttcttccagagggaaatcaggacctgtcagggacacaatgttcctaacatatcagcagccagggcct

SEQ ID NO: 442089 - DNA, 140 bp, Artificial Sequence
  Synthetic
aggccctggctgctgatatgcaattgaatatgtcctatgacctcatcatctgtgatgcagaggtcactgacatcgcatcaatcaaccgaataaccctgctaatgtctgactttgctctatgaccttttgggacagcggtg

SEQ ID NO: 442090 - DNA, 140 bp, Artificial Sequence
  Synthetic
caccgctgtcccaaaaggtcatagagcaaagtcagacattagcagggttattcggttgattgatgcgatgtcagtgacctctgcatcacagatgatgaggtcataggacatattcaattgcatatcagcagccagggcct

SEQ ID NO: 442091 - DNA, 140 bp, Artificial Sequence
  Synthetic
atacgccatgctgggtctcctacgacttcatgttccaaccactgatgctttatgctcagacttggacatcagagctggtacaaagagacacaaggttgaaagactctacgtttcattggccgtacttgggagtcggccat

SEQ ID NO: 442092 - DNA, 140 bp, Artificial Sequence
  Synthetic
atggccgactcccaagtacggccaatgaaacgtagagtctttcaaccttgtgtctctttgtaccagctctgatgtccaagtctgagcataaagcatcagtggttggaacatgaagtcgtaggagacccagcatggcgtat

SEQ ID NO: 442093 - DNA, 140 bp, Artificial Sequence
  Synthetic
aggccctggctgctgatatgagttactggattcataactcagatgacctcttctttttcatccgaactatacctcagattctcaaaacggggaaagttctttcgagatgcagagtatttggaccttttgggacagcggtg

SEQ ID NO: 442094 - DNA, 140 bp, Artificial Sequence
  Synthetic
caccgctgtcccaaaaggtccaaatactctgcatctcgaaagaactttccccgttttgagaatctgaggtatagttcggatgaaaaagaagaggtcatctgagttatgaatccagtaactcatatcagcagccagggcct

SEQ ID NO: 442095 - DNA, 140 bp, Artificial Sequence
  Synthetic
aggccctggctgctgatatgtcccctgatgcaccccctggcagacccgtccacagttttcaaggatggggatgaggctgaggattttgtggaggttcaccttcctgatgtgcacaaacaggaccttttgggacagcggtg

SEQ ID NO: 442096 - DNA, 140 bp, Artificial Sequence
  Synthetic
caccgctgtcccaaaaggtcctgtttgtgcacatcaggaaggtgaacctccacaaaatcctcagcctcatccccatccttgaaaactgtggacgggtctgccagggggtgcatcaggggacatatcagcagccagggcct

SEQ ID NO: 442097 - DNA, 140 bp, Artificial Sequence
  Synthetic
atacgccatgctgggtctccggtttctggagctgtccctcactttcaaaaacttcccgatattcgtttaaaaccaggtgactttgaatctctaagtggtagagaaaagtctcgccacatacgtacttgggagtcggccat

SEQ ID NO: 442098 - DNA, 140 bp, Artificial Sequence
  Synthetic
atggccgactcccaagtacgtatgtggcgagacttttctctaccacttagagattcaaagtcacctggttttaaacgaatatcgggaagtttttgaaagtgagggacagctccagaaaccggagacccagcatggcgtat

SEQ ID NO: 442099 - DNA, 140 bp, Artificial Sequence
  Synthetic
aggccctggctgctgatatgtgagaggatttccagatgagatcatatcgaatccctacaacgaaatgatcataaccttgattgacagcgatgtagaatctttcctggtccacaagatggtgaccttttgggacagcggtg

SEQ ID NO: 442100 - DNA, 140 bp, Artificial Sequence
  Synthetic
caccgctgtcccaaaaggtcaccatcttgtggaccaggaaagattctacatcgctgtcaatcaaggttatgatcatttcgttgtagggattcgatatgatctcatctggaaatcctctcacatatcagcagccagggcct

SEQ ID NO: 442101 - DNA, 140 bp, Artificial Sequence
  Synthetic
aggccctggctgctgatatgctgactgaccctttattctatccgccatctgaccccaaaatcttgagacatttcaatatatgctgcagtaccatgatgtacttgtctaccgccttagggggaccttttgggacagcggtg

SEQ ID NO: 442102 - DNA, 140 bp, Artificial Sequence
  Synthetic
caccgctgtcccaaaaggtccccctaaggcggtagacaagtacatcatggtactgcagcatatattgaaatgtctcaagattttggggtcagatggcggatagaataaagggtcagtcagcatatcagcagccagggcct

SEQ ID NO: 442103 - DNA, 140 bp, Artificial Sequence
  Synthetic
aggccctggctgctgatatgtcaagagtcatgagactttcattaatcatctcagttgatcaaacaagatcatgttgattctcataacacgggaaatcttctagcagtttcagtgatcaacgaccttttgggacagcggtg

SEQ ID NO: 442104 - DNA, 140 bp, Artificial Sequence
  Synthetic
caccgctgtcccaaaaggtcgttgatcactgaaactgctagaagatttcccgtgttatgagaatcaacatgatcttgtttgatcaactgagatgattaatgaaagtctcatgactcttgacatatcagcagccagggcct

SEQ ID NO: 442105 - DNA, 140 bp, Artificial Sequence
  Synthetic
aggccctggctgctgatatgccgcctgtcaatccccgagagtttttgaaatctatagacctcggaggactgccagatgaggacttgataattggcctcaagccaaaggaacgagaattgagaccttttgggacagcggtg

SEQ ID NO: 442106 - DNA, 140 bp, Artificial Sequence
  Synthetic
caccgctgtcccaaaaggtctcaattctcgttcctttggcttgaggccaattatcaagtcctcatctggcagtcctccgaggtctatagatttcaaaaactctcggggattgacaggcggcatatcagcagccagggcct

SEQ ID NO: 442107 - DNA, 140 bp, Artificial Sequence
  Synthetic
atacgccatgctgggtctccgagaggtaataacggcgtctccagagaacgactggttgtggatcttctcggacttcagaagttccaaaatgacatacctgactctcatcacttatcagtccgtacttgggagtcggccat

SEQ ID NO: 442108 - DNA, 140 bp, Artificial Sequence
  Synthetic
atggccgactcccaagtacggactgataagtgatgagagtcaggtatgtcattttggaacttctgaagtccgagaagatccacaaccagtcgttctctggagacgccgttattacctctcggagacccagcatggcgtat

SEQ ID NO: 442109 - DNA, 140 bp, Artificial Sequence
  Synthetic
atacgccatgctgggtctcctttgtcatcaccgaaaagctcttggctaactacatcttgccactttttgacgcactgactatgacagacaacctgaacaaagtgtttaaaaagttgatcgcgtacttgggagtcggccat

SEQ ID NO: 442110 - DNA, 140 bp, Artificial Sequence
  Synthetic
atggccgactcccaagtacgcgatcaactttttaaacactttgttcaggttgtctgtcatagtcagtgcgtcaaaaagtggcaagatgtagttagccaagagcttttcggtgatgacaaaggagacccagcatggcgtat

SEQ ID NO: 442111 - DNA, 140 bp, Artificial Sequence
  Synthetic
atacgccatgctgggtctccgtgcctaagagtcggagggaggtgtcatcctcatgtaaacggagtgtttttcaatggtataattctgggtccggatggacatgtcctgattccagagatgcgtacttgggagtcggccat

SEQ ID NO: 442112 - DNA, 140 bp, Artificial Sequence
  Synthetic
atggccgactcccaagtacgcatctctggaatcaggacatgtccatccggacccagaattataccattgaaaaacactccgtttacatgaggatgacacctccctccgactcttaggcacggagacccagcatggcgtat

SEQ ID NO: 442113 - DNA, 140 bp, Artificial Sequence
  Synthetic
aggccctggctgctgatatgcatctctcctggattacagttgtttgtagactaggcgcccttgagaagatgtattgaccaccattcttgtagggtacaccctgaaaaaaacaagatctcagaccttttgggacagcggtg

SEQ ID NO: 442114 - DNA, 140 bp, Artificial Sequence
  Synthetic
caccgctgtcccaaaaggtctgagatcttgtttttttcagggtgtaccctacaagaatggtggtcaatacatcttctcaagggcgcctagtctacaaacaactgtaatccaggagagatgcatatcagcagccagggcct

SEQ ID NO: 442115 - DNA, 140 bp, Artificial Sequence
  Synthetic
atacgccatgctgggtctccctcactgagaagaactaggtgggtagatcaagaagtccgccatgcagctagaaccatgacgggagattatagccccaacaagaagatgtcacgcaaggcacgtacttgggagtcggccat

SEQ ID NO: 442116 - DNA, 140 bp, Artificial Sequence
  Synthetic
atggccgactcccaagtacgtgccttgcgtgacatcttcttgttggggctataatctcccgtcatggttctagctgcatggcggacttcttgatctacccacctagttcttctcagtgagggagacccagcatggcgtat

SEQ ID NO: 442117 - DNA, 140 bp, Artificial Sequence
  Synthetic
atacgccatgctgggtctccaaaaatgtaacacccctacaatggatgccgacaagattgtatttaaagtcaataatcaggtggtctccttgaagcctgagattatcgtggatcaatatgacgtacttgggagtcggccat

SEQ ID NO: 442118 - DNA, 140 bp, Artificial Sequence
  Synthetic
atggccgactcccaagtacgtcatattgatccacgataatctcaggcttcaaggagaccacctgattattgactttaaatacaatcttgtcggcatccattgtaggggtgttacatttttggagacccagcatggcgtat

SEQ ID NO: 442119 - DNA, 140 bp, Artificial Sequence
  Synthetic
atacgccatgctgggtctccggtttcaaaacccgttgatctctggcttaagagtggtccaatgggcaacaggcgcccattacaagctcaaacctattctggatgatctcaatgttttccccgtacttgggagtcggccat

SEQ ID NO: 442120 - DNA, 140 bp, Artificial Sequence
  Synthetic
atggccgactcccaagtacggggaaaacattgagatcatccagaataggtttgagcttgtaatgggcgcctgttgcccattggaccactcttaagccagagatcaacgggttttgaaaccggagacccagcatggcgtat

SEQ ID NO: 442121 - DNA, 140 bp, Artificial Sequence
  Synthetic
atacgccatgctgggtctccgtccctgtgtctcgtggttggagatggatcggggggaatatcaagagcagtacttaacatgtttccagacgccaagcttgtctttaacagcctgctagaacgtacttgggagtcggccat

SEQ ID NO: 442122 - DNA, 140 bp, Artificial Sequence
  Synthetic
atggccgactcccaagtacgttctagcaggctgttaaagacaagcttggcgtctggaaacatgttaagtactgctcttgatattccccccgatccatctccaaccacgagacacagggacggagacccagcatggcgtat

SEQ ID NO: 442123 - DNA, 140 bp, Artificial Sequence
  Synthetic
aggccctggctgctgatatgtgagggattttctgctcatgtcagtacaggcagtcttccactacctgttgttcagcccaatcttaaagggcagagtttacaagattctgagtgctgaagggaccttttgggacagcggtg

SEQ ID NO: 442124 - DNA, 140 bp, Artificial Sequence
  Synthetic
caccgctgtcccaaaaggtcccttcagcactcagaatcttgtaaactctgccctttaagattgggctgaacaacaggtagtggaagactgcctgtactgacatgagcagaaaatccctcacatatcagcagccagggcct

SEQ ID NO: 442125 - DNA, 140 bp, Artificial Sequence
  Synthetic
atacgccatgctgggtctcctttgggaaaaaccgtccgacctgagaaacttgaccacatggaagtacttccagtcagtccaaaaacaagtgaacatgtcttatgacctcatcatttgtgacgtacttgggagtcggccat

SEQ ID NO: 442126 - DNA, 140 bp, Artificial Sequence
  Synthetic
atggccgactcccaagtacgtcacaaatgatgaggtcataagacatgttcacttgtttttggactgactggaagtacttccatgtggtcaagtttctcaggtcggacggtttttcccaaaggagacccagcatggcgtat

SEQ ID NO: 442127 - DNA, 140 bp, Artificial Sequence
  Synthetic
aggccctggctgctgatatgcagtcagtccaaaaacaagtgaacatgtcttatgacctcatcatttgtgatgcagaagtcaccgacattgcatcaattaaccggataaccttgttgatgtgaccttttgggacagcggtg

SEQ ID NO: 442128 - DNA, 140 bp, Artificial Sequence
  Synthetic
caccgctgtcccaaaaggtcacatcaacaaggttatccggttaattgatgcaatgtcggtgacttctgcatcacaaatgatgaggtcataagacatgttcacttgtttttggactgactgcatatcagcagccagggcct

SEQ ID NO: 442129 - DNA, 140 bp, Artificial Sequence
  Synthetic
atacgccatgctgggtctccgagggcattcccctcagtcacaggatttataactcaaatgacttcatctttctcatccgagttatacctcagattctccaaacgtgggaagttcttccggcgtacttgggagtcggccat

SEQ ID NO: 442130 - DNA, 140 bp, Artificial Sequence
  Synthetic
atggccgactcccaagtacgccggaagaacttcccacgtttggagaatctgaggtataactcggatgagaaagatgaagtcatttgagttataaatcctgtgactgaggggaatgccctcggagacccagcatggcgtat

SEQ ID NO: 442131 - DNA, 140 bp, Artificial Sequence
  Synthetic
atacgccatgctgggtctccattatcaagatcttgtaagagggtttccagaagaaatcatatccaatccttacaacgagatgatcattactctaattgacagtgatgtggaatctttcttcgtacttgggagtcggccat

SEQ ID NO: 442132 - DNA, 140 bp, Artificial Sequence
  Synthetic
atggccgactcccaagtacgaagaaagattccacatcactgtcaattagagtaatgatcatctcgttgtaaggattggatatgatttcttctggaaaccctcttacaagatcttgataatggagacccagcatggcgtat

SEQ ID NO: 442133 - DNA, 140 bp, Artificial Sequence
  Synthetic
atacgccatgctgggtctccatgaagcggaggactttgttgaggttcaccttccggacgttcacaagcaggtctcaggggtcgatcttggtctcccaaactgggggaaatatgtgctgatcgtacttgggagtcggccat

SEQ ID NO: 442134 - DNA, 140 bp, Artificial Sequence
  Synthetic
atggccgactcccaagtacgatcagcacatatttcccccagtttgggagaccaagatcgacccctgagacctgcttgtgaacgtccggaaggtgaacctcaacaaagtcctccgcttcatggagacccagcatggcgtat

SEQ ID NO: 442135 - DNA, 140 bp, Artificial Sequence
  Synthetic
atacgccatgctgggtctccaatgtctctaagccattgactgaccctttgttctacccgccatcagatcccaaaatcttgagacacttcaacatatgctgcagtacaatgatgtatctgtcgtacttgggagtcggccat

SEQ ID NO: 442136 - DNA, 140 bp, Artificial Sequence
  Synthetic
atggccgactcccaagtacgacagatacatcattgtactgcagcatatgttgaagtgtctcaagattttgggatctgatggcgggtagaacaaagggtcagtcaatggcttagagacattggagacccagcatggcgtat

SEQ ID NO: 442137 - DNA, 140 bp, Artificial Sequence
  Synthetic
atacgccatgctgggtctcctaaggcagaagggctggagtctagtcagcttattgatgatagatagagaatctcaaaccaggaacacaagaaccaagatactagctcaaggagacaaccacgtacttgggagtcggccat

SEQ ID NO: 442138 - DNA, 140 bp, Artificial Sequence
  Synthetic
atggccgactcccaagtacgtggttgtctccttgagctagtatcttggttcttgtgttcctggtttgagattctctatctatcatcaataagctgactagactccagcccttctgccttaggagacccagcatggcgtat

SEQ ID NO: 442139 - DNA, 140 bp, Artificial Sequence
  Synthetic
aggccctggctgctgatatgtacttgggctcgtccacctccatgtcaacccagttgttccatgcatgggaaaaagtcactaacgttcatgtggtgaaaagagctctatcgttaaaagaatgaccttttgggacagcggtg

SEQ ID NO: 442140 - DNA, 140 bp, Artificial Sequence
  Synthetic
caccgctgtcccaaaaggtcattcttttaacgatagagctcttttcaccacatgaacgttagtgactttttcccatgcatggaacaactgggttgacatggaggtggacgagcccaagtacatatcagcagccagggcct

SEQ ID NO: 442141 - DNA, 140 bp, Artificial Sequence
  Synthetic
aggccctggctgctgatatgatatagtagatttggtgggtgacacgtggcacaagctcccgatcacccagatcttcgagatccccgaatcaatggacccttcggagatactagatgataagaccttttgggacagcggtg

SEQ ID NO: 442142 - DNA, 140 bp, Artificial Sequence
  Synthetic
caccgctgtcccaaaaggtcttatcatctagtatctccgaagggtccattgattcggggatctcgaagatctgggtgatcgggagcttgtgccacgtgtcacccaccaaatctactatatcatatcagcagccagggcct

SEQ ID NO: 442143 - DNA, 140 bp, Artificial Sequence
  Synthetic
atacgccatgctgggtctccagaaatagagaggcatcttcaaggatataacaggtggatcaccctcgaggacataagatccagatcatctctactggactatagctgcttataaactgaacgtacttgggagtcggccat

SEQ ID NO: 442144 - DNA, 140 bp, Artificial Sequence
  Synthetic
atggccgactcccaagtacgttcagtttataagcagctatagtccagtagagatgatctggatcttatgtcctcgagggtgatccacctgttatatccttgaagatgcctctctatttctggagacccagcatggcgtat

SEQ ID NO: 442145 - DNA, 140 bp, Artificial Sequence
  Synthetic
atacgccatgctgggtctccccatccttatacatcatgctcagagaaccgtctctgagaggagaaatattctctattccacaaaagatccccgccgcttacccaaccacaatgaaagaggcgtacttgggagtcggccat

SEQ ID NO: 442146 - DNA, 140 bp, Artificial Sequence
  Synthetic
atggccgactcccaagtacgcctctttcattgtggttgggtaagcggcggggatcttttgtggaatagagaatatttctcctctcagagacggttctctgagcatgatgtataaggatggggagacccagcatggcgtat

SEQ ID NO: 442147 - DNA, 140 bp, Artificial Sequence
  Synthetic
atacgccatgctgggtctcctgattttggggggcttatacatgatgcgactcttagatgatgcttctagaaaaaaacaagatcccaagtcagaacctctgattgtttgattgttttttctcgtacttgggagtcggccat

SEQ ID NO: 442148 - DNA, 140 bp, Artificial Sequence
  Synthetic
atggccgactcccaagtacgagaaaaaacaatcaaacaatcagaggttctgacttgggatcttgtttttttctagaagcatcatctaagagtcgcatcatgtataagccccccaaaatcaggagacccagcatggcgtat

SEQ ID NO: 442149 - DNA, 140 bp, Artificial Sequence
  Synthetic
atacgccatgctgggtctccgtacaagtacccggctatcaaggacttgaagaaacccagcataaccctaggaaaagctcctgatctgaacaaagcatacaagtctgtcttatcgggcatgcgtacttgggagtcggccat

SEQ ID NO: 442150 - DNA, 140 bp, Artificial Sequence
  Synthetic
atggccgactcccaagtacgcatgcccgataagacagacttgtatgctttgttcagatcaggagcttttcctagggttatgctgggtttcttcaagtccttgatagccgggtacttgtacggagacccagcatggcgtat

SEQ ID NO: 442151 - DNA, 140 bp, Artificial Sequence
  Synthetic
atacgccatgctgggtctccctcccatgagtcctggattcacgcgttgtgtcaagaggctgggaacccagatctcggagagagaacactcgagagctttactcgccttttagaagatcctcgtacttgggagtcggccat

SEQ ID NO: 442152 - DNA, 140 bp, Artificial Sequence
  Synthetic
atggccgactcccaagtacgaggatcttctaaaaggcgagtaaagctctcgagtgttctctctccgagatctgggttcccagcctcttgacacaacgcgtgaatccaggactcatgggagggagacccagcatggcgtat

SEQ ID NO: 442153 - DNA, 140 bp, Artificial Sequence
  Synthetic
atacgccatgctgggtctccctctttttaaaatctgttgagcctctgtttcctcgatttctcagtgagctcttcagctcgtccttcttgggaatccctgagtcaatcattggactgataccgtacttgggagtcggccat

SEQ ID NO: 442154 - DNA, 140 bp, Artificial Sequence
  Synthetic
atggccgactcccaagtacggtatcagtccaatgattgactcagggattcccaagaaggacgagctgaagagctcactgagaaatcgaggaaacagaggctcaacagattttaaaaagagggagacccagcatggcgtat

SEQ ID NO: 442155 - DNA, 140 bp, Artificial Sequence
  Synthetic
aggccctggctgctgatatgttctatccctcagaaaatccccgccgcttatccaaccaccatgaaagaaggcaacagatcgatcttgtgttatctccaacatgtgctacgctatgagcgagaccttttgggacagcggtg

SEQ ID NO: 442156 - DNA, 140 bp, Artificial Sequence
  Synthetic
caccgctgtcccaaaaggtctcgctcatagcgtagcacatgttggagataacacaagatcgatctgttgccttctttcatggtggttggataagcggcggggattttctgagggatagaacatatcagcagccagggcct

SEQ ID NO: 442157 - DNA, 140 bp, Artificial Sequence
  Synthetic
atacgccatgctgggtctcctcaggaaggaaagtatcggttactcctcaaaatgggaaggtcatgtcttcatgggagtattacaagagtgagggcaggaccagtctgtgagtgctggccacgtacttgggagtcggccat

SEQ ID NO: 442158 - DNA, 140 bp, Artificial Sequence
  Synthetic
atggccgactcccaagtacgtggccagcactcacagactggtcctgccctcactcttgtaatactcccatgaagacatgaccttcccattttgaggagtaaccgatactttccttcctgaggagacccagcatggcgtat

SEQ ID NO: 442159 - DNA, 140 bp, Artificial Sequence
  Synthetic
atacgccatgctgggtctccaggatacaatgacggaactatcttccctgtcaacatatatggcaaggtctcccctagagactatttaagggggcttgcaagaggagttctaatagggtcgcgtacttgggagtcggccat

SEQ ID NO: 442160 - DNA, 140 bp, Artificial Sequence
  Synthetic
atggccgactcccaagtacgcgaccctattagaactcctcttgcaagcccccttaaatagtctctaggggagaccttgccatatatgttgacagggaagatagttccgtcattgtatcctggagacccagcatggcgtat

SEQ ID NO: 442161 - DNA, 140 bp, Artificial Sequence
  Synthetic
atacgccatgctgggtctcccttcagaagttccaaaatgacctatctaacccttatcacctatcagtctcatcttttacttcagagggttgagaagagtctctctaaaagtatgagggcccgtacttgggagtcggccat

SEQ ID NO: 442162 - DNA, 140 bp, Artificial Sequence
  Synthetic
atggccgactcccaagtacgggccctcatacttttagagagactcttctcaaccctctgaagtaaaagatgagactgataggtgataagggttagataggtcattttggaacttctgaagggagacccagcatggcgtat

SEQ ID NO: 442163 - DNA, 140 bp, Artificial Sequence
  Synthetic
aggccctggctgctgatatgtgagtggaggagatgacatcatttccagagttatagattttgactcaatctgggaaaaaccgtccgacctgaggaacttggccacctggagatacttccagaccttttgggacagcggtg

SEQ ID NO: 442164 - DNA, 140 bp, Artificial Sequence
  Synthetic
caccgctgtcccaaaaggtctggaagtatctccaggtggccaagttcctcaggtcggacggtttttcccagattgagtcaaaatctataactctggaaatgatgtcatctcctccactcacatatcagcagccagggcct

SEQ ID NO: 442165 - DNA, 140 bp, Artificial Sequence
  Synthetic
aggccctggctgctgatatggttccatatacgtcagttctcagaccctgtctctgaagggttgtcattctggagagagatctggttaagctcccacgaatcctggattcacgcgttgtgtgaccttttgggacagcggtg

SEQ ID NO: 442166 - DNA, 140 bp, Artificial Sequence
  Synthetic
caccgctgtcccaaaaggtcacacaacgcgtgaatccaggattcgtgggagcttaaccagatctctctccagaatgacaacccttcagagacagggtctgagaactgacgtatatggaaccatatcagcagccagggcct

SEQ ID NO: 442167 - DNA, 140 bp, Artificial Sequence
  Synthetic
aggccctggctgctgatatgtcccatgatagcggattcagcatgagtttatcgagaaaggcagtcagtctcccatgaaggacataagcaatagctcactatcatattgcatctcagcaaagaccttttgggacagcggtg

SEQ ID NO: 442168 - DNA, 140 bp, Artificial Sequence
  Synthetic
caccgctgtcccaaaaggtctttgctgagatgcaatatgatagtgagctattgcttatgtccttcatgggagactgactgcctttctcgataaactcatgctgaatccgctatcatgggacatatcagcagccagggcct

SEQ ID NO: 442169 - DNA, 140 bp, Artificial Sequence
  Synthetic
aggccctggctgctgatatgagatgcaatcgtccctccttcagcagcatatggagttgttggaatcctcagttatccccctgatgcaccctttagcagacccgtctacagttttcaaggagaccttttgggacagcggtg

SEQ ID NO: 442170 - DNA, 140 bp, Artificial Sequence
  Synthetic
caccgctgtcccaaaaggtctccttgaaaactgtagacgggtctgctaaagggtgcatcagggggataactgaggattccaacaactccatatgctgctgaaggagggacgattgcatctcatatcagcagccagggcct

SEQ ID NO: 442171 - DNA, 140 bp, Artificial Sequence
  Synthetic
atacgccatgctgggtctccttcgagagtcaagaaactttcattaatcatcccaactgatcagacacagttacgtaggttctgataatgtatgacgtcttctgacagtgtcagtgaccaacgtacttgggagtcggccat

SEQ ID NO: 442172 - DNA, 140 bp, Artificial Sequence
  Synthetic
atggccgactcccaagtacgttggtcactgacactgtcagaagacgtcatacattatcagaacctacgtaactgtgtctgatcagttgggatgattaatgaaagtttcttgactctcgaaggagacccagcatggcgtat

SEQ ID NO: 442173 - DNA, 140 bp, Artificial Sequence
  Synthetic
atacgccatgctgggtctccctcagcaggttgcggtttcgacctcagcaaacccagcccctgcttctgagctggacatcagaaccctctctaggaggcttcaaaacccattaatctcaggcgtacttgggagtcggccat

SEQ ID NO: 442174 - DNA, 140 bp, Artificial Sequence
  Synthetic
atggccgactcccaagtacgcctgagattaatgggttttgaagcctcctagagagggttctgatgtccagctcagaagcaggggctgggtttgctgaggtcgaaaccgcaacctgctgagggagacccagcatggcgtat

SEQ ID NO: 442175 - DNA, 140 bp, Artificial Sequence
  Synthetic
atacgccatgctgggtctccgatagtgaagactaccagactcattggcagcatcgaggacctatccggagaggtagaaagacaccttcatgggtacaacaggtggatcaccctcaaggatcgtacttgggagtcggccat

SEQ ID NO: 442176 - DNA, 140 bp, Artificial Sequence
  Synthetic
atggccgactcccaagtacgatccttgagggtgatccacctgttgtacccatgaaggtgtctttctacctctccggataggtcctcgatgctgccaatgagtctggtagtcttcactatcggagacccagcatggcgtat

SEQ ID NO: 442177 - DNA, 140 bp, Artificial Sequence
  Synthetic
aggccctggctgctgatatgctttctccgcaagatcgtgaaaaattgcagggatgaggacgcccaaaagtcctcgcctgtgtctgcccctccggatgatgatgatctgtggttgcctcctgaccttttgggacagcggtg

SEQ ID NO: 442178 - DNA, 140 bp, Artificial Sequence
  Synthetic
caccgctgtcccaaaaggtcaggaggcaaccacagatcatcatcatccggaggggcagacacaggcgaggacttttgggcgtcctcatccctgcaatttttcacgatcttgcggagaaagcatatcagcagccagggcct

SEQ ID NO: 442179 - DNA, 140 bp, Artificial Sequence
  Synthetic
atacgccatgctgggtctccgcctcccatgatggacataagcaatagttcacaaccatcttgcatctcagtgaagtgtacataactattgagggctgggtcatctaagcatttcagtcgacgtacttgggagtcggccat

SEQ ID NO: 442180 - DNA, 140 bp, Artificial Sequence
  Synthetic
atggccgactcccaagtacgtcgactgaaatgcttagatgacccagccctcaatagttatgtacacttcactgagatgcaagatggttgtgaactattgcttatgtccatcatgggaggcggagacccagcatggcgtat

SEQ ID NO: 442181 - DNA, 140 bp, Artificial Sequence
  Synthetic
aggccctggctgctgatatgtttctattattatagccatcgtgatagtcttctccaatagggtgttcaatgtttcgaaaccgctgactgaccctttattctatccgccatctgatcccaagaccttttgggacagcggtg

SEQ ID NO: 442182 - DNA, 140 bp, Artificial Sequence
  Synthetic
caccgctgtcccaaaaggtcttgggatcagatggcggatagaataaagggtcagtcagcggtttcgaaacattgaacaccctattggagaagactatcacgatggctataataatagaaacatatcagcagccagggcct

SEQ ID NO: 442183 - DNA, 140 bp, Artificial Sequence
  Synthetic
atacgccatgctgggtctcccctgaatacgtcccgctgaaagaactcacaagcaagaagaacatgaggaacttttgtatcaacggagaggttagagtgtgtagcccgaatggttactcgtcgtacttgggagtcggccat

SEQ ID NO: 442184 - DNA, 140 bp, Artificial Sequence
  Synthetic
atggccgactcccaagtacgacgagtaaccattcgggctacacactctaacctctccgttgatacaaaagttcctcatgttcttcttgcttgtgagttctttcagcgggacgtattcaggggagacccagcatggcgtat

SEQ ID NO: 442185 - DNA, 140 bp, Artificial Sequence
  Synthetic
atacgccatgctgggtctccggctcactataagctcaaacctattttggatgatctcaatgtcttcccatccctatgtctggtggtcggggatggatcaggggggatatcaagagcggtgcgtacttgggagtcggccat

SEQ ID NO: 442186 - DNA, 140 bp, Artificial Sequence
  Synthetic
atggccgactcccaagtacgcaccgctcttgatatcccccctgatccatccccgaccaccagacatagggatgggaagacattgagatcatccaaaataggtttgagcttatagtgagccggagacccagcatggcgtat

SEQ ID NO: 442187 - DNA, 140 bp, Artificial Sequence
  Synthetic
atacgccatgctgggtctcctgaagtagccttggctgatgacggaaccgtcaattctgatgacgaggactacttctctagtgagaccaggagtccggaggcagtctacactcgaatcatgcgtacttgggagtcggccat

SEQ ID NO: 442188 - DNA, 140 bp, Artificial Sequence
  Synthetic
atggccgactcccaagtacgcatgattcgagtgtagactgcctccggactcctggtctcactagagaagtagtcctcgtcatcagaattgacggttccgtcatcagccaaggctacttcaggagacccagcatggcgtat

SEQ ID NO: 442189 - DNA, 140 bp, Artificial Sequence
  Synthetic
atacgccatgctgggtctccatctgggagaggaattcttcgggaaaggaacattcgaaagaagattcttcagagatgagaaagaacttcaagaatacgaggcggctgaactgacaaagaccgtacttgggagtcggccat

SEQ ID NO: 442190 - DNA, 140 bp, Artificial Sequence
  Synthetic
atggccgactcccaagtacggtctttgtcagttcagccgcctcgtattcttgaagttctttctcatctctgaagaatcttctttcgaatgttcctttcccgaagaattcctctcccagatggagacccagcatggcgtat

SEQ ID NO: 442191 - DNA, 140 bp, Artificial Sequence
  Synthetic
atacgccatgctgggtctccagagactgctgttcctcactcttatttcatccattttcgctcattgggcttgagtgggaaatctccatattcatcaaatgcagttggtcatgtgttcaaccgtacttgggagtcggccat

SEQ ID NO: 442192 - DNA, 140 bp, Artificial Sequence
  Synthetic
atggccgactcccaagtacggttgaacacatgaccaactgcatttgatgaatatggagatttcccactcaagcccaatgagcgaaaatggatgaaataagagtgaggaacagcagtctctggagacccagcatggcgtat

SEQ ID NO: 442193 - DNA, 140 bp, Artificial Sequence
  Synthetic
aggccctggctgctgatatgacggttaacttccccaacccttcaggaaggtcttcagaggataaatcaacccaaaccactggtcgagagcccaagaaggagacaacatccactccttctcgaccttttgggacagcggtg

SEQ ID NO: 442194 - DNA, 140 bp, Artificial Sequence
  Synthetic
caccgctgtcccaaaaggtcgagaaggagtggatgttgtctccttcttgggctctcgaccagtggtttgggttgatttatcctctgaagaccttcctgaagggttggggaagttaaccgtcatatcagcagccagggcct

SEQ ID NO: 442195 - DNA, 140 bp, Artificial Sequence
  Synthetic
aggccctggctgctgatatgacaagttcccctctcgatcttcagggatattcttgtataattttgagcagttgaaaatgaaccttgatgatatagtcaaggaggcaaaaaatgtgccagggaccttttgggacagcggtg

SEQ ID NO: 442196 - DNA, 140 bp, Artificial Sequence
  Synthetic
caccgctgtcccaaaaggtccctggcacattttttgcctccttgactatatcatcaaggttcattttcaactgctcaaaattatacaagaatatccctgaagatcgagaggggaacttgtcatatcagcagccagggcct

SEQ ID NO: 442197 - DNA, 140 bp, Artificial Sequence
  Synthetic
aggccctggctgctgatatgcttgcatctctaatgaccaaatagtcaacctagccaatataatgtcgacagtatccaccaatgcgctgacagtagcacaacactctcaatctctgattaagaccttttgggacagcggtg

SEQ ID NO: 442198 - DNA, 140 bp, Artificial Sequence
  Synthetic
caccgctgtcccaaaaggtcttaatcagagattgagagtgttgtgctactgtcagcgcattggtggatactgtcgacattatattggctaggttgactatttggtcattagagatgcaagcatatcagcagccagggcct

SEQ ID NO: 442199 - DNA, 140 bp, Artificial Sequence
  Synthetic
atacgccatgctgggtctccctctgcgcagaacgaagtgggtggatcaagaagtgcgccatgcagccagaaccatgatcggggattacagccctaacaaaaagatgtcacgcaaggcaggcgtacttgggagtcggccat

SEQ ID NO: 442200 - DNA, 140 bp, Artificial Sequence
  Synthetic
atggccgactcccaagtacgcctgccttgcgtgacatctttttgttagggctgtaatccccgatcatggttctggctgcatggcgcacttcttgatccacccacttcgttctgcgcagagggagacccagcatggcgtat

SEQ ID NO: 442201 - DNA, 140 bp, Artificial Sequence
  Synthetic
atacgccatgctgggtctccctttctacgtaagatagtgaaaaactgtagggatgaggacactcaaaaaccctctcctgtgtcagcccctccggatgacgatgacctgtggcttccaccccgtacttgggagtcggccat

SEQ ID NO: 442202 - DNA, 140 bp, Artificial Sequence
  Synthetic
atggccgactcccaagtacggggtggaagccacaggtcatcgtcatccggaggggctgacacaggagagggtttttgagtgtcctcatccctacagtttttcactatcttacgtagaaagggagacccagcatggcgtat

SEQ ID NO: 442203 - DNA, 140 bp, Artificial Sequence
  Synthetic
atacgccatgctgggtctcccctctcctgtgtcagcccctccggatgacgatgacctgtggcttccaccccctgaatacgtcccgctgaaagaactcacaagcaagaagaacatgaggaacgtacttgggagtcggccat

SEQ ID NO: 442204 - DNA, 140 bp, Artificial Sequence
  Synthetic
atggccgactcccaagtacgttcctcatgttcttcttgcttgtgagttctttcagcgggacgtattcagggggtggaagccacaggtcatcgtcatccggaggggctgacacaggagaggggagacccagcatggcgtat

SEQ ID NO: 442205 - DNA, 140 bp, Artificial Sequence
  Synthetic
aggccctggctgctgatatgaatcataggatgattgggttagtcaaagttgttattggactagctttgtcaggagctccagtccctgagggcatgaactgggtatacaaactgaggagaagaccttttgggacagcggtg

SEQ ID NO: 442206 - DNA, 140 bp, Artificial Sequence
  Synthetic
caccgctgtcccaaaaggtcttctcctcagtttgtatacccagttcatgccctcagggactggagctcctgacaaagctagtccaataacaactttgactaacccaatcatcctatgattcatatcagcagccagggcct

SEQ ID NO: 442207 - DNA, 140 bp, Artificial Sequence
  Synthetic
atacgccatgctgggtctccaggagctccagtccctgagggcatgaactgggtatacaaactgaggagaacccttatcttccagtgggctgattctaggggccctcttgaaggggaggagcgtacttgggagtcggccat

SEQ ID NO: 442208 - DNA, 140 bp, Artificial Sequence
  Synthetic
atggccgactcccaagtacgctcctccccttcaagagggcccctagaatcagcccactggaagataagggttctcctcagtttgtatacccagttcatgccctcagggactggagctcctggagacccagcatggcgtat

SEQ ID NO: 442209 - DNA, 140 bp, Artificial Sequence
  Synthetic
atacgccatgctgggtctccaatttggttgtggaggacgaaggatgcaccaacctgtcagggttctcctacatggaacttaaagttggatacatctcagccataaaagtgaacgggttcacgtacttgggagtcggccat

SEQ ID NO: 442210 - DNA, 140 bp, Artificial Sequence
  Synthetic
atggccgactcccaagtacgtgaacccgttcacttttatggctgagatgtatccaactttaagttccatgtaggagaaccctgacaggttggtgcatccttcgtcctccacaaccaaattggagacccagcatggcgtat

SEQ ID NO: 442211 - DNA, 140 bp, Artificial Sequence
  Synthetic
aggccctggctgctgatatgcatggaacttaaagttggatacatctcagccataaaagtgaacgggttcacttgcacaggcgttgtgacagaggcagaaacctacaccaactttgttggtgaccttttgggacagcggtg

SEQ ID NO: 442212 - DNA, 140 bp, Artificial Sequence
  Synthetic
caccgctgtcccaaaaggtcaccaacaaagttggtgtaggtttctgcctctgtcacaacgcctgtgcaagtgaacccgttcacttttatggctgagatgtatccaactttaagttccatgcatatcagcagccagggcct

SEQ ID NO: 442213 - DNA, 140 bp, Artificial Sequence
  Synthetic
aggccctggctgctgatatgtgtctaagggtgggagggaggtgtcatcctcatgtgaacggggtgttttttaatggtataatactagggcccgatggccatgttctaatcccagaaatgcgaccttttgggacagcggtg

SEQ ID NO: 442214 - DNA, 140 bp, Artificial Sequence
  Synthetic
caccgctgtcccaaaaggtcgcatttctgggattagaacatggccatcgggccctagtattataccattaaaaaacaccccgttcacatgaggatgacacctccctcccacccttagacacatatcagcagccagggcct

SEQ ID NO: 442215 - DNA, 140 bp, Artificial Sequence
  Synthetic
aggccctggctgctgatatgagtctctacacaatccgtaccctgactaccattggcttcgaactgtaaaaaccacaaaggagtctctcgttatcatatccccaagtgtggcagatttggagaccttttgggacagcggtg

SEQ ID NO: 442216 - DNA, 140 bp, Artificial Sequence
  Synthetic
caccgctgtcccaaaaggtctccaaatctgccacacttggggatatgataacgagagactcctttgtggtttttacagttcgaagccaatggtagtcagggtacggattgtgtagagactcatatcagcagccagggcct

SEQ ID NO: 442217 - DNA, 140 bp, Artificial Sequence
  Synthetic
aggccctggctgctgatatgatctcctactccagaggattgagagaaatttgtctaaaggtatgagagccagcctgcgacaaatgagttctttaatgaggcaggtgctgggtgggcacgggaccttttgggacagcggtg

SEQ ID NO: 442218 - DNA, 140 bp, Artificial Sequence
  Synthetic
caccgctgtcccaaaaggtcccgtgcccacccagcacctgcctcattaaagaactcatttgtcgcaggctggctctcatacctttagacaaatttctctcaatcctctggagtaggagatcatatcagcagccagggcct

SEQ ID NO: 442219 - DNA, 140 bp, Artificial Sequence
  Synthetic
atacgccatgctgggtctccatgaatggaggcagactcaaaaggtcacacataaggagatttgtctcagttagctccaatcatcaagctcgccctaattcattcgctgagtttttaaacacgtacttgggagtcggccat

SEQ ID NO: 442220 - DNA, 140 bp, Artificial Sequence
  Synthetic
atggccgactcccaagtacgtgtttaaaaactcagcgaatgaattagggcgagcttgatgattggagctaactgagacaaatctccttatgtgtgaccttttgagtctgcctccattcatggagacccagcatggcgtat

SEQ ID NO: 442221 - DNA, 140 bp, Artificial Sequence
  Synthetic
aggccctggctgctgatatggtgtttaagagttggagggaggtgtcatcctcatgtgaacggggtgtttttcaatggtataatattgggacctgacggccatgttctaatcccagagatggaccttttgggacagcggtg

SEQ ID NO: 442222 - DNA, 140 bp, Artificial Sequence
  Synthetic
caccgctgtcccaaaaggtccatctctgggattagaacatggccgtcaggtcccaatattataccattgaaaaacaccccgttcacatgaggatgacacctccctccaactcttaaacaccatatcagcagccagggcct

SEQ ID NO: 442223 - DNA, 140 bp, Artificial Sequence
  Synthetic
aggccctggctgctgatatgacgaggctgaggattttgtagaagttcaccttcccgacgtgcacaagcaggtctcaggggttgatctgggtctcccaaactgggggaagtatgtattactgaccttttgggacagcggtg

SEQ ID NO: 442224 - DNA, 140 bp, Artificial Sequence
  Synthetic
caccgctgtcccaaaaggtcagtaatacatacttcccccagtttgggagacccagatcaacccctgagacctgcttgtgcacgtcgggaaggtgaacttctacaaaatcctcagcctcgtcatatcagcagccagggcct

SEQ ID NO: 442225 - DNA, 140 bp, Artificial Sequence
  Synthetic
atacgccatgctgggtctccagaggagggccggtccctagcgagaaggtcatcattacggctctttccaaacctcctgtcaacccaagagaatttttgaagtctatagaccttggaggatcgtacttgggagtcggccat

SEQ ID NO: 442226 - DNA, 140 bp, Artificial Sequence
  Synthetic
atggccgactcccaagtacgatcctccaaggtctatagacttcaaaaattctcttgggttgacaggaggtttggaaagagccgtaatgatgaccttctcgctagggaccggccctcctctggagacccagcatggcgtat

SEQ ID NO: 442227 - DNA, 140 bp, Artificial Sequence
  Synthetic
aggccctggctgctgatatgtgaggctgaagattttattgaagttcaccttcccgatgtacacaaacaggtctcaggggttgacctgggtctcccagactgggggaagtacgtgttgatggaccttttgggacagcggtg

SEQ ID NO: 442228 - DNA, 140 bp, Artificial Sequence
  Synthetic
caccgctgtcccaaaaggtccatcaacacgtacttcccccagtctgggagacccaggtcaacccctgagacctgtttgtgtacatcgggaaggtgaacttcaataaaatcttcagcctcacatatcagcagccagggcct

SEQ ID NO: 442229 - DNA, 140 bp, Artificial Sequence
  Synthetic
aggccctggctgctgatatgacggggaggaaggtgtcggtcacctcccaaagcgggaaggtcatatcttcatgggagtcgtataaaagtgggggtgagactaggctgtgaaggccggtcagaccttttgggacagcggtg

SEQ ID NO: 442230 - DNA, 140 bp, Artificial Sequence
  Synthetic
caccgctgtcccaaaaggtctgaccggccttcacagcctagtctcacccccacttttatacgactcccatgaagatatgaccttcccgctttgggaggtgaccgacaccttcctccccgtcatatcagcagccagggcct

SEQ ID NO: 442231 - DNA, 140 bp, Artificial Sequence
  Synthetic
aggccctggctgctgatatgtcctttcgacgcttcaagttccgaagatcacctccccttttggggtttggggggaatctctgggctcaatagttctccttgaactccatccaacagggtagaccttttgggacagcggtg

SEQ ID NO: 442232 - DNA, 140 bp, Artificial Sequence
  Synthetic
caccgctgtcccaaaaggtctaccctgttggatggagttcaaggagaactattgagcccagagattccccccaaaccccaaaaggggaggtgatcttcggaacttgaagcgtcgaaaggacatatcagcagccagggcct

SEQ ID NO: 442233 - DNA, 140 bp, Artificial Sequence
  Synthetic
atacgccatgctgggtctccttcccttacattaaaccaaataggagttagttgagagaagttgtttgcctcctatgaaggacatgagcaatagatcacaatcatcttacatcccgataagcgtacttgggagtcggccat

SEQ ID NO: 442234 - DNA, 140 bp, Artificial Sequence
  Synthetic
atggccgactcccaagtacgcttatcgggatgtaagatgattgtgatctattgctcatgtccttcataggaggcaaacaacttctctcaactaactcctatttggtttaatgtaagggaaggagacccagcatggcgtat

SEQ ID NO: 442235 - DNA, 140 bp, Artificial Sequence
  Synthetic
atacgccatgctgggtctcctatctccaatgatcaaatagtaaacctcgctaatataatgtcgacagtctccaccaacgccttaactgtcgctcaacattcccaatctttgatcaagccgcgtacttgggagtcggccat

SEQ ID NO: 442236 - DNA, 140 bp, Artificial Sequence
  Synthetic
atggccgactcccaagtacgcggcttgatcaaagattgggaatgttgagcgacagttaaggcgttggtggagactgtcgacattatattagcgaggtttactatttgatcattggagataggagacccagcatggcgtat

SEQ ID NO: 442237 - DNA, 140 bp, Artificial Sequence
  Synthetic
aggccctggctgctgatatgtaccaggaccttgtaagaggatttcctgaggagatcatatccaacccatataatgagatgatcataactctgattgacagtgatgtggaatctttcctgggaccttttgggacagcggtg

SEQ ID NO: 442238 - DNA, 140 bp, Artificial Sequence
  Synthetic
caccgctgtcccaaaaggtcccaggaaagattccacatcactgtcaatcagagttatgatcatctcattatatgggttggatatgatctcctcaggaaatcctcttacaaggtcctggtacatatcagcagccagggcct

SEQ ID NO: 442239 - DNA, 140 bp, Artificial Sequence
  Synthetic
atacgccatgctgggtctccaacttggtcgtggaggacgagggatgcaccaacctgtcaggattctcctacatggagctcaaagtgggatacatctccgccataaaagtgaacgggttcacgtacttgggagtcggccat

SEQ ID NO: 442240 - DNA, 140 bp, Artificial Sequence
  Synthetic
atggccgactcccaagtacgtgaacccgttcacttttatggcggagatgtatcccactttgagctccatgtaggagaatcctgacaggttggtgcatccctcgtcctccacgaccaagttggagacccagcatggcgtat

SEQ ID NO: 442241 - DNA, 140 bp, Artificial Sequence
  Synthetic
aggccctggctgctgatatgcagggaggaaggtgtcagttacttcccaaagcgggaaggtcatatcttcatgggagtcctataaaagtgggggggagactagactgtgaggatcggttatgaccttttgggacagcggtg

SEQ ID NO: 442242 - DNA, 140 bp, Artificial Sequence
  Synthetic
caccgctgtcccaaaaggtcataaccgatcctcacagtctagtctcccccccacttttataggactcccatgaagatatgaccttcccgctttgggaagtaactgacaccttcctccctgcatatcagcagccagggcct

SEQ ID NO: 442243 - DNA, 140 bp, Artificial Sequence
  Synthetic
atacgccatgctgggtctcctgtggaggctgaaatcgctcaccagattgctgagagcttttccaagaagtacaaattcccttcccgatcgtcagggatattcttgtataactttgagcagcgtacttgggagtcggccat

SEQ ID NO: 442244 - DNA, 140 bp, Artificial Sequence
  Synthetic
atggccgactcccaagtacgctgctcaaagttatacaagaatatccctgacgatcgggaagggaatttgtacttcttggaaaagctctcagcaatctggtgagcgatttcagcctccacaggagacccagcatggcgtat

SEQ ID NO: 442245 - DNA, 140 bp, Artificial Sequence
  Synthetic
aggccctggctgctgatatgcatcgctggggatcaagtcttgtctatgtgtggaaactccggctatgaagtcattaaaatattggagccatatgtcgtgaacagtttagtccagagagcagaccttttgggacagcggtg

SEQ ID NO: 442246 - DNA, 140 bp, Artificial Sequence
  Synthetic
caccgctgtcccaaaaggtctgctctctggactaaactgttcacgacatatggctccaatattttaatgacttcatagccggagtttccacacatagacaagacttgatccccagcgatgcatatcagcagccagggcct

SEQ ID NO: 442247 - DNA, 140 bp, Artificial Sequence
  Synthetic
atacgccatgctgggtctcctgctccaagtccaacatgaaaaaaacgggcaacaccactgataaaatgaactttctgcgcaagatagtgaagaactgtagagatgagaacactcagaagtcgtacttgggagtcggccat

SEQ ID NO: 442248 - DNA, 140 bp, Artificial Sequence
  Synthetic
atggccgactcccaagtacgacttctgagtgttctcatctctacagttcttcactatcttgcgcagaaagttcattttatcagtggtgttgcccgtttttttcatgttggacttggagcaggagacccagcatggcgtat

SEQ ID NO: 442249 - DNA, 140 bp, Artificial Sequence
  Synthetic
aggccctggctgctgatatggtgtacggctgttacaggcattgggggcacccttatatagactatcgaaagggtctgtccaaactatatgatcaagttcacattaagaaagtgatagatagaccttttgggacagcggtg

SEQ ID NO: 442250 - DNA, 140 bp, Artificial Sequence
  Synthetic
caccgctgtcccaaaaggtctatctatcactttcttaatgtgaacttgatcatatagtttggacagaccctttcgatagtctatataagggtgcccccaatgcctgtaacagccgtacaccatatcagcagccagggcct

SEQ ID NO: 442251 - DNA, 140 bp, Artificial Sequence
  Synthetic
atacgccatgctgggtctccttggaatactctcaggaaattacctgggatgatgatacagaatttgtcggattggaaatacgagtgagtgcaagacaatgccatatccagggcaggatttcgtacttgggagtcggccat

SEQ ID NO: 442252 - DNA, 140 bp, Artificial Sequence
  Synthetic
atggccgactcccaagtacgaaatcctgccctggatatggcattgtcttgcactcactcgtatttccaatccgacaaattctgtatcatcatcccaggtaatttcctgagagtattccaaggagacccagcatggcgtat

SEQ ID NO: 442253 - DNA, 140 bp, Artificial Sequence
  Synthetic
aggccctggctgctgatatgggaacccagatattcagacgacctgatatcccagctgtgtcagctatatatcgctggagatcatgtcttgtctatgtgcgggaactctggttatgaggtcgaccttttgggacagcggtg

SEQ ID NO: 442254 - DNA, 140 bp, Artificial Sequence
  Synthetic
caccgctgtcccaaaaggtcgacctcataaccagagttcccgcacatagacaagacatgatctccagcgatatatagctgacacagctgggatatcaggtcgtctgaatatctgggttcccatatcagcagccagggcct

SEQ ID NO: 442255 - DNA, 140 bp, Artificial Sequence
  Synthetic
atacgccatgctgggtctccatgagggggaggaccccatcttcttgttccaatcctatctggacaatattggagttcagatagtcagacaaatgaggtcaggagaaagattcctcaagatcgtacttgggagtcggccat

SEQ ID NO: 442256 - DNA, 140 bp, Artificial Sequence
  Synthetic
atggccgactcccaagtacgatcttgaggaatctttctcctgacctcatttgtctgactatctgaactccaatattgtccagataggattggaacaagaagatggggtcctccccctcatggagacccagcatggcgtat

SEQ ID NO: 442257 - DNA, 140 bp, Artificial Sequence
  Synthetic
aggccctggctgctgatatgttcaagaatcataagaccttcatccatcaccccagtcgaccagtcatggttatgtagattctcataatgagggaaatattctagcagtttcagtgaccaagaccttttgggacagcggtg

SEQ ID NO: 442258 - DNA, 140 bp, Artificial Sequence
  Synthetic
caccgctgtcccaaaaggtcttggtcactgaaactgctagaatatttccctcattatgagaatctacataaccatgactggtcgactggggtgatggatgaaggtcttatgattcttgaacatatcagcagccagggcct

SEQ ID NO: 442259 - DNA, 140 bp, Artificial Sequence
  Synthetic
atacgccatgctgggtctccgattgtgaccaaagactttgtgtattctcaaaattctggttgtctctttgatagaaactatacacttatgctgaaagacctcttcttgtctcggttcaaccgtacttgggagtcggccat

SEQ ID NO: 442260 - DNA, 140 bp, Artificial Sequence
  Synthetic
atggccgactcccaagtacggttgaaccgagacaagaagaggtctttcagcataagtgtatagtttctatcaaagagacaaccagaattttgagaatacacaaagtctttggtcacaatcggagacccagcatggcgtat

SEQ ID NO: 442261 - DNA, 140 bp, Artificial Sequence
  Synthetic
atacgccatgctgggtctccttagaatggtttttggggttgtgttttatttttagaggttttttgatatttgtttgagattaggagattttgaatttttaagtggtagagaaaagttttacgtacttgggagtcggccat

SEQ ID NO: 442262 - DNA, 140 bp, Artificial Sequence
  Synthetic
atggccgactcccaagtacgtaaaacttttctctaccacttaaaaattcaaaatctcctaatctcaaacaaatatcaaaaaacctctaaaaataaaacacaaccccaaaaaccattctaaggagacccagcatggcgtat

SEQ ID NO: 442263 - DNA, 140 bp, Artificial Sequence
  Synthetic
atacgccatgctgggtctcccgagaactcaagaaggagacagtgtcagcttccgctcagcgagaaagtcaatcatctaaggccaaagctgctgcccagaccgcctctggtcctcctgctccgtacttgggagtcggccat

SEQ ID NO: 442264 - DNA, 140 bp, Artificial Sequence
  Synthetic
atggccgactcccaagtacggagcaggaggaccagaggcggtctgggcagcagctttggccttagatgattgactttctcgctgagcggaagctgacactgtctccttcttgagttctcgggagacccagcatggcgtat

SEQ ID NO: 442265 - DNA, 140 bp, Artificial Sequence
  Synthetic
atacgccatgctgggtctccgatacaatgatggaaccatcttccctgtcaacatatacggtaaggtttcccctagggattacttgagagggctcgcgagaggagtcttgataggatcctccgtacttgggagtcggccat

SEQ ID NO: 442266 - DNA, 140 bp, Artificial Sequence
  Synthetic
atggccgactcccaagtacggaggatcctatcaagactcctctcgcgagccctctcaagtaatccctaggggaaaccttaccgtatatgttgacagggaagatggttccatcattgtatcggagacccagcatggcgtat

SEQ ID NO: 442267 - DNA, 140 bp, Artificial Sequence
  Synthetic
aggccctggctgctgatatgcagagtttcgagaggcaatcctgttgtccaagacccatagagataacttcatactcttcttaaaatctgttgagcctctgtttcctcgatttctcagtgagaccttttgggacagcggtg

SEQ ID NO: 442268 - DNA, 140 bp, Artificial Sequence
  Synthetic
caccgctgtcccaaaaggtctcactgagaaatcgaggaaacagaggctcaacagattttaagaagagtatgaagttatctctatgggtcttggacaacaggattgcctctcgaaactctgcatatcagcagccagggcct

SEQ ID NO: 442269 - DNA, 140 bp, Artificial Sequence
  Synthetic
aggccctggctgctgatatgtgtcttcaagaggacagggtctgccctacataggttcaagtcagccaggtacagtgaagggggatactcttctgtttgtccaaatctcctctctcacatcgaccttttgggacagcggtg

SEQ ID NO: 442270 - DNA, 140 bp, Artificial Sequence
  Synthetic
caccgctgtcccaaaaggtcgatgtgagagaggagatttggacaaacagaagagtatcccccttcactgtacctggctgacttgaacctatgtagggcagaccctgtcctcttgaagacacatatcagcagccagggcct

SEQ ID NO: 442271 - DNA, 140 bp, Artificial Sequence
  Synthetic
aggccctggctgctgatatgagcgtgcataactagaaagggctgggtcatctaagcttttcagtcgggaaaaaaactgtagatcaaaagagcaactggcaacacttctcatcttgagactgaccttttgggacagcggtg

SEQ ID NO: 442272 - DNA, 140 bp, Artificial Sequence
  Synthetic
caccgctgtcccaaaaggtcagtctcaagatgagaagtgttgccagttgctcttttgatctacagtttttttcccgactgaaaagcttagatgacccagccctttctagttatgcacgctcatatcagcagccagggcct

SEQ ID NO: 442273 - DNA, 140 bp, Artificial Sequence
  Synthetic
atacgccatgctgggtctccccctgttttcaaaaggacggggtcagccttgcataggttcaagtctgccagatacagcgaaggagggtattcttctgtttgcccgaacctcctctctcatcgtacttgggagtcggccat

SEQ ID NO: 442274 - DNA, 140 bp, Artificial Sequence
  Synthetic
atggccgactcccaagtacgatgagagaggaggttcgggcaaacagaagaataccctccttcgctgtatctggcagacttgaacctatgcaaggctgaccccgtccttttgaaaacagggggagacccagcatggcgtat

SEQ ID NO: 442275 - DNA, 140 bp, Artificial Sequence
  Synthetic
atacgccatgctgggtctccacttaccaggagtgtttggccagcgacctggccaaaaggatcctcaggtggggatttgacaagtattccaaatggtatattgattcaagactcctctcaacgtacttgggagtcggccat

SEQ ID NO: 442276 - DNA, 140 bp, Artificial Sequence
  Synthetic
atggccgactcccaagtacgttgagaggagtcttgaatcaatataccatttggaatacttgtcaaatccccacctgaggatccttttggccaggtcgctggccaaacactcctggtaagtggagacccagcatggcgtat

SEQ ID NO: 442277 - DNA, 140 bp, Artificial Sequence
  Synthetic
aggccctggctgctgatatgcatctccggtgcaacaggtgtgtaaggcccattgacgatataacacttgagacttctcagatcttcgagttcccggatgtgtcaaagagaatctctagaagaccttttgggacagcggtg

SEQ ID NO: 442278 - DNA, 140 bp, Artificial Sequence
  Synthetic
caccgctgtcccaaaaggtcttctagagattctctttgacacatccgggaactcgaagatctgagaagtctcaagtgttatatcgtcaatgggccttacacacctgttgcaccggagatgcatatcagcagccagggcct

SEQ ID NO: 442279 - DNA, 140 bp, Artificial Sequence
  Synthetic
atacgccatgctgggtctccgatttttggggggcttgtacacgatgagactcttagatgatgcatctagaaaaaaacaaggtctcaagtctgaacctctgattgtttgattgttttttctcgtacttgggagtcggccat

SEQ ID NO: 442280 - DNA, 140 bp, Artificial Sequence
  Synthetic
atggccgactcccaagtacgagaaaaaacaatcaaacaatcagaggttcagacttgagaccttgtttttttctagatgcatcatctaagagtctcatcgtgtacaagccccccaaaaatcggagacccagcatggcgtat

SEQ ID NO: 442281 - DNA, 140 bp, Artificial Sequence
  Synthetic
aggccctggctgctgatatgttgaattgatctcaggggtaatttcgtatatcctcctgaggctggataatcacccctccttgtacataatgctaagagaaccgtctcttagaggagaaatgaccttttgggacagcggtg

SEQ ID NO: 442282 - DNA, 140 bp, Artificial Sequence
  Synthetic
caccgctgtcccaaaaggtcatttctcctctaagagacggttctcttagcattatgtacaaggaggggtgattatccagcctcaggaggatatacgaaattacccctgagatcaattcaacatatcagcagccagggcct

SEQ ID NO: 442283 - DNA, 140 bp, Artificial Sequence
  Synthetic
aggccctggctgctgatatgagactttagaagtgctaaaatgacgtacctgactctcattacttaccagtctcatctcctactccagagggttgagagaaacctgtctaagggtatgagagaccttttgggacagcggtg

SEQ ID NO: 442284 - DNA, 140 bp, Artificial Sequence
  Synthetic
caccgctgtcccaaaaggtctctcatacccttagacaggtttctctcaaccctctggagtaggagatgagactggtaagtaatgagagtcaggtacgtcattttagcacttctaaagtctcatatcagcagccagggcct

SEQ ID NO: 442285 - DNA, 140 bp, Artificial Sequence
  Synthetic
atacgccatgctgggtctcccccgacaagctgaataaaataatgcaagatgacctgaaccgttacgcattcatataaacacaccccctcgcccagtcacactatgcaataaaatctggcccgtacttgggagtcggccat

SEQ ID NO: 442286 - DNA, 140 bp, Artificial Sequence
  Synthetic
atggccgactcccaagtacgggccagattttattgcatagtgtgactgggcgagggggtgtgtttatatgaatgcgtaacggttcaggtcatcttgcattattttattcagcttgtcgggggagacccagcatggcgtat

SEQ ID NO: 442287 - DNA, 140 bp, Artificial Sequence
  Synthetic
aggccctggctgctgatatgactctttgcgaaggacaaggtgggtggatcaagaggtgcgccatgcagctagaaccatgactggagattacagccccaacaagaaagtgtctcgtaaggcgaccttttgggacagcggtg

SEQ ID NO: 442288 - DNA, 140 bp, Artificial Sequence
  Synthetic
caccgctgtcccaaaaggtcgccttacgagacactttcttgttggggctgtaatctccagtcatggttctagctgcatggcgcacctcttgatccacccaccttgtccttcgcaaagagtcatatcagcagccagggcct

SEQ ID NO: 442289 - DNA, 140 bp, Artificial Sequence
  Synthetic
aggccctggctgctgatatgagaaccatgactggagattacagccccaacaagaaagtgtctcgtaaggcaggatgttcagaatgggtctgctctgctcaacaggttgcagtctccacctgaccttttgggacagcggtg

SEQ ID NO: 442290 - DNA, 140 bp, Artificial Sequence
  Synthetic
caccgctgtcccaaaaggtcaggtggagactgcaacctgttgagcagagcagacccattctgaacatcctgccttacgagacactttcttgttggggctgtaatctccagtcatggttctcatatcagcagccagggcct

SEQ ID NO: 442291 - DNA, 140 bp, Artificial Sequence
  Synthetic
aggccctggctgctgatatgaataatcaggtggtctccttgaagccagagattatcgttgatcaatatgaatataagtacccagctatcaaagatctgaagaaacccagtatctccctaggaccttttgggacagcggtg

SEQ ID NO: 442292 - DNA, 140 bp, Artificial Sequence
  Synthetic
caccgctgtcccaaaaggtcctagggagatactgggtttcttcagatctttgatagctgggtacttatattcatattgatcaacgataatctctggcttcaaggagaccacctgattattcatatcagcagccagggcct

SEQ ID NO: 442293 - DNA, 140 bp, Artificial Sequence
  Synthetic
aggccctggctgctgatatgatgcagaagttactgacattgcatctatcaaccggataaccctgttaatgtctgattttgcattgtctatagatggaccactttatttggtcttcaaaacgaccttttgggacagcggtg

SEQ ID NO: 442294 - DNA, 140 bp, Artificial Sequence
  Synthetic
caccgctgtcccaaaaggtcgttttgaagaccaaataaagtggtccatctatagacaatgcaaaatcagacattaacagggttatccggttgatagatgcaatgtcagtaacttctgcatcatatcagcagccagggcct

SEQ ID NO: 442295 - DNA, 140 bp, Artificial Sequence
  Synthetic
atacgccatgctgggtctccaactaacacctctcgtacgattctgcagtttgctagcaggaccggtacataactataaagggctgggtcatctaagcatttcagtcgagaaaaaaactgtcgtacttgggagtcggccat

SEQ ID NO: 442296 - DNA, 140 bp, Artificial Sequence
  Synthetic
atggccgactcccaagtacgacagtttttttctcgactgaaatgcttagatgacccagccctttatagttatgtaccggtcctgctagcaaactgcagaatcgtacgagaggtgttagttggagacccagcatggcgtat

SEQ ID NO: 442297 - DNA, 140 bp, Artificial Sequence
  Synthetic
aggccctggctgctgatatgcaacgattactaaaagactctttgcgaaggacaaggtgggtagatcaagaggtgcgccatgcagctagaaccatgagtggagattacagccccaacaagagaccttttgggacagcggtg

SEQ ID NO: 442298 - DNA, 140 bp, Artificial Sequence
  Synthetic
caccgctgtcccaaaaggtctcttgttggggctgtaatctccactcatggttctagctgcatggcgcacctcttgatctacccaccttgtccttcgcaaagagtcttttagtaatcgttgcatatcagcagccagggcct

SEQ ID NO: 442299 - DNA, 140 bp, Artificial Sequence
  Synthetic
atacgccatgctgggtctcctcttgagtctgtataggttgagcaaaatatctggacaaaacactggtaattacaagacaaacatcgcagatagaatagagcagattttcgagacggctcccgtacttgggagtcggccat

SEQ ID NO: 442300 - DNA, 140 bp, Artificial Sequence
  Synthetic
atggccgactcccaagtacgggagccgtctcgaaaatctgctctattctatctgcgatgtttgtcttgtaattaccagtgttttgtccagatattttgctcaacctatacagactcaagaggagacccagcatggcgtat

SEQ ID NO: 442301 - DNA, 140 bp, Artificial Sequence
  Synthetic
aggccctggctgctgatatgacgcttaacaacaaaatcagagaagaagtagacagtgtcgtctacaaagcaaaaatgtaacacccctacaatggatgccgacaagattgtattcaaagtcgaccttttgggacagcggtg

SEQ ID NO: 442302 - DNA, 140 bp, Artificial Sequence
  Synthetic
caccgctgtcccaaaaggtcgactttgaatacaatcttgtcggcatccattgtaggggtgttacatttttgctttgtagacgacactgtctacttcttctctgattttgttgttaagcgtcatatcagcagccagggcct

SEQ ID NO: 442303 - DNA, 140 bp, Artificial Sequence
  Synthetic
aggccctggctgctgatatgatagtcccgaaagtctgcacatgctaagagtcttgtgtgatgtgtcttgaaaaaaacaagatcttgaatccgagcctctggctgtttgattgttttttccgaccttttgggacagcggtg

SEQ ID NO: 442304 - DNA, 140 bp, Artificial Sequence
  Synthetic
caccgctgtcccaaaaggtcggaaaaaacaatcaaacagccagaggctcggattcaagatcttgtttttttcaagacacatcacacaagactcttagcatgtgcagactttcgggactatcatatcagcagccagggcct

SEQ ID NO: 442305 - DNA, 140 bp, Artificial Sequence
  Synthetic
aggccctggctgctgatatgggccaacacgtattcctcttatctgtttttccatgtaattaccttatacatgaatgccctagactgggaagaggaaaaaaccatcctagcattatggaaagaccttttgggacagcggtg

SEQ ID NO: 442306 - DNA, 140 bp, Artificial Sequence
  Synthetic
caccgctgtcccaaaaggtctttccataatgctaggatggttttttcctcttcccagtctagggcattcatgtataaggtaattacatggaaaaacagataagaggaatacgtgttggcccatatcagcagccagggcct

SEQ ID NO: 442307 - DNA, 140 bp, Artificial Sequence
  Synthetic
aggccctggctgctgatatgcttttagaggtttgtaggtactaagacccttagacgatgcaactagaaaaaaacaagactctgaatcagaacctctggctgtttgattattttttctctcgaccttttgggacagcggtg

SEQ ID NO: 442308 - DNA, 140 bp, Artificial Sequence
  Synthetic
caccgctgtcccaaaaggtcgagagaaaaaataatcaaacagccagaggttctgattcagagtcttgtttttttctagttgcatcgtctaagggtcttagtacctacaaacctctaaaagcatatcagcagccagggcct

SEQ ID NO: 442309 - DNA, 140 bp, Artificial Sequence
  Synthetic
aggccctggctgctgatatgaagactctttgacggtgcaacctgaaaaaaacaagatcctgattcataacctctgtttgcttgattgtttttccatctttattgtttttttgttaagcgtgaccttttgggacagcggtg

SEQ ID NO: 442310 - DNA, 140 bp, Artificial Sequence
  Synthetic
caccgctgtcccaaaaggtcacgcttaacaaaaaaacaataaagatggaaaaacaatcaagcaaacagaggttatgaatcaggatcttgtttttttcaggttgcaccgtcaaagagtcttcatatcagcagccagggcct

SEQ ID NO: 442311 - DNA, 140 bp, Artificial Sequence
  Synthetic
atacgccatgctgggtctccgcatgaatgcagccaagctcgaccctgatgatgtatgctcttatctagcagctgcaatgcagttctttgagggagcatgtcctgatgactggaccagctacgtacttgggagtcggccat

SEQ ID NO: 442312 - DNA, 140 bp, Artificial Sequence
  Synthetic
atggccgactcccaagtacgtagctggtccagtcatcaggacatgctccctcaaagaactgcattgcagctgctagataagagcatacatcatcagggtcgagcttggctgcattcatgcggagacccagcatggcgtat

SEQ ID NO: 442313 - DNA, 140 bp, Artificial Sequence
  Synthetic
aggccctggctgctgatatggattttgcattgtctatagatggccccctttatctggttttcaaaacttatggtaccatgcttgtaaatccagaatacagagcaattcagcacctatccagaccttttgggacagcggtg

SEQ ID NO: 442314 - DNA, 140 bp, Artificial Sequence
  Synthetic
caccgctgtcccaaaaggtctggataggtgctgaattgctctgtattctggatttacaagcatggtaccataagttttgaaaaccagataaagggggccatctatagacaatgcaaaatccatatcagcagccagggcct

SEQ ID NO: 442315 - DNA, 140 bp, Artificial Sequence
  Synthetic
atacgccatgctgggtctcctcggtgtagtcaaagttgttgttggactggcattgtcaggggctccagtccctgagggtatgaattgggtgtacaaattgaggagaaccctcatcttccacgtacttgggagtcggccat

SEQ ID NO: 442316 - DNA, 140 bp, Artificial Sequence
  Synthetic
atggccgactcccaagtacgtggaagatgagggttctcctcaatttgtacacccaattcataccctcagggactggagcccctgacaatgccagtccaacaacaactttgactacaccgaggagacccagcatggcgtat

SEQ ID NO: 442317 - DNA, 140 bp, Artificial Sequence
  Synthetic
atacgccatgctgggtctccggccgattcttcgctctaatgtcatggaatctaagattatattttgtcatcaccgagaagctcttggccaactacattttgccactttttgacgcactgacgtacttgggagtcggccat

SEQ ID NO: 442318 - DNA, 140 bp, Artificial Sequence
  Synthetic
atggccgactcccaagtacgtcagtgcgtcaaaaagtggcaaaatgtagttggccaagagcttctcggtgatgacaaaatataatcttagattccatgacattagagcgaagaatcggccggagacccagcatggcgtat

SEQ ID NO: 442319 - DNA, 140 bp, Artificial Sequence
  Synthetic
aggccctggctgctgatatgggactatgagaaatggaacaatcatcaaagattggagtcaacggaggatgtattttctgtcctagatcaggtgtttggattgaagagggtgttttctagagaccttttgggacagcggtg

SEQ ID NO: 442320 - DNA, 140 bp, Artificial Sequence
  Synthetic
caccgctgtcccaaaaggtctctagaaaacaccctcttcaatccaaacacctgatctaggacagaaaatacatcctccgttgactccaatctttgatgattgttccatttctcatagtcccatatcagcagccagggcct

SEQ ID NO: 442321 - DNA, 140 bp, Artificial Sequence
  Synthetic
aggccctggctgctgatatgaatgcagttcttcgaggggacgtgtcccgaagactggaccagctatgggatcctgattgcacggaaaggagataagatcaccccagattctctggtggaggaccttttgggacagcggtg

SEQ ID NO: 442322 - DNA, 140 bp, Artificial Sequence
  Synthetic
caccgctgtcccaaaaggtcctccaccagagaatctggggtgatcttatctcctttccgtgcaatcaggatcccatagctggtccagtcttcgggacacgtcccctcgaagaactgcattcatatcagcagccagggcct

SEQ ID NO: 442323 - DNA, 140 bp, Artificial Sequence
  Synthetic
atacgccatgctgggtctccagaaacatagaagacaatcaggctcatctccagggggaacccatagaagtggacaatcttcctgaggacatgaggcgacttcacctggatgatgggaaatcgtacttgggagtcggccat

SEQ ID NO: 442324 - DNA, 140 bp, Artificial Sequence
  Synthetic
atggccgactcccaagtacgatttcccatcatccaggtgaagtcgcctcatgtcctcaggaagattgtccacttctatgggttccccctggagatgagcctgattgtcttctatgtttctggagacccagcatggcgtat

SEQ ID NO: 442325 - DNA, 140 bp, Artificial Sequence
  Synthetic
aggccctggctgctgatatggactttcagatggatgaaggagaggatcctagcctcctgttccagtcgtacctggacaacgttggagtccaaatggtcagacaaatgaggtcaggagaaagaccttttgggacagcggtg

SEQ ID NO: 442326 - DNA, 140 bp, Artificial Sequence
  Synthetic
caccgctgtcccaaaaggtctttctcctgacctcatttgtctgaccatttggactccaacgttgtccaggtacgactggaacaggaggctaggatcctctccttcatccatctgaaagtccatatcagcagccagggcct

SEQ ID NO: 442327 - DNA, 140 bp, Artificial Sequence
  Synthetic
atacgccatgctgggtctcccgctgacagtggcacaacactctcaatctctgatcaaacctatgagggattttctgctcatgtcagtacaggcagttttccactacctgctgtttagccccgtacttgggagtcggccat

SEQ ID NO: 442328 - DNA, 140 bp, Artificial Sequence
  Synthetic
atggccgactcccaagtacggggctaaacagcaggtagtggaaaactgcctgtactgacatgagcagaaaatccctcataggtttgatcagagattgagagtgttgtgccactgtcagcgggagacccagcatggcgtat

SEQ ID NO: 442329 - DNA, 140 bp, Artificial Sequence
  Synthetic
aggccctggctgctgatatggatgcaatcatccctcctccagcaacatatggagttgttggaatcttcagttatccccctgatgcaccccctggcagacccttctacagttttcaaagaagaccttttgggacagcggtg

SEQ ID NO: 442330 - DNA, 140 bp, Artificial Sequence
  Synthetic
caccgctgtcccaaaaggtcttctttgaaaactgtagaagggtctgccagggggtgcatcagggggataactgaagattccaacaactccatatgttgctggaggagggatgattgcatccatatcagcagccagggcct

SEQ ID NO: 442331 - DNA, 140 bp, Artificial Sequence
  Synthetic
aggccctggctgctgatatgccctgtacatgaacgccttagactgggatgaagagaagaccatcttagctttatggaaagatttgacctcagtggatattgggaaggacttggtcaaattgaccttttgggacagcggtg

SEQ ID NO: 442332 - DNA, 140 bp, Artificial Sequence
  Synthetic
caccgctgtcccaaaaggtcaatttgaccaagtccttcccaatatccactgaggtcaaatctttccataaagctaagatggtcttctcttcatcccagtctaaggcgttcatgtacagggcatatcagcagccagggcct

SEQ ID NO: 442333 - DNA, 140 bp, Artificial Sequence
  Synthetic
aggccctggctgctgatatgcgtgactcgtttagcccatgatggatctaaactccccctaaggtgtgtactgggatgggtcgctctggccaattcaaagaaattccaactgttagtcgaagaccttttgggacagcggtg

SEQ ID NO: 442334 - DNA, 140 bp, Artificial Sequence
  Synthetic
caccgctgtcccaaaaggtcttcgactaacagttggaatttctttgaattggccagagcgacccatcccagtacacaccttagggggagtttagatccatcatgggctaaacgagtcacgcatatcagcagccagggcct

SEQ ID NO: 442335 - DNA, 140 bp, Artificial Sequence
  Synthetic
atacgccatgctgggtctccgagtgcaggtgctctggcaacactaatgctgacaatcttcttaatgacatgttgcagaagagctaatcgaacagaatcaatacaacgagatcccggggagcgtacttgggagtcggccat

SEQ ID NO: 442336 - DNA, 140 bp, Artificial Sequence
  Synthetic
atggccgactcccaagtacgctccccgggatctcgttgtattgattctgttcgattagctcttctgcaacatgtcattaagaagattgtcagcattagtgttgccagagcacctgcactcggagacccagcatggcgtat

SEQ ID NO: 442337 - DNA, 140 bp, Artificial Sequence
  Synthetic
aggccctggctgctgatatgtccttcgatcagtcatttttttcacgaggtcccctaaagggatacttgggctcgtccacctccatgtcaacccagctattccatgcatgggaaaaagtcagaccttttgggacagcggtg

SEQ ID NO: 442338 - DNA, 140 bp, Artificial Sequence
  Synthetic
caccgctgtcccaaaaggtctgactttttcccatgcatggaatagctgggttgacatggaggtggacgagcccaagtatccctttaggggacctcgtgaaaaaaatgactgatcgaaggacatatcagcagccagggcct

SEQ ID NO: 442339 - DNA, 140 bp, Artificial Sequence
  Synthetic
atacgccatgctgggtctcctacagacactatgtctgatttgacccaagacgggaagaactatgatttcatgtttcagccattgatgctttatgcgcaaacatggacatcagagctggtacgtacttgggagtcggccat

SEQ ID NO: 442340 - DNA, 140 bp, Artificial Sequence
  Synthetic
atggccgactcccaagtacgtaccagctctgatgtccatgtttgcgcataaagcatcaatggctgaaacatgaaatcatagttcttcccgtcttgggtcaaatcagacatagtgtctgtaggagacccagcatggcgtat

SEQ ID NO: 442341 - DNA, 140 bp, Artificial Sequence
  Synthetic
aggccctggctgctgatatgatgtagagctgcatacaattggaagatggccggtgaccccagatatgaagagtctctacacaatccataccctgactatcattggcttcgaactgtaaaagaccttttgggacagcggtg

SEQ ID NO: 442342 - DNA, 140 bp, Artificial Sequence
  Synthetic
caccgctgtcccaaaaggtcttttacagttcgaagccaatgatagtcagggtatggattgtgtagagactcttcatatctggggtcaccggccatcttccaattgtatgcagctctacatcatatcagcagccagggcct

SEQ ID NO: 442343 - DNA, 140 bp, Artificial Sequence
  Synthetic
aggccctggctgctgatatgatgaggcggaagactttgttgaggttcatcttccggatgttcacaaacaggtctcggatgttgaccttggtcttccgagttgggggaagtatctgttgatgaccttttgggacagcggtg

SEQ ID NO: 442344 - DNA, 140 bp, Artificial Sequence
  Synthetic
caccgctgtcccaaaaggtcatcaacagatacttcccccaactcggaagaccaaggtcaacatccgagacctgtttgtgaacatccggaagatgaacctcaacaaagtcttccgcctcatcatatcagcagccagggcct

SEQ ID NO: 442345 - DNA, 140 bp, Artificial Sequence
  Synthetic
aggccctggctgctgatatgcccatatgacagatcccttcactcgagggtcttcactggcgggaaatgctcgggaataacggtgtcttccacctactgctcaactaaccatgattacaccgaccttttgggacagcggtg

SEQ ID NO: 442346 - DNA, 140 bp, Artificial Sequence
  Synthetic
caccgctgtcccaaaaggtcggtgtaatcatggttagttgagcagtaggtggaagacaccgttattcccgagcatttcccgccagtgaagaccctcgagtgaagggatctgtcatatgggcatatcagcagccagggcct

SEQ ID NO: 442347 - DNA, 140 bp, Artificial Sequence
  Synthetic
atacgccatgctgggtctcccacggcgtccccggagaatgactggctgtggatcttctcagacttcagaagtgcgaaaatgacgtacttgaccctcattacctaccagtctcacctcctacgtacttgggagtcggccat

SEQ ID NO: 442348 - DNA, 140 bp, Artificial Sequence
  Synthetic
atggccgactcccaagtacgtaggaggtgagactggtaggtaatgagggtcaagtacgtcattttcgcacttctgaagtctgagaagatccacagccagtcattctccggggacgccgtgggagacccagcatggcgtat

SEQ ID NO: 442349 - DNA, 140 bp, Artificial Sequence
  Synthetic
atacgccatgctgggtctccagttatgtggagttcttggacttagacttgtagatggaacatgggtcgcgatgcaaacatcagatgataccaaatggtgccctccagaccagttggtgaacgtacttgggagtcggccat

SEQ ID NO: 442350 - DNA, 140 bp, Artificial Sequence
  Synthetic
atggccgactcccaagtacgttcaccaactggtctggagggcaccatttggtatcatctgatgtttgcatcgcgacccatgttccatctacaagtctaagtccaagaactccacataactggagacccagcatggcgtat

SEQ ID NO: 442351 - DNA, 140 bp, Artificial Sequence
  Synthetic
atacgccatgctgggtctccgctcactacaagtcagtccggacttggaatgagatcatcccctcaaaagggtgtttaagagttggagggaggtgtcaccctcatgtgaacggggtgttttcgtacttgggagtcggccat

SEQ ID NO: 442352 - DNA, 140 bp, Artificial Sequence
  Synthetic
atggccgactcccaagtacgaaaacaccccgttcacatgagggtgacacctccctccaactcttaaacacccttttgaggggatgatctcattccaagtccggactgacttgtagtgagcggagacccagcatggcgtat

SEQ ID NO: 442353 - DNA, 140 bp, Artificial Sequence
  Synthetic
atacgccatgctgggtctcctgtttcggggacttccccatctacacgataccagagaaacttggcccttggagtcccatcgacatacatcatctcagctgccccaacaacctagtcgtggcgtacttgggagtcggccat

SEQ ID NO: 442354 - DNA, 140 bp, Artificial Sequence
  Synthetic
atggccgactcccaagtacgccacgactaggttgttggggcagctgagatgatgtatgtcgatgggactccaagggccaagtttctctggtatcgtgtagatggggaagtccccgaaacaggagacccagcatggcgtat

SEQ ID NO: 442355 - DNA, 140 bp, Artificial Sequence
  Synthetic
atacgccatgctgggtctccaaaaagtcactaatgttcatgtggtaaaacgggctttatcgttaaaagaatctataaactggttcatcaatagaaattccaatttggctcaaactctaatcgtacttgggagtcggccat

SEQ ID NO: 442356 - DNA, 140 bp, Artificial Sequence
  Synthetic
atggccgactcccaagtacgattagagtttgagccaaattggaatttctattgatgaaccagtttatagattcttttaacgataaagcccgttttaccacatgaacattagtgactttttggagacccagcatggcgtat

SEQ ID NO: 442357 - DNA, 140 bp, Artificial Sequence
  Synthetic
atacgccatgctgggtctccaaaagcaggtcaacatgtcgtatgacctcattatttgtgatgcagaagttactgatattgcatctatcaaccggataactctgttgatgtctgatttcgccgtacttgggagtcggccat

SEQ ID NO: 442358 - DNA, 140 bp, Artificial Sequence
  Synthetic
atggccgactcccaagtacggcgaaatcagacatcaacagagttatccggttgatagatgcaatatcagtaacttctgcatcacaaataatgaggtcatacgacatgttgacctgcttttggagacccagcatggcgtat

SEQ ID NO: 442359 - DNA, 140 bp, Artificial Sequence
  Synthetic
aggccctggctgctgatatggaatctctgagttcaacagtcctccttgaactccatccaacagggtagattcaagagtcacgagactttcattaatcatctcaattgatcaaacaaggtcgaccttttgggacagcggtg

SEQ ID NO: 442360 - DNA, 140 bp, Artificial Sequence
  Synthetic
caccgctgtcccaaaaggtcgaccttgtttgatcaattgagatgattaatgaaagtctcgtgactcttgaatctaccctgttggatggagttcaaggaggactgttgaactcagagattccatatcagcagccagggcct

SEQ ID NO: 442361 - DNA, 140 bp, Artificial Sequence
  Synthetic
aggccctggctgctgatatgatgttgattctcatagtacgggaaatcttctagcagtttcagtgaccaacggtgctttcattctccagaaactgacatcaaaggtagtagacgggccaaggaccttttgggacagcggtg

SEQ ID NO: 442362 - DNA, 140 bp, Artificial Sequence
  Synthetic
caccgctgtcccaaaaggtccttggcccgtctactacctttgatgtcagtttctggagaatgaaagcaccgttggtcactgaaactgctagaagatttcccgtactatgagaatcaacatcatatcagcagccagggcct

SEQ ID NO: 442363 - DNA, 140 bp, Artificial Sequence
  Synthetic
aggccctggctgctgatatgaagaatgtaacacccctacaatggatgccgacaagattgtgtttaaagtcaataatcaggtggtctctctgaagcctgaaattataatagatcaatatgagaccttttgggacagcggtg

SEQ ID NO: 442364 - DNA, 140 bp, Artificial Sequence
  Synthetic
caccgctgtcccaaaaggtctcatattgatctattataatttcaggcttcagagagaccacctgattattgactttaaacacaatcttgtcggcatccattgtaggggtgttacattcttcatatcagcagccagggcct

SEQ ID NO: 442365 - DNA, 140 bp, Artificial Sequence
  Synthetic
atacgccatgctgggtctccacttgacctcttccacccttcgggagatgagccttgtgttattcaattgtagcagccccaaaagtgagatgcagagagctcgttccttaaactatcaagacgtacttgggagtcggccat

SEQ ID NO: 442366 - DNA, 140 bp, Artificial Sequence
  Synthetic
atggccgactcccaagtacgtcttgatagtttaaggaacgagctctctgcatctcacttttggggctgctacaattgaataacacaaggctcatctcccgaagggtggaagaggtcaagtggagacccagcatggcgtat

SEQ ID NO: 442367 - DNA, 140 bp, Artificial Sequence
  Synthetic
atacgccatgctgggtctcctgatcataactctgattgacagtgatgtagagtccttcctggtccacaagatggtggatgatcttgagttacagaggggaactctgtctaaagtggctatcgtacttgggagtcggccat

SEQ ID NO: 442368 - DNA, 140 bp, Artificial Sequence
  Synthetic
atggccgactcccaagtacgatagccactttagacagagttcccctctgtaactcaagatcatccaccatcttgtggaccaggaaggactctacatcactgtcaatcagagttatgatcaggagacccagcatggcgtat

SEQ ID NO: 442369 - DNA, 140 bp, Artificial Sequence
  Synthetic
aggccctggctgctgatatgctcccgaaagcttgtacatgctaagactcttgcgcgatgtatcttgaaaaaaacaagatcttgaatccgaacctctggttgtttgattgtttttttcgtcgaccttttgggacagcggtg

SEQ ID NO: 442370 - DNA, 140 bp, Artificial Sequence
  Synthetic
caccgctgtcccaaaaggtcgacgaaaaaaacaatcaaacaaccagaggttcggattcaagatcttgtttttttcaagatacatcgcgcaagagtcttagcatgtacaagctttcgggagcatatcagcagccagggcct

SEQ ID NO: 442371 - DNA, 140 bp, Artificial Sequence
  Synthetic
atacgccatgctgggtctccctttagaagctccaagatgacatatctgactctcatcacctaccagtctcatcttttacttcagagggttgagaaaaatctctccaaaagtatgagggcccgtacttgggagtcggccat

SEQ ID NO: 442372 - DNA, 140 bp, Artificial Sequence
  Synthetic
atggccgactcccaagtacgggccctcatacttttggagagatttttctcaaccctctgaagtaaaagatgagactggtaggtgatgagagtcagatatgtcatcttggagcttctaaagggagacccagcatggcgtat

SEQ ID NO: 442373 - DNA, 140 bp, Artificial Sequence
  Synthetic
atacgccatgctgggtctcccgtgacagaggctgagacctacaccaattttgtaggttatgtcaccaccacgtttaagaggaagcacttccgtccgatgccagatgcatgcagagccgcacgtacttgggagtcggccat

SEQ ID NO: 442374 - DNA, 140 bp, Artificial Sequence
  Synthetic
atggccgactcccaagtacgtgcggctctgcatgcatctggcatcggacggaagtgcttcctcttaaacgtggtggtgacataacctacaaaattggtgtaggtctcagcctctgtcacgggagacccagcatggcgtat

SEQ ID NO: 442375 - DNA, 140 bp, Artificial Sequence
  Synthetic
atacgccatgctgggtctcctatggctgttacaggcattgggggcacccctatatagattatcgaaagggtctgtcaaaactatatgatcaagttcacattaagaaagtgatagataagtcgtacttgggagtcggccat

SEQ ID NO: 442376 - DNA, 140 bp, Artificial Sequence
  Synthetic
atggccgactcccaagtacgacttatctatcactttcttaatgtgaacttgatcatatagttttgacagaccctttcgataatctatataggggtgcccccaatgcctgtaacagccataggagacccagcatggcgtat

SEQ ID NO: 442377 - DNA, 140 bp, Artificial Sequence
  Synthetic
atacgccatgctgggtctccatatagtagatctggtaggggatacatggcacaagctcccgatcacgcaaatctttgagattcctgaatcaatggacccgtcagaaatattggatgataacgtacttgggagtcggccat

SEQ ID NO: 442378 - DNA, 140 bp, Artificial Sequence
  Synthetic
atggccgactcccaagtacgttatcatccaatatttctgacgggtccattgattcaggaatctcaaagatttgcgtgatcgggagcttgtgccatgtatcccctaccagatctactatatggagacccagcatggcgtat

SEQ ID NO: 442379 - DNA, 140 bp, Artificial Sequence
  Synthetic
aggccctggctgctgatatgatctttgagattcctgaatcaatggacccgtcagaaatattggatgataaatcacattctttcaccagaacaagactagcttcttggctgtcagagaaccgaccttttgggacagcggtg

SEQ ID NO: 442380 - DNA, 140 bp, Artificial Sequence
  Synthetic
caccgctgtcccaaaaggtcggttctctgacagccaagaagctagtcttgttctggtgaaagaatgtgatttatcatccaatatttctgacgggtccattgattcaggaatctcaaagatcatatcagcagccagggcct

SEQ ID NO: 442381 - DNA, 140 bp, Artificial Sequence
  Synthetic
aggccctggctgctgatatgacgcttaacaacaaaatcagagaagaagcagacaacgtcagttgcaaagcaaaagtgtaacacccctaaaatggataccgacaagattgtattcaaagtcgaccttttgggacagcggtg

SEQ ID NO: 442382 - DNA, 140 bp, Artificial Sequence
  Synthetic
caccgctgtcccaaaaggtcgactttgaatacaatcttgtcggtatccattttaggggtgttacacttttgctttgcaactgacgttgtctgcttcttctctgattttgttgttaagcgtcatatcagcagccagggcct

SEQ ID NO: 442383 - DNA, 140 bp, Artificial Sequence
  Synthetic
aggccctggctgctgatatgaatgccgccaaacttgatcctgatgatgtatgttcttacttggcagcatcaatgcagtttttcgaggggacatgtccagaagattggaccagctatggaagaccttttgggacagcggtg

SEQ ID NO: 442384 - DNA, 140 bp, Artificial Sequence
  Synthetic
caccgctgtcccaaaaggtcttccatagctggtccaatcttctggacatgtcccctcgaaaaactgcattgatgctgccaagtaagaacatacatcatcaggatcaagtttggcggcattcatatcagcagccagggcct

SEQ ID NO: 442385 - DNA, 140 bp, Artificial Sequence
  Synthetic
aggccctggctgctgatatgcagttccaatcatcaagcccgtccaaactcattcgccgagtttctaaacaagacatattcgagtgactcttagggtgttaaataacagggtgccggaaatgaccttttgggacagcggtg

SEQ ID NO: 442386 - DNA, 140 bp, Artificial Sequence
  Synthetic
caccgctgtcccaaaaggtcatttccggcaccctgttatttaacaccctaagagtcactcgaatatgtcttgtttagaaactcggcgaatgagtttggacgggcttgatgattggaactgcatatcagcagccagggcct

SEQ ID NO: 442387 - DNA, 140 bp, Artificial Sequence
  Synthetic
aggccctggctgctgatatggaccatgtgcagttatgactttctcatctatgggaaaactcccttgtttcgaggcaacatattggtgcctgaatccaaaagatgggccagagtctcttgcgaccttttgggacagcggtg

SEQ ID NO: 442388 - DNA, 140 bp, Artificial Sequence
  Synthetic
caccgctgtcccaaaaggtcgcaagagactctggcccatcttttggattcaggcaccaatatgttgcctcgaaacaagggagttttcccatagatgagaaagtcataactgcacatggtccatatcagcagccagggcct

SEQ ID NO: 442389 - DNA, 140 bp, Artificial Sequence
  Synthetic
atacgccatgctgggtctcccctggaaaatgttggagtccaaatagtcagacagatgaggtccggagagagattcctcaagatttggtcacagactgtagaggaaatagtctcctatgtccgtacttgggagtcggccat

SEQ ID NO: 442390 - DNA, 140 bp, Artificial Sequence
  Synthetic
atggccgactcccaagtacggacataggagactatttcctctacagtctgtgaccaaatcttgaggaatctctctccggacctcatctgtctgactatttggactccaacattttccaggggagacccagcatggcgtat

SEQ ID NO: 442391 - DNA, 140 bp, Artificial Sequence
  Synthetic
atacgccatgctgggtctccatgaagtcattaaactattagagccatatgtcgtgaacagtttagtccagagagcagaaaagtttagacctcttattcattctttaggagactttcctgtcgtacttgggagtcggccat

SEQ ID NO: 442392 - DNA, 140 bp, Artificial Sequence
  Synthetic
atggccgactcccaagtacgacaggaaagtctcctaaagaatgaataagaggtctaaacttttctgctctctggactaaactgttcacgacatatggctctaatagtttaatgacttcatggagacccagcatggcgtat

SEQ ID NO: 442393 - DNA, 140 bp, Artificial Sequence
  Synthetic
aggccctggctgctgatatgatcttggggagagaacactcgagagctttactcgccttctagaagatcctaccaccttaaatataaaaggaggtgccagtcccaccattctactaaaggagaccttttgggacagcggtg

SEQ ID NO: 442394 - DNA, 140 bp, Artificial Sequence
  Synthetic
caccgctgtcccaaaaggtctcctttagtagaatggtgggactggcacctccttttatatttaaggtggtaggatcttctagaaggcgagtaaagctctcgagtgttctctccccaagatcatatcagcagccagggcct

SEQ ID NO: 442395 - DNA, 140 bp, Artificial Sequence
  Synthetic
atacgccatgctgggtctccgagtttagggaagcgatcctcttgtctaagactcatagggataatttcatactcttcttgaaatctgttgagcctttgttcccccgatttctcagtgagccgtacttgggagtcggccat

SEQ ID NO: 442396 - DNA, 140 bp, Artificial Sequence
  Synthetic
atggccgactcccaagtacggctcactgagaaatcgggggaacaaaggctcaacagatttcaagaagagtatgaaattatccctatgagtcttagacaagaggatcgcttccctaaactcggagacccagcatggcgtat

SEQ ID NO: 442397 - DNA, 140 bp, Artificial Sequence
  Synthetic
aggccctggctgctgatatggtatccacaaatgcattgactgtagcacaacactctcagtctttgattaaaccaatgagggactttttgcttatgtcagtacaagccgttttccattactgaccttttgggacagcggtg

SEQ ID NO: 442398 - DNA, 140 bp, Artificial Sequence
  Synthetic
caccgctgtcccaaaaggtcagtaatggaaaacggcttgtactgacataagcaaaaagtccctcattggtttaatcaaagactgagagtgttgtgctacagtcaatgcatttgtggataccatatcagcagccagggcct

SEQ ID NO: 442399 - DNA, 140 bp, Artificial Sequence
  Synthetic
aggccctggctgctgatatgctgctgaccgaattttaatactcaggcctaccagacaagggggcctgagttgctctgaattcgacgtaaaaaaaacagggaacaccactgataagatgaagaccttttgggacagcggtg

SEQ ID NO: 442400 - DNA, 140 bp, Artificial Sequence
  Synthetic
caccgctgtcccaaaaggtcttcatcttatcagtggtgttccctgttttttttacgtcgaattcagagcaactcaggcccccttgtctggtaggcctgagtattaaaattcggtcagcagcatatcagcagccagggcct

SEQ ID NO: 442401 - DNA, 140 bp, Artificial Sequence
  Synthetic
atacgccatgctgggtctccatgaatggaggtcgactcaagagatcgcatatacggagatatgtctcagtcagttccaatcatcaagctcgtccaaattcattcgccgagtttctgaacacgtacttgggagtcggccat

SEQ ID NO: 442402 - DNA, 140 bp, Artificial Sequence
  Synthetic
atggccgactcccaagtacgtgttcagaaactcggcgaatgaatttggacgagcttgatgattggaactgactgagacatatctccgtatatgcgatctcttgagtcgacctccattcatggagacccagcatggcgtat

SEQ ID NO: 442403 - DNA, 140 bp, Artificial Sequence
  Synthetic
aggccctggctgctgatatgtgtaattctagcttgagtctgtcgtctcactggatcaggttgatttacaagatagtgaagactaccagactcattggcagtatcgaggacctatccggaggaccttttgggacagcggtg

SEQ ID NO: 442404 - DNA, 140 bp, Artificial Sequence
  Synthetic
caccgctgtcccaaaaggtcctccggataggtcctcgatactgccaatgagtctggtagtcttcactatcttgtaaatcaacctgatccagtgagacgacagactcaagctagaattacacatatcagcagccagggcct

SEQ ID NO: 442405 - DNA, 140 bp, Artificial Sequence
  Synthetic
aggccctggctgctgatatgatgcacttgtggaacaacaggaggaagcaatcctagagtttctgtgtcagtacttccatctttcgatcagtcatttttttcacgaggtcccctaaagggagaccttttgggacagcggtg

SEQ ID NO: 442406 - DNA, 140 bp, Artificial Sequence
  Synthetic
caccgctgtcccaaaaggtctccctttaggggacctcgtgaaaaaaatgactgatcgaaagatggaagtactgacacagaaactctaggattgcttcctcctgttgttccacaagtgcatcatatcagcagccagggcct

SEQ ID NO: 442407 - DNA, 140 bp, Artificial Sequence
  Synthetic
aggccctggctgctgatatgcgtccaaccttggtgagatgaccgagaagaggggaaacaagtatcgagaggactttcagatggatgaaggagagaatcctagtctcttgttccagtcttagaccttttgggacagcggtg

SEQ ID NO: 442408 - DNA, 140 bp, Artificial Sequence
  Synthetic
caccgctgtcccaaaaggtctaagactggaacaagagactaggattctctccttcatccatctgaaagtcctctcgatacttgtttcccctcttctcggtcatctcaccaaggttggacgcatatcagcagccagggcct

SEQ ID NO: 442409 - DNA, 140 bp, Artificial Sequence
  Synthetic
aggccctggctgctgatatgacagtcaactttcccaacccttcaggaaggtctttggaggacaaatcaacccagactactggccgggagcccaagaaagagacaatatctactcattcccgaccttttgggacagcggtg

SEQ ID NO: 442410 - DNA, 140 bp, Artificial Sequence
  Synthetic
caccgctgtcccaaaaggtcgggaatgagtagatattgtctctttcttgggctcccggccagtagtctgggttgatttgtcctccaaagaccttcctgaagggttgggaaagttgactgtcatatcagcagccagggcct

SEQ ID NO: 442411 - DNA, 140 bp, Artificial Sequence
  Synthetic
aggccctggctgctgatatgaggggctccagtccctgagggcatgaactgggtgtacaagttgaggagaacccttatcttccagtgggctgattccaggggccctcttgaaggggaggaggaccttttgggacagcggtg

SEQ ID NO: 442412 - DNA, 140 bp, Artificial Sequence
  Synthetic
caccgctgtcccaaaaggtcctcctccccttcaagagggcccctggaatcagcccactggaagataagggttctcctcaacttgtacacccagttcatgccctcagggactggagcccctcatatcagcagccagggcct

SEQ ID NO: 442413 - DNA, 140 bp, Artificial Sequence
  Synthetic
aggccctggctgctgatatgaatagaggccgagatcgctcaccagattgctgagagcttttccaagaagtacaaattcccttctagatcctcaggtatattcttgtataattttgagcaggaccttttgggacagcggtg

SEQ ID NO: 442414 - DNA, 140 bp, Artificial Sequence
  Synthetic
caccgctgtcccaaaaggtcctgctcaaaattatacaagaatatacctgaggatctagaagggaatttgtacttcttggaaaagctctcagcaatctggtgagcgatctcggcctctattcatatcagcagccagggcct

SEQ ID NO: 442415 - DNA, 140 bp, Artificial Sequence
  Synthetic
aggccctggctgctgatatgcttgtacgggtgtggtgacggaagcagaaacctacactaactttgttggctatgtcaccaccacgtttaagagaaagcactttcgaccaactccggatgcgaccttttgggacagcggtg

SEQ ID NO: 442416 - DNA, 140 bp, Artificial Sequence
  Synthetic
caccgctgtcccaaaaggtcgcatccggagttggtcgaaagtgctttctcttaaacgtggtggtgacatagccaacaaagttagtgtaggtttctgcttccgtcaccacacccgtacaagcatatcagcagccagggcct

SEQ ID NO: 442417 - DNA, 140 bp, Artificial Sequence
  Synthetic
atacgccatgctgggtctcccccgacaagctgaataaaatcatgcaggatgatttgaatcgctatgcatcttgctaaccgagcttctaaactcagtccttctagacaataaaatctgaggcgtacttgggagtcggccat

SEQ ID NO: 442418 - DNA, 140 bp, Artificial Sequence
  Synthetic
atggccgactcccaagtacgcctcagattttattgtctagaaggactgagtttagaagctcggttagcaagatgcatagcgattcaaatcatcctgcatgattttattcagcttgtcgggggagacccagcatggcgtat

SEQ ID NO: 442419 - DNA, 140 bp, Artificial Sequence
  Synthetic
aggccctggctgctgatatgagtctctgcacaatccctatcctgattatcattggctccggactgtaaaaaccaccaaagagtcctttgttatcatatctccaagtgtggcagatctagagaccttttgggacagcggtg

SEQ ID NO: 442420 - DNA, 140 bp, Artificial Sequence
  Synthetic
caccgctgtcccaaaaggtctctagatctgccacacttggagatatgataacaaaggactctttggtggtttttacagtccggagccaatgataatcaggatagggattgtgcagagactcatatcagcagccagggcct

SEQ ID NO: 442421 - DNA, 140 bp, Artificial Sequence
  Synthetic
atacgccatgctgggtctccgcaacagatcgatcttgtgttatctccaacatgtgctacgctatgagcgagaggtgatcacagcgtctccagagaatgactggctgtggatcttctcagacgtacttgggagtcggccat

SEQ ID NO: 442422 - DNA, 140 bp, Artificial Sequence
  Synthetic
atggccgactcccaagtacgtctgagaagatccacagccagtcattctctggagacgctgtgatcacctctcgctcatagcgtagcacatgttggagataacacaagatcgatctgttgcggagacccagcatggcgtat

SEQ ID NO: 442423 - DNA, 140 bp, Artificial Sequence
  Synthetic
atacgccatgctgggtctcccagatcagacctcatcgggttatgggaggatcaaatatactgcttggatatgtccaacggcccaacatgctggaatggtcaagacggcgggctagagggtcgtacttgggagtcggccat

SEQ ID NO: 442424 - DNA, 140 bp, Artificial Sequence
  Synthetic
atggccgactcccaagtacgaccctctagcccgccgtcttgaccattccagcatgttgggccgttggacatatccaagcagtatatttgatcctcccataacccgatgaggtctgatctgggagacccagcatggcgtat

SEQ ID NO: 442425 - DNA, 140 bp, Artificial Sequence
  Synthetic
atacgccatgctgggtctccaggagctccagtccctgagggcatgaactgggtgtacaagttgaggagaacccttatcttccagtgggctgattctaggggccctcttgaaggggaagagcgtacttgggagtcggccat

SEQ ID NO: 442426 - DNA, 140 bp, Artificial Sequence
  Synthetic
atggccgactcccaagtacgctcttccccttcaagagggcccctagaatcagcccactggaagataagggttctcctcaacttgtacacccagttcatgccctcagggactggagctcctggagacccagcatggcgtat

SEQ ID NO: 442427 - DNA, 140 bp, Artificial Sequence
  Synthetic
aggccctggctgctgatatgtacatgactttcattcagatgagattgaacatcttgttgtggaggagttggtcaagaaaagggaagagtgtctagatgcactggagtccatcatgaccacgaccttttgggacagcggtg

SEQ ID NO: 442428 - DNA, 140 bp, Artificial Sequence
  Synthetic
caccgctgtcccaaaaggtcgtggtcatgatggactccagtgcatctagacactcttcccttttcttgaccaactcctccacaacaagatgttcaatctcatctgaatgaaagtcatgtacatatcagcagccagggcct

SEQ ID NO: 442429 - DNA, 140 bp, Artificial Sequence
  Synthetic
aggccctggctgctgatatgcaaacccagcccctgtctcagagctcgacataagggccctctctaagaggtttcaaaaccctctgatctcaggcctgagggtggttcagtgggcaaccgggaccttttgggacagcggtg

SEQ ID NO: 442430 - DNA, 140 bp, Artificial Sequence
  Synthetic
caccgctgtcccaaaaggtcccggttgcccactgaaccaccctcaggcctgagatcagagggttttgaaacctcttagagagggcccttatgtcgagctctgagacaggggctgggtttgcatatcagcagccagggcct

SEQ ID NO: 442431 - DNA, 140 bp, Artificial Sequence
  Synthetic
atacgccatgctgggtctcctcgtgtaaattctcataatacaggagatcttctagcagtttcagtaaccaacggtgctttcattatccaggaattgatgccaaaggttgtggacaggccacgtacttgggagtcggccat

SEQ ID NO: 442432 - DNA, 140 bp, Artificial Sequence
  Synthetic
atggccgactcccaagtacgtggcctgtccacaacctttggcatcaattcctggataatgaaagcaccgttggttactgaaactgctagaagatctcctgtattatgagaatttacacgaggagacccagcatggcgtat

SEQ ID NO: 442433 - DNA, 140 bp, Artificial Sequence
  Synthetic
atacgccatgctgggtctccctcaacatgtttccagatgccaagcttgtgttcaacagccttttagaggtgaatgatctgatggcttccggaacacatccactacctccttcagcaatcacgtacttgggagtcggccat

SEQ ID NO: 442434 - DNA, 140 bp, Artificial Sequence
  Synthetic
atggccgactcccaagtacgtgattgctgaaggaggtagtggatgtgttccggaagccatcagatcattcacctctaaaaggctgttgaacacaagcttggcatctggaaacatgttgagggagacccagcatggcgtat

SEQ ID NO: 442435 - DNA, 140 bp, Artificial Sequence
  Synthetic
aggccctggctgctgatatgaactaggtccttggagcccaattgacatacatcatctcagctgtccaaacaacttggtcgtggaggacgagggatgcaccaacctgtcaggattctcctagaccttttgggacagcggtg

SEQ ID NO: 442436 - DNA, 140 bp, Artificial Sequence
  Synthetic
caccgctgtcccaaaaggtctaggagaatcctgacaggttggtgcatccctcgtcctccacgaccaagttgtttggacagctgagatgatgtatgtcaattgggctccaaggacctagttcatatcagcagccagggcct

SEQ ID NO: 442437 - DNA, 140 bp, Artificial Sequence
  Synthetic
atacgccatgctgggtctccacagggaggaaagtgtcggtaacctcccaaagcgggagggtcatatcttcatgggagtcatacaaaagcggaggtgagaccaagctgtaagggcaggtcacgtacttgggagtcggccat

SEQ ID NO: 442438 - DNA, 140 bp, Artificial Sequence
  Synthetic
atggccgactcccaagtacgtgacctgcccttacagcttggtctcacctccgcttttgtatgactcccatgaagatatgaccctcccgctttgggaggttaccgacactttcctccctgtggagacccagcatggcgtat

SEQ ID NO: 442439 - DNA, 140 bp, Artificial Sequence
  Synthetic
atacgccatgctgggtctccatgggagtcttacaagagcggaggcgagaccaagctgtgaggagggcttcctcctccacacactatgcttggaagactgctcccccccaatacatggaagcgtacttgggagtcggccat

SEQ ID NO: 442440 - DNA, 140 bp, Artificial Sequence
  Synthetic
atggccgactcccaagtacgcttccatgtattgggggggagcagtcttccaagcatagtgtgtggaggaggaagccctcctcacagcttggtctcgcctccgctcttgtaagactcccatggagacccagcatggcgtat

SEQ ID NO: 442441 - DNA, 140 bp, Artificial Sequence
  Synthetic
atacgccatgctgggtctccaaaaatgtaacacccctacaatggatgccgacaagattgtattcaaagtcaataatcaggtggtctctttgaagcctgagattatagtggatcaatatgacgtacttgggagtcggccat

SEQ ID NO: 442442 - DNA, 140 bp, Artificial Sequence
  Synthetic
atggccgactcccaagtacgtcatattgatccactataatctcaggcttcaaagagaccacctgattattgactttgaatacaatcttgtcggcatccattgtaggggtgttacatttttggagacccagcatggcgtat

SEQ ID NO: 442443 - DNA, 140 bp, Artificial Sequence
  Synthetic
aggccctggctgctgatatgcagggataactgtgtcttctacctactgcctgactaaccatgaatacaccatttggatgccagagaatctgagactagggacgtcttgtgacattttcacgaccttttgggacagcggtg

SEQ ID NO: 442444 - DNA, 140 bp, Artificial Sequence
  Synthetic
caccgctgtcccaaaaggtcgtgaaaatgtcacaagacgtccctagtctcagattctctggcatccaaatggtgtattcatggttagtcaggcagtaggtagaagacacagttatccctgcatatcagcagccagggcct

SEQ ID NO: 442445 - DNA, 140 bp, Artificial Sequence
  Synthetic
aggccctggctgctgatatgtagatgagagaggcttatataagtccctaaaaggagcatgcaaactcaagttatgtggggttcttgggcttagactcatggatgggacatgggtcgcaatgaccttttgggacagcggtg

SEQ ID NO: 442446 - DNA, 140 bp, Artificial Sequence
  Synthetic
caccgctgtcccaaaaggtcattgcgacccatgtcccatccatgagtctaagcccaagaaccccacataacttgagtttgcatgctccttttagggacttatataagcctctctcatctacatatcagcagccagggcct

SEQ ID NO: 442447 - DNA, 140 bp, Artificial Sequence
  Synthetic
atacgccatgctgggtctcctcatgggaatcacacaagagtgggggtgagaccagactgtgaggactggccgtcctttcaacgatccaagtcctgaagatcacctccccttggggggttccgtacttgggagtcggccat

SEQ ID NO: 442448 - DNA, 140 bp, Artificial Sequence
  Synthetic
atggccgactcccaagtacggaaccccccaaggggaggtgatcttcaggacttggatcgttgaaaggacggccagtcctcacagtctggtctcacccccactcttgtgtgattcccatgaggagacccagcatggcgtat

SEQ ID NO: 442449 - DNA, 140 bp, Artificial Sequence
  Synthetic
atacgccatgctgggtctccgtcaagaaaagagaggagtgtctggatgcaatagagtccatcatgaccaccaagtcagtgagttttagacgtctcagccacttaagaaaacttgtccctgcgtacttgggagtcggccat

SEQ ID NO: 442450 - DNA, 140 bp, Artificial Sequence
  Synthetic
atggccgactcccaagtacgcagggacaagttttcttaagtggctgagacgtctaaaactcactgacttggtggtcatgatggactctattgcatccagacactcctctcttttcttgacggagacccagcatggcgtat

SEQ ID NO: 442451 - DNA, 140 bp, Artificial Sequence
  Synthetic
aggccctggctgctgatatggtgtttaagagttggggggagatgtcatcctcatgtgaaaggggtgttcttcaacgggataatactgggacctgacggccatgttctaatcccagagatggaccttttgggacagcggtg

SEQ ID NO: 442452 - DNA, 140 bp, Artificial Sequence
  Synthetic
caccgctgtcccaaaaggtccatctctgggattagaacatggccgtcaggtcccagtattatcccgttgaagaacacccctttcacatgaggatgacatctccccccaactcttaaacaccatatcagcagccagggcct

SEQ ID NO: 442453 - DNA, 140 bp, Artificial Sequence
  Synthetic
aggccctggctgctgatatgcttgctaaccgaactcttaaactcagtccctctagatgataaaacctgagatgtcctaaagtcaacatgaaaaaaacgggcaacaccactgacaaaatgagaccttttgggacagcggtg

SEQ ID NO: 442454 - DNA, 140 bp, Artificial Sequence
  Synthetic
caccgctgtcccaaaaggtctcattttgtcagtggtgttgcccgtttttttcatgttgactttaggacatctcaggttttatcatctagagggactgagtttaagagttcggttagcaagcatatcagcagccagggcct

SEQ ID NO: 442455 - DNA, 140 bp, Artificial Sequence
  Synthetic
atacgccatgctgggtctccatgaggctgaggattttgttgaagttcaccttcccgatgtgcacaaacaggtctcaggggttgacttgggtctcccgaactgggggaagtatatattagtcgtacttgggagtcggccat

SEQ ID NO: 442456 - DNA, 140 bp, Artificial Sequence
  Synthetic
atggccgactcccaagtacgactaatatatacttcccccagttcgggagacccaagtcaacccctgagacctgtttgtgcacatcgggaaggtgaacttcaacaaaatcctcagcctcatggagacccagcatggcgtat

SEQ ID NO: 442457 - DNA, 140 bp, Artificial Sequence
  Synthetic
aggccctggctgctgatatgacagagagaaagatgtcagtcactccccaaagcgggaagatcatatcttcctgggagtcatataagagtggaggtgagaccagactgtgaaagctggtctgaccttttgggacagcggtg

SEQ ID NO: 442458 - DNA, 140 bp, Artificial Sequence
  Synthetic
caccgctgtcccaaaaggtcagaccagctttcacagtctggtctcacctccactcttatatgactcccaggaagatatgatcttcccgctttggggagtgactgacatctttctctctgtcatatcagcagccagggcct

SEQ ID NO: 442459 - DNA, 140 bp, Artificial Sequence
  Synthetic
aggccctggctgctgatatgctaagagtcatgagactttcattaatcacctcaattgatctgacatgatcatgtagattctcacgatacgggaaatcttctagcagtttcagtgaccaaagaccttttgggacagcggtg

SEQ ID NO: 442460 - DNA, 140 bp, Artificial Sequence
  Synthetic
caccgctgtcccaaaaggtctttggtcactgaaactgctagaagatttcccgtatcgtgagaatctacatgatcatgtcagatcaattgaggtgattaatgaaagtctcatgactcttagcatatcagcagccagggcct

SEQ ID NO: 442461 - DNA, 140 bp, Artificial Sequence
  Synthetic
aggccctggctgctgatatgctcttttagattatagctgcttgtaaactaggcattctcgagggaatatacagactaagactctttgacggtgcaacctgaaaaaaacaagatcctgattgaccttttgggacagcggtg

SEQ ID NO: 442462 - DNA, 140 bp, Artificial Sequence
  Synthetic
caccgctgtcccaaaaggtcaatcaggatcttgtttttttcaggttgcaccgtcaaagagtcttagtctgtatattccctcgagaatgcctagtttacaagcagctataatctaaaagagcatatcagcagccagggcct

SEQ ID NO: 442463 - DNA, 140 bp, Artificial Sequence
  Synthetic
atacgccatgctgggtctccgttgacaagagaccccaccgttccggagcatgcatcgttagttggtcttctcttgagtctgtatagattgagcaaaatatctggacagaacactggcaatcgtacttgggagtcggccat

SEQ ID NO: 442464 - DNA, 140 bp, Artificial Sequence
  Synthetic
atggccgactcccaagtacgattgccagtgttctgtccagatattttgctcaatctatacagactcaagagaagaccaactaacgatgcatgctccggaacggtggggtctcttgtcaacggagacccagcatggcgtat

SEQ ID NO: 442465 - DNA, 140 bp, Artificial Sequence
  Synthetic
aggccctggctgctgatatgtcccctgatggtggactcaacgcgagttgattgataaaggcaacttgcctcccatgaaggacataagcaatagctcacaatcatctagcatctcagcaaagaccttttgggacagcggtg

SEQ ID NO: 442466 - DNA, 140 bp, Artificial Sequence
  Synthetic
caccgctgtcccaaaaggtctttgctgagatgctagatgattgtgagctattgcttatgtccttcatgggaggcaagttgcctttatcaatcaactcgcgttgagtccaccatcaggggacatatcagcagccagggcct

SEQ ID NO: 442467 - DNA, 140 bp, Artificial Sequence
  Synthetic
aggccctggctgctgatatgctaacagacaattgctcaaggtcccacaaagttttgaaagattatttcaagaaaatagacttgggttctctcaaagtgggcggaactgctgcacagtcaagaccttttgggacagcggtg

SEQ ID NO: 442468 - DNA, 140 bp, Artificial Sequence
  Synthetic
caccgctgtcccaaaaggtcttgactgtgcagcagttccgcccactttgagagaacccaagtctattttcttgaaataatctttcaaaactttgtgggaccttgagcaattgtctgttagcatatcagcagccagggcct

SEQ ID NO: 442469 - DNA, 140 bp, Artificial Sequence
  Synthetic
aggccctggctgctgatatgcagagtcaccggacaggggcttttagactattcaagggttacatacgcctttcacctggactatgagaagtggaacaatcatcagaggctggaatcgacagaccttttgggacagcggtg

SEQ ID NO: 442470 - DNA, 140 bp, Artificial Sequence
  Synthetic
caccgctgtcccaaaaggtctgtcgattccagcctctgatgattgttccacttctcatagtccaggtgaaaggcgtatgtaacccttgaatagtctaaaagcccctgtccggtgactctgcatatcagcagccagggcct

SEQ ID NO: 442471 - DNA, 140 bp, Artificial Sequence
  Synthetic
aggccctggctgctgatatgagatgtataaccgacttggcccatttctattccaagtcatcccccatagagaagcttttaaattgtacgctagtaaatagagggctgagagtccccccaggaccttttgggacagcggtg

SEQ ID NO: 442472 - DNA, 140 bp, Artificial Sequence
  Synthetic
caccgctgtcccaaaaggtcctggggggactctcagccctctatttactagcgtacaatttaaaagcttctctatgggggatgacttggaatagaaatgggccaagtcggttatacatctcatatcagcagccagggcct

SEQ ID NO: 442473 - DNA, 140 bp, Artificial Sequence
  Synthetic
aggccctggctgctgatatgtagatgaaagaggcctgtataagtctctaaagggagcatgcaaactcaagttatgtggagttcttggacttagactcatggatgggacatgggttgcgatgaccttttgggacagcggtg

SEQ ID NO: 442474 - DNA, 140 bp, Artificial Sequence
  Synthetic
caccgctgtcccaaaaggtcatcgcaacccatgtcccatccatgagtctaagtccaagaactccacataacttgagtttgcatgctccctttagagacttatacaggcctctttcatctacatatcagcagccagggcct

SEQ ID NO: 442475 - DNA, 140 bp, Artificial Sequence
  Synthetic
aggccctggctgctgatatgcctatatatgaatgccctagactgggacgaagaaaaaaccatcctagcattatggaaggatttaacctcagtggatatcgggaaggacttggtcaagttcgaccttttgggacagcggtg

SEQ ID NO: 442476 - DNA, 140 bp, Artificial Sequence
  Synthetic
caccgctgtcccaaaaggtcgaacttgaccaagtccttcccgatatccactgaggttaaatccttccataatgctaggatggttttttcttcgtcccagtctagggcattcatatataggcatatcagcagccagggcct

SEQ ID NO: 442477 - DNA, 140 bp, Artificial Sequence
  Synthetic
aggccctggctgctgatatgatctgttcttgtcccgcttcaactccttaatgattttgctttctccccctgagccccgatactcagatgacttggtatctcaactgtgccagctatacatgaccttttgggacagcggtg

SEQ ID NO: 442478 - DNA, 140 bp, Artificial Sequence
  Synthetic
caccgctgtcccaaaaggtcatgtatagctggcacagttgagataccaagtcatctgagtatcggggctcagggggagaaagcaaaatcattaaggagttgaagcgggacaagaacagatcatatcagcagccagggcct

SEQ ID NO: 442479 - DNA, 140 bp, Artificial Sequence
  Synthetic
aggccctggctgctgatatgacatcaagatgctagatccaggagaggtctatgatgaccccattgatccaatcgagtcagaggctgaacccagaggagcccccactgtccccaacatcttgaccttttgggacagcggtg

SEQ ID NO: 442480 - DNA, 140 bp, Artificial Sequence
  Synthetic
caccgctgtcccaaaaggtcaagatgttggggacagtgggggctcctctgggttcagcctctgactcgattggatcaatggggtcatcatagacctctcctggatctagcatcttgatgtcatatcagcagccagggcct

SEQ ID NO: 442481 - DNA, 140 bp, Artificial Sequence
  Synthetic
aggccctggctgctgatatgtttttagggttctggatcaattcgacaacatacatgacctggtgtttgtgtacggctgctacaggcattgggggcacccctatatagattatcgaaaggggaccttttgggacagcggtg

SEQ ID NO: 442482 - DNA, 140 bp, Artificial Sequence
  Synthetic
caccgctgtcccaaaaggtcccctttcgataatctatataggggtgcccccaatgcctgtagcagccgtacacaaacaccaggtcatgtatgttgtcgaattgatccagaaccctaaaaacatatcagcagccagggcct

SEQ ID NO: 442483 - DNA, 140 bp, Artificial Sequence
  Synthetic
aggccctggctgctgatatgcctaccaggagtgtttagcaagcgacctggccaggagaattctcagatggggatttgataagtactctaagtggtatctagattctagattcttagcccagaccttttgggacagcggtg

SEQ ID NO: 442484 - DNA, 140 bp, Artificial Sequence
  Synthetic
caccgctgtcccaaaaggtctgggctaagaatctagaatctagataccacttagagtacttatcaaatccccatctgagaattctcctggccaggtcgcttgctaaacactcctggtaggcatatcagcagccagggcct

SEQ ID NO: 442485 - DNA, 140 bp, Artificial Sequence
  Synthetic
aggccctggctgctgatatgtatgtcacaaccacgttcaaaagaaagcacttccgcccaacaccagatgagtgtagagccgcgtacaactggaagatggccggtgaccccagatatgagggaccttttgggacagcggtg

SEQ ID NO: 442486 - DNA, 140 bp, Artificial Sequence
  Synthetic
caccgctgtcccaaaaggtccctcatatctggggtcaccggccatcttccagttgtacgcggctctacactcatctggtgttgggcggaagtgctttcttttgaacgtggttgtgacatacatatcagcagccagggcct

SEQ ID NO: 442487 - DNA, 140 bp, Artificial Sequence
  Synthetic
aggccctggctgctgatatggcagatcttttgagggaaatctcttgggggaggaaagtagtgggtacaacagttccccacccttctgagatgttgggactgcttcctaagtcctccatctgaccttttgggacagcggtg

SEQ ID NO: 442488 - DNA, 140 bp, Artificial Sequence
  Synthetic
caccgctgtcccaaaaggtcagatggaggacttaggaagcagtcccaacatctcagaagggtggggaactgttgtacccactactttcctcccccaagagatttccctcaaaagatctgccatatcagcagccagggcct

SEQ ID NO: 442489 - DNA, 140 bp, Artificial Sequence
  Synthetic
atacgccatgctgggtctccaggcagtttaggaggagtctctcaagaacattagaagagtccttctataactcagagatccatgggatcaaccggatgacccaaactccccaaagggtcgcgtacttgggagtcggccat

SEQ ID NO: 442490 - DNA, 140 bp, Artificial Sequence
  Synthetic
atggccgactcccaagtacgcgaccctttggggagtttgggtcatccggttgatcccatggatctctgagttatagaaggactcttctaatgttcttgagagactcctcctaaactgcctggagacccagcatggcgtat

SEQ ID NO: 442491 - DNA, 140 bp, Artificial Sequence
  Synthetic
aggccctggctgctgatatgagattgagggccgattctttgctctaatgtcatggaatctaagattatattttgtcatcactgaaaaactcttggccaactacatcttaccactttttgagaccttttgggacagcggtg

SEQ ID NO: 442492 - DNA, 140 bp, Artificial Sequence
  Synthetic
caccgctgtcccaaaaggtctcaaaaagtggtaagatgtagttggccaagagtttttcagtgatgacaaaatataatcttagattccatgacattagagcaaagaatcggccctcaatctcatatcagcagccagggcct

SEQ ID NO: 442493 - DNA, 140 bp, Artificial Sequence
  Synthetic
atacgccatgctgggtctccacgcttaacaacaaaatcagagaagaagtagacagtatcgtctacaaagcaaaaatgtaacacccctacaatggatgccgacaagattgtattcaaggtccgtacttgggagtcggccat

SEQ ID NO: 442494 - DNA, 140 bp, Artificial Sequence
  Synthetic
atggccgactcccaagtacggaccttgaatacaatcttgtcggcatccattgtaggggtgttacatttttgctttgtagacgatactgtctacttcttctctgattttgttgttaagcgtggagacccagcatggcgtat

SEQ ID NO: 442495 - DNA, 140 bp, Artificial Sequence
  Synthetic
atacgccatgctgggtctcctgacagttcttcctggaatctgtgcaacagggtagattcaagggtcaagatactttcatcaatcatctcaactgatcagctacagtgaagtagactctgacgtacttgggagtcggccat

SEQ ID NO: 442496 - DNA, 140 bp, Artificial Sequence
  Synthetic
atggccgactcccaagtacgtcagagtctacttcactgtagctgatcagttgagatgattgatgaaagtatcttgacccttgaatctaccctgttgcacagattccaggaagaactgtcaggagacccagcatggcgtat

SEQ ID NO: 442497 - DNA, 140 bp, Artificial Sequence
  Synthetic
atacgccatgctgggtctccataagacgtactgatgtggaagggaattgggctctaacagggggcatggagttgacaagggaccctactgtttcagagcatgcatctctggttggccttccgtacttgggagtcggccat

SEQ ID NO: 442498 - DNA, 140 bp, Artificial Sequence
  Synthetic
atggccgactcccaagtacggaaggccaaccagagatgcatgctctgaaacagtagggtcccttgtcaactccatgccccctgttagagcccaattcccttccacatcagtacgtcttatggagacccagcatggcgtat

SEQ ID NO: 442499 - DNA, 140 bp, Artificial Sequence
  Synthetic
atacgccatgctgggtctccggttctgtgtccgacatatatgttgtcgccgggactgtctcgagaggggctcctctatgagttagagagtatatcaaggaatgcactgtcaatataccgacgtacttgggagtcggccat

SEQ ID NO: 442500 - DNA, 140 bp, Artificial Sequence
  Synthetic
atggccgactcccaagtacgtcggtatattgacagtgcattccttgatatactctctaactcatagaggagcccctctcgagacagtcccggcgacaacatatatgtcggacacagaaccggagacccagcatggcgtat

SEQ ID NO: 442501 - DNA, 140 bp, Artificial Sequence
  Synthetic
atacgccatgctgggtctcctcttgagtttatataggttgagcaaaatctctggacagaataccggcaattacaagacaaacatcgcggatagaatagagcagattttcgagacagcccccgtacttgggagtcggccat

SEQ ID NO: 442502 - DNA, 140 bp, Artificial Sequence
  Synthetic
atggccgactcccaagtacgggggctgtctcgaaaatctgctctattctatccgcgatgtttgtcttgtaattgccggtattctgtccagagattttgctcaacctatataaactcaagaggagacccagcatggcgtat

SEQ ID NO: 442503 - DNA, 140 bp, Artificial Sequence
  Synthetic
aggccctggctgctgatatggaggtaatatcttggtgcctgaatccaaaagatgggccagagtctcttgcatctctaatgaccaaatagtcaaccttgccaatataatgtcgacagtatcgaccttttgggacagcggtg

SEQ ID NO: 442504 - DNA, 140 bp, Artificial Sequence
  Synthetic
caccgctgtcccaaaaggtcgatactgtcgacattatattggcaaggttgactatttggtcattagagatgcaagagactctggcccatcttttggattcaggcaccaagatattacctccatatcagcagccagggcct

SEQ ID NO: 442505 - DNA, 140 bp, Artificial Sequence
  Synthetic
atacgccatgctgggtctccggtttataaagcaaataaatctcactgcgagagaagcactattatacttcttccacaagaactttgaggaagaaataagaagaatgttcgagcctgggcacgtacttgggagtcggccat

SEQ ID NO: 442506 - DNA, 140 bp, Artificial Sequence
  Synthetic
atggccgactcccaagtacgtgcccaggctcgaacattcttcttatttcttcctcaaagttcttgtggaagaagtataatagtgcttctctcgcagtgagatttatttgctttataaaccggagacccagcatggcgtat

SEQ ID NO: 442507 - DNA, 140 bp, Artificial Sequence
  Synthetic
atacgccatgctgggtctccctcattcactttgttggatgttatatgggtcaggtgagatctctaaatgcaacagtgattgcaacatgtgccccgcatgagatgtctgttcttgggggctcgtacttgggagtcggccat

SEQ ID NO: 442508 - DNA, 140 bp, Artificial Sequence
  Synthetic
atggccgactcccaagtacgagcccccaagaacagacatctcatgcggggcacatgttgcaatcactgttgcatttagagatctcacctgacccatataacatccaacaaagtgaatgagggagacccagcatggcgtat

SEQ ID NO: 442509 - DNA, 140 bp, Artificial Sequence
  Synthetic
aggccctggctgctgatatgctcccatgagtcttggattcacgcgttgtgtcaagaggctgggaacccagatcttggggagagaacacttgagagcttcactcgccttctggaagatcccgaccttttgggacagcggtg

SEQ ID NO: 442510 - DNA, 140 bp, Artificial Sequence
  Synthetic
caccgctgtcccaaaaggtcgggatcttccagaaggcgagtgaagctctcaagtgttctctccccaagatctgggttcccagcctcttgacacaacgcgtgaatccaagactcatgggagcatatcagcagccagggcct

SEQ ID NO: 442511 - DNA, 140 bp, Artificial Sequence
  Synthetic
atacgccatgctgggtctccatttgggggaggagttcttcgggaaaggaacttttgaaaggagattcttcagggatgagaaggaacttcaggaatatgaggcagctgaattgacaaaagccgtacttgggagtcggccat

SEQ ID NO: 442512 - DNA, 140 bp, Artificial Sequence
  Synthetic
atggccgactcccaagtacggcttttgtcaattcagctgcctcatattcctgaagttccttctcatccctgaagaatctcctttcaaaagttcctttcccgaagaactcctcccccaaatggagacccagcatggcgtat

SEQ ID NO: 442513 - DNA, 140 bp, Artificial Sequence
  Synthetic
atacgccatgctgggtctccctcttcttaaagtctgttgaacctctgtttcctcgatttctcagtgagctcttcagttcatcttttttgggaatccccgagtcaatcattggactgataccgtacttgggagtcggccat

SEQ ID NO: 442514 - DNA, 140 bp, Artificial Sequence
  Synthetic
atggccgactcccaagtacggtatcagtccaatgattgactcggggattcccaaaaaagatgaactgaagagctcactgagaaatcgaggaaacagaggttcaacagactttaagaagagggagacccagcatggcgtat

SEQ ID NO: 442515 - DNA, 140 bp, Artificial Sequence
  Synthetic
atacgccatgctgggtctcccaacgagatgtatacatctctcatgaaaaaaactaacacccctcctttcgaaccgtctcagacatgagcaagatttttgtcaacccaagtgcgatcagggcgtacttgggagtcggccat

SEQ ID NO: 442516 - DNA, 140 bp, Artificial Sequence
  Synthetic
atggccgactcccaagtacgccctgatcgcacttgggttgacaaaaatcttgctcatgtctgagacggttcgaaaggaggggtgttagtttttttcatgagagatgtatacatctcgttgggagacccagcatggcgtat

SEQ ID NO: 442517 - DNA, 140 bp, Artificial Sequence
  Synthetic
atacgccatgctgggtctccccagacacctcagagggtcgggagggtgtgggcttgctcttcagagagagcagatctacttagggagatctcttggggaagaaaagtggtaggcacgacacgtacttgggagtcggccat

SEQ ID NO: 442518 - DNA, 140 bp, Artificial Sequence
  Synthetic
atggccgactcccaagtacgtgtcgtgcctaccacttttcttccccaagagatctccctaagtagatctgctctctctgaagagcaagcccacaccctcccgaccctctgaggtgtctggggagacccagcatggcgtat

SEQ ID NO: 442519 - DNA, 140 bp, Artificial Sequence
  Synthetic
aggccctggctgctgatatgctgcacttgtggagcaacaggaggaggcaatcctagagtttctgtgtcagtcctcccttctttcgatcagtcatttttttcaagaggccccctgaagggagaccttttgggacagcggtg

SEQ ID NO: 442520 - DNA, 140 bp, Artificial Sequence
  Synthetic
caccgctgtcccaaaaggtctcccttcagggggcctcttgaaaaaaatgactgatcgaaagaagggaggactgacacagaaactctaggattgcctcctcctgttgctccacaagtgcagcatatcagcagccagggcct

SEQ ID NO: 442521 - DNA, 140 bp, Artificial Sequence
  Synthetic
aggccctggctgctgatatgcctggacaatgttggaattcaaatagtcagacaaatgaagtcaggggggagattcctgaaaatatggtctcagactgtcgaggagatcatatcctatgtcgaccttttgggacagcggtg

SEQ ID NO: 442522 - DNA, 140 bp, Artificial Sequence
  Synthetic
caccgctgtcccaaaaggtcgacataggatatgatctcctcgacagtctgagaccatattttcaggaatctcccccctgacttcatttgtctgactatttgaattccaacattgtccaggcatatcagcagccagggcct

SEQ ID NO: 442523 - DNA, 140 bp, Artificial Sequence
  Synthetic
atacgccatgctgggtctccacagggtcaccgggcaagggcttttggactattcgagggttacatatgcatttcacctggactatgaaaagtggaacaatcatcaaagattagagtcaaccgtacttgggagtcggccat

SEQ ID NO: 442524 - DNA, 140 bp, Artificial Sequence
  Synthetic
atggccgactcccaagtacggttgactctaatctttgatgattgttccacttttcatagtccaggtgaaatgcatatgtaaccctcgaatagtccaaaagcccttgcccggtgaccctgtggagacccagcatggcgtat

SEQ ID NO: 442525 - DNA, 140 bp, Artificial Sequence
  Synthetic
atacgccatgctgggtctccagcgagctagtcaaccctcaaaaattaaaatggcagctcaaactgtctctggccctccggctttagaatggtctgtcgccaatgaagaggatgacccatccgtacttgggagtcggccat

SEQ ID NO: 442526 - DNA, 140 bp, Artificial Sequence
  Synthetic
atggccgactcccaagtacggatgggtcatcctcttcattggcgacagaccattctaaagccggagggccagagacagtttgagctgccattttaatttttgagggttgactagctcgctggagacccagcatggcgtat

SEQ ID NO: 442527 - DNA, 140 bp, Artificial Sequence
  Synthetic
aggccctggctgctgatatgtctgttagcacagacaccatgtctgatttgacccaagacgggaaaaactacgatttcatgttccagccattgatgctctatgcgcagacgtggacatcaggaccttttgggacagcggtg

SEQ ID NO: 442528 - DNA, 140 bp, Artificial Sequence
  Synthetic
caccgctgtcccaaaaggtcctgatgtccacgtctgcgcatagagcatcaatggctggaacatgaaatcgtagtttttcccgtcttgggtcaaatcagacatggtgtctgtgctaacagacatatcagcagccagggcct

SEQ ID NO: 442529 - DNA, 140 bp, Artificial Sequence
  Synthetic
atacgccatgctgggtctcctttctagaacacatgagttttttcagaagtcctggatctattattcagacagatcagacctcattgggttatgggaggatcaaatatactgcttggatatcgtacttgggagtcggccat

SEQ ID NO: 442530 - DNA, 140 bp, Artificial Sequence
  Synthetic
atggccgactcccaagtacgatatccaagcagtatatttgatcctcccataacccaatgaggtctgatctgtctgaataatagatccaggacttctgaaaaaactcatgtgttctagaaaggagacccagcatggcgtat

SEQ ID NO: 442531 - DNA, 140 bp, Artificial Sequence
  Synthetic
atacgccatgctgggtctccttatggaaagatttgacctcagtggatattgggaaggacttggtcaaattcaaagatcaaatatggggactattgattgtgacgaaggactatgtctactcgtacttgggagtcggccat

SEQ ID NO: 442532 - DNA, 140 bp, Artificial Sequence
  Synthetic
atggccgactcccaagtacgagtagacatagtccttcgtcacaatcaatagtccccatatttgatctttgaatttgaccaagtccttcccaatatccactgaggtcaaatctttccataaggagacccagcatggcgtat

SEQ ID NO: 442533 - DNA, 140 bp, Artificial Sequence
  Synthetic
atacgccatgctgggtctccctgaaaatgaacctcgacgacatagtcaaggagtcgaagaatgtgccaggtgtgactcgtttggcccatgacggatccaaactccctctgagatgtgtgccgtacttgggagtcggccat

SEQ ID NO: 442534 - DNA, 140 bp, Artificial Sequence
  Synthetic
atggccgactcccaagtacggcacacatctcagagggagtttggatccgtcatgggccaaacgagtcacacctggcacattcttcgactccttgactatgtcgtcgaggttcattttcagggagacccagcatggcgtat

SEQ ID NO: 442535 - DNA, 140 bp, Artificial Sequence
  Synthetic
aggccctggctgctgatatgtgtgactcgtttggcccatgacggatccaaactccctctgagatgtgtgctgggatgggttgccctagcaaattccaaaaaattccagctgctggttgaggaccttttgggacagcggtg

SEQ ID NO: 442536 - DNA, 140 bp, Artificial Sequence
  Synthetic
caccgctgtcccaaaaggtcctcaaccagcagctggaattttttggaatttgctagggcaacccatcccagcacacatctcagagggagtttggatccgtcatgggccaaacgagtcacacatatcagcagccagggcct

SEQ ID NO: 442537 - DNA, 140 bp, Artificial Sequence
  Synthetic
atacgccatgctgggtctcctgggatgggttgccctagcaaattccaaaaaattccagctgctggttgagcctgacaagctaaacaaaataatgcaagatgacctgaaccgttatgcgcccgtacttgggagtcggccat

SEQ ID NO: 442538 - DNA, 140 bp, Artificial Sequence
  Synthetic
atggccgactcccaagtacgggcgcataacggttcaggtcatcttgcattattttgtttagcttgtcaggctcaaccagcagctggaattttttggaatttgctagggcaacccatcccaggagacccagcatggcgtat

SEQ ID NO: 442539 - DNA, 140 bp, Artificial Sequence
  Synthetic
aggccctggctgctgatatgccaggtgattttgaatccctaagcggcagagaaaagtctcgccatatagggtcggctcaggggctcttgtactcaattttggtggcaattcatgactcaggaccttttgggacagcggtg

SEQ ID NO: 442540 - DNA, 140 bp, Artificial Sequence
  Synthetic
caccgctgtcccaaaaggtcctgagtcatgaattgccaccaaaattgagtacaagagcccctgagccgaccctatatggcgagacttttctctgccgcttagggattcaaaatcacctggcatatcagcagccagggcct

SEQ ID NO: 442541 - DNA, 140 bp, Artificial Sequence
  Synthetic
aggccctggctgctgatatgattgttgaggcttgtaaatactgaagctcttggatggtgtaccctgaaaaaaacaagatcccaaatcagaacctctggttgcttgattgtttttttcattgaccttttgggacagcggtg

SEQ ID NO: 442542 - DNA, 140 bp, Artificial Sequence
  Synthetic
caccgctgtcccaaaaggtcaatgaaaaaaacaatcaagcaaccagaggttctgatttgggatcttgtttttttcagggtacaccatccaagagcttcagtatttacaagcctcaacaatcatatcagcagccagggcct

SEQ ID NO: 442543 - DNA, 140 bp, Artificial Sequence
  Synthetic
atacgccatgctgggtctccgatttgcttcttgacaagaatgacaaatatcaacattaatagacctcttgaattgatctcaggggtaatttcatatatccttctgaggctggatgatcatcgtacttgggagtcggccat

SEQ ID NO: 442544 - DNA, 140 bp, Artificial Sequence
  Synthetic
atggccgactcccaagtacgatgatcatccagcctcagaaggatatatgaaattacccctgagatcaattcaagaggtctattaatgttgatatttgtcattcttgtcaagaagcaaatcggagacccagcatggcgtat

SEQ ID NO: 442545 - DNA, 140 bp, Artificial Sequence
  Synthetic
atacgccatgctgggtctccaatcaaagaatgattgggctggtcaaggttgttgttggattagcgttgtcaggggccccggttcctgagggcatgaactgggtatacaaactgaggagaacgtacttgggagtcggccat

SEQ ID NO: 442546 - DNA, 140 bp, Artificial Sequence
  Synthetic
atggccgactcccaagtacgttctcctcagtttgtatacccagttcatgccctcaggaaccggggcccctgacaacgctaatccaacaacaaccttgaccagcccaatcattctttgattggagacccagcatggcgtat

SEQ ID NO: 442547 - DNA, 140 bp, Artificial Sequence
  Synthetic
aggccctggctgctgatatgtacttgggctcgtccacctctatgtcaacccagctattccatgcatgggaaaaagtcactaatgttcatgtggtgaaaagggctctatcgttaaaagaatgaccttttgggacagcggtg

SEQ ID NO: 442548 - DNA, 140 bp, Artificial Sequence
  Synthetic
caccgctgtcccaaaaggtcattcttttaacgatagagcccttttcaccacatgaacattagtgactttttcccatgcatggaatagctgggttgacatagaggtggacgagcccaagtacatatcagcagccagggcct

SEQ ID NO: 442549 - DNA, 140 bp, Artificial Sequence
  Synthetic
atacgccatgctgggtctcccactactgaaagcctgtacatgctgagaatcttgtgtgatgcatcttgaaaaaaacaagatcttgaatccgagcctctggttgtttgattgttttttttacgtacttgggagtcggccat

SEQ ID NO: 442550 - DNA, 140 bp, Artificial Sequence
  Synthetic
atggccgactcccaagtacgtaaaaaaaacaatcaaacaaccagaggctcggattcaagatcttgtttttttcaagatgcatcacacaagattctcagcatgtacaggctttcagtagtgggagacccagcatggcgtat

SEQ ID NO: 442551 - DNA, 140 bp, Artificial Sequence
  Synthetic
aggccctggctgctgatatgatgttcagaatgggtctgttctgctcaacaggttgcagtctccacctcgtccaacccagcccctgtctcagagctcgacataagggccctatctaagagagaccttttgggacagcggtg

SEQ ID NO: 442552 - DNA, 140 bp, Artificial Sequence
  Synthetic
caccgctgtcccaaaaggtctctcttagatagggcccttatgtcgagctctgagacaggggctgggttggacgaggtggagactgcaacctgttgagcagaacagacccattctgaacatcatatcagcagccagggcct

SEQ ID NO: 442553 - DNA, 140 bp, Artificial Sequence
  Synthetic
aggccctggctgctgatatgaggaacatcgaggacaatcaggctcatctccaaggagaacccatagaggtggacagtctccctgaagacatgagacggcttcagttggatgatacaaaacgaccttttgggacagcggtg

SEQ ID NO: 442554 - DNA, 140 bp, Artificial Sequence
  Synthetic
caccgctgtcccaaaaggtcgttttgtatcatccaactgaagccgtctcatgtcttcagggagactgtccacctctatgggttctccttggagatgagcctgattgtcctcgatgttcctcatatcagcagccagggcct

SEQ ID NO: 442555 - DNA, 140 bp, Artificial Sequence
  Synthetic
aggccctggctgctgatatgtttcgagaacgcacgagttttttcaaaagtcctggatctattactcagacagatcagacctcatcgggttatgggaagatcaaatatactgcttagatatgaccttttgggacagcggtg

SEQ ID NO: 442556 - DNA, 140 bp, Artificial Sequence
  Synthetic
caccgctgtcccaaaaggtcatatctaagcagtatatttgatcttcccataacccgatgaggtctgatctgtctgagtaatagatccaggacttttgaaaaaactcgtgcgttctcgaaacatatcagcagccagggcct

SEQ ID NO: 442557 - DNA, 140 bp, Artificial Sequence
  Synthetic
aggccctggctgctgatatgtgggaaaaaccgtccgacctgaggaacctggctacctggagatacttccagtctgtccaaaaacaggtcaacatgtcctatgatctcattatttgtgatggaccttttgggacagcggtg

SEQ ID NO: 442558 - DNA, 140 bp, Artificial Sequence
  Synthetic
caccgctgtcccaaaaggtccatcacaaataatgagatcataggacatgttgacctgtttttggacagactggaagtatctccaggtagccaggttcctcaggtcggacggtttttcccacatatcagcagccagggcct

SEQ ID NO: 442559 - DNA, 140 bp, Artificial Sequence
  Synthetic
aggccctggctgctgatatggatagtgaagactaccagactagtcggcagcatagaggacttatcaggagaggtagaaagacaccttcatgggtacaacaggtggatcaccctcgaggatgaccttttgggacagcggtg

SEQ ID NO: 442560 - DNA, 140 bp, Artificial Sequence
  Synthetic
caccgctgtcccaaaaggtcatcctcgagggtgatccacctgttgtacccatgaaggtgtctttctacctctcctgataagtcctctatgctgccgactagtctggtagtcttcactatccatatcagcagccagggcct

SEQ ID NO: 442561 - DNA, 140 bp, Artificial Sequence
  Synthetic
aggccctggctgctgatatgcgggactatgctagtaaacccagactataaggctattcaacacctgtcaagagcgttcccctcagtcacagggtttataacccaagtgacttcgtccttcgaccttttgggacagcggtg

SEQ ID NO: 442562 - DNA, 140 bp, Artificial Sequence
  Synthetic
caccgctgtcccaaaaggtcgaaggacgaagtcacttgggttataaaccctgtgactgaggggaacgctcttgacaggtgttgaatagccttatagtctgggtttactagcatagtcccgcatatcagcagccagggcct

SEQ ID NO: 442563 - DNA, 140 bp, Artificial Sequence
  Synthetic
aggccctggctgctgatatgtcaactgtagcagccctaaaagtgagatgcaaagggctcgttccttgaactatcaagatcttgtaaggggatttcctgaagaaatcatatcgaatccttagaccttttgggacagcggtg

SEQ ID NO: 442564 - DNA, 140 bp, Artificial Sequence
  Synthetic
caccgctgtcccaaaaggtctaaggattcgatatgatttcttcaggaaatccccttacaagatcttgatagttcaaggaacgagccctttgcatctcacttttagggctgctacagttgacatatcagcagccagggcct

SEQ ID NO: 442565 - DNA, 140 bp, Artificial Sequence
  Synthetic
atacgccatgctgggtctcctggatgaaaggggcttgtacaagtctctaaaaggagcctgtaaactcaagctgtgcggagttctcggacttagacttatggacggaacctgggtttcaatcgtacttgggagtcggccat

SEQ ID NO: 442566 - DNA, 140 bp, Artificial Sequence
  Synthetic
atggccgactcccaagtacgattgaaacccaggttccgtccataagtctaagtccgagaactccgcacagcttgagtttacaggctccttttagagacttgtacaagcccctttcatccaggagacccagcatggcgtat

SEQ ID NO: 442567 - DNA, 140 bp, Artificial Sequence
  Synthetic
atacgccatgctgggtctcctcaaacatcagacgacaccaaatggtgccctccggatcaactggtgaatctacatgactttcactcagacgaaatagagcatcttgtcgtagaggagttgcgtacttgggagtcggccat

SEQ ID NO: 442568 - DNA, 140 bp, Artificial Sequence
  Synthetic
atggccgactcccaagtacgcaactcctctacgacaagatgctctatttcgtctgagtgaaagtcatgtagattcaccagttgatccggagggcaccatttggtgtcgtctgatgtttgaggagacccagcatggcgtat

SEQ ID NO: 442569 - DNA, 140 bp, Artificial Sequence
  Synthetic
aggccctggctgctgatatggtggctatcattataaccatcatgatagttttctccaatagagtcttcaacgtttccaaacctttaattgaccccttgttctatccaccatctgatcctagaccttttgggacagcggtg

SEQ ID NO: 442570 - DNA, 140 bp, Artificial Sequence
  Synthetic
caccgctgtcccaaaaggtctaggatcagatggtggatagaacaaggggtcaattaaaggtttggaaacgttgaagactctattggagaaaactatcatgatggttataatgatagccaccatatcagcagccagggcct

SEQ ID NO: 442571 - DNA, 140 bp, Artificial Sequence
  Synthetic
aggccctggctgctgatatgtagacctataacctattacttcaggaagcaagtcattcgagggaatatttacctatcttggagttggtccgacgacaccttggtgttcaagcgggtagccgaccttttgggacagcggtg

SEQ ID NO: 442572 - DNA, 140 bp, Artificial Sequence
  Synthetic
caccgctgtcccaaaaggtcggctacccgcttgaacaccaaggtgtcgtcggaccaactccaagataggtaaatattccctcgaatgacttgcttcctgaagtaataggttataggtctacatatcagcagccagggcct

SEQ ID NO: 442573 - DNA, 140 bp, Artificial Sequence
  Synthetic
atacgccatgctgggtctccgtgtttgaaagtcagagagaggtgtcatcctcctgtggatggagtgttcttcaatggcataattttgggtccggacgggaacgtcctgatacctgagatgcgtacttgggagtcggccat

SEQ ID NO: 442574 - DNA, 140 bp, Artificial Sequence
  Synthetic
atggccgactcccaagtacgcatctcaggtatcaggacgttcccgtccggacccaaaattatgccattgaagaacactccatccacaggaggatgacacctctctctgactttcaaacacggagacccagcatggcgtat

SEQ ID NO: 442575 - DNA, 140 bp, Artificial Sequence
  Synthetic
aggccctggctgctgatatgtctcaaaccaggaacacaagaaccaagatactagctcaaggagataaccaggttctgtgtccgacatatatgttgtcgccgggactgtctcgagaggggcgaccttttgggacagcggtg

SEQ ID NO: 442576 - DNA, 140 bp, Artificial Sequence
  Synthetic
caccgctgtcccaaaaggtcgcccctctcgagacagtcccggcgacaacatatatgtcggacacagaacctggttatctccttgagctagtatcttggttcttgtgttcctggtttgagacatatcagcagccagggcct

SEQ ID NO: 442577 - DNA, 140 bp, Artificial Sequence
  Synthetic
aggccctggctgctgatatgaggtagaaaaacaccttcacgggtacaacaggtggatcacccttgaagatatcagatctagatcatccctactagactacagttgcttataaacttgatagaccttttgggacagcggtg

SEQ ID NO: 442578 - DNA, 140 bp, Artificial Sequence
  Synthetic
caccgctgtcccaaaaggtctatcaagtttataagcaactgtagtctagtagggatgatctagatctgatatcttcaagggtgatccacctgttgtacccgtgaaggtgtttttctacctcatatcagcagccagggcct

SEQ ID NO: 442579 - DNA, 140 bp, Artificial Sequence
  Synthetic
atacgccatgctgggtctccatgaagcggaggacttcgttgaagttcacctcccagatgttcacaaacagatctcaggggttgaccttggtctcccgagttgggggaaatatctcctgatcgtacttgggagtcggccat

SEQ ID NO: 442580 - DNA, 140 bp, Artificial Sequence
  Synthetic
atggccgactcccaagtacgatcaggagatatttcccccaactcgggagaccaaggtcaacccctgagatctgtttgtgaacatctgggaggtgaacttcaacgaagtcctccgcttcatggagacccagcatggcgtat

SEQ ID NO: 442581 - DNA, 140 bp, Artificial Sequence
  Synthetic
aggccctggctgctgatatgttccaggaggcctgtacacgatgaggctcttggacgatgtatcttgaaaaaaacaggatcttgaatccaagcctctggttgtttgattgttttttttgtcgaccttttgggacagcggtg

SEQ ID NO: 442582 - DNA, 140 bp, Artificial Sequence
  Synthetic
caccgctgtcccaaaaggtcgacaaaaaaaacaatcaaacaaccagaggcttggattcaagatcctgtttttttcaagatacatcgtccaagagcctcatcgtgtacaggcctcctggaacatatcagcagccagggcct

SEQ ID NO: 442583 - DNA, 140 bp, Artificial Sequence
  Synthetic
aggccctggctgctgatatgacgcttaacaacaaaatcagagaagaagcagacagcgtcatttgcaaagcaaaaatgtaacacccctacaatggatgccgacaagattgtattcaaagtcgaccttttgggacagcggtg

SEQ ID NO: 442584 - DNA, 140 bp, Artificial Sequence
  Synthetic
caccgctgtcccaaaaggtcgactttgaatacaatcttgtcggcatccattgtaggggtgttacatttttgctttgcaaatgacgctgtctgcttcttctctgattttgttgttaagcgtcatatcagcagccagggcct

SEQ ID NO: 442585 - DNA, 140 bp, Artificial Sequence
  Synthetic
atacgccatgctgggtctcctcaggaaagaaggtaaatgcaaccccccagactaggaaagttgtatcttcatgggagttgtacaagagggaaggcgatgccaggctgtgagggcgggccacgtacttgggagtcggccat

SEQ ID NO: 442586 - DNA, 140 bp, Artificial Sequence
  Synthetic
atggccgactcccaagtacgtggcccgccctcacagcctggcatcgccttccctcttgtacaactcccatgaagatacaactttcctagtctggggggttgcatttaccttctttcctgaggagacccagcatggcgtat

SEQ ID NO: 442587 - DNA, 140 bp, Artificial Sequence
  Synthetic
aggccctggctgctgatatgaatgctgccaagctcgatcctgacgatgtatgttcctatttggcagctgcgatgcaactctttgaagggacatgtcctgaagactggaccagctatggaagaccttttgggacagcggtg

SEQ ID NO: 442588 - DNA, 140 bp, Artificial Sequence
  Synthetic
caccgctgtcccaaaaggtcttccatagctggtccagtcttcaggacatgtcccttcaaagagttgcatcgcagctgccaaataggaacatacatcgtcaggatcgagcttggcagcattcatatcagcagccagggcct

SEQ ID NO: 442589 - DNA, 140 bp, Artificial Sequence
  Synthetic
aggccctggctgctgatatgactgacgagagaccccacggtttctgaacatgcatccttagtcggtctgctcttgagtctgtataggttgagcaaaatatcaggacaaaacacaggcaacgaccttttgggacagcggtg

SEQ ID NO: 442590 - DNA, 140 bp, Artificial Sequence
  Synthetic
caccgctgtcccaaaaggtcgttgcctgtgttttgtcctgatattttgctcaacctatacagactcaagagcagaccgactaaggatgcatgttcagaaaccgtggggtctctcgtcagtcatatcagcagccagggcct

SEQ ID NO: 442591 - DNA, 140 bp, Artificial Sequence
  Synthetic
aggccctggctgctgatatgtcagccaacccggcccctgtctcagagcttgacattagggccctctctaagaggtttcaaaaccccttgatctcgggcctgagagtggttcagtgggcaagaccttttgggacagcggtg

SEQ ID NO: 442592 - DNA, 140 bp, Artificial Sequence
  Synthetic
caccgctgtcccaaaaggtcttgcccactgaaccactctcaggcccgagatcaaggggttttgaaacctcttagagagggccctaatgtcaagctctgagacaggggccgggttggctgacatatcagcagccagggcct

SEQ ID NO: 442593 - DNA, 140 bp, Artificial Sequence
  Synthetic
atacgccatgctgggtctccaaaactgtgaaatgtagggacaatcagcaacacttctcatcctaagaactgcaccatgatgattgatccgggagaggtctttgacgaccccattgatccgcgtacttgggagtcggccat

SEQ ID NO: 442594 - DNA, 140 bp, Artificial Sequence
  Synthetic
atggccgactcccaagtacgcggatcaatggggtcgtcaaagacctctcccggatcaatcatcatggtgcagttcttaggatgagaagtgttgctgattgtccctacatttcacagttttggagacccagcatggcgtat

SEQ ID NO: 442595 - DNA, 140 bp, Artificial Sequence
  Synthetic
aggccctggctgctgatatggcgctaattggagtaccataccgaacttccgattcttggccggaacatacgacatgtatttctcccggattgagcatctatattcagcgatcagagtggggaccttttgggacagcggtg

SEQ ID NO: 442596 - DNA, 140 bp, Artificial Sequence
  Synthetic
caccgctgtcccaaaaggtccccactctgatcgctgaatatagatgctcaatccgggagaaatacatgtcgtatgttccggccaagaatcggaagttcggtatggtactccaattagcgccatatcagcagccagggcct

SEQ ID NO: 442597 - DNA, 140 bp, Artificial Sequence
  Synthetic
aggccctggctgctgatatgatttaggggaggagtttttcgggaagggaacgttcgaaaggagattcttcagagacgaaaaagaacttcaagaatatgagacggcagaattgacaaagacgaccttttgggacagcggtg

SEQ ID NO: 442598 - DNA, 140 bp, Artificial Sequence
  Synthetic
caccgctgtcccaaaaggtcgtctttgtcaattctgccgtctcatattcttgaagttctttttcgtctctgaagaatctcctttcgaacgttcccttcccgaaaaactcctcccctaaatcatatcagcagccagggcct

SEQ ID NO: 442599 - DNA, 140 bp, Artificial Sequence
  Synthetic
aggccctggctgctgatatgatgaggccgaggatttcgttgaagttcacctacccgatgtgcacaaacaggtctcgggggttgacctgggtctcccaaactgggggaagtatgtatcactgaccttttgggacagcggtg

SEQ ID NO: 442600 - DNA, 140 bp, Artificial Sequence
  Synthetic
caccgctgtcccaaaaggtcagtgatacatacttcccccagtttgggagacccaggtcaacccccgagacctgtttgtgcacatcgggtaggtgaacttcaacgaaatcctcggcctcatcatatcagcagccagggcct

SEQ ID NO: 442601 - DNA, 140 bp, Artificial Sequence
  Synthetic
aggccctggctgctgatatgtgatctccctttggctgtacggtgcatattctgaatcgaacagaagccgaaagtgtataacagacttggcccagttctactccaagtcttcccccatagagaccttttgggacagcggtg

SEQ ID NO: 442602 - DNA, 140 bp, Artificial Sequence
  Synthetic
caccgctgtcccaaaaggtctctatgggggaagacttggagtagaactgggccaagtctgttatacactttcggcttctgttcgattcagaatatgcaccgtacagccaaagggagatcacatatcagcagccagggcct

SEQ ID NO: 442603 - DNA, 140 bp, Artificial Sequence
  Synthetic
aggccctggctgctgatatggacggtcattgctgcatgtgctcctcatgagatgtctgtcctagggggttatctgggggaagagttttttggaaagggcacatttgaaagaagattctttgaccttttgggacagcggtg

SEQ ID NO: 442604 - DNA, 140 bp, Artificial Sequence
  Synthetic
caccgctgtcccaaaaggtcaaagaatcttctttcaaatgtgccctttccaaaaaactcttcccccagataaccccctaggacagacatctcatgaggagcacatgcagcaatgaccgtccatatcagcagccagggcct

SEQ ID NO: 442605 - DNA, 140 bp, Artificial Sequence
  Synthetic
atacgccatgctgggtctcctccaccaatgcactaacagtggctcaacactctcaatcattgattaaaccaatgagggatttcctgctcatgtcagtgcaggcagttttccactacctgtcgtacttgggagtcggccat

SEQ ID NO: 442606 - DNA, 140 bp, Artificial Sequence
  Synthetic
atggccgactcccaagtacgacaggtagtggaaaactgcctgcactgacatgagcaggaaatccctcattggtttaatcaatgattgagagtgttgagccactgttagtgcattggtggaggagacccagcatggcgtat

SEQ ID NO: 442607 - DNA, 140 bp, Artificial Sequence
  Synthetic
aggccctggctgctgatatgggtcctcctgctctagaatggtccactgctaatgaggaggatgatccatccgtggaggctgaaattgctcaccagattgccgagagcttttctaagaaatgaccttttgggacagcggtg

SEQ ID NO: 442608 - DNA, 140 bp, Artificial Sequence
  Synthetic
caccgctgtcccaaaaggtcatttcttagaaaagctctcggcaatctggtgagcaatttcagcctccacggatggatcatcctcctcattagcagtggaccattctagagcaggaggacccatatcagcagccagggcct

SEQ ID NO: 442609 - DNA, 140 bp, Artificial Sequence
  Synthetic
aggccctggctgctgatatgacttttctggtgagaccaggagtcctgaagctgtttatactcggatcatgatgaacggagggcgactaaagagatctcacataaggagatatgtttcagtgaccttttgggacagcggtg

SEQ ID NO: 442610 - DNA, 140 bp, Artificial Sequence
  Synthetic
caccgctgtcccaaaaggtcactgaaacatatctccttatgtgagatctctttagtcgccctccgttcatcatgatccgagtataaacagcttcaggactcctggtctcaccagaaaagtcatatcagcagccagggcct

SEQ ID NO: 442611 - DNA, 140 bp, Artificial Sequence
  Synthetic
aggccctggctgctgatatgagacaacttgtgtacatccttcatgaaaaaaactaacacctctccttgcgaaccatccctaatatgagcaagatctttgtcaatccgagtgcaatcagaggaccttttgggacagcggtg

SEQ ID NO: 442612 - DNA, 140 bp, Artificial Sequence
  Synthetic
caccgctgtcccaaaaggtcctctgattgcactcggattgacaaagatcttgctcatattagggatggttcgcaaggagaggtgttagtttttttcatgaaggatgtacacaagttgtctcatatcagcagccagggcct

SEQ ID NO: 442613 - DNA, 140 bp, Artificial Sequence
  Synthetic
atacgccatgctgggtctccaaccatccctaatatgagcaagatctttgtcaatccgagtgcaatcagagccggtctggccgatcttgagatggcggaagagactgttgatttgatcaaccgtacttgggagtcggccat

SEQ ID NO: 442614 - DNA, 140 bp, Artificial Sequence
  Synthetic
atggccgactcccaagtacggttgatcaaatcaacagtctcttccgccatctcaagatcggccagaccggctctgattgcactcggattgacaaagatcttgctcatattagggatggttggagacccagcatggcgtat

SEQ ID NO: 442615 - DNA, 140 bp, Artificial Sequence
  Synthetic
atacgccatgctgggtctccaggttcaggcctctcattcattccttaggagatttccccgcatttataagagataaggtgggtcaacttgagggaacatttggtcctagtgcaaagaggtcgtacttgggagtcggccat

SEQ ID NO: 442616 - DNA, 140 bp, Artificial Sequence
  Synthetic
atggccgactcccaagtacgacctctttgcactaggaccaaatgttccctcaagttgacccaccttatctcttataaatgcggggaaatctcctaaggaatgaatgagaggcctgaacctggagacccagcatggcgtat

SEQ ID NO: 442617 - DNA, 140 bp, Artificial Sequence
  Synthetic
aggccctggctgctgatatgtgctctgaattcgacatgaaaaaaacaggcaacaccactgataagatgaactttctacgcaagatagtgaaaaactgtagggatgaggacacccagaagcgaccttttgggacagcggtg

SEQ ID NO: 442618 - DNA, 140 bp, Artificial Sequence
  Synthetic
caccgctgtcccaaaaggtcgcttctgggtgtcctcatccctacagtttttcactatcttgcgtagaaagttcatcttatcagtggtgttgcctgtttttttcatgtcgaattcagagcacatatcagcagccagggcct

SEQ ID NO: 442619 - DNA, 140 bp, Artificial Sequence
  Synthetic
aggccctggctgctgatatgcctggacaatgttggagtccaaatagtcagacaaatgaggtcaggagagagattcctcaaaatatggtcacagacggtggaggagattatatcttacgtcgaccttttgggacagcggtg

SEQ ID NO: 442620 - DNA, 140 bp, Artificial Sequence
  Synthetic
caccgctgtcccaaaaggtcgacgtaagatataatctcctccaccgtctgtgaccatattttgaggaatctctctcctgacctcatttgtctgactatttggactccaacattgtccaggcatatcagcagccagggcct

SEQ ID NO: 442621 - DNA, 140 bp, Artificial Sequence
  Synthetic
atacgccatgctgggtctccgattcctcaaaatatggtcacagacggtggaggagattatatcttacgtcacagtcaactttcccagcccaccaggcaagtccctggaagacaaatccaccgtacttgggagtcggccat

SEQ ID NO: 442622 - DNA, 140 bp, Artificial Sequence
  Synthetic
atggccgactcccaagtacggtggatttgtcttccagggacttgcctggtgggctgggaaagttgactgtgacgtaagatataatctcctccaccgtctgtgaccatattttgaggaatcggagacccagcatggcgtat

SEQ ID NO: 442623 - DNA, 140 bp, Artificial Sequence
  Synthetic
aggccctggctgctgatatgggtcctccagcccttgagtggtcagctaccaacgaagaagacgatctgtcagtagaggccgagatcgctcaccagattgctgaaagcttctccaagaagtgaccttttgggacagcggtg

SEQ ID NO: 442624 - DNA, 140 bp, Artificial Sequence
  Synthetic
caccgctgtcccaaaaggtcacttcttggagaagctttcagcaatctggtgagcgatctcggcctctactgacagatcgtcttcttcgttggtagctgaccactcaagggctggaggacccatatcagcagccagggcct

SEQ ID NO: 442625 - DNA, 140 bp, Artificial Sequence
  Synthetic
aggccctggctgctgatatgggtgtattaacatgaactcgagagcatgtcaattatggtctgacatgtctcttcagacacaaaggtctgaagaagacaaagattcttctctgcttctagagaccttttgggacagcggtg

SEQ ID NO: 442626 - DNA, 140 bp, Artificial Sequence
  Synthetic
caccgctgtcccaaaaggtctctagaagcagagaagaatctttgtcttcttcagacctttgtgtctgaagagacatgtcagaccataattgacatgctctcgagttcatgttaatacacccatatcagcagccagggcct

SEQ ID NO: 442627 - DNA, 140 bp, Artificial Sequence
  Synthetic
aggccctggctgctgatatgtgtgacccgtttagcccatgacgggtccaagctccctctaagatgtgtgctggggtgggttgctctagctaattccaagagattccagctgttagttgaagaccttttgggacagcggtg

SEQ ID NO: 442628 - DNA, 140 bp, Artificial Sequence
  Synthetic
caccgctgtcccaaaaggtcttcaactaacagctggaatctcttggaattagctagagcaacccaccccagcacacatcttagagggagcttggacccgtcatgggctaaacgggtcacacatatcagcagccagggcct

SEQ ID NO: 442629 - DNA, 140 bp, Artificial Sequence
  Synthetic
aggccctggctgctgatatgccggggggggcccgttcctagcgagaaggtcatcatcacggccctgtctaagccgcctgtcaatcctcgagagtttttgaaatctatcgacctcggaggggaccttttgggacagcggtg

SEQ ID NO: 442630 - DNA, 140 bp, Artificial Sequence
  Synthetic
caccgctgtcccaaaaggtcccctccgaggtcgatagatttcaaaaactctcgaggattgacaggcggcttagacagggccgtgatgatgaccttctcgctaggaacgggccccccccggcatatcagcagccagggcct

SEQ ID NO: 442631 - DNA, 140 bp, Artificial Sequence
  Synthetic
aggccctggctgctgatatgtgttttaaattctacatgaaaaaaacaggcaacaccactgataaaatgaatttcatacgcaagatagtgaaaaactgtagagatgaggacacccagaagcgaccttttgggacagcggtg

SEQ ID NO: 442632 - DNA, 140 bp, Artificial Sequence
  Synthetic
caccgctgtcccaaaaggtcgcttctgggtgtcctcatctctacagtttttcactatcttgcgtatgaaattcattttatcagtggtgttgcctgtttttttcatgtagaatttaaaacacatatcagcagccagggcct

SEQ ID NO: 442633 - DNA, 140 bp, Artificial Sequence
  Synthetic
aggccctggctgctgatatgcttttgtatcaacggagaagtgaaagtgtgcagtccgaatggttactcattcaggatcctgcggcacattctgagatcattcgacgagatatattccggagaccttttgggacagcggtg

SEQ ID NO: 442634 - DNA, 140 bp, Artificial Sequence
  Synthetic
caccgctgtcccaaaaggtctccggaatatatctcgtcgaatgatctcagaatgtgccgcaggatcctgaatgagtaaccattcggactgcacactttcacttctccgttgatacaaaagcatatcagcagccagggcct

SEQ ID NO: 442635 - DNA, 140 bp, Artificial Sequence
  Synthetic
aggccctggctgctgatatgaggagccccagtccctgagggcatgaactgggtctacaaattgaggagaactcttatcttccaatgggctgattctagaggccctcttgagggggaggaagaccttttgggacagcggtg

SEQ ID NO: 442636 - DNA, 140 bp, Artificial Sequence
  Synthetic
caccgctgtcccaaaaggtcttcctccccctcaagagggcctctagaatcagcccattggaagataagagttctcctcaatttgtagacccagttcatgccctcagggactggggctcctcatatcagcagccagggcct

SEQ ID NO: 442637 - DNA, 140 bp, Artificial Sequence
  Synthetic
aggccctggctgctgatatggccatcgaggagggggcgtccaaactggggctcattataaagaaggaagagaccatgtgtagttacgatttcctcatctatggaaagacccccttgtttcgaccttttgggacagcggtg

SEQ ID NO: 442638 - DNA, 140 bp, Artificial Sequence
  Synthetic
caccgctgtcccaaaaggtcgaaacaagggggtctttccatagatgaggaaatcgtaactacacatggtctcttccttctttataatgagccccagtttggacgccccctcctcgatggccatatcagcagccagggcct

SEQ ID NO: 442639 - DNA, 140 bp, Artificial Sequence
  Synthetic
atacgccatgctgggtctccatctccaatgaccagatagtcaaccttgccaatataatgtcaacagtatctaccaatgccttgactgtggcacaacactctcaatctttaatcaagccgacgtacttgggagtcggccat

SEQ ID NO: 442640 - DNA, 140 bp, Artificial Sequence
  Synthetic
atggccgactcccaagtacgtcggcttgattaaagattgagagtgttgtgccacagtcaaggcattggtagatactgttgacattatattggcaaggttgactatctggtcattggagatggagacccagcatggcgtat

SEQ ID NO: 442641 - DNA, 140 bp, Artificial Sequence
  Synthetic
aggccctggctgctgatatggtttctggggccgtgcctcactttcagaagcttcctgacatccgtctcagaccaggtgattttgaatctctaaatggtagagagaagtctcgccatatcggaccttttgggacagcggtg

SEQ ID NO: 442642 - DNA, 140 bp, Artificial Sequence
  Synthetic
caccgctgtcccaaaaggtccgatatggcgagacttctctctaccatttagagattcaaaatcacctggtctgagacggatgtcaggaagcttctgaaagtgaggcacggccccagaaaccatatcagcagccagggcct

SEQ ID NO: 442643 - DNA, 140 bp, Artificial Sequence
  Synthetic
aggccctggctgctgatatgtcaagagtcatgagattttcattgatcatctcagttgatcaaacaaggtcatgtagattctcataatacgggaaatcttctagcagtttcagtgaccaacgaccttttgggacagcggtg

SEQ ID NO: 442644 - DNA, 140 bp, Artificial Sequence
  Synthetic
caccgctgtcccaaaaggtcgttggtcactgaaactgctagaagatttcccgtattatgagaatctacatgaccttgtttgatcaactgagatgatcaatgaaaatctcatgactcttgacatatcagcagccagggcct

SEQ ID NO: 442645 - DNA, 140 bp, Artificial Sequence
  Synthetic
atacgccatgctgggtctcctggggggagtatctggaatgtctctcggaaggttccacatacgtcagttctctgatcctgtctcagaagggctgtccttttggagagagatctggctaagcgtacttgggagtcggccat

SEQ ID NO: 442646 - DNA, 140 bp, Artificial Sequence
  Synthetic
atggccgactcccaagtacgcttagccagatctctctccaaaaggacagcccttctgagacaggatcagagaactgacgtatgtggaaccttccgagagacattccagatactccccccaggagacccagcatggcgtat

SEQ ID NO: 442647 - DNA, 140 bp, Artificial Sequence
  Synthetic
aggccctggctgctgatatgaacttggcccctggagccctattgacatacatcatctcagctgtccaaacaatttggttgtggaggacgagggatgcaccaacctgtcaggattttcctagaccttttgggacagcggtg

SEQ ID NO: 442648 - DNA, 140 bp, Artificial Sequence
  Synthetic
caccgctgtcccaaaaggtctaggaaaatcctgacaggttggtgcatccctcgtcctccacaaccaaattgtttggacagctgagatgatgtatgtcaatagggctccaggggccaagttcatatcagcagccagggcct

SEQ ID NO: 442649 - DNA, 140 bp, Artificial Sequence
  Synthetic
atacgccatgctgggtctccctccaatgagtcatggatccatgcgctgtgtcaagaagcgggaaacccggatcttggagagagaacactggagagctttactcgtctgctcgaagatcctcgtacttgggagtcggccat

SEQ ID NO: 442650 - DNA, 140 bp, Artificial Sequence
  Synthetic
atggccgactcccaagtacgaggatcttcgagcagacgagtaaagctctccagtgttctctctccaagatccgggtttcccgcttcttgacacagcgcatggatccatgactcattggagggagacccagcatggcgtat

SEQ ID NO: 442651 - DNA, 140 bp, Artificial Sequence
  Synthetic
aggccctggctgctgatatggggggaaatctctgggttcaatagtcctccctaaactccgtgtaacagggtagattcaagagtcacgagacctccattaatcatctcagttgatcagacagaccttttgggacagcggtg

SEQ ID NO: 442652 - DNA, 140 bp, Artificial Sequence
  Synthetic
caccgctgtcccaaaaggtctgtctgatcaactgagatgattaatggaggtctcgtgactcttgaatctaccctgttacacggagtttagggaggactattgaacccagagatttccccccatatcagcagccagggcct

SEQ ID NO: 442653 - DNA, 140 bp, Artificial Sequence
  Synthetic
aggccctggctgctgatatggtgcagggccgcatacaactggaagttggccggtgaccctagatatgaagagtctttgcacaacccataccctgactatcattggctccgaacggtaaaagaccttttgggacagcggtg

SEQ ID NO: 442654 - DNA, 140 bp, Artificial Sequence
  Synthetic
caccgctgtcccaaaaggtcttttaccgttcggagccaatgatagtcagggtatgggttgtgcaaagactcttcatatctagggtcaccggccaacttccagttgtatgcggccctgcaccatatcagcagccagggcct

SEQ ID NO: 442655 - DNA, 140 bp, Artificial Sequence
  Synthetic
aggccctggctgctgatatgctcttcttgaaatctgtcgagcctttgtttccccgatttctcagtgagctcttcagttcatcattcttggggattcctgaatcaattatcgggttaatacgaccttttgggacagcggtg

SEQ ID NO: 442656 - DNA, 140 bp, Artificial Sequence
  Synthetic
caccgctgtcccaaaaggtcgtattaacccgataattgattcaggaatccccaagaatgatgaactgaagagctcactgagaaatcggggaaacaaaggctcgacagatttcaagaagagcatatcagcagccagggcct

SEQ ID NO: 442657 - DNA, 140 bp, Artificial Sequence
  Synthetic
aggccctggctgctgatatgcggggataaccgtgtcctccatctactgccctaccaaccatgattacaccatctggatgccagagaatccgagactggggacatcttgtgacatttttgtgaccttttgggacagcggtg

SEQ ID NO: 442658 - DNA, 140 bp, Artificial Sequence
  Synthetic
caccgctgtcccaaaaggtcacaaaaatgtcacaagatgtccccagtctcggattctctggcatccagatggtgtaatcatggttggtagggcagtagatggaggacacggttatccccgcatatcagcagccagggcct

SEQ ID NO: 442659 - DNA, 140 bp, Artificial Sequence
  Synthetic
atacgccatgctgggtctccgtgcctcatccctctgaaatgttggggttacttccgaaatcttcgatctcctgctcctgtggggtgactggaaggggaaatcctcgaatatctgtgtctgcgtacttgggagtcggccat

SEQ ID NO: 442660 - DNA, 140 bp, Artificial Sequence
  Synthetic
atggccgactcccaagtacgcagacacagatattcgaggatttccccttccagtcaccccacaggagcaggagatcgaagatttcggaagtaaccccaacatttcagagggatgaggcacggagacccagcatggcgtat

SEQ ID NO: 442661 - DNA, 140 bp, Artificial Sequence
  Synthetic
aggccctggctgctgatatgctatgtggggttctcggactcagacttatggatggaacatgggtcgcaatgcgaacgtcggacgagaccaaatggtgccctcctgatcaattggtgaatagaccttttgggacagcggtg

SEQ ID NO: 442662 - DNA, 140 bp, Artificial Sequence
  Synthetic
caccgctgtcccaaaaggtctattcaccaattgatcaggagggcaccatttggtctcgtccgacgttcgcattgcgacccatgttccatccataagtctgagtccgagaaccccacatagcatatcagcagccagggcct

SEQ ID NO: 442663 - DNA, 140 bp, Artificial Sequence
  Synthetic
atacgccatgctgggtctccgcgaacgtcggacgagaccaaatggtgccctcctgatcaattggtgaatatacatgactttcgctcagatgagatcgaacatcttgttgtggaggagttgcgtacttgggagtcggccat

SEQ ID NO: 442664 - DNA, 140 bp, Artificial Sequence
  Synthetic
atggccgactcccaagtacgcaactcctccacaacaagatgttcgatctcatctgagcgaaagtcatgtatattcaccaattgatcaggagggcaccatttggtctcgtccgacgttcgcggagacccagcatggcgtat

SEQ ID NO: 442665 - DNA, 140 bp, Artificial Sequence
  Synthetic
atacgccatgctgggtctccgaaagtcaccaatgttcacgtggtgaaaagagccttatctcttaaagagtctataaattggtttatcacaagaaactcaaatctggctcaaaccctagttcgtacttgggagtcggccat

SEQ ID NO: 442666 - DNA, 140 bp, Artificial Sequence
  Synthetic
atggccgactcccaagtacgaactagggtttgagccagatttgagtttcttgtgataaaccaatttatagactctttaagagataaggctcttttcaccacgtgaacattggtgactttcggagacccagcatggcgtat

SEQ ID NO: 442667 - DNA, 140 bp, Artificial Sequence
  Synthetic
aggccctggctgctgatatggcttcggaaaggcatacaccatattcaacaagaccctgatggaagctgatgctcactacaagtcagtccggacctgggatgaaatcatcccctcaaaagggaccttttgggacagcggtg

SEQ ID NO: 442668 - DNA, 140 bp, Artificial Sequence
  Synthetic
caccgctgtcccaaaaggtcccttttgaggggatgatttcatcccaggtccggactgacttgtagtgagcatcagcttccatcagggtcttgttgaatatggtgtatgcctttccgaagccatatcagcagccagggcct

SEQ ID NO: 442669 - DNA, 140 bp, Artificial Sequence
  Synthetic
atacgccatgctgggtctccccctagagactacttgagagggctcgcaagaggagtgttgataggatcctcaatttgctttttgacaagaatgacaaatatcaacatcaatagacctctccgtacttgggagtcggccat

SEQ ID NO: 442670 - DNA, 140 bp, Artificial Sequence
  Synthetic
atggccgactcccaagtacggagaggtctattgatgttgatatttgtcattcttgtcaaaaagcaaattgaggatcctatcaacactcctcttgcgagccctctcaagtagtctctagggggagacccagcatggcgtat

SEQ ID NO: 442671 - DNA, 140 bp, Artificial Sequence
  Synthetic
aggccctggctgctgatatgcaatcatccctccttcagcagcatatggagttgttggagtcctcagtgatccctctaatgcaccccttggcagacccatcagcagttttcaaggatgatggaccttttgggacagcggtg

SEQ ID NO: 442672 - DNA, 140 bp, Artificial Sequence
  Synthetic
caccgctgtcccaaaaggtccatcatccttgaaaactgctgatgggtctgccaaggggtgcattagagggatcactgaggactccaacaactccatatgctgctgaaggagggatgattgcatatcagcagccagggcct

SEQ ID NO: 442673 - DNA, 140 bp, Artificial Sequence
  Synthetic
aggccctggctgctgatatggagtgcaggtgctctgattgccctgatactgataatcttcctaatgacatgttgtagaaaaattaagcgatcagaatccacacagcatagtctcagagaagaccttttgggacagcggtg

SEQ ID NO: 442674 - DNA, 140 bp, Artificial Sequence
  Synthetic
caccgctgtcccaaaaggtcttctctgagactatgctgtgtggattctgatcgcttaatttttctacaacatgtcattaggaagattatcagtatcagggcaatcagagcacctgcactccatatcagcagccagggcct

SEQ ID NO: 442675 - DNA, 140 bp, Artificial Sequence
  Synthetic
atacgccatgctgggtctccgttgtagaaaaattaagcgatcagaatccacacagcatagtctcagagaaacagggaggaaagtgtcggtcacttcccaaaacgggaaggtaatatcttccgtacttgggagtcggccat

SEQ ID NO: 442676 - DNA, 140 bp, Artificial Sequence
  Synthetic
atggccgactcccaagtacggaagatattaccttcccgttttgggaagtgaccgacactttcctccctgtttctctgagactatgctgtgtggattctgatcgcttaatttttctacaacggagacccagcatggcgtat

SEQ ID NO: 442677 - DNA, 140 bp, Artificial Sequence
  Synthetic
aggccctggctgctgatatgttgtgtacggttgttacaggcattggggccatccctatatagattatagaaagggtctgtcaaaactatatgatcaagttcacattaagaaagtgatagagaccttttgggacagcggtg

SEQ ID NO: 442678 - DNA, 140 bp, Artificial Sequence
  Synthetic
caccgctgtcccaaaaggtctctatcactttcttaatgtgaacttgatcatatagttttgacagaccctttctataatctatatagggatggccccaatgcctgtaacaaccgtacacaacatatcagcagccagggcct

SEQ ID NO: 442679 - DNA, 140 bp, Artificial Sequence
  Synthetic
aggccctggctgctgatatggaatctttgggcttgacagtcctcccctagctctggatgacagggtagatttaagagtcacgagactttcattaatcatctctattgatcagacatggtcgaccttttgggacagcggtg

SEQ ID NO: 442680 - DNA, 140 bp, Artificial Sequence
  Synthetic
caccgctgtcccaaaaggtcgaccatgtctgatcaatagagatgattaatgaaagtctcgtgactcttaaatctaccctgtcatccagagctaggggaggactgtcaagcccaaagattccatatcagcagccagggcct

SEQ ID NO: 442681 - DNA, 140 bp, Artificial Sequence
  Synthetic
aggccctggctgctgatatgggatattttggatgaccccgtgtttggacacggaccgaggttgtagtctgtcccctgatgtcggatcagaaggggttcaattgaggaaggcgatttgcctgaccttttgggacagcggtg

SEQ ID NO: 442682 - DNA, 140 bp, Artificial Sequence
  Synthetic
caccgctgtcccaaaaggtcaggcaaatcgccttcctcaattgaaccccttctgatccgacatcaggggacagactacaacctcggtccgtgtccaaacacggggtcatccaaaatatcccatatcagcagccagggcct

SEQ ID NO: 442683 - DNA, 140 bp, Artificial Sequence
  Synthetic
atacgccatgctgggtctccgaggcaataacagcatcaccggagaatgaatggttgtggatattctcagactttagaagctctaagatgacgtatctgactcttattacttaccaatctccgtacttgggagtcggccat

SEQ ID NO: 442684 - DNA, 140 bp, Artificial Sequence
  Synthetic
atggccgactcccaagtacggagattggtaagtaataagagtcagatacgtcatcttagagcttctaaagtctgagaatatccacaaccattcattctccggtgatgctgttattgcctcggagacccagcatggcgtat

SEQ ID NO: 442685 - DNA, 140 bp, Artificial Sequence
  Synthetic
aggccctggctgctgatatgaaaactttggaccaagagagcaattggcaacacttctcatcttgagacgtccatcaagatgctcgatccaggagaggtctatgatgaccccgttgacccagaccttttgggacagcggtg

SEQ ID NO: 442686 - DNA, 140 bp, Artificial Sequence
  Synthetic
caccgctgtcccaaaaggtctgggtcaacggggtcatcatagacctctcctggatcgagcatcttgatggacgtctcaagatgagaagtgttgccaattgctctcttggtccaaagttttcatatcagcagccagggcct

SEQ ID NO: 442687 - DNA, 140 bp, Artificial Sequence
  Synthetic
atacgccatgctgggtctccagaagataccctagagtcagatgaagacattcagaggctgctaaaagactctttgcgtaggactaggtgggtagaccaggaagtacgccatgcagcgaggcgtacttgggagtcggccat

SEQ ID NO: 442688 - DNA, 140 bp, Artificial Sequence
  Synthetic
atggccgactcccaagtacgcctcgctgcatggcgtacttcctggtctacccacctagtcctacgcaaagagtcttttagcagcctctgaatgtcttcatctgactctagggtatcttctggagacccagcatggcgtat

SEQ ID NO: 442689 - DNA, 140 bp, Artificial Sequence
  Synthetic
aggccctggctgctgatatgctttgcgtaggactaggtgggtagaccaggaagtacgccatgcagcgaggaccatggcaggatgttatagccccagcaagaggatgtcacgcaaagccgggaccttttgggacagcggtg

SEQ ID NO: 442690 - DNA, 140 bp, Artificial Sequence
  Synthetic
caccgctgtcccaaaaggtcccggctttgcgtgacatcctcttgctggggctataacatcctgccatggtcctcgctgcatggcgtacttcctggtctacccacctagtcctacgcaaagcatatcagcagccagggcct

SEQ ID NO: 442691 - DNA, 140 bp, Artificial Sequence
  Synthetic
aggccctggctgctgatatgggctgatgttagattggttgaaaacagggaataggcctcaccggatgaccttgacagacaattgttctaggtcttacaaggttctgaaggattatttcaagaccttttgggacagcggtg

SEQ ID NO: 442692 - DNA, 140 bp, Artificial Sequence
  Synthetic
caccgctgtcccaaaaggtcttgaaataatccttcagaaccttgtaagacctagaacaattgtctgtcaaggtcatccggtgaggcctattccctgttttcaaccaatctaacatcagcccatatcagcagccagggcct

SEQ ID NO: 442693 - DNA, 140 bp, Artificial Sequence
  Synthetic
aggccctggctgctgatatgagatgcataactgacttgacccatttctattccaagtcctcccccatagagaagctgctaaattgtacacttgggaatagagggctgagaatccccccgggaccttttgggacagcggtg

SEQ ID NO: 442694 - DNA, 140 bp, Artificial Sequence
  Synthetic
caccgctgtcccaaaaggtcccggggggattctcagccctctattcccaagtgtacaatttagcagcttctctatgggggaggacttggaatagaaatgggtcaagtcagttatgcatctcatatcagcagccagggcct

SEQ ID NO: 442695 - DNA, 140 bp, Artificial Sequence
  Synthetic
aggccctggctgctgatatgcctgtacatgaatgctctagactgggatgaagaaaagaccatcttagcgttatggaaagatttgacctcagtggatatcggaaaggacttggtcaagttcgaccttttgggacagcggtg

SEQ ID NO: 442696 - DNA, 140 bp, Artificial Sequence
  Synthetic
caccgctgtcccaaaaggtcgaacttgaccaagtcctttccgatatccactgaggtcaaatctttccataacgctaagatggtcttttcttcatcccagtctagagcattcatgtacaggcatatcagcagccagggcct

SEQ ID NO: 442697 - DNA, 140 bp, Artificial Sequence
  Synthetic
atacgccatgctgggtctccgattttgcactgtccatagacggcccactctatctggttttcaaaacttacggcaccatgctggtaaatccagactacaaagccattcaacatctgtctacgtacttgggagtcggccat

SEQ ID NO: 442698 - DNA, 140 bp, Artificial Sequence
  Synthetic
atggccgactcccaagtacgtagacagatgttgaatggctttgtagtctggatttaccagcatggtgccgtaagttttgaaaaccagatagagtgggccgtctatggacagtgcaaaatcggagacccagcatggcgtat

SEQ ID NO: 442699 - DNA, 140 bp, Artificial Sequence
  Synthetic
aggccctggctgctgatatgaccttttcttgtctcgcttcaactctctgatgatcttgctttctccccctgaaccccggtattcagacgacttgatatctcaactgtgccagttatacatgaccttttgggacagcggtg

SEQ ID NO: 442700 - DNA, 140 bp, Artificial Sequence
  Synthetic
caccgctgtcccaaaaggtcatgtataactggcacagttgagatatcaagtcgtctgaataccggggttcagggggagaaagcaagatcatcagagagttgaagcgagacaagaaaaggtcatatcagcagccagggcct

SEQ ID NO: 442701 - DNA, 140 bp, Artificial Sequence
  Synthetic
atacgccatgctgggtctcctgcagaatatctgacttcttctgctcttagagaaatgagccttgtattgttcaactgtagcagtcccaagagcgagatgcagagagctcgctccttaaatcgtacttgggagtcggccat

SEQ ID NO: 442702 - DNA, 140 bp, Artificial Sequence
  Synthetic
atggccgactcccaagtacgatttaaggagcgagctctctgcatctcgctcttgggactgctacagttgaacaatacaaggctcatttctctaagagcagaagaagtcagatattctgcaggagacccagcatggcgtat

SEQ ID NO: 442703 - DNA, 140 bp, Artificial Sequence
  Synthetic
aggccctggctgctgatatgaaattcagacctctcattcattccctaggagacttccccgtgtttataaaagataaggtgagtcagcttgaagggacttttggtcccagtgcaaaaaggtgaccttttgggacagcggtg

SEQ ID NO: 442704 - DNA, 140 bp, Artificial Sequence
  Synthetic
caccgctgtcccaaaaggtcacctttttgcactgggaccaaaagtcccttcaagctgactcaccttatcttttataaacacggggaagtctcctagggaatgaatgagaggtctgaatttcatatcagcagccagggcct

SEQ ID NO: 442705 - DNA, 140 bp, Artificial Sequence
  Synthetic
atacgccatgctgggtctcctaccaggatcttgtaagaggttttccagaggagatcatatccaatccctataatgagatgatcataactctgattgacagtgatgtagagtcttttctggcgtacttgggagtcggccat

SEQ ID NO: 442706 - DNA, 140 bp, Artificial Sequence
  Synthetic
atggccgactcccaagtacgccagaaaagactctacatcactgtcaatcagagttatgatcatctcattatagggattggatatgatctcctctggaaaacctcttacaagatcctggtaggagacccagcatggcgtat

SEQ ID NO: 442707 - DNA, 140 bp, Artificial Sequence
  Synthetic
atacgccatgctgggtctcctccacaaaatggtagatgatctagaattacagcgaggtactttgtctaaagtttccattattatagccataatgatagtcttctccaatagagtgttcaacgtacttgggagtcggccat

SEQ ID NO: 442708 - DNA, 140 bp, Artificial Sequence
  Synthetic
atggccgactcccaagtacgttgaacactctattggagaagactatcattatggctataataatggaaactttagacaaagtacctcgctgtaattctagatcatctaccattttgtggaggagacccagcatggcgtat

SEQ ID NO: 442709 - DNA, 140 bp, Artificial Sequence
  Synthetic
aggccctggctgctgatatgtctgtcgaagctatacgatcaagtccatattaaaaaagtgatcgataagtcctaccaggagtgtttagcgagcgacctagccaggaggatcctccggtgggaccttttgggacagcggtg

SEQ ID NO: 442710 - DNA, 140 bp, Artificial Sequence
  Synthetic
caccgctgtcccaaaaggtcccaccggaggatcctcctggctaggtcgctcgctaaacactcctggtaggacttatcgatcacttttttaatatggacttgatcgtatagcttcgacagacatatcagcagccagggcct

SEQ ID NO: 442711 - DNA, 140 bp, Artificial Sequence
  Synthetic
atacgccatgctgggtctccactgctttaggggacgttcctagctttgcaagacttcatgatctatacaacagacccataacttattatttcatgaaacaagtcattcgggggaatacttcgtacttgggagtcggccat

SEQ ID NO: 442712 - DNA, 140 bp, Artificial Sequence
  Synthetic
atggccgactcccaagtacgaagtattcccccgaatgacttgtttcatgaaataataagttatgggtctgttgtatagatcatgaagtcttgcaaagctaggaacgtcccctaaagcagtggagacccagcatggcgtat

SEQ ID NO: 442713 - DNA, 140 bp, Artificial Sequence
  Synthetic
aggccctggctgctgatatgatatcgtagacttggtgggggatacgtggcataggctcccgatcacccagatctttgagatccccgaatcgatggacccgtcagaaatactggacgacaagaccttttgggacagcggtg

SEQ ID NO: 442714 - DNA, 140 bp, Artificial Sequence
  Synthetic
caccgctgtcccaaaaggtcttgtcgtccagtatttctgacgggtccatcgattcggggatctcaaagatctgggtgatcgggagcctatgccacgtatcccccaccaagtctacgatatcatatcagcagccagggcct

SEQ ID NO: 442715 - DNA, 140 bp, Artificial Sequence
  Synthetic
aggccctggctgctgatatgccgcctgtcaaccccagagagttcttaaagtctatcgacctcggaggactgcctgacgaagacttgataattggtctcaaaccaaaggaacgagaacttagaccttttgggacagcggtg

SEQ ID NO: 442716 - DNA, 140 bp, Artificial Sequence
  Synthetic
caccgctgtcccaaaaggtctaagttctcgttcctttggtttgagaccaattatcaagtcttcgtcaggcagtcctccgaggtcgatagactttaagaactctctggggttgacaggcggcatatcagcagccagggcct

SEQ ID NO: 442717 - DNA, 140 bp, Artificial Sequence
  Synthetic
aggccctggctgctgatatgttcaagggtataacaggtggattactctcgaagacatcagatctagatcatctctactggactacagctgcttataagctgaacactgctagaggtttatgaccttttgggacagcggtg

SEQ ID NO: 442718 - DNA, 140 bp, Artificial Sequence
  Synthetic
caccgctgtcccaaaaggtcataaacctctagcagtgttcagcttataagcagctgtagtccagtagagatgatctagatctgatgtcttcgagagtaatccacctgttatacccttgaacatatcagcagccagggcct

SEQ ID NO: 442719 - DNA, 140 bp, Artificial Sequence
  Synthetic
aggccctggctgctgatatgaagtaccaaggctttcggacgatgcgccttgaaaaaaacgagatcccgaatcagaacctctggttgtttgattattttttttatctttattgtttttttggaccttttgggacagcggtg

SEQ ID NO: 442720 - DNA, 140 bp, Artificial Sequence
  Synthetic
caccgctgtcccaaaaggtccaaaaaaacaataaagataaaaaaaataatcaaacaaccagaggttctgattcgggatctcgtttttttcaaggcgcatcgtccgaaagccttggtacttcatatcagcagccagggcct

SEQ ID NO: 442721 - DNA, 140 bp, Artificial Sequence
  Synthetic
aggccctggctgctgatatgtgcgctgactatgacagataacctgaacaaggtgttcaaaaagttgattgacagggtcactgggcaggggcttttggactattcgagggttacatatgctgaccttttgggacagcggtg

SEQ ID NO: 442722 - DNA, 140 bp, Artificial Sequence
  Synthetic
caccgctgtcccaaaaggtcagcatatgtaaccctcgaatagtccaaaagcccctgcccagtgaccctgtcaatcaactttttgaacaccttgttcaggttatctgtcatagtcagcgcacatatcagcagccagggcct

SEQ ID NO: 442723 - DNA, 140 bp, Artificial Sequence
  Synthetic
atacgccatgctgggtctccaaaaatgtaacacccctacaatggatgccgacaagattgtatttaaagtcaataatcaggtggtctccctgaaacccgagattattgtggatcaatatgacgtacttgggagtcggccat

SEQ ID NO: 442724 - DNA, 140 bp, Artificial Sequence
  Synthetic
atggccgactcccaagtacgtcatattgatccacaataatctcgggtttcagggagaccacctgattattgactttaaatacaatcttgtcggcatccattgtaggggtgttacatttttggagacccagcatggcgtat

SEQ ID NO: 442725 - DNA, 140 bp, Artificial Sequence
  Synthetic
atacgccatgctgggtctccaataatcaggtggtctccctgaaacccgagattattgtggatcaatatgaatacaaatatccggccatcaaagacttgaagaaacccagtatcaccctagcgtacttgggagtcggccat

SEQ ID NO: 442726 - DNA, 140 bp, Artificial Sequence
  Synthetic
atggccgactcccaagtacgctagggtgatactgggtttcttcaagtctttgatggccggatatttgtattcatattgatccacaataatctcgggtttcagggagaccacctgattattggagacccagcatggcgtat

SEQ ID NO: 442727 - DNA, 140 bp, Artificial Sequence
  Synthetic
aggccctggctgctgatatgtctcgaggacacacgagttttttcagaagtcttggatctattattcagacagatcagacctcattggtttatgggaggaccaaatatactgtctagacatgaccttttgggacagcggtg

SEQ ID NO: 442728 - DNA, 140 bp, Artificial Sequence
  Synthetic
caccgctgtcccaaaaggtcatgtctagacagtatatttggtcctcccataaaccaatgaggtctgatctgtctgaataatagatccaagacttctgaaaaaactcgtgtgtcctcgagacatatcagcagccagggcct

SEQ ID NO: 442729 - DNA, 140 bp, Artificial Sequence
  Synthetic
aggccctggctgctgatatgagattgagggtcgattttttgccttgatgtcttggaatctaagattgtactttgttatcacagagaagctcttggctaattatatcttgccactcttcgagaccttttgggacagcggtg

SEQ ID NO: 442730 - DNA, 140 bp, Artificial Sequence
  Synthetic
caccgctgtcccaaaaggtctcgaagagtggcaagatataattagccaagagcttctctgtgataacaaagtacaatcttagattccaagacatcaaggcaaaaaatcgaccctcaatctcatatcagcagccagggcct

SEQ ID NO: 442731 - DNA, 140 bp, Artificial Sequence
  Synthetic
aggccctggctgctgatatgtctcaaaccaggaacacaagaactaagatattggcccaaggagataaccaggttctatgtccgacatatatgttgtcgccaggactgtcacaggaggggcgaccttttgggacagcggtg

SEQ ID NO: 442732 - DNA, 140 bp, Artificial Sequence
  Synthetic
caccgctgtcccaaaaggtcgcccctcctgtgacagtcctggcgacaacatatatgtcggacatagaacctggttatctccttgggccaatatcttagttcttgtgttcctggtttgagacatatcagcagccagggcct

SEQ ID NO: 442733 - DNA, 140 bp, Artificial Sequence
  Synthetic
atacgccatgctgggtctccaaggtccccgctgcttacccgaccacgatgaaggagggcaacagatccattctgtgctaccttcaacacgtgttgcgctatgaacgagaggtaatcacatcgtacttgggagtcggccat

SEQ ID NO: 442734 - DNA, 140 bp, Artificial Sequence
  Synthetic
atggccgactcccaagtacgatgtgattacctctcgttcatagcgcaacacgtgttgaaggtagcacagaatggatctgttgccctccttcatcgtggtcgggtaagcagcggggaccttggagacccagcatggcgtat

SEQ ID NO: 442735 - DNA, 140 bp, Artificial Sequence
  Synthetic
aggccctggctgctgatatggaccatgtgtagttacgactttctcatttatgggaagacccctttgtttcgaggtaacatcctggtacctgaatccaaaagatgggcccgagtctcttgcgaccttttgggacagcggtg

SEQ ID NO: 442736 - DNA, 140 bp, Artificial Sequence
  Synthetic
caccgctgtcccaaaaggtcgcaagagactcgggcccatcttttggattcaggtaccaggatgttacctcgaaacaaaggggtcttcccataaatgagaaagtcgtaactacacatggtccatatcagcagccagggcct

SEQ ID NO: 442737 - DNA, 140 bp, Artificial Sequence
  Synthetic
atacgccatgctgggtctccggtttataaagcaaataaatctcaccgcgagagaagcattattgtatttcttccacaagaactttgaagaagaaataagaagaatgtttgagcctggacacgtacttgggagtcggccat

SEQ ID NO: 442738 - DNA, 140 bp, Artificial Sequence
  Synthetic
atggccgactcccaagtacgtgtccaggctcaaacattcttcttatttcttcttcaaagttcttgtggaagaaatacaataatgcttctctcgcggtgagatttatttgctttataaaccggagacccagcatggcgtat

SEQ ID NO: 442739 - DNA, 140 bp, Artificial Sequence
  Synthetic
aggccctggctgctgatatgtgagggactttctgcttatgtcagtgcaggcagtctttcactacttgttattcagcccaattttaaaaggcagagtctacaagattttgagtgctgaagggaccttttgggacagcggtg

SEQ ID NO: 442740 - DNA, 140 bp, Artificial Sequence
  Synthetic
caccgctgtcccaaaaggtcccttcagcactcaaaatcttgtagactctgccttttaaaattgggctgaataacaagtagtgaaagactgcctgcactgacataagcagaaagtccctcacatatcagcagccagggcct

SEQ ID NO: 442741 - DNA, 140 bp, Artificial Sequence
  Synthetic
aggccctggctgctgatatgacttacgggactatgctagtaaacccagactataaagcgattcaacacttgtcgagagcgttcccctcagtcacaggatttataactcaagtaacttcgtgaccttttgggacagcggtg

SEQ ID NO: 442742 - DNA, 140 bp, Artificial Sequence
  Synthetic
caccgctgtcccaaaaggtcacgaagttacttgagttataaatcctgtgactgaggggaacgctctcgacaagtgttgaatcgctttatagtctgggtttactagcatagtcccgtaagtcatatcagcagccagggcct

SEQ ID NO: 442743 - DNA, 140 bp, Artificial Sequence
  Synthetic
aggccctggctgctgatatgtcagaccctgtctctgaagggttatctttctggagagagatctggctcagttcccaagagtcttggattcatgcactgtgccaagaggctgggaacccgggaccttttgggacagcggtg

SEQ ID NO: 442744 - DNA, 140 bp, Artificial Sequence
  Synthetic
caccgctgtcccaaaaggtcccgggttcccagcctcttggcacagtgcatgaatccaagactcttgggaactgagccagatctctctccagaaagataacccttcagagacagggtctgacatatcagcagccagggcct

SEQ ID NO: 442745 - DNA, 140 bp, Artificial Sequence
  Synthetic
atacgccatgctgggtctccatttgggagaggagtttttcggaaaaggaacttttgaaaggagattcttcagggacgagaaggagcttcaggaatatgaggcagctgaattaacaagagccgtacttgggagtcggccat

SEQ ID NO: 442746 - DNA, 140 bp, Artificial Sequence
  Synthetic
atggccgactcccaagtacggctcttgttaattcagctgcctcatattcctgaagctccttctcgtccctgaagaatctcctttcaaaagttccttttccgaaaaactcctctcccaaatggagacccagcatggcgtat

SEQ ID NO: 442747 - DNA, 140 bp, Artificial Sequence
  Synthetic
aggccctggctgctgatatgtgcaatcagaaaggcgctgtatgatgaggtggacaaggtagagaattcagagttcagagaggcaatccttctgtccaaaactcacagagataacttcatagaccttttgggacagcggtg

SEQ ID NO: 442748 - DNA, 140 bp, Artificial Sequence
  Synthetic
caccgctgtcccaaaaggtctatgaagttatctctgtgagttttggacagaaggattgcctctctgaactctgaattctctaccttgtccacctcatcatacagcgcctttctgattgcacatatcagcagccagggcct

SEQ ID NO: 442749 - DNA, 140 bp, Artificial Sequence
  Synthetic
atacgccatgctgggtctccatgaatggaggtagactaaaaagatcacacataaggaggtatgtctcagtcagctctaatcatcaaactcgccctaactcgtttgctgaatttttaaacacgtacttgggagtcggccat

SEQ ID NO: 442750 - DNA, 140 bp, Artificial Sequence
  Synthetic
atggccgactcccaagtacgtgtttaaaaattcagcaaacgagttagggcgagtttgatgattagagctgactgagacatacctccttatgtgtgatctttttagtctacctccattcatggagacccagcatggcgtat

SEQ ID NO: 442751 - DNA, 140 bp, Artificial Sequence
  Synthetic
aggccctggctgctgatatgagaactcccggactataagacggcagttcagaaagagtctctcaagaactctggaagagtccttctacaactcagagatccatgggataaatcggatgacgaccttttgggacagcggtg

SEQ ID NO: 442752 - DNA, 140 bp, Artificial Sequence
  Synthetic
caccgctgtcccaaaaggtcgtcatccgatttatcccatggatctctgagttgtagaaggactcttccagagttcttgagagactctttctgaactgccgtcttatagtccgggagttctcatatcagcagccagggcct

SEQ ID NO: 442753 - DNA, 140 bp, Artificial Sequence
  Synthetic
atacgccatgctgggtctccctggaagagtccttctacaactcagagatccatgggataaatcggatgacgcagacacctcagagggtcggaagggtgtggccctgctcttcggaaagggcgtacttgggagtcggccat

SEQ ID NO: 442754 - DNA, 140 bp, Artificial Sequence
  Synthetic
atggccgactcccaagtacgccctttccgaagagcagggccacacccttccgaccctctgaggtgtctgcgtcatccgatttatcccatggatctctgagttgtagaaggactcttccagggagacccagcatggcgtat

SEQ ID NO: 442755 - DNA, 140 bp, Artificial Sequence
  Synthetic
aggccctggctgctgatatgctgcacttgcggagcgactggagggggtaacccgagagtttcggtgtctgtactcccgtcctttgatcagtcatttttttcacgaggccctctaaagggggaccttttgggacagcggtg

SEQ ID NO: 442756 - DNA, 140 bp, Artificial Sequence
  Synthetic
caccgctgtcccaaaaggtccccctttagagggcctcgtgaaaaaaatgactgatcaaaggacgggagtacagacaccgaaactctcgggttaccccctccagtcgctccgcaagtgcagcatatcagcagccagggcct

SEQ ID NO: 442757 - DNA, 140 bp, Artificial Sequence
  Synthetic
aggccctggctgctgatatgctataaactggtttatcacgaggaattccaacctggctcagactctaattaggaatatcatgtctctgacaggccctgatttccctctagaggaagctccgaccttttgggacagcggtg

SEQ ID NO: 442758 - DNA, 140 bp, Artificial Sequence
  Synthetic
caccgctgtcccaaaaggtcggagcttcctctagagggaaatcagggcctgtcagagacatgatattcctaattagagtctgagccaggttggaattcctcgtgataaaccagtttatagcatatcagcagccagggcct

SEQ ID NO: 442759 - DNA, 140 bp, Artificial Sequence
  Synthetic
aggccctggctgctgatatgtgtcttcaagaggacagggtcagccttacataggttcaagtctgccagatacagcgaaggagggtattcttctgtctgccccaacctcctctctcatatcgaccttttgggacagcggtg

SEQ ID NO: 442760 - DNA, 140 bp, Artificial Sequence
  Synthetic
caccgctgtcccaaaaggtcgatatgagagaggaggttggggcagacagaagaataccctccttcgctgtatctggcagacttgaacctatgtaaggctgaccctgtcctcttgaagacacatatcagcagccagggcct

SEQ ID NO: 442761 - DNA, 140 bp, Artificial Sequence
  Synthetic
aggccctggctgctgatatgtccgttagcacagacactatgtccgacttgacccaagacgggagaaactatgacttcatgtttcagccattgatgctttacgcgcagacatggacatcaggaccttttgggacagcggtg

SEQ ID NO: 442762 - DNA, 140 bp, Artificial Sequence
  Synthetic
caccgctgtcccaaaaggtcctgatgtccatgtctgcgcgtaaagcatcaatggctgaaacatgaagtcatagtttctcccgtcttgggtcaagtcggacatagtgtctgtgctaacggacatatcagcagccagggcct

SEQ ID NO: 442763 - DNA, 140 bp, Artificial Sequence
  Synthetic
aggccctggctgctgatatgacaaatttccttcccgatcatcagggatattcttgtataactttgagcagttgaaaatgaaccttgacgatatagtcaaggagtcgaaaaatgtgccagggaccttttgggacagcggtg

SEQ ID NO: 442764 - DNA, 140 bp, Artificial Sequence
  Synthetic
caccgctgtcccaaaaggtccctggcacatttttcgactccttgactatatcgtcaaggttcattttcaactgctcaaagttatacaagaatatccctgatgatcgggaaggaaatttgtcatatcagcagccagggcct

SEQ ID NO: 442765 - DNA, 140 bp, Artificial Sequence
  Synthetic
atacgccatgctgggtctcccattagatcccgatcatctctgttagattatagctgcttgtaagactaagcactctcgagggaatgtacagactaagattatgggacggtgtaacctgaacgtacttgggagtcggccat

SEQ ID NO: 442766 - DNA, 140 bp, Artificial Sequence
  Synthetic
atggccgactcccaagtacgttcaggttacaccgtcccataatcttagtctgtacattccctcgagagtgcttagtcttacaagcagctataatctaacagagatgatcgggatctaatgggagacccagcatggcgtat

SEQ ID NO: 442767 - DNA, 140 bp, Artificial Sequence
  Synthetic
aggccctggctgctgatatgttctcaaatcttcgaatttccagatgtgtcaaaaaggatatccagaatggtttccggagctgtgcctcactttcaaaaacttcctgatatccgtcttaaagaccttttgggacagcggtg

SEQ ID NO: 442768 - DNA, 140 bp, Artificial Sequence
  Synthetic
caccgctgtcccaaaaggtctttaagacggatatcaggaagtttttgaaagtgaggcacagctccggaaaccattctggatatcctttttgacacatctggaaattcgaagatttgagaacatatcagcagccagggcct

SEQ ID NO: 442769 - DNA, 140 bp, Artificial Sequence
  Synthetic
atacgccatgctgggtctcccccgacaagctaaacaaaataatgcaagatgacctgaaccgttacacatctctctaatcacaccctcaggctctgccacactatgcagtcagatctgatccgtacttgggagtcggccat

SEQ ID NO: 442770 - DNA, 140 bp, Artificial Sequence
  Synthetic
atggccgactcccaagtacggatcagatctgactgcatagtgtggcagagcctgagggtgtgattagagagatgtgtaacggttcaggtcatcttgcattattttgtttagcttgtcgggggagacccagcatggcgtat

SEQ ID NO: 442771 - DNA, 140 bp, Artificial Sequence
  Synthetic
atacgccatgctgggtctcctctgtacttgatcgagtgttcggattgaggagggtgttctccagaactcatgagttttttcagaagtcctggatctattattcagatagatctgatcttacgtacttgggagtcggccat

SEQ ID NO: 442772 - DNA, 140 bp, Artificial Sequence
  Synthetic
atggccgactcccaagtacgtaagatcagatctatctgaataatagatccaggacttctgaaaaaactcatgagttctggagaacaccctcctcaatccgaacactcgatcaagtacagaggagacccagcatggcgtat

SEQ ID NO: 442773 - DNA, 140 bp, Artificial Sequence
  Synthetic
aggccctggctgctgatatggatacaatgatggaacaatattccctgttaacatatacggcaaggtctcccctagggactacttgagggggctcgcaagaggagtcttgatagggtcttcgaccttttgggacagcggtg

SEQ ID NO: 442774 - DNA, 140 bp, Artificial Sequence
  Synthetic
caccgctgtcccaaaaggtcgaagaccctatcaagactcctcttgcgagccccctcaagtagtccctaggggagaccttgccgtatatgttaacagggaatattgttccatcattgtatccatatcagcagccagggcct

SEQ ID NO: 442775 - DNA, 140 bp, Artificial Sequence
  Synthetic
atacgccatgctgggtctcccctcccttatatcagcccctccagatgacgatgatctatggttaccccctccggaatatgttccattgaaggagctcgcaggcaagaagaacatgagaaacgtacttgggagtcggccat

SEQ ID NO: 442776 - DNA, 140 bp, Artificial Sequence
  Synthetic
atggccgactcccaagtacgtttctcatgttcttcttgcctgcgagctccttcaatggaacatattccggagggggtaaccatagatcatcgtcatctggaggggctgatataagggaggggagacccagcatggcgtat

SEQ ID NO: 442777 - DNA, 140 bp, Artificial Sequence
  Synthetic
aggccctggctgctgatatgccctctttgtatataatgctaagagaaccgtctcttaggggggagatcttctctatcccccagaaaatcccagctgcttatccgactacaatgaaagaaggaccttttgggacagcggtg

SEQ ID NO: 442778 - DNA, 140 bp, Artificial Sequence
  Synthetic
caccgctgtcccaaaaggtccttctttcattgtagtcggataagcagctgggattttctgggggatagagaagatctcccccctaagagacggttctcttagcattatatacaaagagggcatatcagcagccagggcct

SEQ ID NO: 442779 - DNA, 140 bp, Artificial Sequence
  Synthetic
atacgccatgctgggtctccaatcaaagaatgatcgggttggtcaaagttgttgttggattggcgttatcaggggctccagttcctgagggaatgaactgggtatacaaattgagaagaacgtacttgggagtcggccat

SEQ ID NO: 442780 - DNA, 140 bp, Artificial Sequence
  Synthetic
atggccgactcccaagtacgttcttctcaatttgtatacccagttcattccctcaggaactggagcccctgataacgccaatccaacaacaactttgaccaacccgatcattctttgattggagacccagcatggcgtat

SEQ ID NO: 442781 - DNA, 140 bp, Artificial Sequence
  Synthetic
aggccctggctgctgatatgctttagaagtgccaaaatgacgtacttgaccctcatcacctaccagtctcatctcctacttcaaagggttgagaggaacttgtctaaaagtatgagagccgaccttttgggacagcggtg

SEQ ID NO: 442782 - DNA, 140 bp, Artificial Sequence
  Synthetic
caccgctgtcccaaaaggtcggctctcatacttttagacaagttcctctcaaccctttgaagtaggagatgagactggtaggtgatgagggtcaagtacgtcattttggcacttctaaagcatatcagcagccagggcct

SEQ ID NO: 442783 - DNA, 140 bp, Artificial Sequence
  Synthetic
atacgccatgctgggtctcctctgggagaggaattcttcgggaaagggacatttgaaagaagattcttcagagatgagaaagaacttcaagaatacgaggcggctgaactgacaaagactcgtacttgggagtcggccat

SEQ ID NO: 442784 - DNA, 140 bp, Artificial Sequence
  Synthetic
atggccgactcccaagtacgagtctttgtcagttcagccgcctcgtattcttgaagttctttctcatctctgaagaatcttctttcaaatgtccctttcccgaagaattcctctcccagaggagacccagcatggcgtat

SEQ ID NO: 442785 - DNA, 140 bp, Artificial Sequence
  Synthetic
aggccctggctgctgatatgccctacgaagaacaaggtgggttgatcaagaagtgcgccatgcagctagaaccatgacgggagattatagccctaacaggaggatgtcacgtaaggcggggaccttttgggacagcggtg

SEQ ID NO: 442786 - DNA, 140 bp, Artificial Sequence
  Synthetic
caccgctgtcccaaaaggtccccgccttacgtgacatcctcctgttagggctataatctcccgtcatggttctagctgcatggcgcacttcttgatcaacccaccttgttcttcgtagggcatatcagcagccagggcct

SEQ ID NO: 442787 - DNA, 140 bp, Artificial Sequence
  Synthetic
atacgccatgctgggtctcctgaatggaggtcgactaaagagatctcacatacggagatatgtctcagtcagttccaatcatcaagcccgtccaaactcattcgccgagtttctaaacaacgtacttgggagtcggccat

SEQ ID NO: 442788 - DNA, 140 bp, Artificial Sequence
  Synthetic
atggccgactcccaagtacgttgtttagaaactcggcgaatgagtttggacgggcttgatgattggaactgactgagacatatctccgtatgtgagatctctttagtcgacctccattcaggagacccagcatggcgtat

SEQ ID NO: 442789 - DNA, 140 bp, Artificial Sequence
  Synthetic
aggccctggctgctgatatgtttcaaaacccgttgatctcgggcttgagagtggttcaatgggcgactggggcccattataagcttaagcctattctagatgatctcaatgtcttcccatgaccttttgggacagcggtg

SEQ ID NO: 442790 - DNA, 140 bp, Artificial Sequence
  Synthetic
caccgctgtcccaaaaggtcatgggaagacattgagatcatctagaataggcttaagcttataatgggccccagtcgcccattgaaccactctcaagcccgagatcaacgggttttgaaacatatcagcagccagggcct

SEQ ID NO: 442791 - DNA, 140 bp, Artificial Sequence
  Synthetic
atacgccatgctgggtctccaatctcttcgttgtgtctcgggaagttccccatctacacgataccagacaagctcggtccctggagccctatcgacatacatcacctcagctgtccaaatcgtacttgggagtcggccat

SEQ ID NO: 442792 - DNA, 140 bp, Artificial Sequence
  Synthetic
atggccgactcccaagtacgatttggacagctgaggtgatgtatgtcgatagggctccagggaccgagcttgtctggtatcgtgtagatggggaacttcccgagacacaacgaagagattggagacccagcatggcgtat

SEQ ID NO: 442793 - DNA, 140 bp, Artificial Sequence
  Synthetic
aggccctggctgctgatatgagctcggtccctggagccctatcgacatacatcacctcagctgtccaaataatttagttgtggaggacgaggggtgcaccagcctatcagggttctcttagaccttttgggacagcggtg

SEQ ID NO: 442794 - DNA, 140 bp, Artificial Sequence
  Synthetic
caccgctgtcccaaaaggtctaagagaaccctgataggctggtgcacccctcgtcctccacaactaaattatttggacagctgaggtgatgtatgtcgatagggctccagggaccgagctcatatcagcagccagggcct

SEQ ID NO: 442795 - DNA, 140 bp, Artificial Sequence
  Synthetic
aggccctggctgctgatatggaatgacctgatggcttccggtacgcatccgctaccaccttctgcaatcatgagcggaggagatgacatcgtctcccgagtaatagacattgactcaatcgaccttttgggacagcggtg

SEQ ID NO: 442796 - DNA, 140 bp, Artificial Sequence
  Synthetic
caccgctgtcccaaaaggtcgattgagtcaatgtctattactcgggagacgatgtcatctcctccgctcatgattgcagaaggtggtagcggatgcgtaccggaagccatcaggtcattccatatcagcagccagggcct

SEQ ID NO: 442797 - DNA, 140 bp, Artificial Sequence
  Synthetic
aggccctggctgctgatatgaatcaagtcatgtagattctcataacgcgggagatcttctagcagtttcagtgcccaactgtgctttcattctccaggaactaatactaagggttgtggagaccttttgggacagcggtg

SEQ ID NO: 442798 - DNA, 140 bp, Artificial Sequence
  Synthetic
caccgctgtcccaaaaggtctccacaacccttagtattagttcctggagaatgaaagcacagttgggcactgaaactgctagaagatctcccgcgttatgagaatctacatgacttgattcatatcagcagccagggcct

SEQ ID NO: 442799 - DNA, 140 bp, Artificial Sequence
  Synthetic
aggccctggctgctgatatgtatgtcaccaccacattcaagaggaaacattttcgccctataccagatgcatgcagggctgcatacaactggaagatggctggtgatcctagatatgagggaccttttgggacagcggtg

SEQ ID NO: 442800 - DNA, 140 bp, Artificial Sequence
  Synthetic
caccgctgtcccaaaaggtccctcatatctaggatcaccagccatcttccagttgtatgcagccctgcatgcatctggtatagggcgaaaatgtttcctcttgaatgtggtggtgacatacatatcagcagccagggcct

SEQ ID NO: 442801 - DNA, 140 bp, Artificial Sequence
  Synthetic
atacgccatgctgggtctccctggagtctggttagtctattaatgatagatcgtgagtctcaaaccaggaacacaagaactaagatactagctcagggggacaatcaggttctatgtccacgtacttgggagtcggccat

SEQ ID NO: 442802 - DNA, 140 bp, Artificial Sequence
  Synthetic
atggccgactcccaagtacgtggacatagaacctgattgtccccctgagctagtatcttagttcttgtgttcctggtttgagactcacgatctatcattaatagactaaccagactccagggagacccagcatggcgtat

SEQ ID NO: 442803 - DNA, 140 bp, Artificial Sequence
  Synthetic
aggccctggctgctgatatgcagaagtcaccgacattacgtctatcaaccggataactctgttgatgtccgacttcgcattgtctatagacggaccactttatctggtcttcaaaacctagaccttttgggacagcggtg

SEQ ID NO: 442804 - DNA, 140 bp, Artificial Sequence
  Synthetic
caccgctgtcccaaaaggtctaggttttgaagaccagataaagtggtccgtctatagacaatgcgaagtcggacatcaacagagttatccggttgatagacgtaatgtcggtgacttctgcatatcagcagccagggcct

SEQ ID NO: 442805 - DNA, 140 bp, Artificial Sequence
  Synthetic
aggccctggctgctgatatgttctcagatcttcgagttcccggatgtgtcaaagaggatatccagaatggtttccggagccgtgcctcactttcaaaaacttcctgatatccgtttgagagaccttttgggacagcggtg

SEQ ID NO: 442806 - DNA, 140 bp, Artificial Sequence
  Synthetic
caccgctgtcccaaaaggtctctcaaacggatatcaggaagtttttgaaagtgaggcacggctccggaaaccattctggatatcctctttgacacatccgggaactcgaagatctgagaacatatcagcagccagggcct

SEQ ID NO: 442807 - DNA, 140 bp, Artificial Sequence
  Synthetic
atacgccatgctgggtctcccccatacaacaaatctcttcattctagggtgtttcctggtgggaagtgtctgggaataacgatctcttccacctactgctcaaccaaccatgattacacccgtacttgggagtcggccat

SEQ ID NO: 442808 - DNA, 140 bp, Artificial Sequence
  Synthetic
atggccgactcccaagtacgggtgtaatcatggttggttgagcagtaggtggaagagatcgttattcccagacacttcccaccaggaaacaccctagaatgaagagatttgttgtatgggggagacccagcatggcgtat

SEQ ID NO: 442809 - DNA, 140 bp, Artificial Sequence
  Synthetic
aggccctggctgctgatatgtcatcagagatatacctccgattctctaaacggggaaaatttttccgagatgcggagtacctaacctcctccacccttcgggagatgagccttgtgttgtgaccttttgggacagcggtg

SEQ ID NO: 442810 - DNA, 140 bp, Artificial Sequence
  Synthetic
caccgctgtcccaaaaggtcacaacacaaggctcatctcccgaagggtggaggaggttaggtactccgcatctcggaaaaattttccccgtttagagaatcggaggtatatctctgatgacatatcagcagccagggcct

SEQ ID NO: 442811 - DNA, 140 bp, Artificial Sequence
  Synthetic
aggccctggctgctgatatgcaacgaaatgatcataactctaattgacagtgatgtagaatctttcctggttcataagatggtagatgatcttgagttacaaaggggagccctgtctaaagaccttttgggacagcggtg

SEQ ID NO: 442812 - DNA, 140 bp, Artificial Sequence
  Synthetic
caccgctgtcccaaaaggtctttagacagggctcccctttgtaactcaagatcatctaccatcttatgaaccaggaaagattctacatcactgtcaattagagttatgatcatttcgttgcatatcagcagccagggcct

SEQ ID NO: 442813 - DNA, 140 bp, Artificial Sequence
  Synthetic
atacgccatgctgggtctccgtcaaaaagagagaagagtgtctggacgcattggagtccatcatgactactaaatctgtaagttttagacgtctcagctatttgagaaaacttgtccctgcgtacttgggagtcggccat

SEQ ID NO: 442814 - DNA, 140 bp, Artificial Sequence
  Synthetic
atggccgactcccaagtacgcagggacaagttttctcaaatagctgagacgtctaaaacttacagatttagtagtcatgatggactccaatgcgtccagacactcttctctctttttgacggagacccagcatggcgtat

SEQ ID NO: 442815 - DNA, 140 bp, Artificial Sequence
  Synthetic
aggccctggctgctgatatgaaatattgaggcacttcaacatatgctgcagcacgatgatgtatctatctacagccttcggcgatgtccccagctttgcgagacttcatgatctatacaagaccttttgggacagcggtg

SEQ ID NO: 442816 - DNA, 140 bp, Artificial Sequence
  Synthetic
caccgctgtcccaaaaggtcttgtatagatcatgaagtctcgcaaagctggggacatcgccgaaggctgtagatagatacatcatcgtgctgcagcatatgttgaagtgcctcaatatttcatatcagcagccagggcct

SEQ ID NO: 442817 - DNA, 140 bp, Artificial Sequence
  Synthetic
aggccctggctgctgatatggaggggggcctgttccgagtgagaaggtcattatcacagctctgtccaaaccgcctgtcaaccccagagagttcttaaaatctatcgacctcggagggttgaccttttgggacagcggtg

SEQ ID NO: 442818 - DNA, 140 bp, Artificial Sequence
  Synthetic
caccgctgtcccaaaaggtcaaccctccgaggtcgatagattttaagaactctctggggttgacaggcggtttggacagagctgtgataatgaccttctcactcggaacaggcccccctccatatcagcagccagggcct

SEQ ID NO: 442819 - DNA, 140 bp, Artificial Sequence
  Synthetic
aggccctggctgctgatatgtgtaactctagcttaagcctctcatcccattggatcaggctgatttacaagattgtaaagactaccagactcatcggaagaatcgaggatctatctgggggaccttttgggacagcggtg

SEQ ID NO: 442820 - DNA, 140 bp, Artificial Sequence
  Synthetic
caccgctgtcccaaaaggtcccccagatagatcctcgattcttccgatgagtctggtagtctttacaatcttgtaaatcagcctgatccaatgggatgagaggcttaagctagagttacacatatcagcagccagggcct

SEQ ID NO: 442821 - DNA, 140 bp, Artificial Sequence
  Synthetic
aggccctggctgctgatatgccttcaaaggcctatacatgataagacccttatgaactgcaccctgaaaaaaacgagatcttaaatccgatcctctggctgtttgattgttttttccatcgaccttttgggacagcggtg

SEQ ID NO: 442822 - DNA, 140 bp, Artificial Sequence
  Synthetic
caccgctgtcccaaaaggtcgatggaaaaaacaatcaaacagccagaggatcggatttaagatctcgtttttttcagggtgcagttcataagggtcttatcatgtataggcctttgaaggcatatcagcagccagggcct

SEQ ID NO: 442823 - DNA, 140 bp, Artificial Sequence
  Synthetic
atacgccatgctgggtctcctcaggaaagagggtaccggcaaccccccagacgagaaaagtcgtatcttcatgggagttgtacaagagtgaaggcgatgccaggctgtgagggcaggccacgtacttgggagtcggccat

SEQ ID NO: 442824 - DNA, 140 bp, Artificial Sequence
  Synthetic
atggccgactcccaagtacgtggcctgccctcacagcctggcatcgccttcactcttgtacaactcccatgaagatacgacttttctcgtctggggggttgccggtaccctctttcctgaggagacccagcatggcgtat

SEQ ID NO: 442825 - DNA, 140 bp, Artificial Sequence
  Synthetic
aggccctggctgctgatatgaaaaatgtaacacccctacaatggatgccgacaagattgtattcaagatcaataatcaggtggtttctctgaagcctgaaatcatcgtggatcaatatgagaccttttgggacagcggtg

SEQ ID NO: 442826 - DNA, 140 bp, Artificial Sequence
  Synthetic
caccgctgtcccaaaaggtctcatattgatccacgatgatttcaggcttcagagaaaccacctgattattgatcttgaatacaatcttgtcggcatccattgtaggggtgttacatttttcatatcagcagccagggcct

SEQ ID NO: 442827 - DNA, 140 bp, Artificial Sequence
  Synthetic
atacgccatgctgggtctcctcaggagtcggaaaacattcattagccatctccactgatcaaaaatagtcatgtagatttttatgatgtattatgtattttgacagtgtcattgactaatcgtacttgggagtcggccat

SEQ ID NO: 442828 - DNA, 140 bp, Artificial Sequence
  Synthetic
atggccgactcccaagtacgattagtcaatgacactgtcaaaatacataatacatcataaaaatctacatgactatttttgatcagtggagatggctaatgaatgttttccgactcctgaggagacccagcatggcgtat

SEQ ID NO: 442829 - DNA, 140 bp, Artificial Sequence
  Synthetic
aggccctggctgctgatatgaatgctgccaaacttgatcctgatgatgtatgttcctacttggcagcagcgatgcagttttttgaagggacatgtccagaagactggaccagctatggaagaccttttgggacagcggtg

SEQ ID NO: 442830 - DNA, 140 bp, Artificial Sequence
  Synthetic
caccgctgtcccaaaaggtcttccatagctggtccagtcttctggacatgtcccttcaaaaaactgcatcgctgctgccaagtaggaacatacatcatcaggatcaagtttggcagcattcatatcagcagccagggcct

SEQ ID NO: 442831 - DNA, 140 bp, Artificial Sequence
  Synthetic
atacgccatgctgggtctccgatgcagttttttgaagggacatgtccagaagactggaccagctatggaatcctgatcgcacgaaaaggagacaagatcaccccagattctcttgtggaacgtacttgggagtcggccat

SEQ ID NO: 442832 - DNA, 140 bp, Artificial Sequence
  Synthetic
atggccgactcccaagtacgttccacaagagaatctggggtgatcttgtctccttttcgtgcgatcaggattccatagctggtccagtcttctggacatgtcccttcaaaaaactgcatcggagacccagcatggcgtat

SEQ ID NO: 442833 - DNA, 140 bp, Artificial Sequence
  Synthetic
atacgccatgctgggtctccagattagttgagagagacgacttacatcctatgaaggacacaagcaataggtcacaatcatcttacatcctgataaggtgtttataactacaaagggatacgtacttgggagtcggccat

SEQ ID NO: 442834 - DNA, 140 bp, Artificial Sequence
  Synthetic
atggccgactcccaagtacgtatccctttgtagttataaacaccttatcaggatgtaagatgattgtgacctattgcttgtgtccttcataggatgtaagtcgtctctctcaactaatctggagacccagcatggcgtat

SEQ ID NO: 442835 - DNA, 140 bp, Artificial Sequence
  Synthetic
atacgccatgctgggtctcctcttgagtctgtataggttgagcaaaatatcaggacaaaacaccggtaactataagacaaacattgcagataggatagagcagatttttgaaacagcccccgtacttgggagtcggccat

SEQ ID NO: 442836 - DNA, 140 bp, Artificial Sequence
  Synthetic
atggccgactcccaagtacgggggctgtttcaaaaatctgctctatcctatctgcaatgtttgtcttatagttaccggtgttttgtcctgatattttgctcaacctatacagactcaagaggagacccagcatggcgtat

SEQ ID NO: 442837 - DNA, 140 bp, Artificial Sequence
  Synthetic
atacgccatgctgggtctcctcaacaacacttctcctcccaagaactgcactatgatgattgatccgggagaggtttttgacgaccccatcgatccgatcgagtcggaggccgagtcaagcgtacttgggagtcggccat

SEQ ID NO: 442838 - DNA, 140 bp, Artificial Sequence
  Synthetic
atggccgactcccaagtacgcttgactcggcctccgactcgatcggatcgatggggtcgtcaaaaacctctcccggatcaatcatcatagtgcagttcttgggaggagaagtgttgttgaggagacccagcatggcgtat

SEQ ID NO: 442839 - DNA, 140 bp, Artificial Sequence
  Synthetic
aggccctggctgctgatatggtgctaattggagtactataccaaacttcagatttttggccggaacatacgacatgtttttctctcgaattgaacatctgtattcagcgatcagagtagggaccttttgggacagcggtg

SEQ ID NO: 442840 - DNA, 140 bp, Artificial Sequence
  Synthetic
caccgctgtcccaaaaggtccctactctgatcgctgaatacagatgttcaattcgagagaaaaacatgtcgtatgttccggccaaaaatctgaagtttggtatagtactccaattagcaccatatcagcagccagggcct

SEQ ID NO: 442841 - DNA, 140 bp, Artificial Sequence
  Synthetic
atacgccatgctgggtctccaagtgggtggaactgctgcacaatccatgatctccctttggctgtacggtgcatattctgaatcgaacagaagccgaaagtgtataacagacttggcccacgtacttgggagtcggccat

SEQ ID NO: 442842 - DNA, 140 bp, Artificial Sequence
  Synthetic
atggccgactcccaagtacgtgggccaagtctgttatacactttcggcttctgttcgattcagaatatgcaccgtacagccaaagggagatcatggattgtgcagcagttccacccacttggagacccagcatggcgtat

SEQ ID NO: 442843 - DNA, 140 bp, Artificial Sequence
  Synthetic
atacgccatgctgggtctccggagacagctgttcctcactcttatttcattcacttccgttcactaggcttgagtgggaaatctccttattcgtcaaatgccgtcggtcatgtgttcaatcgtacttgggagtcggccat

SEQ ID NO: 442844 - DNA, 140 bp, Artificial Sequence
  Synthetic
atggccgactcccaagtacgattgaacacatgaccgacggcatttgacgaataaggagatttcccactcaagcctagtgaacggaagtgaatgaaataagagtgaggaacagctgtctccggagacccagcatggcgtat

SEQ ID NO: 442845 - DNA, 140 bp, Artificial Sequence
  Synthetic
aggccctggctgctgatatgctccgatgtgacaggtgtgtaaggccaatcgatgatatcacactggagacctctcaaatctttgagtttccggatgtgtcaaaaagaatatctaggatgggaccttttgggacagcggtg

SEQ ID NO: 442846 - DNA, 140 bp, Artificial Sequence
  Synthetic
caccgctgtcccaaaaggtcccatcctagatattctttttgacacatccggaaactcaaagatttgagaggtctccagtgtgatatcatcgattggccttacacacctgtcacatcggagcatatcagcagccagggcct

SEQ ID NO: 442847 - DNA, 140 bp, Artificial Sequence
  Synthetic
aggccctggctgctgatatgcagttccaatcatcaagcccgtccaaactccttcgctgagtttttgaacaagacgtattcgagtgactcataagaagttgaacaatagggtgccggaggtgaccttttgggacagcggtg

SEQ ID NO: 442848 - DNA, 140 bp, Artificial Sequence
  Synthetic
caccgctgtcccaaaaggtcacctccggcaccctattgttcaacttcttatgagtcactcgaatacgtcttgttcaaaaactcagcgaaggagtttggacgggcttgatgattggaactgcatatcagcagccagggcct

SEQ ID NO: 442849 - DNA, 140 bp, Artificial Sequence
  Synthetic
aggccctggctgctgatatgtgcctgacgacgacctgataattggcctcaagccaaaggaaagagagctaaagattgaaggtcgattctttgcgttgatgtcttggaatttaagattgtagaccttttgggacagcggtg

SEQ ID NO: 442850 - DNA, 140 bp, Artificial Sequence
  Synthetic
caccgctgtcccaaaaggtctacaatcttaaattccaagacatcaacgcaaagaatcgaccttcaatctttagctctctttcctttggcttgaggccaattatcaggtcgtcgtcaggcacatatcagcagccagggcct

SEQ ID NO: 442851 - DNA, 140 bp, Artificial Sequence
  Synthetic
aggccctggctgctgatatgctctgcgtagaacgaggtgggtggatcaagaagtgcgccacgcagccagaactatgacgggggattacagccccaacaagaagatgtcacgcaaggcggggaccttttgggacagcggtg

SEQ ID NO: 442852 - DNA, 140 bp, Artificial Sequence
  Synthetic
caccgctgtcccaaaaggtccccgccttgcgtgacatcttcttgttggggctgtaatcccccgtcatagttctggctgcgtggcgcacttcttgatccacccacctcgttctacgcagagcatatcagcagccagggcct

SEQ ID NO: 442853 - DNA, 140 bp, Artificial Sequence
  Synthetic
aggccctggctgctgatatggatgaggctgaggactttgttgaagttcaccttcccgatgtgcacaaacaagtctctggggttgacctgggtctcccaaactgggggaaatatgtattaagaccttttgggacagcggtg

SEQ ID NO: 442854 - DNA, 140 bp, Artificial Sequence
  Synthetic
caccgctgtcccaaaaggtcttaatacatatttcccccagtttgggagacccaggtcaaccccagagacttgtttgtgcacatcgggaaggtgaacttcaacaaagtcctcagcctcatccatatcagcagccagggcct

SEQ ID NO: 442855 - DNA, 140 bp, Artificial Sequence
  Synthetic
aggccctggctgctgatatgacatgttgtggaagagtccatcgacccaagtctacacaacacggtctcggagggacagggaggaaggtgtcggtcacttcccaaagcgggaaggtcatatgaccttttgggacagcggtg

SEQ ID NO: 442856 - DNA, 140 bp, Artificial Sequence
  Synthetic
caccgctgtcccaaaaggtcatatgaccttcccgctttgggaagtgaccgacaccttcctccctgtccctccgagaccgtgttgtgtagacttgggtcgatggactcttccacaacatgtcatatcagcagccagggcct

SEQ ID NO: 442857 - DNA, 140 bp, Artificial Sequence
  Synthetic
aggccctggctgctgatatgtttcagaaccctctcatctcggggttaagggtggttcagtgggcaactggtgcccattataaactcaagcccattctggatgatctcaatgtttttccatgaccttttgggacagcggtg

SEQ ID NO: 442858 - DNA, 140 bp, Artificial Sequence
  Synthetic
caccgctgtcccaaaaggtcatggaaaaacattgagatcatccagaatgggcttgagtttataatgggcaccagttgcccactgaaccacccttaaccccgagatgagagggttctgaaacatatcagcagccagggcct

SEQ ID NO: 442859 - DNA, 140 bp, Artificial Sequence
  Synthetic
aggccctggctgctgatatgtgggagaaaccatcagatctcaggaacttgaccacatggaagtacttccagtcagtccaaaaaaaggtgaacatgtcttatgacctcatcatttgtgatggaccttttgggacagcggtg

SEQ ID NO: 442860 - DNA, 140 bp, Artificial Sequence
  Synthetic
caccgctgtcccaaaaggtccatcacaaatgatgaggtcataagacatgttcacctttttttggactgactggaagtacttccatgtggtcaagttcctgagatctgatggtttctcccacatatcagcagccagggcct

SEQ ID NO: 442861 - DNA, 140 bp, Artificial Sequence
  Synthetic
aggccctggctgctgatatggcaacagatcgatcttgtgttatctacaacatgtgctacgctatgaaagagatgtaatcacagcgtctccagaaaacgactggctgtggatcttctcagagaccttttgggacagcggtg

SEQ ID NO: 442862 - DNA, 140 bp, Artificial Sequence
  Synthetic
caccgctgtcccaaaaggtctctgagaagatccacagccagtcgttttctggagacgctgtgattacatctctttcatagcgtagcacatgttgtagataacacaagatcgatctgttgccatatcagcagccagggcct

SEQ ID NO: 442863 - DNA, 140 bp, Artificial Sequence
  Synthetic
aggccctggctgctgatatgatctttgagattcctgaatcgatggacccgtcagaaatattggatgacaaatcacattctttcaccagaacgagactagcctcttggctgtcagagaaccgaccttttgggacagcggtg

SEQ ID NO: 442864 - DNA, 140 bp, Artificial Sequence
  Synthetic
caccgctgtcccaaaaggtcggttctctgacagccaagaggctagtctcgttctggtgaaagaatgtgatttgtcatccaatatttctgacgggtccatcgattcaggaatctcaaagatcatatcagcagccagggcct

SEQ ID NO: 442865 - DNA, 140 bp, Artificial Sequence
  Synthetic
aggccctggctgctgatatggtctcaaacctaaggaaagggaactaaaaattgagggtcgattttttgctttaatgtcttggaatttgaggttgtactttgtcatcacagaaaagctcctgaccttttgggacagcggtg

SEQ ID NO: 442866 - DNA, 140 bp, Artificial Sequence
  Synthetic
caccgctgtcccaaaaggtcaggagcttttctgtgatgacaaagtacaacctcaaattccaagacattaaagcaaaaaatcgaccctcaatttttagttccctttccttaggtttgagaccatatcagcagccagggcct

SEQ ID NO: 442867 - DNA, 140 bp, Artificial Sequence
  Synthetic
aggccctggctgctgatatgtgggatgggttgccttggccagttctaagaaattccaactgttagtcgagcctgacaagctaaacaaaatcatgcaagatgatttgaatcgctatgcatcgaccttttgggacagcggtg

SEQ ID NO: 442868 - DNA, 140 bp, Artificial Sequence
  Synthetic
caccgctgtcccaaaaggtcgatgcatagcgattcaaatcatcttgcatgattttgtttagcttgtcaggctcgactaacagttggaatttcttagaactggccaaggcaacccatcccacatatcagcagccagggcct

SEQ ID NO: 442869 - DNA, 140 bp, Artificial Sequence
  Synthetic
atacgccatgctgggtctcccaatgagatgatcataaccttgattgacagtgatgtggaatccttcctggttcataagatggtggatgatctcgaattacaaagagggactctatctaaacgtacttgggagtcggccat

SEQ ID NO: 442870 - DNA, 140 bp, Artificial Sequence
  Synthetic
atggccgactcccaagtacgtttagatagagtccctctttgtaattcgagatcatccaccatcttatgaaccaggaaggattccacatcactgtcaatcaaggttatgatcatctcattgggagacccagcatggcgtat

SEQ ID NO: 442871 - DNA, 140 bp, Artificial Sequence
  Synthetic
aggccctggctgctgatatgatcaaatctagatcatctctactggactacagttgcttatgaactgaacattattggggcttgtaaatactgaagctcttagacgatataccctgaaaaagaccttttgggacagcggtg

SEQ ID NO: 442872 - DNA, 140 bp, Artificial Sequence
  Synthetic
caccgctgtcccaaaaggtctttttcagggtatatcgtctaagagcttcagtatttacaagccccaataatgttcagttcataagcaactgtagtccagtagagatgatctagatttgatcatatcagcagccagggcct

SEQ ID NO: 442873 - DNA, 140 bp, Artificial Sequence
  Synthetic
atacgccatgctgggtctccttattggggcttgtaaatactgaagctcttagacgatataccctgaaaaaaacgagatcccaaatcagaacctctggttgcttgattgtttttttcatctcgtacttgggagtcggccat

SEQ ID NO: 442874 - DNA, 140 bp, Artificial Sequence
  Synthetic
atggccgactcccaagtacgagatgaaaaaaacaatcaagcaaccagaggttctgatttgggatctcgtttttttcagggtatatcgtctaagagcttcagtatttacaagccccaataaggagacccagcatggcgtat

SEQ ID NO: 442875 - DNA, 140 bp, Artificial Sequence
  Synthetic
aggccctggctgctgatatgaacactctcaatctttaattaagccgatgagagactttttacttatgtctgttcaagctgttttccattacctgctgtttagccctatcttgaagggcaggaccttttgggacagcggtg

SEQ ID NO: 442876 - DNA, 140 bp, Artificial Sequence
  Synthetic
caccgctgtcccaaaaggtcctgcccttcaagatagggctaaacagcaggtaatggaaaacagcttgaacagacataagtaaaaagtctctcatcggcttaattaaagattgagagtgttcatatcagcagccagggcct

SEQ ID NO: 442877 - DNA, 140 bp, Artificial Sequence
  Synthetic
atacgccatgctgggtctccactcccaaagttccaattgtctttttgacagaaactacacacttatgctaaaagatcttttcttgtctcgcttcaactccttaatggtcttgctctctcccgtacttgggagtcggccat

SEQ ID NO: 442878 - DNA, 140 bp, Artificial Sequence
  Synthetic
atggccgactcccaagtacgggagagagcaagaccattaaggagttgaagcgagacaagaaaagatcttttagcataagtgtgtagtttctgtcaaaaagacaattggaactttgggagtggagacccagcatggcgtat

SEQ ID NO: 442879 - DNA, 140 bp, Artificial Sequence
  Synthetic
aggccctggctgctgatatgggacttaaagaaaaaatggtctctcaggctcttttgtttgtatctcctttgattttatcactgtgttccggggaattccccatttacacgataccagacagaccttttgggacagcggtg

SEQ ID NO: 442880 - DNA, 140 bp, Artificial Sequence
  Synthetic
caccgctgtcccaaaaggtctgtctggtatcgtgtaaatggggaattccccggaacacagtgataaaatcaaaggagatacaaacaaaagagcctgagagaccattttttctttaagtcccatatcagcagccagggcct

SEQ ID NO: 442881 - DNA, 140 bp, Artificial Sequence
  Synthetic
atacgccatgctgggtctcccgctgtgtcaggaggctggaaacccggatctaggagagagaacgctggagagctttactcgtctgctagaagatcctactactctgaatattaaaggaggcgtacttgggagtcggccat

SEQ ID NO: 442882 - DNA, 140 bp, Artificial Sequence
  Synthetic
atggccgactcccaagtacgcctcctttaatattcagagtagtaggatcttctagcagacgagtaaagctctccagcgttctctctcctagatccgggtttccagcctcctgacacagcgggagacccagcatggcgtat

SEQ ID NO: 442883 - DNA, 140 bp, Artificial Sequence
  Synthetic
aggccctggctgctgatatgagtccctgcacaatccgtaccccgactaccattggcttcgaactgtgaagaccaccaaagagtctctcgttatcatatctccaagtgttgcagatctggagaccttttgggacagcggtg

SEQ ID NO: 442884 - DNA, 140 bp, Artificial Sequence
  Synthetic
caccgctgtcccaaaaggtctccagatctgcaacacttggagatatgataacgagagactctttggtggtcttcacagttcgaagccaatggtagtcggggtacggattgtgcagggactcatatcagcagccagggcct

SEQ ID NO: 442885 - DNA, 140 bp, Artificial Sequence
  Synthetic
atacgccatgctgggtctcccagttcagaaggagtctttcaagaacattggaggagtctttttataactcagagatccacgggatcaataggatgacacagactccccaaagggtcgggacgtacttgggagtcggccat

SEQ ID NO: 442886 - DNA, 140 bp, Artificial Sequence
  Synthetic
atggccgactcccaagtacgtcccgaccctttggggagtctgtgtcatcctattgatcccgtggatctctgagttataaaaagactcctccaatgttcttgaaagactccttctgaactgggagacccagcatggcgtat

SEQ ID NO: 442887 - DNA, 140 bp, Artificial Sequence
  Synthetic
atacgccatgctgggtctcctatctatcttggagttggtccgacgacacctcagtgttcaagagggtagcctgtaattctagcctgagtctatcatctcactggatcaggctgatttacacgtacttgggagtcggccat

SEQ ID NO: 442888 - DNA, 140 bp, Artificial Sequence
  Synthetic
atggccgactcccaagtacgtgtaaatcagcctgatccagtgagatgatagactcaggctagaattacaggctaccctcttgaacactgaggtgtcgtcggaccaactccaagatagataggagacccagcatggcgtat

SEQ ID NO: 442889 - DNA, 140 bp, Artificial Sequence
  Synthetic
aggccctggctgctgatatgaaagggaggaaagtatcggtcacttcccaaagcgggaaggtcatatcttcatgggagtcatataaaagcgggggtgagaccagtctgtgaaggctggtcagaccttttgggacagcggtg

SEQ ID NO: 442890 - DNA, 140 bp, Artificial Sequence
  Synthetic
caccgctgtcccaaaaggtctgaccagccttcacagactggtctcacccccgcttttatatgactcccatgaagatatgaccttcccgctttgggaagtgaccgatactttcctccctttcatatcagcagccagggcct

SEQ ID NO: 442891 - DNA, 140 bp, Artificial Sequence
  Synthetic
atacgccatgctgggtctcctttttttcgcgaggccccctgaagggatacctaggctcatccacctccatgtctactcagctattccacgcatgggagaaagtcactaatgttcacgtggcgtacttgggagtcggccat

SEQ ID NO: 442892 - DNA, 140 bp, Artificial Sequence
  Synthetic
atggccgactcccaagtacgccacgtgaacattagtgactttctcccatgcgtggaatagctgagtagacatggaggtggatgagcctaggtatcccttcagggggcctcgcgaaaaaaaggagacccagcatggcgtat

SEQ ID NO: 442893 - DNA, 140 bp, Artificial Sequence
  Synthetic
aggccctggctgctgatatggcaaacatcagatgagaccaaatggtgcccttctgatcagttggtgaatttgcacgactttcgctcagacgagattgaacatctcgttgtggaggagttggaccttttgggacagcggtg

SEQ ID NO: 442894 - DNA, 140 bp, Artificial Sequence
  Synthetic
caccgctgtcccaaaaggtccaactcctccacaacgagatgttcaatctcgtctgagcgaaagtcgtgcaaattcaccaactgatcagaagggcaccatttggtctcatctgatgtttgccatatcagcagccagggcct

SEQ ID NO: 442895 - DNA, 140 bp, Artificial Sequence
  Synthetic
atacgccatgctgggtctcctgaaaagagctttgtctcttaaagagtctataaactggtttatcacaagaaactccaatctggctcaaaccttagtcagaaacataatatccctgacaggcgtacttgggagtcggccat

SEQ ID NO: 442896 - DNA, 140 bp, Artificial Sequence
  Synthetic
atggccgactcccaagtacgcctgtcagggatattatgtttctgactaaggtttgagccagattggagtttcttgtgataaaccagtttatagactctttaagagacaaagctcttttcaggagacccagcatggcgtat

SEQ ID NO: 442897 - DNA, 140 bp, Artificial Sequence
  Synthetic
aggccctggctgctgatatgggtttggaaaagcatataccatattcaacaaaaccttgatggaggctgatgctcattacaagtcagttcggacctggaatgagattattccctcgaaagggaccttttgggacagcggtg

SEQ ID NO: 442898 - DNA, 140 bp, Artificial Sequence
  Synthetic
caccgctgtcccaaaaggtccctttcgagggaataatctcattccaggtccgaactgacttgtaatgagcatcagcctccatcaaggttttgttgaatatggtatatgcttttccaaacccatatcagcagccagggcct

SEQ ID NO: 442899 - DNA, 140 bp, Artificial Sequence
  Synthetic
atacgccatgctgggtctcctgttttcaaaaggacagggtcagccttacataggttcaagtctgccagatacagcgaaggagggtattcttctgtttgcccgaacctcctctctcatatccgtacttgggagtcggccat

SEQ ID NO: 442900 - DNA, 140 bp, Artificial Sequence
  Synthetic
atggccgactcccaagtacggatatgagagaggaggttcgggcaaacagaagaataccctccttcgctgtatctggcagacttgaacctatgtaaggctgaccctgtccttttgaaaacaggagacccagcatggcgtat

SEQ ID NO: 442901 - DNA, 140 bp, Artificial Sequence
  Synthetic
aggccctggctgctgatatgtgcctctcatgaaggacataagcaatagctcacaatcatctcgcatctcagtcaagtgtgcataattataaagggctgggtcatctaagcttttcagtcggaccttttgggacagcggtg

SEQ ID NO: 442902 - DNA, 140 bp, Artificial Sequence
  Synthetic
caccgctgtcccaaaaggtccgactgaaaagcttagatgacccagccctttataattatgcacacttgactgagatgcgagatgattgtgagctattgcttatgtccttcatgagaggcacatatcagcagccagggcct

SEQ ID NO: 442903 - DNA, 140 bp, Artificial Sequence
  Synthetic
aggccctggctgctgatatgcaatcatccctcctccagcaacatgtggagttgttggaatcctccgttatccccctgatgcaccccttggcagacccgtctacagttttcaaggatggtggaccttttgggacagcggtg

SEQ ID NO: 442904 - DNA, 140 bp, Artificial Sequence
  Synthetic
caccgctgtcccaaaaggtccaccatccttgaaaactgtagacgggtctgccaaggggtgcatcagggggataacggaggattccaacaactccacatgttgctggaggagggatgattgcatatcagcagccagggcct

SEQ ID NO: 442905 - DNA, 140 bp, Artificial Sequence
  Synthetic
aggccctggctgctgatatggttatggtgccgttgaatcgctgcattttatcagagtcaaatctattacctttacattttaagcttctcggatgtgaaaaaaactattaacatccctccagaccttttgggacagcggtg

SEQ ID NO: 442906 - DNA, 140 bp, Artificial Sequence
  Synthetic
caccgctgtcccaaaaggtctggagggatgttaatagtttttttcacatccgagaagcttaaaatgtaaaggtaatagatttgactctgataaaatgcagcgattcaacggcaccataaccatatcagcagccagggcct

SEQ ID NO: 442907 - DNA, 140 bp, Artificial Sequence
  Synthetic
atacgccatgctgggtctccccaacccagcccctgtctcagagctcgacataagggccctatctaagagatttcaaaaccctttaatctctggactgagagtggttcagtgggcaaccggcgtacttgggagtcggccat

SEQ ID NO: 442908 - DNA, 140 bp, Artificial Sequence
  Synthetic
atggccgactcccaagtacgccggttgcccactgaaccactctcagtccagagattaaagggttttgaaatctcttagatagggcccttatgtcgagctctgagacaggggctgggttggggagacccagcatggcgtat

SEQ ID NO: 442909 - DNA, 140 bp, Artificial Sequence
  Synthetic
aggccctggctgctgatatggagtgcgggagccctgactgccttgatgttgatagctttcctaatgacatgttgcagaggagtcaatctaccaaaatctacgcaacgcagtcctggaggggaccttttgggacagcggtg

SEQ ID NO: 442910 - DNA, 140 bp, Artificial Sequence
  Synthetic
caccgctgtcccaaaaggtcccctccaggactgcgttgcgtagattttggtagattgactcctctgcaacatgtcattaggaaagctatcaacatcaaggcagtcagggctcccgcactccatatcagcagccagggcct

SEQ ID NO: 442911 - DNA, 140 bp, Artificial Sequence
  Synthetic
aggccctggctgctgatatgtcctgtcgactcctcaagtcctgaagatcacctcccactggagttggggggaatctctgggttcagtagtcctccttgaactccatgcaacagggtagatgaccttttgggacagcggtg

SEQ ID NO: 442912 - DNA, 140 bp, Artificial Sequence
  Synthetic
caccgctgtcccaaaaggtcatctaccctgttgcatggagttcaaggaggactactgaacccagagattccccccaactccagtgggaggtgatcttcaggacttgaggagtcgacaggacatatcagcagccagggcct

SEQ ID NO: 442913 - DNA, 140 bp, Artificial Sequence
  Synthetic
atacgccatgctgggtctcctacattctcttgcgactagacaatcacccatccttgtatattatgctcagagagccatctcttcgaggagagatattctctattccccaaaaagtccccgcgtacttgggagtcggccat

SEQ ID NO: 442914 - DNA, 140 bp, Artificial Sequence
  Synthetic
atggccgactcccaagtacgcggggactttttggggaatagagaatatctctcctcgaagagatggctctctgagcataatatacaaggatgggtgattgtctagtcgcaagagaatgtaggagacccagcatggcgtat

SEQ ID NO: 442915 - DNA, 140 bp, Artificial Sequence
  Synthetic
aggccctggctgctgatatgtcttaagtctgtataggttgagcaaaatatcgggacaaaacaccggcaattacaagacaaacattgcggataggatagagcagatttttgagactgccccgaccttttgggacagcggtg

SEQ ID NO: 442916 - DNA, 140 bp, Artificial Sequence
  Synthetic
caccgctgtcccaaaaggtcggggcagtctcaaaaatctgctctatcctatccgcaatgtttgtcttgtaattgccggtgttttgtcccgatattttgctcaacctatacagacttaagacatatcagcagccagggcct

SEQ ID NO: 442917 - DNA, 140 bp, Artificial Sequence
  Synthetic
aggccctggctgctgatatgggtgctttcattctccaggagctaataccaaaggttggggacagtccagggggtgtttagaatgactccgcacttgggcacagaaagaggtcatagcatagaccttttgggacagcggtg

SEQ ID NO: 442918 - DNA, 140 bp, Artificial Sequence
  Synthetic
caccgctgtcccaaaaggtctatgctatgacctctttctgtgcccaagtgcggagtcattctaaacaccccctggactgtccccaacctttggtattagctcctggagaatgaaagcacccatatcagcagccagggcct

SEQ ID NO: 442919 - DNA, 140 bp, Artificial Sequence
  Synthetic
atacgccatgctgggtctccgaatgagtggttgtggatattctcagactttaggagctctaagatgacatatctgactcttatcacttaccaatctcatcttttacttcaaagagttgagcgtacttgggagtcggccat

SEQ ID NO: 442920 - DNA, 140 bp, Artificial Sequence
  Synthetic
atggccgactcccaagtacgctcaactctttgaagtaaaagatgagattggtaagtgataagagtcagatatgtcatcttagagctcctaaagtctgagaatatccacaaccactcattcggagacccagcatggcgtat

SEQ ID NO: 442921 - DNA, 140 bp, Artificial Sequence
  Synthetic
aggccctggctgctgatatggtgtacatacctacaaagggctgggtcatctaagcttttcagtcgagaaaaaaactgtagaccgacagagcaaccagcaacacttctcatcctaagactggaccttttgggacagcggtg

SEQ ID NO: 442922 - DNA, 140 bp, Artificial Sequence
  Synthetic
caccgctgtcccaaaaggtccagtcttaggatgagaagtgttgctggttgctctgtcggtctacagtttttttctcgactgaaaagcttagatgacccagccctttgtaggtatgtacaccatatcagcagccagggcct

SEQ ID NO: 442923 - DNA, 140 bp, Artificial Sequence
  Synthetic
atacgccatgctgggtctccaggatattcagaggctgctaaaagactccttgcgtaggactaggtgggtagaccaggaagtgcgccatgccgcgaggaccatggtaggatgttatagccccgtacttgggagtcggccat

SEQ ID NO: 442924 - DNA, 140 bp, Artificial Sequence
  Synthetic
atggccgactcccaagtacggggctataacatcctaccatggtcctcgcggcatggcgcacttcctggtctacccacctagtcctacgcaaggagtcttttagcagcctctgaatatcctggagacccagcatggcgtat

SEQ ID NO: 442925 - DNA, 140 bp, Artificial Sequence
  Synthetic
aggccctggctgctgatatggaggaactctgactacaatctcaactctcctctgatagaagatccagccagactaatgttagaatggttaaaaacagggaatagaccttatcggatgactgaccttttgggacagcggtg

SEQ ID NO: 442926 - DNA, 140 bp, Artificial Sequence
  Synthetic
caccgctgtcccaaaaggtcagtcatccgataaggtctattccctgtttttaaccattctaacattagtctggctggatcttctatcagaggagagttgagattgtagtcagagttcctccatatcagcagccagggcct

SEQ ID NO: 442927 - DNA, 140 bp, Artificial Sequence
  Synthetic
aggccctggctgctgatatgtgatttctatttggttatatggtgctcactctgaatcaaaaaggagccggggatgtataactgacttggcccatttctactccaagtcatcccccatagagaccttttgggacagcggtg

SEQ ID NO: 442928 - DNA, 140 bp, Artificial Sequence
  Synthetic
caccgctgtcccaaaaggtctctatgggggatgacttggagtagaaatgggccaagtcagttatacatccccggctcctttttgattcagagtgagcaccatataaccaaatagaaatcacatatcagcagccagggcct

SEQ ID NO: 442929 - DNA, 140 bp, Artificial Sequence
  Synthetic
atacgccatgctgggtctccggatgtataactgacttggcccatttctactccaagtcatcccccatagagaagctgttaaattgtacgctaatgaatagagggttgagggtccccccagcgtacttgggagtcggccat

SEQ ID NO: 442930 - DNA, 140 bp, Artificial Sequence
  Synthetic
atggccgactcccaagtacgctggggggaccctcaaccctctattcattagcgtacaatttaacagcttctctatgggggatgacttggagtagaaatgggccaagtcagttatacatccggagacccagcatggcgtat

SEQ ID NO: 442931 - DNA, 140 bp, Artificial Sequence
  Synthetic
aggccctggctgctgatatgtggacaatctccctgacgatatgaggcggcttcagctggatgacggaaaaccatctggccttaacgagatggccgcggcaggagaaagcaagtatcgggagaccttttgggacagcggtg

SEQ ID NO: 442932 - DNA, 140 bp, Artificial Sequence
  Synthetic
caccgctgtcccaaaaggtctcccgatacttgctttctcctgccgcggccatctcgttaaggccagatggttttccgtcatccagctgaagccgcctcatatcgtcagggagattgtccacatatcagcagccagggcct

SEQ ID NO: 442933 - DNA, 140 bp, Artificial Sequence
  Synthetic
aggccctggctgctgatatgatctgttcttgtctcgcttcaactccttaatgattttgctttctccccctgagcccagatactcagacgacttggtatctcagctatgccagctatacatgaccttttgggacagcggtg

SEQ ID NO: 442934 - DNA, 140 bp, Artificial Sequence
  Synthetic
caccgctgtcccaaaaggtcatgtatagctggcatagctgagataccaagtcgtctgagtatctgggctcagggggagaaagcaaaatcattaaggagttgaagcgagacaagaacagatcatatcagcagccagggcct

SEQ ID NO: 442935 - DNA, 140 bp, Artificial Sequence
  Synthetic
aggccctggctgctgatatgatgaagctgaggattttgttgaagttcatcttcccgatgtgcataaacaggtctctggggttgacctgggcctcccaaactgggggaagtatgtattactgaccttttgggacagcggtg

SEQ ID NO: 442936 - DNA, 140 bp, Artificial Sequence
  Synthetic
caccgctgtcccaaaaggtcagtaatacatacttcccccagtttgggaggcccaggtcaaccccagagacctgtttatgcacatcgggaagatgaacttcaacaaaatcctcagcttcatcatatcagcagccagggcct

SEQ ID NO: 442937 - DNA, 140 bp, Artificial Sequence
  Synthetic
aggccctggctgctgatatggaattacagcgaggtactttgtctaaagtttccattattatagctatcatgatagtcttctccaatagagttttcaacatatcgaaaccgctgactgaccgaccttttgggacagcggtg

SEQ ID NO: 442938 - DNA, 140 bp, Artificial Sequence
  Synthetic
caccgctgtcccaaaaggtcggtcagtcagcggtttcgatatgttgaaaactctattggagaagactatcatgatagctataataatggaaactttagacaaagtacctcgctgtaattccatatcagcagccagggcct

SEQ ID NO: 442939 - DNA, 140 bp, Artificial Sequence
  Synthetic
aggccctggctgctgatatgcctaccaggagtgtttagcaagcgacctggcccggaggatcctcaggtggggatttgataagtactctaagtggtatctggattcaagattcctagcccagaccttttgggacagcggtg

SEQ ID NO: 442940 - DNA, 140 bp, Artificial Sequence
  Synthetic
caccgctgtcccaaaaggtctgggctaggaatcttgaatccagataccacttagagtacttatcaaatccccacctgaggatcctccgggccaggtcgcttgctaaacactcctggtaggcatatcagcagccagggcct

SEQ ID NO: 442941 - DNA, 140 bp, Artificial Sequence
  Synthetic
aggccctggctgctgatatgctttgcaaggcttcatgatctatacaacagacccataacttattacttcatgaaacaagtcattcgggggaacacttatctgtcctggagttggtccgatgaccttttgggacagcggtg

SEQ ID NO: 442942 - DNA, 140 bp, Artificial Sequence
  Synthetic
caccgctgtcccaaaaggtcatcggaccaactccaggacagataagtgttcccccgaatgacttgtttcatgaagtaataagttatgggtctgttgtatagatcatgaagccttgcaaagcatatcagcagccagggcct

SEQ ID NO: 442943 - DNA, 140 bp, Artificial Sequence
  Synthetic
atacgccatgctgggtctccggggaagtatagaagatctgtccaaggaggtggaaaagcaccttcgaaggtacaacaggtggatcaccctcagagacatcagatccagatcatctctgttcgtacttgggagtcggccat

SEQ ID NO: 442944 - DNA, 140 bp, Artificial Sequence
  Synthetic
atggccgactcccaagtacgaacagagatgatctggatctgatgtctctgagggtgatccacctgttgtaccttcgaaggtgcttttccacctccttggacagatcttctatacttccccggagacccagcatggcgtat

SEQ ID NO: 442945 - DNA, 140 bp, Artificial Sequence
  Synthetic
aggccctggctgctgatatggaggggggcctgttcctagcgagaaggttattatcacagccctgtctaagccgcctgtcaatcccagagagtttttgaaatctatagacattggaggattgaccttttgggacagcggtg

SEQ ID NO: 442946 - DNA, 140 bp, Artificial Sequence
  Synthetic
caccgctgtcccaaaaggtcaatcctccaatgtctatagatttcaaaaactctctgggattgacaggcggcttagacagggctgtgataataaccttctcgctaggaacaggcccccctccatatcagcagccagggcct

SEQ ID NO: 442947 - DNA, 140 bp, Artificial Sequence
  Synthetic
atacgccatgctgggtctccagattatagctgcttataagctaagtgccctcgatggaatgtacaaactgagactcctagactgtgcatcctgaaaaaaacaggatcagagttccgaacccgtacttgggagtcggccat

SEQ ID NO: 442948 - DNA, 140 bp, Artificial Sequence
  Synthetic
atggccgactcccaagtacgggttcggaactctgatcctgtttttttcaggatgcacagtctaggagtctcagtttgtacattccatcgagggcacttagcttataagcagctataatctggagacccagcatggcgtat

SEQ ID NO: 442949 - DNA, 140 bp, Artificial Sequence
  Synthetic
aggccctggctgctgatatgagattgagggccgattctttgctctaatgtcatggaatctaagactgtattttgtcatcaccgagaaactcttggccacctacatcctaccactttttgagaccttttgggacagcggtg

SEQ ID NO: 442950 - DNA, 140 bp, Artificial Sequence
  Synthetic
caccgctgtcccaaaaggtctcaaaaagtggtaggatgtaggtggccaagagtttctcggtgatgacaaaatacagtcttagattccatgacattagagcaaagaatcggccctcaatctcatatcagcagccagggcct

SEQ ID NO: 442951 - DNA, 140 bp, Artificial Sequence
  Synthetic
aggccctggctgctgatatgtctcatcttctactccagagggttgagagaaacctatctaagagtatgagagataacctgcgacaattgagttctttgatgaggcaggtgctgggcgggcgaccttttgggacagcggtg

SEQ ID NO: 442952 - DNA, 140 bp, Artificial Sequence
  Synthetic
caccgctgtcccaaaaggtcgcccgcccagcacctgcctcatcaaagaactcaattgtcgcaggttatctctcatactcttagataggtttctctcaaccctctggagtagaagatgagacatatcagcagccagggcct

SEQ ID NO: 442953 - DNA, 140 bp, Artificial Sequence
  Synthetic
aggccctggctgctgatatggtacaagtaccctgctatcaaagatttgaaaaagccctgtataaccctagggaaagcccccgacttgaacaaagcatacaaatcagttttatcaggcatggaccttttgggacagcggtg

SEQ ID NO: 442954 - DNA, 140 bp, Artificial Sequence
  Synthetic
caccgctgtcccaaaaggtccatgcctgataaaactgatttgtatgctttgttcaagtcgggggctttccctagggttatacagggctttttcaaatctttgatagcagggtacttgtaccatatcagcagccagggcct

SEQ ID NO: 442955 - DNA, 140 bp, Artificial Sequence
  Synthetic
atacgccatgctgggtctcccaacttccatgtcgacccagctgttccatgcctgggagaaagtcaccaatgttcatgtggtgaaacgagccctatcactcaaggaatctataaactggttcgtacttgggagtcggccat

SEQ ID NO: 442956 - DNA, 140 bp, Artificial Sequence
  Synthetic
atggccgactcccaagtacgaaccagtttatagattccttgagtgatagggctcgtttcaccacatgaacattggtgactttctcccaggcatggaacagctgggtcgacatggaagttgggagacccagcatggcgtat

SEQ ID NO: 442957 - DNA, 140 bp, Artificial Sequence
  Synthetic
aggccctggctgctgatatgataaaacgtaatgatgtagaagggaattgggctctgacaggaggcatggagatgacaagggaccccaccgtctctgagcatgcatctttggttggtcttcgaccttttgggacagcggtg

SEQ ID NO: 442958 - DNA, 140 bp, Artificial Sequence
  Synthetic
caccgctgtcccaaaaggtcgaagaccaaccaaagatgcatgctcagagacggtggggtcccttgtcatctccatgcctcctgtcagagcccaattcccttctacatcattacgttttatcatatcagcagccagggcct

SEQ ID NO: 442959 - DNA, 140 bp, Artificial Sequence
  Synthetic
atacgccatgctgggtctccggttctgtgtccgacatatatgttgtcgccgggactgtctcaagaggggcttctctatgaattagagagtatatcaaggaatgcactgtcgatataccgtcgtacttgggagtcggccat

SEQ ID NO: 442960 - DNA, 140 bp, Artificial Sequence
  Synthetic
atggccgactcccaagtacgacggtatatcgacagtgcattccttgatatactctctaattcatagagaagcccctcttgagacagtcccggcgacaacatatatgtcggacacagaaccggagacccagcatggcgtat

SEQ ID NO: 442961 - DNA, 140 bp, Artificial Sequence
  Synthetic
atacgccatgctgggtctccatccctctctgtacatcatgcttagagaaccatctcttagaggagagatattttctatccctcagaaaatccccgccgcttacccaaccacgatgaaagacgtacttgggagtcggccat

SEQ ID NO: 442962 - DNA, 140 bp, Artificial Sequence
  Synthetic
atggccgactcccaagtacgtctttcatcgtggttgggtaagcggcggggattttctgagggatagaaaatatctctcctctaagagatggttctctaagcatgatgtacagagagggatggagacccagcatggcgtat

SEQ ID NO: 442963 - DNA, 140 bp, Artificial Sequence
  Synthetic
atacgccatgctgggtctccggagacggctgttcctcactcttatttcattcacttccgttcactaggcttgagtgggaagtctccttattcatcgaatgccgttggtcatgtgttcaatcgtacttgggagtcggccat

SEQ ID NO: 442964 - DNA, 140 bp, Artificial Sequence
  Synthetic
atggccgactcccaagtacgattgaacacatgaccaacggcattcgatgaataaggagacttcccactcaagcctagtgaacggaagtgaatgaaataagagtgaggaacagccgtctccggagacccagcatggcgtat

SEQ ID NO: 442965 - DNA, 140 bp, Artificial Sequence
  Synthetic
aggccctggctgctgatatgtttagcccaatcttaaagggtagagtttacaagatcctgagtgctgagggagatagctttctcctagctatgtcaaggataatctatctagatccatcttgaccttttgggacagcggtg

SEQ ID NO: 442966 - DNA, 140 bp, Artificial Sequence
  Synthetic
caccgctgtcccaaaaggtcaagatggatctagatagattatccttgacatagctaggagaaagctatctccctcagcactcaggatcttgtaaactctaccctttaagattgggctaaacatatcagcagccagggcct

SEQ ID NO: 442967 - DNA, 140 bp, Artificial Sequence
  Synthetic
aggccctggctgctgatatgaacagttattgccgcatgtgctcctcatgagatgtctgttctagggggctatctaggggaggaattctttgggagaggaacattcgaaagaagattcttcgaccttttgggacagcggtg

SEQ ID NO: 442968 - DNA, 140 bp, Artificial Sequence
  Synthetic
caccgctgtcccaaaaggtcgaagaatcttctttcgaatgttcctctcccaaagaattcctcccctagatagccccctagaacagacatctcatgaggagcacatgcggcaataactgttcatatcagcagccagggcct

SEQ ID NO: 442969 - DNA, 140 bp, Artificial Sequence
  Synthetic
atacgccatgctgggtctccatctaggggaggaattctttgggagaggaacattcgaaagaagattcttcagagatgagaaagaacttcaagaatacgaggcagctgaactgacaaagaccgtacttgggagtcggccat

SEQ ID NO: 442970 - DNA, 140 bp, Artificial Sequence
  Synthetic
atggccgactcccaagtacggtctttgtcagttcagctgcctcgtattcttgaagttctttctcatctctgaagaatcttctttcgaatgttcctctcccaaagaattcctcccctagatggagacccagcatggcgtat

SEQ ID NO: 442971 - DNA, 140 bp, Artificial Sequence
  Synthetic
atacgccatgctgggtctccctcttcctaaagtctgttgagcctctgtttcctcgatttctcagtgagctattcagttcatcctttttgggaatccctgagtcaatcattggactgataccgtacttgggagtcggccat

SEQ ID NO: 442972 - DNA, 140 bp, Artificial Sequence
  Synthetic
atggccgactcccaagtacggtatcagtccaatgattgactcagggattcccaaaaaggatgaactgaatagctcactgagaaatcgaggaaacagaggctcaacagactttaggaagagggagacccagcatggcgtat

SEQ ID NO: 442973 - DNA, 140 bp, Artificial Sequence
  Synthetic
aggccctggctgctgatatgctatcgattgtgtatatccatcatgaaaaaaactaacacccctcctttcgaaccatccccaaatatgagcaagatcttcgtcaatccgagtgctatcagagaccttttgggacagcggtg

SEQ ID NO: 442974 - DNA, 140 bp, Artificial Sequence
  Synthetic
caccgctgtcccaaaaggtctctgatagcactcggattgacgaagatcttgctcatatttggggatggttcgaaaggaggggtgttagtttttttcatgatggatatacacaatcgatagcatatcagcagccagggcct

SEQ ID NO: 442975 - DNA, 140 bp, Artificial Sequence
  Synthetic
aggccctggctgctgatatgactcgcccaagaccaccccttgactccttatatcaaaacccaaacatggccacccaaacacatagtagacttggtaggggatacatggcacaagctcccagaccttttgggacagcggtg

SEQ ID NO: 442976 - DNA, 140 bp, Artificial Sequence
  Synthetic
caccgctgtcccaaaaggtctgggagcttgtgccatgtatcccctaccaagtctactatgtgtttgggtggccatgtttgggttttgatataaggagtcaaggggtggtcttgggcgagtcatatcagcagccagggcct

SEQ ID NO: 442977 - DNA, 140 bp, Artificial Sequence
  Synthetic
atacgccatgctgggtctcccagatctactgagggagatctcttggggaagaaaagtggtaggcacgacagttcctcacccctctgagatgttggggttacttcctaaatcctccatctccgtacttgggagtcggccat

SEQ ID NO: 442978 - DNA, 140 bp, Artificial Sequence
  Synthetic
atggccgactcccaagtacggagatggaggatttaggaagtaaccccaacatctcagaggggtgaggaactgtcgtgcctaccacttttcttccccaagagatctccctcagtagatctgggagacccagcatggcgtat

SEQ ID NO: 442979 - DNA, 140 bp, Artificial Sequence
  Synthetic
aggccctggctgctgatatgacctggacaacgttggagtccagatagtcagacaaatgaggtcaggagaaagattcctcaaaatatggtcacagaccgtggaagagattatatcctatgtgaccttttgggacagcggtg

SEQ ID NO: 442980 - DNA, 140 bp, Artificial Sequence
  Synthetic
caccgctgtcccaaaaggtcacataggatataatctcttccacggtctgtgaccatattttgaggaatctttctcctgacctcatttgtctgactatctggactccaacgttgtccaggtcatatcagcagccagggcct

SEQ ID NO: 442981 - DNA, 140 bp, Artificial Sequence
  Synthetic
aggccctggctgctgatatgcacggtcaacttccccaacccttcaggaaggtcttcagaggataagtcgacccagaccactagtcgagagcccaagaaggagacaacatccactccttctgaccttttgggacagcggtg

SEQ ID NO: 442982 - DNA, 140 bp, Artificial Sequence
  Synthetic
caccgctgtcccaaaaggtcagaaggagtggatgttgtctccttcttgggctctcgactagtggtctgggtcgacttatcctctgaagaccttcctgaagggttggggaagttgaccgtgcatatcagcagccagggcct

SEQ ID NO: 442983 - DNA, 140 bp, Artificial Sequence
  Synthetic
aggccctggctgctgatatgtggccctccatcctttgaatggtctgctaccaatgaggaggatgatctatcagtagaggctgagatcgctcaccagattgctgaaagcttttctaagaaggaccttttgggacagcggtg

SEQ ID NO: 442984 - DNA, 140 bp, Artificial Sequence
  Synthetic
caccgctgtcccaaaaggtccttcttagaaaagctttcagcaatctggtgagcgatctcagcctctactgatagatcatcctcctcattggtagcagaccattcaaaggatggagggccacatatcagcagccagggcct

SEQ ID NO: 442985 - DNA, 140 bp, Artificial Sequence
  Synthetic
aggccctggctgctgatatgcaacccctgatgctttatgcgcaaacatggacatcggaactggtgcaaagagacacaaggctgaaagactccacttttcattggcatctccgatgcggaagaccttttgggacagcggtg

SEQ ID NO: 442986 - DNA, 140 bp, Artificial Sequence
  Synthetic
caccgctgtcccaaaaggtcttccgcatcggagatgccaatgaaaagtggagtctttcagccttgtgtctctttgcaccagttccgatgtccatgtttgcgcataaagcatcaggggttgcatatcagcagccagggcct

SEQ ID NO: 442987 - DNA, 140 bp, Artificial Sequence
  Synthetic
aggccctggctgctgatatgttctcagattttcgagttcccggatgtgtcaaaaaggatatccagaatggtctctggagccgtgcctcattttcagaaacttcctgatatccgcttgagagaccttttgggacagcggtg

SEQ ID NO: 442988 - DNA, 140 bp, Artificial Sequence
  Synthetic
caccgctgtcccaaaaggtctctcaagcggatatcaggaagtttctgaaaatgaggcacggctccagagaccattctggatatcctttttgacacatccgggaactcgaaaatctgagaacatatcagcagccagggcct

SEQ ID NO: 442989 - DNA, 140 bp, Artificial Sequence
  Synthetic
aggccctggctgctgatatggtcagtccaaaaacaggtcaacatgtattatgacctcattatttgtgatgcagaagttactgacattgcatctatcaatcggataaccctgttaatgtctgaccttttgggacagcggtg

SEQ ID NO: 442990 - DNA, 140 bp, Artificial Sequence
  Synthetic
caccgctgtcccaaaaggtcagacattaacagggttatccgattgatagatgcaatgtcagtaacttctgcatcacaaataatgaggtcataatacatgttgacctgtttttggactgaccatatcagcagccagggcct

SEQ ID NO: 442991 - DNA, 140 bp, Artificial Sequence
  Synthetic
aggccctggctgctgatatggatacaacgatggaaccatctttcctgtcaacatatacggcagagtttcccctagagactatttgagagggctcgcaaggggaatcttgataggatcctcgaccttttgggacagcggtg

SEQ ID NO: 442992 - DNA, 140 bp, Artificial Sequence
  Synthetic
caccgctgtcccaaaaggtcgaggatcctatcaagattccccttgcgagccctctcaaatagtctctaggggaaactctgccgtatatgttgacaggaaagatggttccatcgttgtatccatatcagcagccagggcct

SEQ ID NO: 442993 - DNA, 140 bp, Artificial Sequence
  Synthetic
aggccctggctgctgatatgacttctgtatcaacggagaggtgaaagtgtgtagtccgaacggttactcgttcaggatcctgcggcacattctgagatcattcgacgagatatactctgggaccttttgggacagcggtg

SEQ ID NO: 442994 - DNA, 140 bp, Artificial Sequence
  Synthetic
caccgctgtcccaaaaggtcccagagtatatctcgtcgaatgatctcagaatgtgccgcaggatcctgaacgagtaaccgttcggactacacactttcacctctccgttgatacagaagtcatatcagcagccagggcct

SEQ ID NO: 442995 - DNA, 140 bp, Artificial Sequence
  Synthetic
aggccctggctgctgatatgccctctttgtatataatgctcagagaaccgtctcttagaggcgagatattttctatccctcagagaatccctgccgcctacccaaccaccatgaaggaaggaccttttgggacagcggtg

SEQ ID NO: 442996 - DNA, 140 bp, Artificial Sequence
  Synthetic
caccgctgtcccaaaaggtccttccttcatggtggttgggtaggcggcagggattctctgagggatagaaaatatctcgcctctaagagacggttctctgagcattatatacaaagagggcatatcagcagccagggcct

SEQ ID NO: 442997 - DNA, 140 bp, Artificial Sequence
  Synthetic
aggccctggctgctgatatgcaggagctccagtccctgagggaatgaactgggtatacaaactgaggagaaccctcatcttccagtgggctgattccaggggccctcttgaaggggaagagaccttttgggacagcggtg

SEQ ID NO: 442998 - DNA, 140 bp, Artificial Sequence
  Synthetic
caccgctgtcccaaaaggtctcttccccttcaagagggcccctggaatcagcccactggaagatgagggttctcctcagtttgtatacccagttcattccctcagggactggagctcctgcatatcagcagccagggcct

SEQ ID NO: 442999 - DNA, 140 bp, Artificial Sequence
  Synthetic
aggccctggctgctgatatgctttagaagtgctaagatgacgtacctgaccctcattacttaccagtctcatctcctactccaaagggttgagagacgtttgtctaagagtatgagggttgaccttttgggacagcggtg

SEQ ID NO: 443000 - DNA, 140 bp, Artificial Sequence
  Synthetic
caccgctgtcccaaaaggtcaaccctcatactcttagacaaacgtctctcaaccctttggagtaggagatgagactggtaagtaatgagggtcaggtacgtcatcttagcacttctaaagcatatcagcagccagggcct

SEQ ID NO: 443001 - DNA, 140 bp, Artificial Sequence
  Synthetic
aggccctggctgctgatatgtggtgtatcaacacgagctcgagagcatgtcaactatggtctgacatgtctctcaagacacaaatgtctgaagaggacaaagactcctctcttcttctaggaccttttgggacagcggtg

SEQ ID NO: 443002 - DNA, 140 bp, Artificial Sequence
  Synthetic
caccgctgtcccaaaaggtcctagaagaagagaggagtctttgtcctcttcagacatttgtgtcttgagagacatgtcagaccatagttgacatgctctcgagctcgtgttgatacaccacatatcagcagccagggcct

SEQ ID NO: 443003 - DNA, 140 bp, Artificial Sequence
  Synthetic
atacgccatgctgggtctcctctcaagacacaaatgtctgaagaggacaaagactcctctcttcttctagaataatcagactatatcccgcgggttcatcacttgtatacctctggaagacgtacttgggagtcggccat

SEQ ID NO: 443004 - DNA, 140 bp, Artificial Sequence
  Synthetic
atggccgactcccaagtacgtcttccagaggtatacaagtgatgaacccgcgggatatagtctgattattctagaagaagagaggagtctttgtcctcttcagacatttgtgtcttgagaggagacccagcatggcgtat

SEQ ID NO: 443005 - DNA, 140 bp, Artificial Sequence
  Synthetic
aggccctggctgctgatatgctttgcgaaggaccaagtgggtggatcaagaggtgcgccatgcagctagaaccatgacaggagactacagccccaacaagaaggtgccccgcaaggcggggaccttttgggacagcggtg

SEQ ID NO: 443006 - DNA, 140 bp, Artificial Sequence
  Synthetic
caccgctgtcccaaaaggtccccgccttgcggggcaccttcttgttggggctgtagtctcctgtcatggttctagctgcatggcgcacctcttgatccacccacttggtccttcgcaaagcatatcagcagccagggcct

SEQ ID NO: 443007 - DNA, 140 bp, Artificial Sequence
  Synthetic
atacgccatgctgggtctccctcgctgcgaaggacaaggtgggtggatcaggaggtgcgccacgcagctagaaccatgactggagattacagccccaacaagaaagcatcccgcaaagcacgtacttgggagtcggccat

SEQ ID NO: 443008 - DNA, 140 bp, Artificial Sequence
  Synthetic
atggccgactcccaagtacgtgctttgcgggatgctttcttgttggggctgtaatctccagtcatggttctagctgcgtggcgcacctcctgatccacccaccttgtccttcgcagcgagggagacccagcatggcgtat

SEQ ID NO: 443009 - DNA, 140 bp, Artificial Sequence
  Synthetic
atacgccatgctgggtctccctttaaattttgagcctcttggatgtgaaaaaaactattaacatccctcaaaagacttagggaaagatggttcctcaagctcttttgcttgtaccccttccgtacttgggagtcggccat

SEQ ID NO: 443010 - DNA, 140 bp, Artificial Sequence
  Synthetic
atggccgactcccaagtacggaaggggtacaagcaaaagagcttgaggaaccatctttccctaagtcttttgagggatgttaatagtttttttcacatccaagaggctcaaaatttaaagggagacccagcatggcgtat

SEQ ID NO: 443011 - DNA, 140 bp, Artificial Sequence
  Synthetic
aggccctggctgctgatatgccaacccagcccttgtctcagagcttgacataagggcactctctaagagatttcaaaaccctttaatctctgggttgagagtggttcagtgggcaaccgggaccttttgggacagcggtg

SEQ ID NO: 443012 - DNA, 140 bp, Artificial Sequence
  Synthetic
caccgctgtcccaaaaggtcccggttgcccactgaaccactctcaacccagagattaaagggttttgaaatctcttagagagtgcccttatgtcaagctctgagacaagggctgggttggcatatcagcagccagggcct

SEQ ID NO: 443013 - DNA, 140 bp, Artificial Sequence
  Synthetic
aggccctggctgctgatatgacacttggtccctggagcccgatcgatatacatcatctcagttgcccaaacaatttggttgtggaggatgaaggatgcaccaacctgtcagggttctcctgaccttttgggacagcggtg

SEQ ID NO: 443014 - DNA, 140 bp, Artificial Sequence
  Synthetic
caccgctgtcccaaaaggtcaggagaaccctgacaggttggtgcatccttcatcctccacaaccaaattgtttgggcaactgagatgatgtatatcgatcgggctccagggaccaagtgtcatatcagcagccagggcct

SEQ ID NO: 443015 - DNA, 140 bp, Artificial Sequence
  Synthetic
aggccctggctgctgatatgctaaacatgtttccagatgctaagcttgtgttcaacagcctattagaggtgaatgatctgatggcttccggaacacatccactgcctccctcagcaatcagaccttttgggacagcggtg

SEQ ID NO: 443016 - DNA, 140 bp, Artificial Sequence
  Synthetic
caccgctgtcccaaaaggtctgattgctgagggaggcagtggatgtgttccggaagccatcagatcattcacctctaataggctgttgaacacaagcttagcatctggaaacatgtttagcatatcagcagccagggcct

SEQ ID NO: 443017 - DNA, 140 bp, Artificial Sequence
  Synthetic
aggccctggctgctgatatgacttgcacaggcgttgtgacagaggcagaaacctacactaactttgttggttatgtcaccaccacgttcaaaagaaagcatttccgcccaacaccagatggaccttttgggacagcggtg

SEQ ID NO: 443018 - DNA, 140 bp, Artificial Sequence
  Synthetic
caccgctgtcccaaaaggtccatctggtgttgggcggaaatgctttcttttgaacgtggtggtgacataaccaacaaagttagtgtaggtttctgcctctgtcacaacgcctgtgcaagtcatatcagcagccagggcct

SEQ ID NO: 443019 - DNA, 140 bp, Artificial Sequence
  Synthetic
aggccctggctgctgatatgcgggactatgctagtaaacccagactataaggctattcaacacctgtcaagagcatttccctcagtcacagggtttatcacccaagtaacttcatctttcgaccttttgggacagcggtg

SEQ ID NO: 443020 - DNA, 140 bp, Artificial Sequence
  Synthetic
caccgctgtcccaaaaggtcgaaagatgaagttacttgggtgataaaccctgtgactgagggaaatgctcttgacaggtgttgaatagccttatagtctgggtttactagcatagtcccgcatatcagcagccagggcct

SEQ ID NO: 443021 - DNA, 140 bp, Artificial Sequence
  Synthetic
aggccctggctgctgatatgcgtttggatgcctgaaattctgagactagggacatcttgtgatatttttaccaatagtagagggaagagagcatccaaggggagcaagacctgtggctttgaccttttgggacagcggtg

SEQ ID NO: 443022 - DNA, 140 bp, Artificial Sequence
  Synthetic
caccgctgtcccaaaaggtcaaagccacaggtcttgctccccttggatgctctcttccctctactattggtaaaaatatcacaagatgtccctagtctcagaatttcaggcatccaaacgcatatcagcagccagggcct

SEQ ID NO: 443023 - DNA, 140 bp, Artificial Sequence
  Synthetic
aggccctggctgctgatatggtagatgaaaggggcctatataagtctctaaaaggcgcatgcaaactcaagttatgtggagttcctggacttagacttatggacggaacatgggtcgcgagaccttttgggacagcggtg

SEQ ID NO: 443024 - DNA, 140 bp, Artificial Sequence
  Synthetic
caccgctgtcccaaaaggtctcgcgacccatgttccgtccataagtctaagtccaggaactccacataacttgagtttgcatgcgccttttagagacttatataggcccctttcatctaccatatcagcagccagggcct

SEQ ID NO: 443025 - DNA, 140 bp, Artificial Sequence
  Synthetic
aggccctggctgctgatatgcagacctataacctattacttcaggaagcaagtcatccgagggaatatttatctgtcttggagctggtccgaagacacctcggtgttcaagagggtagccgaccttttgggacagcggtg

SEQ ID NO: 443026 - DNA, 140 bp, Artificial Sequence
  Synthetic
caccgctgtcccaaaaggtcggctaccctcttgaacaccgaggtgtcttcggaccagctccaagacagataaatattccctcggatgacttgcttcctgaagtaataggttataggtctgcatatcagcagccagggcct

SEQ ID NO: 443027 - DNA, 140 bp, Artificial Sequence
  Synthetic
aggccctggctgctgatatggatgagattgaggattttgtggaagttcaccttcccgatgtgcacgaacaggtctcaggggttgacctgggtctcccgaactggggggagtatgtattacgaccttttgggacagcggtg

SEQ ID NO: 443028 - DNA, 140 bp, Artificial Sequence
  Synthetic
caccgctgtcccaaaaggtcgtaatacatactccccccagttcgggagacccaggtcaacccctgagacctgttcgtgcacatcgggaaggtgaacttccacaaaatcctcaatctcatccatatcagcagccagggcct

SEQ ID NO: 443029 - DNA, 140 bp, Artificial Sequence
  Synthetic
aggccctggctgctgatatgagatagaaaaacaccttcacgggtacaacagatggatcaccctagaagatgtcagatctagatcatctctactagactacagttgcttgtaaaccggctagaccttttgggacagcggtg

SEQ ID NO: 443030 - DNA, 140 bp, Artificial Sequence
  Synthetic
caccgctgtcccaaaaggtctagccggtttacaagcaactgtagtctagtagagatgatctagatctgacatcttctagggtgatccatctgttgtacccgtgaaggtgtttttctatctcatatcagcagccagggcct

SEQ ID NO: 443031 - DNA, 140 bp, Artificial Sequence
  Synthetic
aggccctggctgctgatatgctcccggaggcctgtacgtgataaggctcttatatgatatatcttgaaaaaaacaagatcttgaatccgagcctctgattgcttgattgttttttccgtcgaccttttgggacagcggtg

SEQ ID NO: 443032 - DNA, 140 bp, Artificial Sequence
  Synthetic
caccgctgtcccaaaaggtcgacggaaaaaacaatcaagcaatcagaggctcggattcaagatcttgtttttttcaagatatatcatataagagccttatcacgtacaggcctccgggagcatatcagcagccagggcct

SEQ ID NO: 443033 - DNA, 140 bp, Artificial Sequence
  Synthetic
aggccctggctgctgatatggacagggaggaatgtgtcagtcacctcccaaagcgggaaattcataccttcatgggagtcgtataaaagtgggggtgagactggactgtgaagacttgtcgaccttttgggacagcggtg

SEQ ID NO: 443034 - DNA, 140 bp, Artificial Sequence
  Synthetic
caccgctgtcccaaaaggtcgacaagtcttcacagtccagtctcacccccacttttatacgactcccatgaaggtatgaatttcccgctttgggaggtgactgacacattcctccctgtccatatcagcagccagggcct

SEQ ID NO: 443035 - DNA, 140 bp, Artificial Sequence
  Synthetic
aggccctggctgctgatatggggaatctctgggttcaatagtcctccttgaactccattcaacatggtggattcaaaagtcatgagactttcattaatcatctcagttgatcaaacaagggaccttttgggacagcggtg

SEQ ID NO: 443036 - DNA, 140 bp, Artificial Sequence
  Synthetic
caccgctgtcccaaaaggtcccttgtttgatcaactgagatgattaatgaaagtctcatgacttttgaatccaccatgttgaatggagttcaaggaggactattgaacccagagattccccatatcagcagccagggcct

SEQ ID NO: 443037 - DNA, 140 bp, Artificial Sequence
  Synthetic
aggccctggctgctgatatgagaggtatttctgatgactccgtgcgtgggcccggacagaggtcatagtacgtcccatgatagcggactcagcatgagtcgattgagaaaggcaatctgcgaccttttgggacagcggtg

SEQ ID NO: 443038 - DNA, 140 bp, Artificial Sequence
  Synthetic
caccgctgtcccaaaaggtcgcagattgcctttctcaatcgactcatgctgagtccgctatcatgggacgtactatgacctctgtccgggcccacgcacggagtcatcagaaatacctctcatatcagcagccagggcct

SEQ ID NO: 443039 - DNA, 140 bp, Artificial Sequence
  Synthetic
aggccctggctgctgatatggaggtatctggctaacatatactcttcttatttattctttcacgtgatcaccctttacatgaacgccttggactgggatgaggagaagaccatcctagcagaccttttgggacagcggtg

SEQ ID NO: 443040 - DNA, 140 bp, Artificial Sequence
  Synthetic
caccgctgtcccaaaaggtctgctaggatggtcttctcctcatcccagtccaaggcgttcatgtaaagggtgatcacgtgaaagaataaataagaagagtatatgttagccagatacctccatatcagcagccagggcct

SEQ ID NO: 443041 - DNA, 140 bp, Artificial Sequence
  Synthetic
atacgccatgctgggtctcctcttgagtctttataggttgagcaaaatatcgggacaaaacacaggcaactacaagacaaacattgcggacaggatagagcagatttttgagactgctcccgtacttgggagtcggccat

SEQ ID NO: 443042 - DNA, 140 bp, Artificial Sequence
  Synthetic
atggccgactcccaagtacgggagcagtctcaaaaatctgctctatcctgtccgcaatgtttgtcttgtagttgcctgtgttttgtcccgatattttgctcaacctataaagactcaagaggagacccagcatggcgtat

SEQ ID NO: 443043 - DNA, 140 bp, Artificial Sequence
  Synthetic
aggccctggctgctgatatgctaagaaactctgactacaacctcaactcccctttgatagaagatcctgcgggactgatgttagaatggctgaaaacagggaatagaccctgtcggatgagaccttttgggacagcggtg

SEQ ID NO: 443044 - DNA, 140 bp, Artificial Sequence
  Synthetic
caccgctgtcccaaaaggtctcatccgacagggtctattccctgttttcagccattctaacatcagtcccgcaggatcttctatcaaaggggagttgaggttgtagtcagagtttcttagcatatcagcagccagggcct

SEQ ID NO: 443045 - DNA, 140 bp, Artificial Sequence
  Synthetic
aggccctggctgctgatatgaatgatttctctctggttatatggtgcccattctgaatcaaacaggagccggagatgtataacagacttggcccatttctattccaagtcatcccccatagaccttttgggacagcggtg

SEQ ID NO: 443046 - DNA, 140 bp, Artificial Sequence
  Synthetic
caccgctgtcccaaaaggtctatgggggatgacttggaatagaaatgggccaagtctgttatacatctccggctcctgtttgattcagaatgggcaccatataaccagagagaaatcattcatatcagcagccagggcct

SEQ ID NO: 443047 - DNA, 140 bp, Artificial Sequence
  Synthetic
aggccctggctgctgatatggagaagctgttaaattgtacactgggaaacagagggctgagaatccccccagagggggtgttaagttgccttgagaaggtcgattatgataaggcatttggaccttttgggacagcggtg

SEQ ID NO: 443048 - DNA, 140 bp, Artificial Sequence
  Synthetic
caccgctgtcccaaaaggtccaaatgccttatcataatcgaccttctcaaggcaacttaacaccccctctggggggattctcagccctctgtttcccagtgtacaatttaacagcttctccatatcagcagccagggcct

SEQ ID NO: 443049 - DNA, 140 bp, Artificial Sequence
  Synthetic
aggccctggctgctgatatgctcattcactttgtcggatgctatatgggtcaagtcagatcccttaatgcaacagttattgccgcatgtgccccccatgagatgtctgttctggggggctgaccttttgggacagcggtg

SEQ ID NO: 443050 - DNA, 140 bp, Artificial Sequence
  Synthetic
caccgctgtcccaaaaggtcagccccccagaacagacatctcatggggggcacatgcggcaataactgttgcattaagggatctgacttgacccatatagcatccgacaaagtgaatgagcatatcagcagccagggcct

SEQ ID NO: 443051 - DNA, 140 bp, Artificial Sequence
  Synthetic
atacgccatgctgggtctcctgtcatggagtcgatatgaaaaaaacaggcaacaccactaataaaatgaactttctatgtaagatagtgaaaaactgtagggatgaggacacccaaaagccgtacttgggagtcggccat

SEQ ID NO: 443052 - DNA, 140 bp, Artificial Sequence
  Synthetic
atggccgactcccaagtacggcttttgggtgtcctcatccctacagtttttcactatcttacatagaaagttcattttattagtggtgttgcctgtttttttcatatcgactccatgacaggagacccagcatggcgtat

SEQ ID NO: 443053 - DNA, 140 bp, Artificial Sequence
  Synthetic
aggccctggctgctgatatgtgacttagcactggcagacgacggaaccgtcaactctgatgacgaagactatttctccggtgaaaccaggagtccggaagctgtctatactcgaatcatggaccttttgggacagcggtg

SEQ ID NO: 443054 - DNA, 140 bp, Artificial Sequence
  Synthetic
caccgctgtcccaaaaggtccatgattcgagtatagacagcttccggactcctggtttcaccggagaaatagtcttcgtcatcagagttgacggttccgtcgtctgccagtgctaagtcacatatcagcagccagggcct

SEQ ID NO: 443055 - DNA, 140 bp, Artificial Sequence
  Synthetic
aggccctggctgctgatatgcctgcaaattgtgtatatctcacatgaaaaaaactaacacccctccttttgaaccatcccagccatgagcaagatcttcgtcaatccgagtgcaatcagagaccttttgggacagcggtg

SEQ ID NO: 443056 - DNA, 140 bp, Artificial Sequence
  Synthetic
caccgctgtcccaaaaggtctctgattgcactcggattgacgaagatcttgctcatggctgggatggttcaaaaggaggggtgttagtttttttcatgtgagatatacacaatttgcaggcatatcagcagccagggcct

SEQ ID NO: 443057 - DNA, 140 bp, Artificial Sequence
  Synthetic
aggccctggctgctgatatgaggaacattgaggacaatcaggctcatctccaaggagatcccatagaggtggacaatctccctgaagacatgagacggcttcaactagatgacgacaaacgaccttttgggacagcggtg

SEQ ID NO: 443058 - DNA, 140 bp, Artificial Sequence
  Synthetic
caccgctgtcccaaaaggtcgtttgtcgtcatctagttgaagccgtctcatgtcttcagggagattgtccacctctatgggatctccttggagatgagcctgattgtcctcaatgttcctcatatcagcagccagggcct

SEQ ID NO: 443059 - DNA, 140 bp, Artificial Sequence
  Synthetic
atacgccatgctgggtctccaaagacaaggtgagtcagcttgaagggacttttggtcctagtgcaaaaaggttttttagagttctgtatcaatttgacaacatacatgatttggttttcgcgtacttgggagtcggccat

SEQ ID NO: 443060 - DNA, 140 bp, Artificial Sequence
  Synthetic
atggccgactcccaagtacgcgaaaaccaaatcatgtatgttgtcaaattgatacagaactctaaaaaacctttttgcactaggaccaaaagtcccttcaagctgactcaccttgtctttggagacccagcatggcgtat

SEQ ID NO: 443061 - DNA, 140 bp, Artificial Sequence
  Synthetic
aggccctggctgctgatatggtcctaccaagagtgtttagcaagcgacctagccaggaggatccttagatggggatttgataagtactctaagtggtatctggattcccgattcctcgcagaccttttgggacagcggtg

SEQ ID NO: 443062 - DNA, 140 bp, Artificial Sequence
  Synthetic
caccgctgtcccaaaaggtctgcgaggaatcgggaatccagataccacttagagtacttatcaaatccccatctaaggatcctcctggctaggtcgcttgctaaacactcttggtaggaccatatcagcagccagggcct

SEQ ID NO: 443063 - DNA, 140 bp, Artificial Sequence
  Synthetic
aggccctggctgctgatatgacctggaaaatgttggagtccaaatagtcagacagatgaggtccggagagagattcctcaagatttggtcgcagactgtagaggaaattgtctcctatgtgaccttttgggacagcggtg

SEQ ID NO: 443064 - DNA, 140 bp, Artificial Sequence
  Synthetic
caccgctgtcccaaaaggtcacataggagacaatttcctctacagtctgcgaccaaatcttgaggaatctctctccggacctcatctgtctgactatttggactccaacattttccaggtcatatcagcagccagggcct

SEQ ID NO: 443065 - DNA, 140 bp, Artificial Sequence
  Synthetic
atacgccatgctgggtctccagattcctcaagatttggtcgcagactgtagaggaaattgtctcctatgtcatgactaacttccccaacccatctggaaggtcttcggaggacaagtctacgtacttgggagtcggccat

SEQ ID NO: 443066 - DNA, 140 bp, Artificial Sequence
  Synthetic
atggccgactcccaagtacgtagacttgtcctccgaagaccttccagatgggttggggaagttagtcatgacataggagacaatttcctctacagtctgcgaccaaatcttgaggaatctggagacccagcatggcgtat

SEQ ID NO: 443067 - DNA, 140 bp, Artificial Sequence
  Synthetic
atacgccatgctgggtctcctgcagaagtcacagatattgcctctatcaaccggataaccctgttgatgtcagatttcgcattatctatagatggaccactttatctggtcttcaaaactcgtacttgggagtcggccat

SEQ ID NO: 443068 - DNA, 140 bp, Artificial Sequence
  Synthetic
atggccgactcccaagtacgagttttgaagaccagataaagtggtccatctatagataatgcgaaatctgacatcaacagggttatccggttgatagaggcaatatctgtgacttctgcaggagacccagcatggcgtat

SEQ ID NO: 443069 - DNA, 140 bp, Artificial Sequence
  Synthetic
aggccctggctgctgatatgtggtcctccagctctcgagtggtctgcgaccaacgaggaggatgacttatctgtggaggcggagatcgcccaccagattgccgagagcttctccaagaaagaccttttgggacagcggtg

SEQ ID NO: 443070 - DNA, 140 bp, Artificial Sequence
  Synthetic
caccgctgtcccaaaaggtctttcttggagaagctctcggcaatctggtgggcgatctccgcctccacagataagtcatcctcctcgttggtcgcagaccactcgagagctggaggaccacatatcagcagccagggcct

SEQ ID NO: 443071 - DNA, 140 bp, Artificial Sequence
  Synthetic
aggccctggctgctgatatgttgccagatgaagacttgataattggcctcaagccaaaggaacgagaattgaagattgagggtcgattctttgctctaatgtcatggaatctaagattgtgaccttttgggacagcggtg

SEQ ID NO: 443072 - DNA, 140 bp, Artificial Sequence
  Synthetic
caccgctgtcccaaaaggtcacaatcttagattccatgacattagagcaaagaatcgaccctcaatcttcaattctcgttcctttggcttgaggccaattatcaagtcttcatctggcaacatatcagcagccagggcct

SEQ ID NO: 443073 - DNA, 140 bp, Artificial Sequence
  Synthetic
aggccctggctgctgatatggacgcactgaccatgacagacaatctgaacaaagtgtttaaaaagttgatcgacagggtcactgggcaagggctttcagactattcaagggtcacatatggaccttttgggacagcggtg

SEQ ID NO: 443074 - DNA, 140 bp, Artificial Sequence
  Synthetic
caccgctgtcccaaaaggtccatatgtgacccttgaatagtctgaaagcccttgcccagtgaccctgtcgatcaactttttaaacactttgttcagattgtctgtcatggtcagtgcgtccatatcagcagccagggcct

SEQ ID NO: 443075 - DNA, 140 bp, Artificial Sequence
  Synthetic
aggccctggctgctgatatggccagacaagttgaacaaaattatgcaggatgatctaaaccgttatacatcctgctgacaattttcacactcaggcccaccagacaatggggcctgagttgaccttttgggacagcggtg

SEQ ID NO: 443076 - DNA, 140 bp, Artificial Sequence
  Synthetic
caccgctgtcccaaaaggtcaactcaggccccattgtctggtgggcctgagtgtgaaaattgtcagcaggatgtataacggtttagatcatcctgcataattttgttcaacttgtctggccatatcagcagccagggcct

SEQ ID NO: 443077 - DNA, 140 bp, Artificial Sequence
  Synthetic
atacgccatgctgggtctcccgcagatctttgagattcctgaatcaatggatccgtcagaaatattggatgacaaatcacattctttcaccagaacgagactagcttcttggctgtcagacgtacttgggagtcggccat

SEQ ID NO: 443078 - DNA, 140 bp, Artificial Sequence
  Synthetic
atggccgactcccaagtacgtctgacagccaagaagctagtctcgttctggtgaaagaatgtgatttgtcatccaatatttctgacggatccattgattcaggaatctcaaagatctgcgggagacccagcatggcgtat

SEQ ID NO: 443079 - DNA, 140 bp, Artificial Sequence
  Synthetic
aggccctggctgctgatatggtgtatcaacatgaattctagagcatgtcaattatggtctgacatgtctcttcagacacaaaggtcggaggaggacaaggactcttccctgctcctagaggaccttttgggacagcggtg

SEQ ID NO: 443080 - DNA, 140 bp, Artificial Sequence
  Synthetic
caccgctgtcccaaaaggtcctctaggagcagggaagagtccttgtcctcctccgacctttgtgtctgaagagacatgtcagaccataattgacatgctctagaattcatgttgatacaccatatcagcagccagggcct

SEQ ID NO: 443081 - DNA, 140 bp, Artificial Sequence
  Synthetic
atacgccatgctgggtctccttatggtgccattaaaccgctgcattttatcaaaatcagattaattacctttacattttgagcctcttggatgtgaaaaaaacttttaacatccctcaaacgtacttgggagtcggccat

SEQ ID NO: 443082 - DNA, 140 bp, Artificial Sequence
  Synthetic
atggccgactcccaagtacgtttgagggatgttaaaagtttttttcacatccaagaggctcaaaatgtaaaggtaattaatctgattttgataaaatgcagcggtttaatggcaccataaggagacccagcatggcgtat

SEQ ID NO: 443083 - DNA, 140 bp, Artificial Sequence
  Synthetic
atacgccatgctgggtctcctcaagagtcaaaaaacattcattagccatttcagctgatccaatacagtcatgtagatttttatgatgtaggatgtattttgatagtgtcattgactaatcgtacttgggagtcggccat

SEQ ID NO: 443084 - DNA, 140 bp, Artificial Sequence
  Synthetic
atggccgactcccaagtacgattagtcaatgacactatcaaaatacatcctacatcataaaaatctacatgactgtattggatcagctgaaatggctaatgaatgttttttgactcttgaggagacccagcatggcgtat

SEQ ID NO: 443085 - DNA, 140 bp, Artificial Sequence
  Synthetic
aggccctggctgctgatatgacaaaactcccggacaatcagaaggcaatttagaaagagtctctcaagaactttagaagaatccttctacaactcagaaatccacgggatcaatcggatggaccttttgggacagcggtg

SEQ ID NO: 443086 - DNA, 140 bp, Artificial Sequence
  Synthetic
caccgctgtcccaaaaggtccatccgattgatcccgtggatttctgagttgtagaaggattcttctaaagttcttgagagactctttctaaattgccttctgattgtccgggagttttgtcatatcagcagccagggcct

SEQ ID NO: 443087 - DNA, 140 bp, Artificial Sequence
  Synthetic
aggccctggctgctgatatgaacagcagagggaagagagcatccaaagggagcaagacctgtggatttgtagatgagagaggcttgtacaaatctctaaaaggagcatgcaaactgaagcgaccttttgggacagcggtg

SEQ ID NO: 443088 - DNA, 140 bp, Artificial Sequence
  Synthetic
caccgctgtcccaaaaggtcgcttcagtttgcatgctccttttagagatttgtacaagcctctctcatctacaaatccacaggtcttgctccctttggatgctctcttccctctgctgttcatatcagcagccagggcct

SEQ ID NO: 443089 - DNA, 140 bp, Artificial Sequence
  Synthetic
aggccctggctgctgatatggatacttgggctcgtccacctccatgtcaacccagctattccatgcatgggaaaaagtcactaatgttcatgtggtgaaaagggctctgtcgttgaaagagaccttttgggacagcggtg

SEQ ID NO: 443090 - DNA, 140 bp, Artificial Sequence
  Synthetic
caccgctgtcccaaaaggtctctttcaacgacagagcccttttcaccacatgaacattagtgactttttcccatgcatggaatagctgggttgacatggaggtggacgagcccaagtatccatatcagcagccagggcct

SEQ ID NO: 443091 - DNA, 140 bp, Artificial Sequence
  Synthetic
aggccctggctgctgatatgctgcacttgtggagtaacaggaggtggaaatcctagaatatcagtgtctgtgcttccttctttcgatcattcattcttttcgagaggctctctaaagggggaccttttgggacagcggtg

SEQ ID NO: 443092 - DNA, 140 bp, Artificial Sequence
  Synthetic
caccgctgtcccaaaaggtccccctttagagagcctctcgaaaagaatgaatgatcgaaagaaggaagcacagacactgatattctaggatttccacctcctgttactccacaagtgcagcatatcagcagccagggcct

SEQ ID NO: 443093 - DNA, 140 bp, Artificial Sequence
  Synthetic
atacgccatgctgggtctccctcactacaaatcggtccggacttggaacgagatcatcccctctaaagggtgtttgagagttggaggcagatgtcatccccatgtgaacggggtgtttttcgtacttgggagtcggccat

SEQ ID NO: 443094 - DNA, 140 bp, Artificial Sequence
  Synthetic
atggccgactcccaagtacgaaaaacaccccgttcacatggggatgacatctgcctccaactctcaaacaccctttagaggggatgatctcgttccaagtccggaccgatttgtagtgagggagacccagcatggcgtat

SEQ ID NO: 443095 - DNA, 140 bp, Artificial Sequence
  Synthetic
atacgccatgctgggtctcctacgattttatgttccagccattgatgctttatgcgcagacatggacatcagagctggtacagagagacacaaggctgagagactccacatttcattggccgtacttgggagtcggccat

SEQ ID NO: 443096 - DNA, 140 bp, Artificial Sequence
  Synthetic
atggccgactcccaagtacggccaatgaaatgtggagtctctcagccttgtgtctctctgtaccagctctgatgtccatgtctgcgcataaagcatcaatggctggaacataaaatcgtaggagacccagcatggcgtat

SEQ ID NO: 443097 - DNA, 140 bp, Artificial Sequence
  Synthetic
atacgccatgctgggtctcccccttaatgcatcctttggcagatccatcaacggtttttaaagatggtgacgaggcggaggattttgttgaggttcaccttccagatgtgcataagcaggcgtacttgggagtcggccat

SEQ ID NO: 443098 - DNA, 140 bp, Artificial Sequence
  Synthetic
atggccgactcccaagtacgcctgcttatgcacatctggaaggtgaacctcaacaaaatcctccgcctcgtcaccatctttaaaaaccgttgatggatctgccaaaggatgcattaagggggagacccagcatggcgtat

SEQ ID NO: 443099 - DNA, 140 bp, Artificial Sequence
  Synthetic
aggccctggctgctgatatgcgaggcggaggattttgttgaggttcaccttccagatgtgcataagcaggtctcaggggtcgatctcggtctcccaagctgggggaagtatgtgttgatggaccttttgggacagcggtg

SEQ ID NO: 443100 - DNA, 140 bp, Artificial Sequence
  Synthetic
caccgctgtcccaaaaggtccatcaacacatacttcccccagcttgggagaccgagatcgacccctgagacctgcttatgcacatctggaaggtgaacctcaacaaaatcctccgcctcgcatatcagcagccagggcct

SEQ ID NO: 443101 - DNA, 140 bp, Artificial Sequence
  Synthetic
atacgccatgctgggtctccgaccaggtgattttgaatctctaagtggtagagaaaagtctcgccatatagggtcggctcagggactcttatactcaatcttagtggcaattcacgactccgtacttgggagtcggccat

SEQ ID NO: 443102 - DNA, 140 bp, Artificial Sequence
  Synthetic
atggccgactcccaagtacggagtcgtgaattgccactaagattgagtataagagtccctgagccgaccctatatggcgagacttttctctaccacttagagattcaaaatcacctggtcggagacccagcatggcgtat

SEQ ID NO: 443103 - DNA, 140 bp, Artificial Sequence
  Synthetic
atacgccatgctgggtctccctccactgcattagaccaggtagagattagttgagaaatacgatttgcctcctatgaaggacacaagcaataggtcacaatcatcctacatcctgataggcgtacttgggagtcggccat

SEQ ID NO: 443104 - DNA, 140 bp, Artificial Sequence
  Synthetic
atggccgactcccaagtacgcctatcaggatgtaggatgattgtgacctattgcttgtgtccttcataggaggcaaatcgtatttctcaactaatctctacctggtctaatgcagtggagggagacccagcatggcgtat

SEQ ID NO: 443105 - DNA, 140 bp, Artificial Sequence
  Synthetic
atacgccatgctgggtctcccagggaggaaagtctcggtaacctcccaaaacgggagggtcatatcttcatgggagtcatacaagagcggaggtgagaccaagctgtaagggcaggtcagcgtacttgggagtcggccat

SEQ ID NO: 443106 - DNA, 140 bp, Artificial Sequence
  Synthetic
atggccgactcccaagtacgctgacctgcccttacagcttggtctcacctccgctcttgtatgactcccatgaagatatgaccctcccgttttgggaggttaccgagactttcctccctgggagacccagcatggcgtat

SEQ ID NO: 443107 - DNA, 140 bp, Artificial Sequence
  Synthetic
aggccctggctgctgatatgtcaagattcttgagacctccattaatcatctcaatctatcagacatggtcatgtagattcttataacacaagaaatcttctagcagttccagtgactaacgaccttttgggacagcggtg

SEQ ID NO: 443108 - DNA, 140 bp, Artificial Sequence
  Synthetic
caccgctgtcccaaaaggtcgttagtcactggaactgctagaagatttcttgtgttataagaatctacatgaccatgtctgatagattgagatgattaatggaggtctcaagaatcttgacatatcagcagccagggcct

SEQ ID NO: 443109 - DNA, 140 bp, Artificial Sequence
  Synthetic
atacgccatgctgggtctccatgtagattcttataacacaagaaatcttctagcagttccagtgactaacggtgcttttaccctccaagaactgacaccaaaggtgatggacaggcctaacgtacttgggagtcggccat

SEQ ID NO: 443110 - DNA, 140 bp, Artificial Sequence
  Synthetic
atggccgactcccaagtacgttaggcctgtccatcacctttggtgtcagttcttggagggtaaaagcaccgttagtcactggaactgctagaagatttcttgtgttataagaatctacatggagacccagcatggcgtat

SEQ ID NO: 443111 - DNA, 140 bp, Artificial Sequence
  Synthetic
aggccctggctgctgatatggactttaggagtgctaaaatgacgtacctgaccctcattacttaccagtctcatctcctactccagagggttgagagaagcttgtcgaagggtatgagaggaccttttgggacagcggtg

SEQ ID NO: 443112 - DNA, 140 bp, Artificial Sequence
  Synthetic
caccgctgtcccaaaaggtcctctcatacccttcgacaagcttctctcaaccctctggagtaggagatgagactggtaagtaatgagggtcaggtacgtcattttagcactcctaaagtccatatcagcagccagggcct

SEQ ID NO: 443113 - DNA, 140 bp, Artificial Sequence
  Synthetic
aggccctggctgctgatatgcctatgaaggacataagcaatagatcaccatcatcttgcatctcagcgaagtgtgcataattataaagggctgggtcattcatgattttcagtcgagaaagaccttttgggacagcggtg

SEQ ID NO: 443114 - DNA, 140 bp, Artificial Sequence
  Synthetic
caccgctgtcccaaaaggtctttctcgactgaaaatcatgaatgacccagccctttataattatgcacacttcgctgagatgcaagatgatggtgatctattgcttatgtccttcataggcatatcagcagccagggcct

SEQ ID NO: 443115 - DNA, 140 bp, Artificial Sequence
  Synthetic
aggccctggctgctgatatgttctttgcgaaggacaaggtgggttgatcaagaggtgcgccatgcagctaaaaccatgactggagattacagccccaacaagaaagtgtctcgcaaggcagaccttttgggacagcggtg

SEQ ID NO: 443116 - DNA, 140 bp, Artificial Sequence
  Synthetic
caccgctgtcccaaaaggtctgccttgcgagacactttcttgttggggctgtaatctccagtcatggttttagctgcatggcgcacctcttgatcaacccaccttgtccttcgcaaagaacatatcagcagccagggcct

SEQ ID NO: 443117 - DNA, 140 bp, Artificial Sequence
  Synthetic
aggccctggctgctgatatgtcaccatgatgattgatccgggagaggtttatgatgacccggtagatccgattgagtcagaggctgaacccagagggactcccactgtccccaacatcttgaccttttgggacagcggtg

SEQ ID NO: 443118 - DNA, 140 bp, Artificial Sequence
  Synthetic
caccgctgtcccaaaaggtcaagatgttggggacagtgggagtccctctgggttcagcctctgactcaatcggatctaccgggtcatcataaacctctcccggatcaatcatcatggtgacatatcagcagccagggcct

SEQ ID NO: 443119 - DNA, 140 bp, Artificial Sequence
  Synthetic
atacgccatgctgggtctccgtacaagtacccggctatcaaggacttgaagaagcccagtataaccttaggaaaagcccctgatttgaacaaagcatacaagtcaattttatccggtatgcgtacttgggagtcggccat

SEQ ID NO: 443120 - DNA, 140 bp, Artificial Sequence
  Synthetic
atggccgactcccaagtacgcataccggataaaattgacttgtatgctttgttcaaatcaggggcttttcctaaggttatactgggcttcttcaagtccttgatagccgggtacttgtacggagacccagcatggcgtat

SEQ ID NO: 443121 - DNA, 140 bp, Artificial Sequence
  Synthetic
atacgccatgctgggtctccggtttcaaaaccctctaatctcgggcctgagagtggttcagtgggcaactggcgcccattataagcttaaacccattctagacgatctcaaggttttccccgtacttgggagtcggccat

SEQ ID NO: 443122 - DNA, 140 bp, Artificial Sequence
  Synthetic
atggccgactcccaagtacggggaaaaccttgagatcgtctagaatgggtttaagcttataatgggcgccagttgcccactgaaccactctcaggcccgagattagagggttttgaaaccggagacccagcatggcgtat

SEQ ID NO: 443123 - DNA, 140 bp, Artificial Sequence
  Synthetic
aggccctggctgctgatatgttgacagacaattgctctaggtcttacaaagtcctgaaggattacttcaagaaggtagatctgggttcccttaaagtgggtggaaccgcagcccagtcgagaccttttgggacagcggtg

SEQ ID NO: 443124 - DNA, 140 bp, Artificial Sequence
  Synthetic
caccgctgtcccaaaaggtctcgactgggctgcggttccacccactttaagggaacccagatctaccttcttgaagtaatccttcaggactttgtaagacctagagcaattgtctgtcaacatatcagcagccagggcct

SEQ ID NO: 443125 - DNA, 140 bp, Artificial Sequence
  Synthetic
aggccctggctgctgatatggtgaatgatctgatggcttccggaacacatccactgcctccgtcagcaatcatgagtggaggagatgacatcgtttccagagtgatagattttgactccagaccttttgggacagcggtg

SEQ ID NO: 443126 - DNA, 140 bp, Artificial Sequence
  Synthetic
caccgctgtcccaaaaggtctggagtcaaaatctatcactctggaaacgatgtcatctcctccactcatgattgctgacggaggcagtggatgtgttccggaagccatcagatcattcaccatatcagcagccagggcct

SEQ ID NO: 443127 - DNA, 140 bp, Artificial Sequence
  Synthetic
atacgccatgctgggtctccgatcttcgaaatccctgaatcaatggacccatcagagatacttgatgataaatcacactctttcactagaacaaggctcgcgtcatggctgtcagaaaaccgtacttgggagtcggccat

SEQ ID NO: 443128 - DNA, 140 bp, Artificial Sequence
  Synthetic
atggccgactcccaagtacggttttctgacagccatgacgcgagccttgttctagtgaaagagtgtgatttatcatcaagtatctctgatgggtccattgattcagggatttcgaagatcggagacccagcatggcgtat

SEQ ID NO: 443129 - DNA, 140 bp, Artificial Sequence
  Synthetic
aggccctggctgctgatatgcctatacatgaatgccctcgactgggatgaagagaagaccatcttagctttatggaaagacttgacgtcagttgatgttgggaaagatttagtcaagttcgaccttttgggacagcggtg

SEQ ID NO: 443130 - DNA, 140 bp, Artificial Sequence
  Synthetic
caccgctgtcccaaaaggtcgaacttgactaaatctttcccaacatcaactgacgtcaagtctttccataaagctaagatggtcttctcttcatcccagtcgagggcattcatgtataggcatatcagcagccagggcct

SEQ ID NO: 443131 - DNA, 140 bp, Artificial Sequence
  Synthetic
aggccctggctgctgatatgacctttttttgtctcgtttcaactctctaatgattttgctttctccccctgagccccggtattcagacgatctgatatcccaactttgccaactatacatgaccttttgggacagcggtg

SEQ ID NO: 443132 - DNA, 140 bp, Artificial Sequence
  Synthetic
caccgctgtcccaaaaggtcatgtatagttggcaaagttgggatatcagatcgtctgaataccggggctcagggggagaaagcaaaatcattagagagttgaaacgagacaaaaaaaggtcatatcagcagccagggcct

SEQ ID NO: 443133 - DNA, 140 bp, Artificial Sequence
  Synthetic
atacgccatgctgggtctccgatgccgagtacttgacctcctccacccttcgggaaatgagccttgtgttattcaattgcagcagccccaagagtgagatgcagagagctcgttccttgacgtacttgggagtcggccat

SEQ ID NO: 443134 - DNA, 140 bp, Artificial Sequence
  Synthetic
atggccgactcccaagtacgtcaaggaacgagctctctgcatctcactcttggggctgctgcaattgaataacacaaggctcatttcccgaagggtggaggaggtcaagtactcggcatcggagacccagcatggcgtat

SEQ ID NO: 443135 - DNA, 140 bp, Artificial Sequence
  Synthetic
atacgccatgctgggtctccactatcaagatcttgtaaggggatttcctgaagagatcatatcgaatccttacaatgagatgatcataactctaattgacaatgatgtagaatcttttctcgtacttgggagtcggccat

SEQ ID NO: 443136 - DNA, 140 bp, Artificial Sequence
  Synthetic
atggccgactcccaagtacgagaaaagattctacatcattgtcaattagagttatgatcatctcattgtaaggattcgatatgatctcttcaggaaatccccttacaagatcttgatagtggagacccagcatggcgtat

SEQ ID NO: 443137 - DNA, 140 bp, Artificial Sequence
  Synthetic
atacgccatgctgggtctccaagtttaggcccctcatccactctttgggggactttcctgtttttataaaggacaaggtgagtcaactcgaggggacattcggtcccagtgcaaaaaggtcgtacttgggagtcggccat

SEQ ID NO: 443138 - DNA, 140 bp, Artificial Sequence
  Synthetic
atggccgactcccaagtacgacctttttgcactgggaccgaatgtcccctcgagttgactcaccttgtcctttataaaaacaggaaagtcccccaaagagtggatgaggggcctaaacttggagacccagcatggcgtat

SEQ ID NO: 443139 - DNA, 140 bp, Artificial Sequence
  Synthetic
aggccctggctgctgatatgaacatttctaagcccttggctgaccccctgttctatccaccgtctgatcctaaaatcctgaggcacttcaacatatgttgcagcactctgatgtatctatgaccttttgggacagcggtg

SEQ ID NO: 443140 - DNA, 140 bp, Artificial Sequence
  Synthetic
caccgctgtcccaaaaggtcatagatacatcagagtgctgcaacatatgttgaagtgcctcaggattttaggatcagacggtggatagaacagggggtcagccaagggcttagaaatgttcatatcagcagccagggcct

SEQ ID NO: 443141 - DNA, 140 bp, Artificial Sequence
  Synthetic
aggccctggctgctgatatgggatttgacaagtactctaaatggtatattgattcgcgacttctccccagagaccaccccttgactccttatatcaaaactcagacatggccacccaaacgaccttttgggacagcggtg

SEQ ID NO: 443142 - DNA, 140 bp, Artificial Sequence
  Synthetic
caccgctgtcccaaaaggtcgtttgggtggccatgtctgagttttgatataaggagtcaaggggtggtctctggggagaagtcgcgaatcaatataccatttagagtacttgtcaaatcccatatcagcagccagggcct

SEQ ID NO: 443143 - DNA, 140 bp, Artificial Sequence
  Synthetic
atacgccatgctgggtctccgaggggggcctgttcctagtgagaaggtcattatcacagctctgtccaagccgcctgtcaatcccagagagttcttaaaatctatcgacctcggcgggttcgtacttgggagtcggccat

SEQ ID NO: 443144 - DNA, 140 bp, Artificial Sequence
  Synthetic
atggccgactcccaagtacgaacccgccgaggtcgatagattttaagaactctctgggattgacaggcggcttggacagagctgtgataatgaccttctcactaggaacaggcccccctcggagacccagcatggcgtat

SEQ ID NO: 443145 - DNA, 140 bp, Artificial Sequence
  Synthetic
aggccctggctgctgatatggatacaatgatgggaccatcttccctgtcaacatatacggcaaagtttcccctagagactatttgagagggctcgcaagaggagtcttgataggatcctcgaccttttgggacagcggtg

SEQ ID NO: 443146 - DNA, 140 bp, Artificial Sequence
  Synthetic
caccgctgtcccaaaaggtcgaggatcctatcaagactcctcttgcgagccctctcaaatagtctctaggggaaactttgccgtatatgttgacagggaagatggtcccatcattgtatccatatcagcagccagggcct

SEQ ID NO: 443147 - DNA, 140 bp, Artificial Sequence
  Synthetic
aggccctggctgctgatatgtttcacaagaactttgaggaagagatacgaagaatgttcgagccagggcaggagactgcggttcctcactcctatttcattcacttccgctcgttgggtcgaccttttgggacagcggtg

SEQ ID NO: 443148 - DNA, 140 bp, Artificial Sequence
  Synthetic
caccgctgtcccaaaaggtcgacccaacgagcggaagtgaatgaaataggagtgaggaaccgcagtctcctgccctggctcgaacattcttcgtatctcttcctcaaagttcttgtgaaacatatcagcagccagggcct

SEQ ID NO: 443149 - DNA, 140 bp, Artificial Sequence
  Synthetic
aggccctggctgctgatatgggaaggctcctgacctgaataaagcatacaagtcagtcctgtctggcatgaacgctgccaagcttgatcctgatgatgtgtgttcctacttggcagctgcgaccttttgggacagcggtg

SEQ ID NO: 443150 - DNA, 140 bp, Artificial Sequence
  Synthetic
caccgctgtcccaaaaggtcgcagctgccaagtaggaacacacatcatcaggatcaagcttggcagcgttcatgccagacaggactgacttgtatgctttattcaggtcaggagccttcccatatcagcagccagggcct

SEQ ID NO: 443151 - DNA, 140 bp, Artificial Sequence
  Synthetic
aggccctggctgctgatatgagatcagacctcatcgggctatgggaggaccaaatatactgcttggatatgtctaacggcccgacctgctggaatggccaagatggcgggctggaaggctgaccttttgggacagcggtg

SEQ ID NO: 443152 - DNA, 140 bp, Artificial Sequence
  Synthetic
caccgctgtcccaaaaggtcagccttccagcccgccatcttggccattccagcaggtcgggccgttagacatatccaagcagtatatttggtcctcccatagcccgatgaggtctgatctcatatcagcagccagggcct

SEQ ID NO: 443153 - DNA, 140 bp, Artificial Sequence
  Synthetic
aggccctggctgctgatatgataaaacgtactgatgtagaaggtaattgggcactgacgggaggtatggaagtgacgagagaccccaccgttgctgaacatgcatctttagttggtcttcgaccttttgggacagcggtg

SEQ ID NO: 443154 - DNA, 140 bp, Artificial Sequence
  Synthetic
caccgctgtcccaaaaggtcgaagaccaactaaagatgcatgttcagcaacggtggggtctctcgtcacttccatacctcccgtcagtgcccaattaccttctacatcagtacgttttatcatatcagcagccagggcct

SEQ ID NO: 443155 - DNA, 140 bp, Artificial Sequence
  Synthetic
atacgccatgctgggtctccacacccctacaatggatgccgacaagattgtattcaaagtcaataatcaggtggtctctttgaagcctgagattatcgtggatcaatatgagtacaagtacgtacttgggagtcggccat

SEQ ID NO: 443156 - DNA, 140 bp, Artificial Sequence
  Synthetic
atggccgactcccaagtacgtacttgtactcatattgatccacgataatctcaggcttcaaagagaccacctgattattgactttgaatacaatcttgtcggcatccattgtaggggtgtggagacccagcatggcgtat

SEQ ID NO: 443157 - DNA, 140 bp, Artificial Sequence
  Synthetic
aggccctggctgctgatatgagttctatgtccaacatatatgttatcgcctgggctatcgagagaggggcttctttatgaactggagagtatatcaagaaatgccctttcaatataccgagaccttttgggacagcggtg

SEQ ID NO: 443158 - DNA, 140 bp, Artificial Sequence
  Synthetic
caccgctgtcccaaaaggtctcggtatattgaaagggcatttcttgatatactctccagttcataaagaagcccctctctcgatagcccaggcgataacatatatgttggacatagaactcatatcagcagccagggcct

SEQ ID NO: 443159 - DNA, 140 bp, Artificial Sequence
  Synthetic
aggccctggctgctgatatgaacttggtccttggagcccgatcgacatacatcatctcagctgcccaaacaatttggttgtggaggacgaaggatgcaccaacctgtcagggttctcctagaccttttgggacagcggtg

SEQ ID NO: 443160 - DNA, 140 bp, Artificial Sequence
  Synthetic
caccgctgtcccaaaaggtctaggagaaccctgacaggttggtgcatccttcgtcctccacaaccaaattgtttgggcagctgagatgatgtatgtcgatcgggctccaaggaccaagttcatatcagcagccagggcct

SEQ ID NO: 443161 - DNA, 140 bp, Artificial Sequence
  Synthetic
aggccctggctgctgatatggaccatgtgtagctatgactttctcatctacgggaaaactccattgtttcgaggtaacatcttggtgcctgagtcaaaaagatgggccagagtctcttgcgaccttttgggacagcggtg

SEQ ID NO: 443162 - DNA, 140 bp, Artificial Sequence
  Synthetic
caccgctgtcccaaaaggtcgcaagagactctggcccatctttttgactcaggcaccaagatgttacctcgaaacaatggagttttcccgtagatgagaaagtcatagctacacatggtccatatcagcagccagggcct

SEQ ID NO: 443163 - DNA, 140 bp, Artificial Sequence
  Synthetic
atacgccatgctgggtctccggttcataaagcaaataaatctcaccgcgagagaggcaatcctatatttcttccacaagaactttgaggaagaaataagaagaatgttcgaaccagggcacgtacttgggagtcggccat

SEQ ID NO: 443164 - DNA, 140 bp, Artificial Sequence
  Synthetic
atggccgactcccaagtacgtgccctggttcgaacattcttcttatttcttcctcaaagttcttgtggaagaaatataggattgcctctctcgcggtgagatttatttgctttatgaaccggagacccagcatggcgtat

SEQ ID NO: 443165 - DNA, 140 bp, Artificial Sequence
  Synthetic
aggccctggctgctgatatgtgagggactttctgcttatgtcagtgcaggcagtctttcactacttgctgttcagccccatcttaaagggtagagtctacaaaattctaagcgctgaggggaccttttgggacagcggtg

SEQ ID NO: 443166 - DNA, 140 bp, Artificial Sequence
  Synthetic
caccgctgtcccaaaaggtcccctcagcgcttagaattttgtagactctaccctttaagatggggctgaacagcaagtagtgaaagactgcctgcactgacataagcagaaagtccctcacatatcagcagccagggcct

SEQ ID NO: 443167 - DNA, 140 bp, Artificial Sequence
  Synthetic
aggccctggctgctgatatgctcattcactttgtcggatgttatatgggtcaggtcaggtctcttaatgccacggttattgccgcttgtgccccccatgaaatgtcagttctcggaggctgaccttttgggacagcggtg

SEQ ID NO: 443168 - DNA, 140 bp, Artificial Sequence
  Synthetic
caccgctgtcccaaaaggtcagcctccgagaactgacatttcatggggggcacaagcggcaataaccgtggcattaagagacctgacctgacccatataacatccgacaaagtgaatgagcatatcagcagccagggcct

SEQ ID NO: 443169 - DNA, 140 bp, Artificial Sequence
  Synthetic
aggccctggctgctgatatgtgacgtagcactggcagacgacggaaccgtcaattctgatgacgaggattacttctccggtgagacgaggagccctgaggccgtctatactcgaatcatggaccttttgggacagcggtg

SEQ ID NO: 443170 - DNA, 140 bp, Artificial Sequence
  Synthetic
caccgctgtcccaaaaggtccatgattcgagtatagacggcctcagggctcctcgtctcaccggagaagtaatcctcgtcatcagaattgacggttccgtcgtctgccagtgctacgtcacatatcagcagccagggcct

SEQ ID NO: 443171 - DNA, 140 bp, Artificial Sequence
  Synthetic
aggccctggctgctgatatgactactttaaatatcaagggaggggcaagccccactatcttactcaaggatgcgatcaggaaagccctgtatgacgaagtagataaggtagagaactctggaccttttgggacagcggtg

SEQ ID NO: 443172 - DNA, 140 bp, Artificial Sequence
  Synthetic
caccgctgtcccaaaaggtccagagttctctaccttatctacttcgtcatacagggctttcctgatcgcatccttgagtaagatagtggggcttgcccctcccttgatatttaaagtagtcatatcagcagccagggcct

SEQ ID NO: 443173 - DNA, 140 bp, Artificial Sequence
  Synthetic
aggccctggctgctgatatgatgaacggaggtcgactaaagagatcacacataaggagatatgttgccgtcagttctaaccatcaagcccgcccaaactcatttgccgagtttctaagcagaccttttgggacagcggtg

SEQ ID NO: 443174 - DNA, 140 bp, Artificial Sequence
  Synthetic
caccgctgtcccaaaaggtctgcttagaaactcggcaaatgagtttgggcgggcttgatggttagaactgacggcaacatatctccttatgtgtgatctctttagtcgacctccgttcatcatatcagcagccagggcct

SEQ ID NO: 443175 - DNA, 140 bp, Artificial Sequence
  Synthetic
aggccctggctgctgatatgtttcagctcctccttcttggggattcctgagtcaatcatcggattgatacaaaactctcggacaataagaagacagtttagaaaaagcctctcaagaactgaccttttgggacagcggtg

SEQ ID NO: 443176 - DNA, 140 bp, Artificial Sequence
  Synthetic
caccgctgtcccaaaaggtcagttcttgagaggctttttctaaactgtcttcttattgtccgagagttttgtatcaatccgatgattgactcaggaatccccaagaaggaggagctgaaacatatcagcagccagggcct

SEQ ID NO: 443177 - DNA, 140 bp, Artificial Sequence
  Synthetic
aggccctggctgctgatatggaaccatcccaaacatgagcaagatctttgtcaatccgagcgcaatcagagccggtttggctgatctcgaaatggctgaggagactgttgatctaatcaagaccttttgggacagcggtg

SEQ ID NO: 443178 - DNA, 140 bp, Artificial Sequence
  Synthetic
caccgctgtcccaaaaggtcttgattagatcaacagtctcctcagccatttcgagatcagccaaaccggctctgattgcgctcggattgacaaagatcttgctcatgtttgggatggttccatatcagcagccagggcct

SEQ ID NO: 443179 - DNA, 140 bp, Artificial Sequence
  Synthetic
aggccctggctgctgatatgacctagacaatgttggagtccaaatagtcagacagatgaggtcaggagagagattcctcaagatctggtcacaaaccgtggaggaaatcatctcctatgtgaccttttgggacagcggtg

SEQ ID NO: 443180 - DNA, 140 bp, Artificial Sequence
  Synthetic
caccgctgtcccaaaaggtcacataggagatgatttcctccacggtttgtgaccagatcttgaggaatctctctcctgacctcatctgtctgactatttggactccaacattgtctaggtcatatcagcagccagggcct

SEQ ID NO: 443181 - DNA, 140 bp, Artificial Sequence
  Synthetic
atacgccatgctgggtctccccataaactggttcatcacaagaaactcaaatttggctcagactctgattagaaacatcatgtctctaacgggtcctgattttcctctagaagaggcccccgtacttgggagtcggccat

SEQ ID NO: 443182 - DNA, 140 bp, Artificial Sequence
  Synthetic
atggccgactcccaagtacgggggcctcttctagaggaaaatcaggacccgttagagacatgatgtttctaatcagagtctgagccaaatttgagtttcttgtgatgaaccagtttatggggagacccagcatggcgtat

SEQ ID NO: 443183 - DNA, 140 bp, Artificial Sequence
  Synthetic
atacgccatgctgggtctcctcaatggtatcatcctgggtcctgatggacatgttctaatcccagagatgcagtcgtctctccttcgacagcatatggagttgttggaatcctcggtaatcgtacttgggagtcggccat

SEQ ID NO: 443184 - DNA, 140 bp, Artificial Sequence
  Synthetic
atggccgactcccaagtacgattaccgaggattccaacaactccatatgctgtcgaaggagagacgactgcatctctgggattagaacatgtccatcaggacccaggatgataccattgaggagacccagcatggcgtat

SEQ ID NO: 443185 - DNA, 140 bp, Artificial Sequence
  Synthetic
aggccctggctgctgatatgctccgatgtaacaggtgtgtaaggccaatcgacgatatcacactggagacctctcaggtcttcgagtttccggatgtgtcgaaaagaatatctaggatgggaccttttgggacagcggtg

SEQ ID NO: 443186 - DNA, 140 bp, Artificial Sequence
  Synthetic
caccgctgtcccaaaaggtcccatcctagatattcttttcgacacatccggaaactcgaagacctgagaggtctccagtgtgatatcgtcgattggccttacacacctgttacatcggagcatatcagcagccagggcct

SEQ ID NO: 443187 - DNA, 140 bp, Artificial Sequence
  Synthetic
atacgccatgctgggtctcccctggagattttgaatctttaagtggtagggaaaaatcccgtcacatagggtctgctcaagggctcctatattcgatcttggtcgcaatacatgactcagcgtacttgggagtcggccat

SEQ ID NO: 443188 - DNA, 140 bp, Artificial Sequence
  Synthetic
atggccgactcccaagtacgctgagtcatgtattgcgaccaagatcgaatataggagcccttgagcagaccctatgtgacgggatttttccctaccacttaaagattcaaaatctccaggggagacccagcatggcgtat

SEQ ID NO: 443189 - DNA, 140 bp, Artificial Sequence
  Synthetic
atacgccatgctgggtctcctcctgattgcacggaggggagacaagatcactccagattctcttgtagacataaaacgtactcatgtggaagggaattgggctctaacagggggtatggacgtacttgggagtcggccat

SEQ ID NO: 443190 - DNA, 140 bp, Artificial Sequence
  Synthetic
atggccgactcccaagtacgtccataccccctgttagagcccaattcccttccacatgagtacgttttatgtctacaagagaatctggagtgatcttgtctcccctccgtgcaatcaggaggagacccagcatggcgtat

SEQ ID NO: 443191 - DNA, 140 bp, Artificial Sequence
  Synthetic
aggccctggctgctgatatgcctgaatatgtcccgttgaaagaactcacaggcaagaaaaacatgaggaacttctgtgtcaatggagaggtcaaagtgtgcagtcccaacggctactcgtgaccttttgggacagcggtg

SEQ ID NO: 443192 - DNA, 140 bp, Artificial Sequence
  Synthetic
caccgctgtcccaaaaggtcacgagtagccgttgggactgcacactttgacctctccattgacacagaagttcctcatgtttttcttgcctgtgagttctttcaacgggacatattcaggcatatcagcagccagggcct

SEQ ID NO: 443193 - DNA, 140 bp, Artificial Sequence
  Synthetic
aggccctggctgctgatatgcatctgctttttgaccagaatgactaatatcaacattaacaggcctctcgagttgatctcaggcgtgatctcatatatcctcttgaggctagataatcacgaccttttgggacagcggtg

SEQ ID NO: 443194 - DNA, 140 bp, Artificial Sequence
  Synthetic
caccgctgtcccaaaaggtcgtgattatctagcctcaagaggatatatgagatcacgcctgagatcaactcgagaggcctgttaatgttgatattagtcattctggtcaaaaagcagatgcatatcagcagccagggcct

SEQ ID NO: 443195 - DNA, 140 bp, Artificial Sequence
  Synthetic
aggccctggctgctgatatgatctaccgctttaggcgacgtccctaacttcgcaagacttcatgacctgtataacagacctataacttgttacttcagaaaacaagttattcgagggaatgaccttttgggacagcggtg

SEQ ID NO: 443196 - DNA, 140 bp, Artificial Sequence
  Synthetic
caccgctgtcccaaaaggtcattccctcgaataacttgttttctgaagtaacaagttataggtctgttatacaggtcatgaagtcttgcgaagttagggacgtcgcctaaagcggtagatcatatcagcagccagggcct

SEQ ID NO: 443197 - DNA, 140 bp, Artificial Sequence
  Synthetic
aggccctggctgctgatatgaggagctccagtccctgagggcatgaattgggtatacaaattgaggagaaccctcatcttccaatgggccgattctaggggtccccttgagggggaggaagaccttttgggacagcggtg

SEQ ID NO: 443198 - DNA, 140 bp, Artificial Sequence
  Synthetic
caccgctgtcccaaaaggtcttcctccccctcaaggggacccctagaatcggcccattggaagatgagggttctcctcaatttgtatacccaattcatgccctcagggactggagctcctcatatcagcagccagggcct

SEQ ID NO: 443199 - DNA, 140 bp, Artificial Sequence
  Synthetic
aggccctggctgctgatatggtaatagatctatcttgtgttacctccaacatgtgctgcgctatgagcgagaggttattacagcatctccagagaatgactggttgtggatcttctcggagaccttttgggacagcggtg

SEQ ID NO: 443200 - DNA, 140 bp, Artificial Sequence
  Synthetic
caccgctgtcccaaaaggtctccgagaagatccacaaccagtcattctctggagatgctgtaataacctctcgctcatagcgcagcacatgttggaggtaacacaagatagatctattaccatatcagcagccagggcct

SEQ ID NO: 443201 - DNA, 140 bp, Artificial Sequence
  Synthetic
aggccctggctgctgatatgttggaatactctcaagagatcacttgggacgatgatactgagtttgtcggattacaaataagagtgagtgcaagacaatgtcatatccaaggcagagtatgaccttttgggacagcggtg

SEQ ID NO: 443202 - DNA, 140 bp, Artificial Sequence
  Synthetic
caccgctgtcccaaaaggtcatactctgccttggatatgacattgtcttgcactcactcttatttgtaatccgacaaactcagtatcatcgtcccaagtgatctcttgagagtattccaacatatcagcagccagggcct

SEQ ID NO: 443203 - DNA, 140 bp, Artificial Sequence
  Synthetic
aggccctggctgctgatatgatcttctacttcagagggttgaaagaaatttgtcgaagagtatgagagctaacctgcgacagatgagttccttgatgaggcaggtgctaggagggcatgggaccttttgggacagcggtg

SEQ ID NO: 443204 - DNA, 140 bp, Artificial Sequence
  Synthetic
caccgctgtcccaaaaggtcccatgccctcctagcacctgcctcatcaaggaactcatctgtcgcaggttagctctcatactcttcgacaaatttctttcaaccctctgaagtagaagatcatatcagcagccagggcct

SEQ ID NO: 443205 - DNA, 140 bp, Artificial Sequence
  Synthetic
aggccctggctgctgatatgaaaaatgtaacacccctacaatggattctgacaagattgtgttcaaagtcaacaatcaggtggtctccctgaagccagaaattattgttgatcaatatgagaccttttgggacagcggtg

SEQ ID NO: 443206 - DNA, 140 bp, Artificial Sequence
  Synthetic
caccgctgtcccaaaaggtctcatattgatcaacaataatttctggcttcagggagaccacctgattgttgactttgaacacaatcttgtcagaatccattgtaggggtgttacatttttcatatcagcagccagggcct

SEQ ID NO: 443207 - DNA, 140 bp, Artificial Sequence
  Synthetic
aggccctggctgctgatatgatagtcagattatatcccacagatttgtcacttttttacctctggaggagagaacatacgggcttaactccaacctttgggagcaatagaacaaaaatatgaccttttgggacagcggtg

SEQ ID NO: 443208 - DNA, 140 bp, Artificial Sequence
  Synthetic
caccgctgtcccaaaaggtcatatttttgttctattgctcccaaaggttggagttaagcccgtatgttctctcctccagaggtaaaaaagtgacaaatctgtgggatataatctgactatcatatcagcagccagggcct

SEQ ID NO: 443209 - DNA, 140 bp, Artificial Sequence
  Synthetic
aggccctggctgctgatatgctaacccggcccctgtctcagagcttgacataagggccctctccaggaggtttcagaaccctctcatctcgggattaagagtggttcagtgggcaactgggaccttttgggacagcggtg

SEQ ID NO: 443210 - DNA, 140 bp, Artificial Sequence
  Synthetic
caccgctgtcccaaaaggtcccagttgcccactgaaccactcttaatcccgagatgagagggttctgaaacctcctggagagggcccttatgtcaagctctgagacaggggccgggttagcatatcagcagccagggcct

SEQ ID NO: 443211 - DNA, 140 bp, Artificial Sequence
  Synthetic
aggccctggctgctgatatgaacttggcccttggagtcctattgacatacatcatctcagttgccctaacaatttagttgtggaggatgaggggtgcaccaacctgtcaggattttcctagaccttttgggacagcggtg

SEQ ID NO: 443212 - DNA, 140 bp, Artificial Sequence
  Synthetic
caccgctgtcccaaaaggtctaggaaaatcctgacaggttggtgcacccctcatcctccacaactaaattgttagggcaactgagatgatgtatgtcaataggactccaagggccaagttcatatcagcagccagggcct

SEQ ID NO: 443213 - DNA, 140 bp, Artificial Sequence
  Synthetic
aggccctggctgctgatatgctcaacatgtttccagatgccaggcttgtattcaatagcttgttggaggtgaatgacctgatggcatccggaacacatccattacctccctcagcaatcagaccttttgggacagcggtg

SEQ ID NO: 443214 - DNA, 140 bp, Artificial Sequence
  Synthetic
caccgctgtcccaaaaggtctgattgctgagggaggtaatggatgtgttccggatgccatcaggtcattcacctccaacaagctattgaatacaagcctggcatctggaaacatgttgagcatatcagcagccagggcct

SEQ ID NO: 443215 - DNA, 140 bp, Artificial Sequence
  Synthetic
atacgccatgctgggtctcccttgcacgggtgtggtgacagaagcagagacctacacaaactttgtcggctacgtcaccaccacatttaagaggaagcacttccgcccgacaccagatgccgtacttgggagtcggccat

SEQ ID NO: 443216 - DNA, 140 bp, Artificial Sequence
  Synthetic
atggccgactcccaagtacggcatctggtgtcgggcggaagtgcttcctcttaaatgtggtggtgacgtagccgacaaagtttgtgtaggtctctgcttctgtcaccacacccgtgcaagggagacccagcatggcgtat

SEQ ID NO: 443217 - DNA, 140 bp, Artificial Sequence
  Synthetic
aggccctggctgctgatatgtgggagaaaccatcggatctcaggaacttgaccacatggaagtacttccagtcagtccaaaggaaggtgaacatgtcttatgacctcatcatttgtgatggaccttttgggacagcggtg

SEQ ID NO: 443218 - DNA, 140 bp, Artificial Sequence
  Synthetic
caccgctgtcccaaaaggtccatcacaaatgatgaggtcataagacatgttcaccttcctttggactgactggaagtacttccatgtggtcaagttcctgagatccgatggtttctcccacatatcagcagccagggcct

SEQ ID NO: 443219 - DNA, 140 bp, Artificial Sequence
  Synthetic
aggccctggctgctgatatgaccaccaaggagtctcttgttatcatatctccgagtgtgtcggacttagacccgtacgataaatctcttcattccagagtttttcccagcggtaaatgctgaccttttgggacagcggtg

SEQ ID NO: 443220 - DNA, 140 bp, Artificial Sequence
  Synthetic
caccgctgtcccaaaaggtcagcatttaccgctgggaaaaactctggaatgaagagatttatcgtacgggtctaagtccgacacactcggagatatgataacaagagactccttggtggtcatatcagcagccagggcct

SEQ ID NO: 443221 - DNA, 140 bp, Artificial Sequence
  Synthetic
aggccctggctgctgatatgccctggagtccgattgacatacatcacctcagctgcccaaacaatttggtagtggaggacgaaggatgcaccaacctgtcagggttctcctacatggaacgaccttttgggacagcggtg

SEQ ID NO: 443222 - DNA, 140 bp, Artificial Sequence
  Synthetic
caccgctgtcccaaaaggtcgttccatgtaggagaaccctgacaggttggtgcatccttcgtcctccactaccaaattgtttgggcagctgaggtgatgtatgtcaatcggactccagggcatatcagcagccagggcct

SEQ ID NO: 443223 - DNA, 140 bp, Artificial Sequence
  Synthetic
aggccctggctgctgatatgtgggactatgctggtaaatccagaatatagagcaattcaacacctgtcaagggcattcccttcagttacaggatttataacccagatgacttcgtcctttgaccttttgggacagcggtg

SEQ ID NO: 443224 - DNA, 140 bp, Artificial Sequence
  Synthetic
caccgctgtcccaaaaggtcaaaggacgaagtcatctgggttataaatcctgtaactgaagggaatgcccttgacaggtgttgaattgctctatattctggatttaccagcatagtcccacatatcagcagccagggcct

SEQ ID NO: 443225 - DNA, 140 bp, Artificial Sequence
  Synthetic
atacgccatgctgggtctccgggcattcccttcagttacaggatttataacccagatgacttcgtccttttcatctgagctataccttcgattctccaaacgaggaaaattcttccgagacgtacttgggagtcggccat

SEQ ID NO: 443226 - DNA, 140 bp, Artificial Sequence
  Synthetic
atggccgactcccaagtacgtctcggaagaattttcctcgtttggagaatcgaaggtatagctcagatgaaaaggacgaagtcatctgggttataaatcctgtaactgaagggaatgcccggagacccagcatggcgtat

SEQ ID NO: 443227 - DNA, 140 bp, Artificial Sequence
  Synthetic
aggccctggctgctgatatgcaatagcagagggaagagagcatccaaagggagcaagacctgtggatttgtggacgaaaggggcttgtacaggtctctaaaaggggcatgcaaattgaaagaccttttgggacagcggtg

SEQ ID NO: 443228 - DNA, 140 bp, Artificial Sequence
  Synthetic
caccgctgtcccaaaaggtctttcaatttgcatgccccttttagagacctgtacaagcccctttcgtccacaaatccacaggtcttgctccctttggatgctctcttccctctgctattgcatatcagcagccagggcct

SEQ ID NO: 443229 - DNA, 140 bp, Artificial Sequence
  Synthetic
aggccctggctgctgatatgctatgtggagttcttggacttagacttatggacggaacatgggctgcgattcaaacatctgatgaggccaaatggtgccctcctgatcagttggtgaatagaccttttgggacagcggtg

SEQ ID NO: 443230 - DNA, 140 bp, Artificial Sequence
  Synthetic
caccgctgtcccaaaaggtctattcaccaactgatcaggagggcaccatttggcctcatcagatgtttgaatcgcagcccatgttccgtccataagtctaagtccaagaactccacatagcatatcagcagccagggcct

SEQ ID NO: 443231 - DNA, 140 bp, Artificial Sequence
  Synthetic
aggccctggctgctgatatgtaccaagatcttgtaagaggattcccagaggagattatatccaatccttacaatgagatgatcataaccttgattgacagtgatgtggaatccttcctgggaccttttgggacagcggtg

SEQ ID NO: 443232 - DNA, 140 bp, Artificial Sequence
  Synthetic
caccgctgtcccaaaaggtcccaggaaggattccacatcactgtcaatcaaggttatgatcatctcattgtaaggattggatataatctcctctgggaatcctcttacaagatcttggtacatatcagcagccagggcct

SEQ ID NO: 443233 - DNA, 140 bp, Artificial Sequence
  Synthetic
aggccctggctgctgatatggtaaagaaaagggaagagtgtctagatgcactggagtctatcatgaccaccaagtccgtaagtttcagacgcctcagtcacttgaggaagctcgtccccggaccttttgggacagcggtg

SEQ ID NO: 443234 - DNA, 140 bp, Artificial Sequence
  Synthetic
caccgctgtcccaaaaggtccggggacgagcttcctcaagtgactgaggcgtctgaaacttacggacttggtggtcatgatagactccagtgcatctagacactcttcccttttctttaccatatcagcagccagggcct

SEQ ID NO: 443235 - DNA, 140 bp, Artificial Sequence
  Synthetic
atacgccatgctgggtctcccaagtccgtaagtttcagacgcctcagtcacttgaggaagctcgtccccgggtttgggaaagcatataccatattcaacaaaaccttgatggaggctgatcgtacttgggagtcggccat

SEQ ID NO: 443236 - DNA, 140 bp, Artificial Sequence
  Synthetic
atggccgactcccaagtacgatcagcctccatcaaggttttgttgaatatggtatatgctttcccaaacccggggacgagcttcctcaagtgactgaggcgtctgaaacttacggacttgggagacccagcatggcgtat

SEQ ID NO: 443237 - DNA, 140 bp, Artificial Sequence
  Synthetic
aggccctggctgctgatatgatgtttaagagttggggggagatgtcacccccatgtaaacggggtgtttttcaatggtatcatcctgggtcctgatggacatgttctaatcccagagatggaccttttgggacagcggtg

SEQ ID NO: 443238 - DNA, 140 bp, Artificial Sequence
  Synthetic
caccgctgtcccaaaaggtccatctctgggattagaacatgtccatcaggacccaggatgataccattgaaaaacaccccgtttacatgggggtgacatctccccccaactcttaaacatcatatcagcagccagggcct

SEQ ID NO: 443239 - DNA, 140 bp, Artificial Sequence
  Synthetic
aggccctggctgctgatatgcctatgtgttgtgtacattccacatgaaaaaaactaacacccctcctcttgaaccatctcgaacatgagcaagatctttgtcaatccgagtgcaatcagagaccttttgggacagcggtg

SEQ ID NO: 443240 - DNA, 140 bp, Artificial Sequence
  Synthetic
caccgctgtcccaaaaggtctctgattgcactcggattgacaaagatcttgctcatgttcgagatggttcaagaggaggggtgttagtttttttcatgtggaatgtacacaacacataggcatatcagcagccagggcct

SEQ ID NO: 443241 - DNA, 140 bp, Artificial Sequence
  Synthetic
aggccctggctgctgatatgatctgtcttggagttggtctgatgatacctctgtgttcaagagggtggcttgtaactctagcttgagtctgtcgtctcactggatcaggctgatctacaagaccttttgggacagcggtg

SEQ ID NO: 443242 - DNA, 140 bp, Artificial Sequence
  Synthetic
caccgctgtcccaaaaggtcttgtagatcagcctgatccagtgagacgacagactcaagctagagttacaagccaccctcttgaacacagaggtatcatcagaccaactccaagacagatcatatcagcagccagggcct

SEQ ID NO: 443243 - DNA, 140 bp, Artificial Sequence
  Synthetic
aggccctggctgctgatatgatcagatctagatcatctctattagactacagctgcttatgagcggaacatcattgaggcttgtaaatactgaagctcttagatggtgtaccctgaaaaagaccttttgggacagcggtg

SEQ ID NO: 443244 - DNA, 140 bp, Artificial Sequence
  Synthetic
caccgctgtcccaaaaggtctttttcagggtacaccatctaagagcttcagtatttacaagcctcaatgatgttccgctcataagcagctgtagtctaatagagatgatctagatctgatcatatcagcagccagggcct

SEQ ID NO: 443245 - DNA, 140 bp, Artificial Sequence
  Synthetic
atacgccatgctgggtctcctcattgaggcttgtaaatactgaagctcttagatggtgtaccctgaaaaaaacaagatcccaaatcagaacctctggttgcttgattatttttttcatctcgtacttgggagtcggccat

SEQ ID NO: 443246 - DNA, 140 bp, Artificial Sequence
  Synthetic
atggccgactcccaagtacgagatgaaaaaaataatcaagcaaccagaggttctgatttgggatcttgtttttttcagggtacaccatctaagagcttcagtatttacaagcctcaatgaggagacccagcatggcgtat

SEQ ID NO: 443247 - DNA, 140 bp, Artificial Sequence
  Synthetic
aggccctggctgctgatatgacgggaaggaaagtgtcggtcacctcccaaagcgggagggtcatatcttcatgggagtcgtataaaagcgggggtgagaccaagctgtagatacaagccagaccttttgggacagcggtg

SEQ ID NO: 443248 - DNA, 140 bp, Artificial Sequence
  Synthetic
caccgctgtcccaaaaggtctggcttgtatctacagcttggtctcacccccgcttttatacgactcccatgaagatatgaccctcccgctttgggaggtgaccgacactttccttcccgtcatatcagcagccagggcct

SEQ ID NO: 443249 - DNA, 140 bp, Artificial Sequence
  Synthetic
aggccctggctgctgatatgcaatctgggagaaaccgtcagacctgagaaacttgacaacctggaaatacttccagtcagtccaaaaacaagtaaatatgtcttatgaccttattatctggaccttttgggacagcggtg

SEQ ID NO: 443250 - DNA, 140 bp, Artificial Sequence
  Synthetic
caccgctgtcccaaaaggtccagataataaggtcataagacatatttacttgtttttggactgactggaagtatttccaggttgtcaagtttctcaggtctgacggtttctcccagattgcatatcagcagccagggcct

SEQ ID NO: 443251 - DNA, 140 bp, Artificial Sequence
  Synthetic
atacgccatgctgggtctccgcagactgtcgatcgtgaactctcaaaggatacaaaatctgcctcttctcagcgagcaagtcaaccatcaaaagttaaaatggcagcccaaactgcctctcgtacttgggagtcggccat

SEQ ID NO: 443252 - DNA, 140 bp, Artificial Sequence
  Synthetic
atggccgactcccaagtacgagaggcagtttgggctgccattttaacttttgatggttgacttgctcgctgagaagaggcagattttgtatcctttgagagttcacgatcgacagtctgcggagacccagcatggcgtat

SEQ ID NO: 443253 - DNA, 140 bp, Artificial Sequence
  Synthetic
atacgccatgctgggtctccttcaagagtcacaagactttcattaatcatctcaatcgatcagatatggttgtgtagattctcataatacaagagatcttctagcagttccagtgaccaacgtacttgggagtcggccat

SEQ ID NO: 443254 - DNA, 140 bp, Artificial Sequence
  Synthetic
atggccgactcccaagtacgttggtcactggaactgctagaagatctcttgtattatgagaatctacacaaccatatctgatcgattgagatgattaatgaaagtcttgtgactcttgaaggagacccagcatggcgtat

SEQ ID NO: 443255 - DNA, 140 bp, Artificial Sequence
  Synthetic
aggccctggctgctgatatgctgtagaggcagagatcgctcatcagattgctgagagcttttccaagaagtacaaattcccttccaggtcatcagggatatttctgtataattttgagcagaccttttgggacagcggtg

SEQ ID NO: 443256 - DNA, 140 bp, Artificial Sequence
  Synthetic
caccgctgtcccaaaaggtctgctcaaaattatacagaaatatccctgatgacctggaagggaatttgtacttcttggaaaagctctcagcaatctgatgagcgatctctgcctctacagcatatcagcagccagggcct

SEQ ID NO: 443257 - DNA, 140 bp, Artificial Sequence
  Synthetic
aggccctggctgctgatatgatatccagatactagactgggtaagagttgatcaagaaaggaaacttgcctcctatgaaggacagaagcaatagatcactatcaccttgcatctcagcaagaccttttgggacagcggtg

SEQ ID NO: 443258 - DNA, 140 bp, Artificial Sequence
  Synthetic
caccgctgtcccaaaaggtcttgctgagatgcaaggtgatagtgatctattgcttctgtccttcataggaggcaagtttcctttcttgatcaactcttacccagtctagtatctggatatcatatcagcagccagggcct

SEQ ID NO: 443259 - DNA, 140 bp, Artificial Sequence
  Synthetic
aggccctggctgctgatatgctggggtgggtagccctagccaactctaagaagttccagctattagtcgagccagacaagctgaacaaaatcatgcaggatgatctgaaccgttatacatgaccttttgggacagcggtg

SEQ ID NO: 443260 - DNA, 140 bp, Artificial Sequence
  Synthetic
caccgctgtcccaaaaggtcatgtataacggttcagatcatcctgcatgattttgttcagcttgtctggctcgactaatagctggaacttcttagagttggctagggctacccaccccagcatatcagcagccagggcct

SEQ ID NO: 443261 - DNA, 140 bp, Artificial Sequence
  Synthetic
aggccctggctgctgatatgcttgttgaccaattctcccactcaggcccatcagacaattgagcctgagttgttttgaaattgacatgaaaaaaacaggcaacaccactgataagatgaagaccttttgggacagcggtg

SEQ ID NO: 443262 - DNA, 140 bp, Artificial Sequence
  Synthetic
caccgctgtcccaaaaggtcttcatcttatcagtggtgttgcctgtttttttcatgtcaatttcaaaacaactcaggctcaattgtctgatgggcctgagtgggagaattggtcaacaagcatatcagcagccagggcct

SEQ ID NO: 443263 - DNA, 140 bp, Artificial Sequence
  Synthetic
aggccctggctgctgatatgaattgagtcagaggccgaacctagaggatctcccactgtccccaacatcctgaggaactctgactataatctcaactcccctctaatagaagatcctgccgaccttttgggacagcggtg

SEQ ID NO: 443264 - DNA, 140 bp, Artificial Sequence
  Synthetic
caccgctgtcccaaaaggtcggcaggatcttctattagaggggagttgagattatagtcagagttcctcaggatgttggggacagtgggagatcctctaggttcggcctctgactcaattcatatcagcagccagggcct

SEQ ID NO: 443265 - DNA, 140 bp, Artificial Sequence
  Synthetic
aggccctggctgctgatatgcttaacagacaactgctctaggtcttataaagtctttaaagattacttcaagaagttagatttgggatctgttaaagtaggtggaactgcagcccagtcggaccttttgggacagcggtg

SEQ ID NO: 443266 - DNA, 140 bp, Artificial Sequence
  Synthetic
caccgctgtcccaaaaggtccgactgggctgcagttccacctactttaacagatcccaaatctaacttcttgaagtaatctttaaagactttataagacctagagcagttgtctgttaagcatatcagcagccagggcct

SEQ ID NO: 443267 - DNA, 140 bp, Artificial Sequence
  Synthetic
atacgccatgctgggtctccagaagttagatttgggatctgttaaagtaggtggaactgcagcccagtcgatgatctctctctggttgtatggtgcccactctgaatcaaacaggagccgcgtacttgggagtcggccat

SEQ ID NO: 443268 - DNA, 140 bp, Artificial Sequence
  Synthetic
atggccgactcccaagtacgcggctcctgtttgattcagagtgggcaccatacaaccagagagagatcatcgactgggctgcagttccacctactttaacagatcccaaatctaacttctggagacccagcatggcgtat

SEQ ID NO: 443269 - DNA, 140 bp, Artificial Sequence
  Synthetic
aggccctggctgctgatatgtgtcatctcactggatcaggttgatctacaagatagtgaagactaccagactcattggcagcataaaagacctatcaggagaggtagaacgacatcttcagaccttttgggacagcggtg

SEQ ID NO: 443270 - DNA, 140 bp, Artificial Sequence
  Synthetic
caccgctgtcccaaaaggtctgaagatgtcgttctacctctcctgataggtcttttatgctgccaatgagtctggtagtcttcactatcttgtagatcaacctgatccagtgagatgacacatatcagcagccagggcct

SEQ ID NO: 443271 - DNA, 140 bp, Artificial Sequence
  Synthetic
aggccctggctgctgatatgattacaagtgagagtaagtgcaagacagtgtcatatccagggcagagtctggtgtatcaacatgaattccagagcgtgtcaattatggtctgacatgtctgaccttttgggacagcggtg

SEQ ID NO: 443272 - DNA, 140 bp, Artificial Sequence
  Synthetic
caccgctgtcccaaaaggtcagacatgtcagaccataattgacacgctctggaattcatgttgatacaccagactctgccctggatatgacactgtcttgcacttactctcacttgtaatcatatcagcagccagggcct

SEQ ID NO: 443273 - DNA, 140 bp, Artificial Sequence
  Synthetic
aggccctggctgctgatatgttatggaaagatttgacttcagtcgatattggaaaagatttagtcaagttcaaagatcaaatatggggggtgttaattgtgacgaaggactttgtgtactgaccttttgggacagcggtg

SEQ ID NO: 443274 - DNA, 140 bp, Artificial Sequence
  Synthetic
caccgctgtcccaaaaggtcagtacacaaagtccttcgtcacaattaacaccccccatatttgatctttgaacttgactaaatcttttccaatatcgactgaagtcaaatctttccataacatatcagcagccagggcct

SEQ ID NO: 443275 - DNA, 140 bp, Artificial Sequence
  Synthetic
atacgccatgctgggtctccgttatggtgccattaaatcgctgcattttatcaaaatctgattaattgcctttacattctgagcctcttggatgtgaaaaaaactattaacatccctcaacgtacttgggagtcggccat

SEQ ID NO: 443276 - DNA, 140 bp, Artificial Sequence
  Synthetic
atggccgactcccaagtacgttgagggatgttaatagtttttttcacatccaagaggctcagaatgtaaaggcaattaatcagattttgataaaatgcagcgatttaatggcaccataacggagacccagcatggcgtat

SEQ ID NO: 443277 - DNA, 140 bp, Artificial Sequence
  Synthetic
atacgccatgctgggtctccttgccggggatcaagtattgtctatgtgtggaaactccggttatgaagtcattaaaatactggaaccatatgtcgtgaacagcttagtccagagggcagacgtacttgggagtcggccat

SEQ ID NO: 443278 - DNA, 140 bp, Artificial Sequence
  Synthetic
atggccgactcccaagtacgtctgccctctggactaagctgttcacgacatatggttccagtattttaatgacttcataaccggagtttccacacatagacaatacttgatccccggcaaggagacccagcatggcgtat

SEQ ID NO: 443279 - DNA, 140 bp, Artificial Sequence
  Synthetic
aggccctggctgctgatatggggacaattttcttctagccatgtctaggatcatctatttagacccctcattggggggagtgtctgggatgtcccttggaaggttccatatacgtcaattgaccttttgggacagcggtg

SEQ ID NO: 443280 - DNA, 140 bp, Artificial Sequence
  Synthetic
caccgctgtcccaaaaggtcaattgacgtatatggaaccttccaagggacatcccagacactccccccaatgaggggtctaaatagatgatcctagacatggctagaagaaaattgtccccatatcagcagccagggcct

SEQ ID NO: 443281 - DNA, 140 bp, Artificial Sequence
  Synthetic
aggccctggctgctgatatgccttttagaagtttgtaggtactaagacccttagacgatgaacctagaaaaaaacaagactctgaatcagaacctctggttgtttgattattttttttatgaccttttgggacagcggtg

SEQ ID NO: 443282 - DNA, 140 bp, Artificial Sequence
  Synthetic
caccgctgtcccaaaaggtcataaaaaaaataatcaaacaaccagaggttctgattcagagtcttgtttttttctaggttcatcgtctaagggtcttagtacctacaaacttctaaaaggcatatcagcagccagggcct

SEQ ID NO: 443283 - DNA, 140 bp, Artificial Sequence
  Synthetic
atacgccatgctgggtctccagacccttagacgatgaacctagaaaaaaacaagactctgaatcagaacctctggttgtttgattattttttttatctttattgtttttttgttaagcgtcgtacttgggagtcggccat

SEQ ID NO: 443284 - DNA, 140 bp, Artificial Sequence
  Synthetic
atggccgactcccaagtacgacgcttaacaaaaaaacaataaagataaaaaaaataatcaaacaaccagaggttctgattcagagtcttgtttttttctaggttcatcgtctaagggtctggagacccagcatggcgtat

SEQ ID NO: 443285 - DNA, 140 bp, Artificial Sequence
  Synthetic
aggccctggctgctgatatgtatgtcaccaccacgtttaagagaaagcactttcgtcctatgccagacgcgtgcagaaccgcatacagctggaagatggctggtgaccccaggtatgaaggaccttttgggacagcggtg

SEQ ID NO: 443286 - DNA, 140 bp, Artificial Sequence
  Synthetic
caccgctgtcccaaaaggtccttcatacctggggtcaccagccatcttccagctgtatgcggttctgcacgcgtctggcataggacgaaagtgctttctcttaaacgtggtggtgacatacatatcagcagccagggcct

SEQ ID NO: 443287 - DNA, 140 bp, Artificial Sequence
  Synthetic
aggccctggctgctgatatggggatttgacaagtactccaaatggtacattgactctcgatttcttcctagagatcatcccttgactccgtacatcaagactcagacatggccacccaaagaccttttgggacagcggtg

SEQ ID NO: 443288 - DNA, 140 bp, Artificial Sequence
  Synthetic
caccgctgtcccaaaaggtctttgggtggccatgtctgagtcttgatgtacggagtcaagggatgatctctaggaagaaatcgagagtcaatgtaccatttggagtacttgtcaaatccccatatcagcagccagggcct

SEQ ID NO: 443289 - DNA, 140 bp, Artificial Sequence
  Synthetic
atacgccatgctgggtctccaatattggagccatatgtcgtgaatagtttagtccagagagcagaaaagtttaggcctctcattcattccttgggagactttcctgtatttataaaagaccgtacttgggagtcggccat

SEQ ID NO: 443290 - DNA, 140 bp, Artificial Sequence
  Synthetic
atggccgactcccaagtacggtcttttataaatacaggaaagtctcccaaggaatgaatgagaggcctaaacttttctgctctctggactaaactattcacgacatatggctccaatattggagacccagcatggcgtat

SEQ ID NO: 443291 - DNA, 140 bp, Artificial Sequence
  Synthetic
aggccctggctgctgatatgaaaccatgtgtagctatgactttctcatctatgggaagactcctttatttcgaggcaatatcttggtgcctgagtcaaagagatgggccagagtctcttggaccttttgggacagcggtg

SEQ ID NO: 443292 - DNA, 140 bp, Artificial Sequence
  Synthetic
caccgctgtcccaaaaggtccaagagactctggcccatctctttgactcaggcaccaagatattgcctcgaaataaaggagtcttcccatagatgagaaagtcatagctacacatggtttcatatcagcagccagggcct

SEQ ID NO: 443293 - DNA, 140 bp, Artificial Sequence
  Synthetic
aggccctggctgctgatatgcccgtatgataaatcccttcactcgagagtttttcctggcggaaaatgttcaggattaaccgtgtcctctacctgttgctctactaaccacgactacaccgaccttttgggacagcggtg

SEQ ID NO: 443294 - DNA, 140 bp, Artificial Sequence
  Synthetic
caccgctgtcccaaaaggtcggtgtagtcgtggttagtagagcaacaggtagaggacacggttaatcctgaacattttccgccaggaaaaactctcgagtgaagggatttatcatacgggcatatcagcagccagggcct

SEQ ID NO: 443295 - DNA, 140 bp, Artificial Sequence
  Synthetic
aggccctggctgctgatatgagtcacactccttcaccagaacgaggctagcgtcttggttgtcagagaacagaggggggcccgttcccagtgaaaaggtcatcatcacagctctgtctaagaccttttgggacagcggtg

SEQ ID NO: 443296 - DNA, 140 bp, Artificial Sequence
  Synthetic
caccgctgtcccaaaaggtcttagacagagctgtgatgatgaccttttcactgggaacgggcccccctctgttctctgacaaccaagacgctagcctcgttctggtgaaggagtgtgactcatatcagcagccagggcct

SEQ ID NO: 443297 - DNA, 140 bp, Artificial Sequence
  Synthetic
atacgccatgctgggtctccagaggggggcccgttcccagtgaaaaggtcatcatcacagctctgtctaaaccacctgtcaatccgagggagtttttaaaatctatcgaccttggaggatcgtacttgggagtcggccat

SEQ ID NO: 443298 - DNA, 140 bp, Artificial Sequence
  Synthetic
atggccgactcccaagtacgatcctccaaggtcgatagattttaaaaactccctcggattgacaggtggtttagacagagctgtgatgatgaccttttcactgggaacgggcccccctctggagacccagcatggcgtat

SEQ ID NO: 443299 - DNA, 140 bp, Artificial Sequence
  Synthetic
aggccctggctgctgatatgtggatgaaagaggcttgtataagtctctaaagggggcatgcaagctgaagctatgtggggtctcagggcttcgacttatggatggaacatgggttgcaatgaccttttgggacagcggtg

SEQ ID NO: 443300 - DNA, 140 bp, Artificial Sequence
  Synthetic
caccgctgtcccaaaaggtcattgcaacccatgttccatccataagtcgaagccctgagaccccacatagcttcagcttgcatgccccctttagagacttatacaagcctctttcatccacatatcagcagccagggcct

SEQ ID NO: 443301 - DNA, 140 bp, Artificial Sequence
  Synthetic
aggccctggctgctgatatgaagatcgagggtcgattttttgccttgatgtcttggaacctaagattgtactttgttatcaccgaaaagctcttagctaattatatcttgccactctttggaccttttgggacagcggtg

SEQ ID NO: 443302 - DNA, 140 bp, Artificial Sequence
  Synthetic
caccgctgtcccaaaaggtccaaagagtggcaagatataattagctaagagcttttcggtgataacaaagtacaatcttaggttccaagacatcaaggcaaaaaatcgaccctcgatcttcatatcagcagccagggcct

SEQ ID NO: 443303 - DNA, 140 bp, Artificial Sequence
  Synthetic
aggccctggctgctgatatgcaccccttgactccttatatcaaaacccaaacatggccacccaaacatattgtagacttggtgggggatacatggcacaagctcccgatcacgcagatctgaccttttgggacagcggtg

SEQ ID NO: 443304 - DNA, 140 bp, Artificial Sequence
  Synthetic
caccgctgtcccaaaaggtcagatctgcgtgatcgggagcttgtgccatgtatcccccaccaagtctacaatatgtttgggtggccatgtttgggttttgatataaggagtcaaggggtgcatatcagcagccagggcct

SEQ ID NO: 443305 - DNA, 140 bp, Artificial Sequence
  Synthetic
atacgccatgctgggtctccggtgtattaacatgaactctagagcatgtcaactatggtctgacctgtccctccaaacacaaaggtctgatgaggataaagattcctcagtgcttctggacgtacttgggagtcggccat

SEQ ID NO: 443306 - DNA, 140 bp, Artificial Sequence
  Synthetic
atggccgactcccaagtacgtccagaagcactgaggaatctttatcctcatcagacctttgtgtttggagggacaggtcagaccatagttgacatgctctagagttcatgttaatacaccggagacccagcatggcgtat

SEQ ID NO: 443307 - DNA, 140 bp, Artificial Sequence
  Synthetic
atacgccatgctgggtctcctagatcagacctcatcggtctatgggaggaccaaatatactgcttagatatgtccaatggcccgacctgttggaatggtcaagatggagggctggagggccgtacttgggagtcggccat

SEQ ID NO: 443308 - DNA, 140 bp, Artificial Sequence
  Synthetic
atggccgactcccaagtacggccctccagccctccatcttgaccattccaacaggtcgggccattggacatatctaagcagtatatttggtcctcccatagaccgatgaggtctgatctaggagacccagcatggcgtat

SEQ ID NO: 443309 - DNA, 140 bp, Artificial Sequence
  Synthetic
aggccctggctgctgatatggatttcgcattgtctatagatggaccactccacttggtcttcaaaacttatgggactatgctagtaaacccagactataaggctgttcaacacctgtcaagaccttttgggacagcggtg

SEQ ID NO: 443310 - DNA, 140 bp, Artificial Sequence
  Synthetic
caccgctgtcccaaaaggtcttgacaggtgttgaacagccttatagtctgggtttactagcatagtcccataagttttgaagaccaagtggagtggtccatctatagacaatgcgaaatccatatcagcagccagggcct

SEQ ID NO: 443311 - DNA, 140 bp, Artificial Sequence
  Synthetic
aggccctggctgctgatatgaggttctatgtccaacatatatgttgtcacctgggctatccagagagggacttctctatgagttggagagcatatcaagaaatgcgctttcaatataccggaccttttgggacagcggtg

SEQ ID NO: 443312 - DNA, 140 bp, Artificial Sequence
  Synthetic
caccgctgtcccaaaaggtccggtatattgaaagcgcatttcttgatatgctctccaactcatagagaagtccctctctggatagcccaggtgacaacatatatgttggacatagaacctcatatcagcagccagggcct

SEQ ID NO: 443313 - DNA, 140 bp, Artificial Sequence
  Synthetic
aggccctggctgctgatatgtttagcccaattttaaagggtagagtttacaaaattctgagtgctgaaggggagagctttctcctagccatgtcaaggataatctatctagacccttcgtgaccttttgggacagcggtg

SEQ ID NO: 443314 - DNA, 140 bp, Artificial Sequence
  Synthetic
caccgctgtcccaaaaggtcacgaagggtctagatagattatccttgacatggctaggagaaagctctccccttcagcactcagaattttgtaaactctaccctttaaaattgggctaaacatatcagcagccagggcct

SEQ ID NO: 443315 - DNA, 140 bp, Artificial Sequence
  Synthetic
aggccctggctgctgatatgacagggaggaaagtgtcattaacttcgcacaacggaagggtcatatcttcatgggaatcatataaaagtggaggtgagaccaagctgtgaggacaaatcagaccttttgggacagcggtg

SEQ ID NO: 443316 - DNA, 140 bp, Artificial Sequence
  Synthetic
caccgctgtcccaaaaggtctgatttgtcctcacagcttggtctcacctccacttttatatgattcccatgaagatatgacccttccgttgtgcgaagttaatgacactttcctccctgtcatatcagcagccagggcct

SEQ ID NO: 443317 - DNA, 140 bp, Artificial Sequence
  Synthetic
aggccctggctgctgatatgttatgtccgacatacatgttgtcgccagggctatctcaagaggggctcctctatgaattggagagaatatcaaggaatgcactttcgatatacagagccggaccttttgggacagcggtg

SEQ ID NO: 443318 - DNA, 140 bp, Artificial Sequence
  Synthetic
caccgctgtcccaaaaggtccggctctgtatatcgaaagtgcattccttgatattctctccaattcatagaggagcccctcttgagatagccctggcgacaacatgtatgtcggacataacatatcagcagccagggcct

SEQ ID NO: 443319 - DNA, 140 bp, Artificial Sequence
  Synthetic
aggccctggctgctgatatggctcccatgagtcttggattcacgccttgtgtcaggaggcggggaatccagatcttggagagagaacactcgagagcttcactcggcttctagaggacccgaccttttgggacagcggtg

SEQ ID NO: 443320 - DNA, 140 bp, Artificial Sequence
  Synthetic
caccgctgtcccaaaaggtcgggtcctctagaagccgagtgaagctctcgagtgttctctctccaagatctggattccccgcctcctgacacaaggcgtgaatccaagactcatgggagccatatcagcagccagggcct

SEQ ID NO: 443321 - DNA, 140 bp, Artificial Sequence
  Synthetic
atacgccatgctgggtctccctaatgaccaaatagtcaacctcgccaatataatgtcgacagtgtccaccaatgcgctaacagtggcacaacactctcaatctttgatcaaaccgatgagcgtacttgggagtcggccat

SEQ ID NO: 443322 - DNA, 140 bp, Artificial Sequence
  Synthetic
atggccgactcccaagtacgctcatcggtttgatcaaagattgagagtgttgtgccactgttagcgcattggtggacactgtcgacattatattggcgaggttgactatttggtcattagggagacccagcatggcgtat

SEQ ID NO: 443323 - DNA, 140 bp, Artificial Sequence
  Synthetic
aggccctggctgctgatatgacgctatcagaaaagccctgtatgatgaagtggacaaggtggagaactcagagtttagagaggcaatcctcttgtctaagacccatagggataactttatgaccttttgggacagcggtg

SEQ ID NO: 443324 - DNA, 140 bp, Artificial Sequence
  Synthetic
caccgctgtcccaaaaggtcataaagttatccctatgggtcttagacaagaggattgcctctctaaactctgagttctccaccttgtccacttcatcatacagggcttttctgatagcgtcatatcagcagccagggcct

SEQ ID NO: 443325 - DNA, 140 bp, Artificial Sequence
  Synthetic
atacgccatgctgggtctccaaattaatgctggagtggttgaaaactgggaatagaccttaccggatgaccctaacggacaactgctctaggtcttacaaagtcctgaaagattattttacgtacttgggagtcggccat

SEQ ID NO: 443326 - DNA, 140 bp, Artificial Sequence
  Synthetic
atggccgactcccaagtacgtaaaataatctttcaggactttgtaagacctagagcagttgtccgttagggtcatccggtaaggtctattcccagttttcaaccactccagcattaatttggagacccagcatggcgtat

SEQ ID NO: 443327 - DNA, 140 bp, Artificial Sequence
  Synthetic
atacgccatgctgggtctcccccagacacctcaacgagtcgggagggtatggccttgctcctcggaaagggcagatctcttgagggaaatctcttgggggaggaaagtggtaggtaccaccgtacttgggagtcggccat

SEQ ID NO: 443328 - DNA, 140 bp, Artificial Sequence
  Synthetic
atggccgactcccaagtacggtggtacctaccactttcctcccccaagagatttccctcaagagatctgccctttccgaggagcaaggccataccctcccgactcgttgaggtgtctgggggagacccagcatggcgtat

SEQ ID NO: 443329 - DNA, 140 bp, Artificial Sequence
  Synthetic
aggccctggctgctgatatggaggtgtataactgacttggcccacttctattccaagtcctcccccatagaaaagttattaaattgcacacttggaaatagagggctaagaattcctccggaccttttgggacagcggtg

SEQ ID NO: 443330 - DNA, 140 bp, Artificial Sequence
  Synthetic
caccgctgtcccaaaaggtccggaggaattcttagccctctatttccaagtgtgcaatttaataacttttctatgggggaggacttggaatagaagtgggccaagtcagttatacacctccatatcagcagccagggcct

SEQ ID NO: 443331 - DNA, 140 bp, Artificial Sequence
  Synthetic
aggccctggctgctgatatggtatttgggctcatcaacctccatgtctactcagctatttcatgcgtgggaaaaggtcaccaatgttcatgtggtgaagagggccctgtcactaaaagaagaccttttgggacagcggtg

SEQ ID NO: 443332 - DNA, 140 bp, Artificial Sequence
  Synthetic
caccgctgtcccaaaaggtcttcttttagtgacagggccctcttcaccacatgaacattggtgaccttttcccacgcatgaaatagctgagtagacatggaggttgatgagcccaaataccatatcagcagccagggcct

SEQ ID NO: 443333 - DNA, 140 bp, Artificial Sequence
  Synthetic
aggccctggctgctgatatgaagtgcaggtgctctgactgcattaatgttgacgattttcttaatgacgtgttgcagaaagactaatagagcagagtcaatacaacacagtcctggagaggaccttttgggacagcggtg

SEQ ID NO: 443334 - DNA, 140 bp, Artificial Sequence
  Synthetic
caccgctgtcccaaaaggtcctctccaggactgtgttgtattgactctgctctattagtctttctgcaacacgtcattaagaaaatcgtcaacattaatgcagtcagagcacctgcacttcatatcagcagccagggcct

SEQ ID NO: 443335 - DNA, 140 bp, Artificial Sequence
  Synthetic
aggccctggctgctgatatgtctataaactggttcatcacaagaaactctaatttggcgcagactctaattaggaacataatgtctctgacaggccctgatttccctctggaggaggctcgaccttttgggacagcggtg

SEQ ID NO: 443336 - DNA, 140 bp, Artificial Sequence
  Synthetic
caccgctgtcccaaaaggtcgagcctcctccagagggaaatcagggcctgtcagagacattatgttcctaattagagtctgcgccaaattagagtttcttgtgatgaaccagtttatagacatatcagcagccagggcct

SEQ ID NO: 443337 - DNA, 140 bp, Artificial Sequence
  Synthetic
atacgccatgctgggtctcctaggaacataatgtctctgacaggccctgatttccctctggaggaggctcctgttttcaaaaggacagggtctgctttgcatagattcaagtctgctagacgtacttgggagtcggccat

SEQ ID NO: 443338 - DNA, 140 bp, Artificial Sequence
  Synthetic
atggccgactcccaagtacgtctagcagacttgaatctatgcaaagcagaccctgtccttttgaaaacaggagcctcctccagagggaaatcagggcctgtcagagacattatgttcctaggagacccagcatggcgtat

SEQ ID NO: 443339 - DNA, 140 bp, Artificial Sequence
  Synthetic
aggccctggctgctgatatgctccgtaagtacagatactatgtctgacttgacccaggacggaaagaactatgatttcatgttccagcccttgatgctttatgcgcaaacatggacatctgaccttttgggacagcggtg

SEQ ID NO: 443340 - DNA, 140 bp, Artificial Sequence
  Synthetic
caccgctgtcccaaaaggtcagatgtccatgtttgcgcataaagcatcaagggctggaacatgaaatcatagttctttccgtcctgggtcaagtcagacatagtatctgtacttacggagcatatcagcagccagggcct

SEQ ID NO: 443341 - DNA, 140 bp, Artificial Sequence
  Synthetic
aggccctggctgctgatatggtttctggagctgtacctcattttcagaaacttcctgatatccgtctgaaaccaggagattttgaatctctaagtggcagggagaaatctcgtcacataggaccttttgggacagcggtg

SEQ ID NO: 443342 - DNA, 140 bp, Artificial Sequence
  Synthetic
caccgctgtcccaaaaggtcctatgtgacgagatttctccctgccacttagagattcaaaatctcctggtttcagacggatatcaggaagtttctgaaaatgaggtacagctccagaaaccatatcagcagccagggcct

SEQ ID NO: 443343 - DNA, 140 bp, Artificial Sequence
  Synthetic
aggccctggctgctgatatggggattcgacaaatactccaagtggtatattgacttgcgactccttgcaagagaccatcccttaaatccctacattaaaactcagacatggccacccaaagaccttttgggacagcggtg

SEQ ID NO: 443344 - DNA, 140 bp, Artificial Sequence
  Synthetic
caccgctgtcccaaaaggtctttgggtggccatgtctgagttttaatgtagggatttaagggatggtctcttgcaaggagtcgcaagtcaatataccacttggagtatttgtcgaatccccatatcagcagccagggcct

SEQ ID NO: 443345 - DNA, 140 bp, Artificial Sequence
  Synthetic
atacgccatgctgggtctccttcatgttccagccattgatgctttatgcacagacatggacatcagagctggtacagagagacacaaggctaagagactctacgtttcattggcacctcccgtacttgggagtcggccat

SEQ ID NO: 443346 - DNA, 140 bp, Artificial Sequence
  Synthetic
atggccgactcccaagtacgggaggtgccaatgaaacgtagagtctcttagccttgtgtctctctgtaccagctctgatgtccatgtctgtgcataaagcatcaatggctggaacatgaaggagacccagcatggcgtat

SEQ ID NO: 443347 - DNA, 140 bp, Artificial Sequence
  Synthetic
aggccctggctgctgatatggatgcaacaggtgtgtgagacccattgacgacgtgaccctggagacctctcagatcttcgagtttccggatgtgtcgaaaagaatatccagaatggtttcgaccttttgggacagcggtg

SEQ ID NO: 443348 - DNA, 140 bp, Artificial Sequence
  Synthetic
caccgctgtcccaaaaggtcgaaaccattctggatattcttttcgacacatccggaaactcgaagatctgagaggtctccagggtcacgtcgtcaatgggtctcacacacctgttgcatccatatcagcagccagggcct

SEQ ID NO: 443349 - DNA, 140 bp, Artificial Sequence
  Synthetic
atacgccatgctgggtctccaccagtctcatctcctactccagagggttgagcgaaacttgtctaagagtatgagagctaacctgcaacaaatgagttctttaatgaggcaggtgctgggcgtacttgggagtcggccat

SEQ ID NO: 443350 - DNA, 140 bp, Artificial Sequence
  Synthetic
atggccgactcccaagtacgcccagcacctgcctcattaaagaactcatttgttgcaggttagctctcatactcttagacaagtttcgctcaaccctctggagtaggagatgagactggtggagacccagcatggcgtat

SEQ ID NO: 443351 - DNA, 140 bp, Artificial Sequence
  Synthetic
atacgccatgctgggtctcctttcaataccccaaaaaattccagcagcttacccgaccacgatgaaagagggcaatcgatccattttgtgttacctccaacatgttctgcgatatgagcgcgtacttgggagtcggccat

SEQ ID NO: 443352 - DNA, 140 bp, Artificial Sequence
  Synthetic
atggccgactcccaagtacgcgctcatatcgcagaacatgttggaggtaacacaaaatggatcgattgccctctttcatcgtggtcgggtaagctgctggaattttttggggtattgaaaggagacccagcatggcgtat

SEQ ID NO: 443353 - DNA, 140 bp, Artificial Sequence
  Synthetic
aggccctggctgctgatatggctcaggggctcttatactcaatcttagtggcaattcacgactcaggatacaatgatggaaccatcttccctgtcaacatatacggcaaggtttcccctagaccttttgggacagcggtg

SEQ ID NO: 443354 - DNA, 140 bp, Artificial Sequence
  Synthetic
caccgctgtcccaaaaggtctaggggaaaccttgccgtatatgttgacagggaagatggttccatcattgtatcctgagtcgtgaattgccactaagattgagtataagagcccctgagccatatcagcagccagggcct

SEQ ID NO: 443355 - DNA, 140 bp, Artificial Sequence
  Synthetic
aggccctggctgctgatatggagaggacaccttagaatctgacgatgacattcaaaggctattgaaggattctctgcgcagaacgaggtgggtggaccaagaagtgcgccatgcagccaggaccttttgggacagcggtg

SEQ ID NO: 443356 - DNA, 140 bp, Artificial Sequence
  Synthetic
caccgctgtcccaaaaggtcctggctgcatggcgcacttcttggtccacccacctcgttctgcgcagagaatccttcaatagcctttgaatgtcatcgtcagattctaaggtgtcctctccatatcagcagccagggcct

SEQ ID NO: 443357 - DNA, 140 bp, Artificial Sequence
  Synthetic
atacgccatgctgggtctccatgtaggttctcataacacgggaaatcttctagcagtttcagtgaccaacggtgctttcattctccaggaaatggtaccaaaggttgtggacgggccgagcgtacttgggagtcggccat

SEQ ID NO: 443358 - DNA, 140 bp, Artificial Sequence
  Synthetic
atggccgactcccaagtacgctcggcccgtccacaacctttggtaccatttcctggagaatgaaagcaccgttggtcactgaaactgctagaagatttcccgtgttatgagaacctacatggagacccagcatggcgtat

SEQ ID NO: 443359 - DNA, 140 bp, Artificial Sequence
  Synthetic
aggccctggctgctgatatggccaacccagcccctgtctcagagcttgatataagggccctctccaagaagttccaaaaccctcttatctcgggcttgagagttgtccagtgggcaactggaccttttgggacagcggtg

SEQ ID NO: 443360 - DNA, 140 bp, Artificial Sequence
  Synthetic
caccgctgtcccaaaaggtccagttgcccactggacaactctcaagcccgagataagagggttttggaacttcttggagagggcccttatatcaagctctgagacaggggctgggttggccatatcagcagccagggcct

SEQ ID NO: 443361 - DNA, 140 bp, Artificial Sequence
  Synthetic
atacgccatgctgggtctccggtcctccagctctggagtggtctgccacaaacgaggaggatgacctatctgtggaggctgaaatcgctcaccagattgctgaaagcttttccaagaagtcgtacttgggagtcggccat

SEQ ID NO: 443362 - DNA, 140 bp, Artificial Sequence
  Synthetic
atggccgactcccaagtacgacttcttggaaaagctttcagcaatctggtgagcgatttcagcctccacagataggtcatcctcctcgtttgtggcagaccactccagagctggaggaccggagacccagcatggcgtat

SEQ ID NO: 443363 - DNA, 140 bp, Artificial Sequence
  Synthetic
aggccctggctgctgatatgtccctatgtctagtggtaggagatggatcggggggaatatcgagagcagtcctcaacatgtttccggacgccaaacttgtattcaacagcttgttggagggaccttttgggacagcggtg

SEQ ID NO: 443364 - DNA, 140 bp, Artificial Sequence
  Synthetic
caccgctgtcccaaaaggtccctccaacaagctgttgaatacaagtttggcgtccggaaacatgttgaggactgctctcgatattccccccgatccatctcctaccactagacatagggacatatcagcagccagggcct

SEQ ID NO: 443365 - DNA, 140 bp, Artificial Sequence
  Synthetic
aggccctggctgctgatatgaggttctatgtccgacatatatgctgtctcctgggttgtcaagagaggggcttctctatgagttggagagcatatcgaggaatgctctttctatataccggaccttttgggacagcggtg

SEQ ID NO: 443366 - DNA, 140 bp, Artificial Sequence
  Synthetic
caccgctgtcccaaaaggtccggtatatagaaagagcattcctcgatatgctctccaactcatagagaagcccctctcttgacaacccaggagacagcatatatgtcggacatagaacctcatatcagcagccagggcct

SEQ ID NO: 443367 - DNA, 140 bp, Artificial Sequence
  Synthetic
atacgccatgctgggtctcctgactggagattacagccccaacaagaaggtgtcccgtaaggtaggatgttcagaatgggtctgctctgctcaacaggttgcagtctctacctcagcaaacgtacttgggagtcggccat

SEQ ID NO: 443368 - DNA, 140 bp, Artificial Sequence
  Synthetic
atggccgactcccaagtacgtttgctgaggtagagactgcaacctgttgagcagagcagacccattctgaacatcctaccttacgggacaccttcttgttggggctgtaatctccagtcaggagacccagcatggcgtat

SEQ ID NO: 443369 - DNA, 140 bp, Artificial Sequence
  Synthetic
aggccctggctgctgatatgatggaaccatgctggtaaatccagaatatcgagctatccaacacctgtcgagggcattcccctcagtcacaggatttataacccagatgacctcgtctttgaccttttgggacagcggtg

SEQ ID NO: 443370 - DNA, 140 bp, Artificial Sequence
  Synthetic
caccgctgtcccaaaaggtcaaagacgaggtcatctgggttataaatcctgtgactgaggggaatgccctcgacaggtgttggatagctcgatattctggatttaccagcatggttccatcatatcagcagccagggcct

SEQ ID NO: 443371 - DNA, 140 bp, Artificial Sequence
  Synthetic
aggccctggctgctgatatgcattataagcttaagcctattctagatgatctcaatgttttcccatctctctgccttgtagttggggacgggtcaggggggatatcaagggcagtcctcagaccttttgggacagcggtg

SEQ ID NO: 443372 - DNA, 140 bp, Artificial Sequence
  Synthetic
caccgctgtcccaaaaggtctgaggactgcccttgatatcccccctgacccgtccccaactacaaggcagagagatgggaaaacattgagatcatctagaataggcttaagcttataatgcatatcagcagccagggcct

SEQ ID NO: 443373 - DNA, 140 bp, Artificial Sequence
  Synthetic
atacgccatgctgggtctccgattttcagatggatgaaggggaggaccccgccctcttattccagtcatacctggacaatgttggagttcaaatggtcaaacaaatgaggtcgggagggacgtacttgggagtcggccat

SEQ ID NO: 443374 - DNA, 140 bp, Artificial Sequence
  Synthetic
atggccgactcccaagtacgtccctcccgacctcatttgtttgaccatttgaactccaacattgtccaggtatgactggaataagagggcggggtcctccccttcatccatctgaaaatcggagacccagcatggcgtat

SEQ ID NO: 443375 - DNA, 140 bp, Artificial Sequence
  Synthetic
aggccctggctgctgatatgagagcgttcccttcagtcacaggatttataacccaaatgacctcgtctttttcatccgagctgtacctcagattctccaagcgagggaagtttttccgaggaccttttgggacagcggtg

SEQ ID NO: 443376 - DNA, 140 bp, Artificial Sequence
  Synthetic
caccgctgtcccaaaaggtcctcggaaaaacttccctcgcttggagaatctgaggtacagctcggatgaaaaagacgaggtcatttgggttataaatcctgtgactgaagggaacgctctcatatcagcagccagggcct

SEQ ID NO: 443377 - DNA, 140 bp, Artificial Sequence
  Synthetic
atacgccatgctgggtctccaaaaatgtaacacccctacaatggatgccgacaagattgtattcaaagtcaataatcaggtggtctccttgaagccagagattatcgttgatcaatatgacgtacttgggagtcggccat

SEQ ID NO: 443378 - DNA, 140 bp, Artificial Sequence
  Synthetic
atggccgactcccaagtacgtcatattgatcaacgataatctctggcttcaaggagaccacctgattattgactttgaatacaatcttgtcggcatccattgtaggggtgttacatttttggagacccagcatggcgtat

SEQ ID NO: 443379 - DNA, 140 bp, Artificial Sequence
  Synthetic
aggccctggctgctgatatgctcagatcccgtctctgaaggattgtcattctggagagaaatttggctgagctcccatgaatcatggattcatgccctgtgtcaggaagcagggaaccccgaccttttgggacagcggtg

SEQ ID NO: 443380 - DNA, 140 bp, Artificial Sequence
  Synthetic
caccgctgtcccaaaaggtcggggttccctgcttcctgacacagggcatgaatccatgattcatgggagctcagccaaatttctctccagaatgacaatccttcagagacgggatctgagcatatcagcagccagggcct

SEQ ID NO: 443381 - DNA, 140 bp, Artificial Sequence
  Synthetic
atacgccatgctgggtctccaatgcaattctttgagggaacatgccctgaggactggaccagttatggaatattgattgcacgaaagggagacaagatcacccccgattcccttgttgagcgtacttgggagtcggccat

SEQ ID NO: 443382 - DNA, 140 bp, Artificial Sequence
  Synthetic
atggccgactcccaagtacgctcaacaagggaatcgggggtgatcttgtctccctttcgtgcaatcaatattccataactggtccagtcctcagggcatgttccctcaaagaattgcattggagacccagcatggcgtat

SEQ ID NO: 443383 - DNA, 140 bp, Artificial Sequence
  Synthetic
aggccctggctgctgatatgacaatgagatgatcataaccctgattgacagtgatgtggagtccttcctggttcacaagatggtggatgatctggaattacagagaggaaccttgtctaagaccttttgggacagcggtg

SEQ ID NO: 443384 - DNA, 140 bp, Artificial Sequence
  Synthetic
caccgctgtcccaaaaggtcttagacaaggttcctctctgtaattccagatcatccaccatcttgtgaaccaggaaggactccacatcactgtcaatcagggttatgatcatctcattgtcatatcagcagccagggcct

SEQ ID NO: 443385 - DNA, 140 bp, Artificial Sequence
  Synthetic
aggccctggctgctgatatgaagatcttgaggcacttcaatatctgctgcagtactatgatgtatctatctatggctttaggtgatgtccccagctttgcaaggcttcatgacttgtacagaccttttgggacagcggtg

SEQ ID NO: 443386 - DNA, 140 bp, Artificial Sequence
  Synthetic
caccgctgtcccaaaaggtctgtacaagtcatgaagccttgcaaagctggggacatcacctaaagccatagatagatacatcatagtactgcagcagatattgaagtgcctcaagatcttcatatcagcagccagggcct

SEQ ID NO: 443387 - DNA, 140 bp, Artificial Sequence
  Synthetic
atacgccatgctgggtctcctatggctttaggtgatgtccccagctttgcaaggcttcatgacttgtacaatagacctataacttattatttcaaaaagcaagtcattcgagggaatattcgtacttgggagtcggccat

SEQ ID NO: 443388 - DNA, 140 bp, Artificial Sequence
  Synthetic
atggccgactcccaagtacgaatattccctcgaatgacttgctttttgaaataataagttataggtctattgtacaagtcatgaagccttgcaaagctggggacatcacctaaagccataggagacccagcatggcgtat

SEQ ID NO: 443389 - DNA, 140 bp, Artificial Sequence
  Synthetic
aggccctggctgctgatatgcaaaattctcggacgataagaagacagtttagaaaaagtctctctagaactctagaggagtcattttacaattcagagattcatgggatcaaccggatgagaccttttgggacagcggtg

SEQ ID NO: 443390 - DNA, 140 bp, Artificial Sequence
  Synthetic
caccgctgtcccaaaaggtctcatccggttgatcccatgaatctctgaattgtaaaatgactcctctagagttctagagagactttttctaaactgtcttcttatcgtccgagaattttgcatatcagcagccagggcct

SEQ ID NO: 443391 - DNA, 140 bp, Artificial Sequence
  Synthetic
atacgccatgctgggtctccttttcaaggccctggatcaatttgacaatatacacgacttagtctttgtgtacggctgttacaggcattggggacatccttacatagattatagaaagggcgtacttgggagtcggccat

SEQ ID NO: 443392 - DNA, 140 bp, Artificial Sequence
  Synthetic
atggccgactcccaagtacgccctttctataatctatgtaaggatgtccccaatgcctgtaacagccgtacacaaagactaagtcgtgtatattgtcaaattgatccagggccttgaaaaggagacccagcatggcgtat

SEQ ID NO: 443393 - DNA, 140 bp, Artificial Sequence
  Synthetic
atacgccatgctgggtctccctgcaactctagcttgagtctgtcatctcactggatcaggctgatttacaagatagtgaagaccactagattcatcggaagcattgaagacctacctgggcgtacttgggagtcggccat

SEQ ID NO: 443394 - DNA, 140 bp, Artificial Sequence
  Synthetic
atggccgactcccaagtacgcccaggtaggtcttcaatgcttccgatgaatctagtggtcttcactatcttgtaaatcagcctgatccagtgagatgacagactcaagctagagttgcagggagacccagcatggcgtat

SEQ ID NO: 443395 - DNA, 140 bp, Artificial Sequence
  Synthetic
aggccctggctgctgatatgcgttcctcacccctctgagatgttggggttgcttcctaagtcctccatctcctgtacctgtggtacaacaggaggaggaaatcctagggtttcagtgtctgaccttttgggacagcggtg

SEQ ID NO: 443396 - DNA, 140 bp, Artificial Sequence
  Synthetic
caccgctgtcccaaaaggtcagacactgaaaccctaggatttcctcctcctgttgtaccacaggtacaggagatggaggacttaggaagcaaccccaacatctcagaggggtgaggaacgcatatcagcagccagggcct

SEQ ID NO: 443397 - DNA, 140 bp, Artificial Sequence
  Synthetic
aggccctggctgctgatatgcatcaggtccagatcatctctgctagactacagttgcttatgagctggagatttctgtggatctgtatatactaagattctcagacagtgtaccgtgaaagaccttttgggacagcggtg

SEQ ID NO: 443398 - DNA, 140 bp, Artificial Sequence
  Synthetic
caccgctgtcccaaaaggtctttcacggtacactgtctgagaatcttagtatatacagatccacagaaatctccagctcataagcaactgtagtctagcagagatgatctggacctgatgcatatcagcagccagggcct

SEQ ID NO: 443399 - DNA, 140 bp, Artificial Sequence
  Synthetic
atacgccatgctgggtctccatttctgtggatctgtatatactaagattctcagacagtgtaccgtgaaaaaaacgaaatctcaagtcagaacctctagctgtttgattattttttccatcgtacttgggagtcggccat

SEQ ID NO: 443400 - DNA, 140 bp, Artificial Sequence
  Synthetic
atggccgactcccaagtacgatggaaaaaataatcaaacagctagaggttctgacttgagatttcgtttttttcacggtacactgtctgagaatcttagtatatacagatccacagaaatggagacccagcatggcgtat

SEQ ID NO: 443401 - DNA, 140 bp, Artificial Sequence
  Synthetic
aggccctggctgctgatatggtacttgggatcatccacctccatgtcgacccagctgttccatgcttgggaaaaggtcactaatgttcatgtggtgaaaagggccttatcactaaaggaggaccttttgggacagcggtg

SEQ ID NO: 443402 - DNA, 140 bp, Artificial Sequence
  Synthetic
caccgctgtcccaaaaggtcctcctttagtgataaggcccttttcaccacatgaacattagtgaccttttcccaagcatggaacagctgggtcgacatggaggtggatgatcccaagtaccatatcagcagccagggcct

SEQ ID NO: 443403 - DNA, 140 bp, Artificial Sequence
  Synthetic
aggccctggctgctgatatggatctagatcatccctactagactacagttgcctgtgaaccggatactcctggaagcctgcccatgctaagactcttgtgtgatgtatcttgaaaaaaacgaccttttgggacagcggtg

SEQ ID NO: 443404 - DNA, 140 bp, Artificial Sequence
  Synthetic
caccgctgtcccaaaaggtcgtttttttcaagatacatcacacaagagtcttagcatgggcaggcttccaggagtatccggttcacaggcaactgtagtctagtagggatgatctagatccatatcagcagccagggcct

SEQ ID NO: 443405 - DNA, 140 bp, Artificial Sequence
  Synthetic
aggccctggctgctgatatgatgacttcatgtttcagcccttgatgctttatgcgcaaacatggacatctgaactagtacaaagggacaccaggctgaaagattctacgttccactggcagaccttttgggacagcggtg

SEQ ID NO: 443406 - DNA, 140 bp, Artificial Sequence
  Synthetic
caccgctgtcccaaaaggtctgccagtggaacgtagaatctttcagcctggtgtccctttgtactagttcagatgtccatgtttgcgcataaagcatcaagggctgaaacatgaagtcatcatatcagcagccagggcct

SEQ ID NO: 443407 - DNA, 140 bp, Artificial Sequence
  Synthetic
aggccctggctgctgatatgtcttgagtctgtataggttgagcaaaatatcggggcaaaacactggcaactataagacaaacattgcagacaggatagagcagatttttgagactgccccgaccttttgggacagcggtg

SEQ ID NO: 443408 - DNA, 140 bp, Artificial Sequence
  Synthetic
caccgctgtcccaaaaggtcggggcagtctcaaaaatctgctctatcctgtctgcaatgtttgtcttatagttgccagtgttttgccccgatattttgctcaacctatacagactcaagacatatcagcagccagggcct

SEQ ID NO: 443409 - DNA, 140 bp, Artificial Sequence
  Synthetic
aggccctggctgctgatatgaagtcagtgagtttcagacgtctcagtcacttaagaaaacttgtccctgggttcggaaaagcatataccatattcaacaaaacgttgatggaggctgatggaccttttgggacagcggtg

SEQ ID NO: 443410 - DNA, 140 bp, Artificial Sequence
  Synthetic
caccgctgtcccaaaaggtccatcagcctccatcaacgttttgttgaatatggtatatgcttttccgaacccagggacaagttttcttaagtgactgagacgtctgaaactcactgacttcatatcagcagccagggcct

SEQ ID NO: 443411 - DNA, 140 bp, Artificial Sequence
  Synthetic
aggccctggctgctgatatggaattgatctcaggtgtgatttcatatatccttctgagactggataatcacccatctttgtatataatgctgagggagccgtctcttagaggagaaatatgaccttttgggacagcggtg

SEQ ID NO: 443412 - DNA, 140 bp, Artificial Sequence
  Synthetic
caccgctgtcccaaaaggtcatatttctcctctaagagacggctccctcagcattatatacaaagatgggtgattatccagtctcagaaggatatatgaaatcacacctgagatcaattccatatcagcagccagggcct

SEQ ID NO: 443413 - DNA, 140 bp, Artificial Sequence
  Synthetic
aggccctggctgctgatatgcctgctgaccaattttaccactcaggcccatcagacaattaagcctgagttattctgaatttgacatgaaaaaaacaggcaacaccactgataaaatgaagaccttttgggacagcggtg

SEQ ID NO: 443414 - DNA, 140 bp, Artificial Sequence
  Synthetic
caccgctgtcccaaaaggtcttcattttatcagtggtgttgcctgtttttttcatgtcaaattcagaataactcaggcttaattgtctgatgggcctgagtggtaaaattggtcagcaggcatatcagcagccagggcct

SEQ ID NO: 443415 - DNA, 140 bp, Artificial Sequence
  Synthetic
atacgccatgctgggtctccgtcaagaaaagagaggagtgtctggatgcactagagtccatcatgaccaccaagtcagtgagtttcagacgcctcagtcatttaagaaaacttgtccctgcgtacttgggagtcggccat

SEQ ID NO: 443416 - DNA, 140 bp, Artificial Sequence
  Synthetic
atggccgactcccaagtacgcagggacaagttttcttaaatgactgaggcgtctgaaactcactgacttggtggtcatgatggactctagtgcatccagacactcctctcttttcttgacggagacccagcatggcgtat

SEQ ID NO: 443417 - DNA, 140 bp, Artificial Sequence
  Synthetic
aggccctggctgctgatatggtttcagaaccctcttatctcaggcctgagagtggttcagtgggcaaccggtgctcattataagctcaagcccatcctagatgatctgaatgttttcccagaccttttgggacagcggtg

SEQ ID NO: 443418 - DNA, 140 bp, Artificial Sequence
  Synthetic
caccgctgtcccaaaaggtctgggaaaacattcagatcatctaggatgggcttgagcttataatgagcaccggttgcccactgaaccactctcaggcctgagataagagggttctgaaaccatatcagcagccagggcct

SEQ ID NO: 443419 - DNA, 140 bp, Artificial Sequence
  Synthetic
aggccctggctgctgatatgtccctatgtctcgtggtaggggacggatcaggagggatatcgagagcagtgctcaacatgttcccagatgctaagcttgtattcaacagcctattggagggaccttttgggacagcggtg

SEQ ID NO: 443420 - DNA, 140 bp, Artificial Sequence
  Synthetic
caccgctgtcccaaaaggtccctccaataggctgttgaatacaagcttagcatctgggaacatgttgagcactgctctcgatatccctcctgatccgtcccctaccacgagacatagggacatatcagcagccagggcct

SEQ ID NO: 443421 - DNA, 140 bp, Artificial Sequence
  Synthetic
aggccctggctgctgatatgcagagagaaagcaaacccctgaaagcccgaatggaggctcaaactgcctctggtcctccagctctcgaatggtctgcaaccaacgaagaggatgatctatgaccttttgggacagcggtg

SEQ ID NO: 443422 - DNA, 140 bp, Artificial Sequence
  Synthetic
caccgctgtcccaaaaggtcatagatcatcctcttcgttggttgcagaccattcgagagctggaggaccagaggcagtttgagcctccattcgggctttcaggggtttgctttctctctgcatatcagcagccagggcct

SEQ ID NO: 443423 - DNA, 140 bp, Artificial Sequence
  Synthetic
aggccctggctgctgatatgacggaaccatgctagtaaatccagattatagagccgttcaacacctgtcgagagcgttcccctcagtcacaggatttataacccagatgacctcgtctttgaccttttgggacagcggtg

SEQ ID NO: 443424 - DNA, 140 bp, Artificial Sequence
  Synthetic
caccgctgtcccaaaaggtcaaagacgaggtcatctgggttataaatcctgtgactgaggggaacgctctcgacaggtgttgaacggctctataatctggatttactagcatggttccgtcatatcagcagccagggcct

SEQ ID NO: 443425 - DNA, 140 bp, Artificial Sequence
  Synthetic
aggccctggctgctgatatgctgggatgggtcgctctggcaaactctaagaagttccagctattagtcgagccggaaaagctgaacaaaatcatgcaggatgatctgaaccgttatacatgaccttttgggacagcggtg

SEQ ID NO: 443426 - DNA, 140 bp, Artificial Sequence
  Synthetic
caccgctgtcccaaaaggtcatgtataacggttcagatcatcctgcatgattttgttcagcttttccggctcgactaatagctggaacttcttagagtttgccagagcgacccatcccagcatatcagcagccagggcct

SEQ ID NO: 443427 - DNA, 140 bp, Artificial Sequence
  Synthetic
aggccctggctgctgatatgggtttggaaaggcgtataccatattcaacaaaaccttgatggaggctgatgctcactataaatcaatccggacttggaatgaaatcatcccctctaaagggaccttttgggacagcggtg

SEQ ID NO: 443428 - DNA, 140 bp, Artificial Sequence
  Synthetic
caccgctgtcccaaaaggtccctttagaggggatgatttcattccaagtccggattgatttatagtgagcatcagcctccatcaaggttttgttgaatatggtatacgcctttccaaacccatatcagcagccagggcct

SEQ ID NO: 443429 - DNA, 140 bp, Artificial Sequence
  Synthetic
aggccctggctgctgatatgcaatcgtccctcctccaccagcatatggaattgttggagtcctcagtcatccctttgatgcatcccttagcagacccgtcaacagtctttaaagacggcggaccttttgggacagcggtg

SEQ ID NO: 443430 - DNA, 140 bp, Artificial Sequence
  Synthetic
caccgctgtcccaaaaggtccgccgtctttaaagactgttgacgggtctgctaagggatgcatcaaagggatgactgaggactccaacaattccatatgctggtggaggagggacgattgcatatcagcagccagggcct

SEQ ID NO: 443431 - DNA, 140 bp, Artificial Sequence
  Synthetic
aggccctggctgctgatatgctgtaactccagcttgagtctgtcatctcactggataaggttgatttacaagatagtgaagaccactagactcatcggaagtgttgaggatttatcaagagaccttttgggacagcggtg

SEQ ID NO: 443432 - DNA, 140 bp, Artificial Sequence
  Synthetic
caccgctgtcccaaaaggtctcttgataaatcctcaacacttccgatgagtctagtggtcttcactatcttgtaaatcaaccttatccagtgagatgacagactcaagctggagttacagcatatcagcagccagggcct

SEQ ID NO: 443433 - DNA, 140 bp, Artificial Sequence
  Synthetic
aggccctggctgctgatatgacttatagaggtgtgtagatattgagacccttagacgatacacctgaaaaaaaacaaggttttgaatcagaacctctggttgtttgattatttcccccatgaccttttgggacagcggtg

SEQ ID NO: 443434 - DNA, 140 bp, Artificial Sequence
  Synthetic
caccgctgtcccaaaaggtcatgggggaaataatcaaacaaccagaggttctgattcaaaaccttgttttttttcaggtgtatcgtctaagggtctcaatatctacacacctctataagtcatatcagcagccagggcct

SEQ ID NO: 443435 - DNA, 140 bp, Artificial Sequence
  Synthetic
atacgccatgctgggtctccgaaaatgtaacacccctacaatggataccgacaagattgtgtttaagatcaataatcaaattgtttctctgaagcccgaaattattgtcgaccaatatgacgtacttgggagtcggccat

SEQ ID NO: 443436 - DNA, 140 bp, Artificial Sequence
  Synthetic
atggccgactcccaagtacgtcatattggtcgacaataatttcgggcttcagagaaacaatttgattattgatcttaaacacaatcttgtcggtatccattgtaggggtgttacattttcggagacccagcatggcgtat

SEQ ID NO: 443437 - DNA, 140 bp, Artificial Sequence
  Synthetic
atacgccatgctgggtctccatcagatccagatcatctctgttagattatagctgcttataaactgagcgcccctggtatagtgtacagattgagactcctagacggtgcaccctgaaaacgtacttgggagtcggccat

SEQ ID NO: 443438 - DNA, 140 bp, Artificial Sequence
  Synthetic
atggccgactcccaagtacgttttcagggtgcaccgtctaggagtctcaatctgtacactataccaggggcgctcagtttataagcagctataatctaacagagatgatctggatctgatggagacccagcatggcgtat

SEQ ID NO: 443439 - DNA, 140 bp, Artificial Sequence
  Synthetic
atacgccatgctgggtctccaatgcagctaagcttgaccccgacgatgtatgctcttatttagcagccgcaatgcaattctttgaaggaacatgcccggaggactggaccagctatggaacgtacttgggagtcggccat

SEQ ID NO: 443440 - DNA, 140 bp, Artificial Sequence
  Synthetic
atggccgactcccaagtacgttccatagctggtccagtcctccgggcatgttccttcaaagaattgcattgcggctgctaaataagagcatacatcgtcggggtcaagcttagctgcattggagacccagcatggcgtat

SEQ ID NO: 443441 - DNA, 140 bp, Artificial Sequence
  Synthetic
atacgccatgctgggtctccctatgtcaccaccacgtttaagagaaagcacttccgcccgacaccagatgcatgcagagcagcatataactggaagatggcaggtgaccccagatatgagcgtacttgggagtcggccat

SEQ ID NO: 443442 - DNA, 140 bp, Artificial Sequence
  Synthetic
atggccgactcccaagtacgctcatatctggggtcacctgccatcttccagttatatgctgctctgcatgcatctggtgtcgggcggaagtgctttctcttaaacgtggtggtgacatagggagacccagcatggcgtat

SEQ ID NO: 443443 - DNA, 140 bp, Artificial Sequence
  Synthetic
atacgccatgctgggtctccgttgactagggaccccaccatttcagaacatgcatccttggtaggtcttctcttgagtctgtacagattgagcaaaatatctggtcagaacaccggaaatcgtacttgggagtcggccat

SEQ ID NO: 443444 - DNA, 140 bp, Artificial Sequence
  Synthetic
atggccgactcccaagtacgatttccggtgttctgaccagatattttgctcaatctgtacagactcaagagaagacctaccaaggatgcatgttctgaaatggtggggtccctagtcaacggagacccagcatggcgtat

SEQ ID NO: 443445 - DNA, 140 bp, Artificial Sequence
  Synthetic
atacgccatgctgggtctccgtgctaactggagcaccataccaaacttcagattcttagctggaacttacgacatgtttttctcccggattgaacatctgtattcggcaattagagtgggcgtacttgggagtcggccat

SEQ ID NO: 443446 - DNA, 140 bp, Artificial Sequence
  Synthetic
atggccgactcccaagtacgcccactctaattgccgaatacagatgttcaatccgggagaaaaacatgtcgtaagttccagctaagaatctgaagtttggtatggtgctccagttagcacggagacccagcatggcgtat

SEQ ID NO: 443447 - DNA, 140 bp, Artificial Sequence
  Synthetic
aggccctggctgctgatatgcatctggatgcctgaaaatccgagactagggacttcttgtgacattttcatcaatagcagagggaagagagcatccaaagggagcaagacctgtggatttgaccttttgggacagcggtg

SEQ ID NO: 443448 - DNA, 140 bp, Artificial Sequence
  Synthetic
caccgctgtcccaaaaggtcaaatccacaggtcttgctccctttggatgctctcttccctctgctattgatgaaaatgtcacaagaagtccctagtctcggattttcaggcatccagatgcatatcagcagccagggcct

SEQ ID NO: 443449 - DNA, 140 bp, Artificial Sequence
  Synthetic
atacgccatgctgggtctcccaaagatcaaatatgggggctactaattgtgacgaaggactttgtttactctcagagttcaaattgtctttttgacaggaactatacacttatgctgaaacgtacttgggagtcggccat

SEQ ID NO: 443450 - DNA, 140 bp, Artificial Sequence
  Synthetic
atggccgactcccaagtacgtttcagcataagtgtatagttcctgtcaaaaagacaatttgaactctgagagtaaacaaagtccttcgtcacaattagtagcccccatatttgatctttgggagacccagcatggcgtat

SEQ ID NO: 443451 - DNA, 140 bp, Artificial Sequence
  Synthetic
atacgccatgctgggtctccttccacaagaactttgaagaggagataagaaggatgtttgaaccgggacaagagaccgcagttcctcactcctatttcatccacttccggtctttgggcccgtacttgggagtcggccat

SEQ ID NO: 443452 - DNA, 140 bp, Artificial Sequence
  Synthetic
atggccgactcccaagtacgggcccaaagaccggaagtggatgaaataggagtgaggaactgcggtctcttgtcccggttcaaacatccttcttatctcctcttcaaagttcttgtggaaggagacccagcatggcgtat

SEQ ID NO: 443453 - DNA, 140 bp, Artificial Sequence
  Synthetic
atacgccatgctgggtctccaatttggttgtggaggacgagggatgcaccaacctgtcaggattttcctacatggaacttaaagtagggtacatttcagccataaaggtgaacgggtttacgtacttgggagtcggccat

SEQ ID NO: 443454 - DNA, 140 bp, Artificial Sequence
  Synthetic
atggccgactcccaagtacgtaaacccgttcacctttatggctgaaatgtaccctactttaagttccatgtaggaaaatcctgacaggttggtgcatccctcgtcctccacaaccaaattggagacccagcatggcgtat

SEQ ID NO: 443455 - DNA, 140 bp, Artificial Sequence
  Synthetic
atacgccatgctgggtctcccacagttattgcaacatgtgccccacatgaaatgtctgttcttggaggttatctgggggaggagttcttcggaagagggacctttgaaagaagattctttcgtacttgggagtcggccat

SEQ ID NO: 443456 - DNA, 140 bp, Artificial Sequence
  Synthetic
atggccgactcccaagtacgaaagaatcttctttcaaaggtccctcttccgaagaactcctcccccagataacctccaagaacagacatttcatgtggggcacatgttgcaataactgtgggagacccagcatggcgtat

SEQ ID NO: 443457 - DNA, 140 bp, Artificial Sequence
  Synthetic
atacgccatgctgggtctccacttttctggtgagaccaggagtcctgaggcagtctatactcggatcatgatgaatggaggccgactcaaaagatcgcacataagaagatatgtctcagtcgtacttgggagtcggccat

SEQ ID NO: 443458 - DNA, 140 bp, Artificial Sequence
  Synthetic
atggccgactcccaagtacgactgagacatatcttcttatgtgcgatcttttgagtcggcctccattcatcatgatccgagtatagactgcctcaggactcctggtctcaccagaaaagtggagacccagcatggcgtat

SEQ ID NO: 443459 - DNA, 140 bp, Artificial Sequence
  Synthetic
aggccctggctgctgatatgtgcctgacgaagacttgataattggtcttaagccaaaggaaagagagctgaagattgaaggtcgattctttgcgttgatgtcttggaatttaagattgtagaccttttgggacagcggtg

SEQ ID NO: 443460 - DNA, 140 bp, Artificial Sequence
  Synthetic
caccgctgtcccaaaaggtctacaatcttaaattccaagacatcaacgcaaagaatcgaccttcaatcttcagctctctttcctttggcttaagaccaattatcaagtcttcgtcaggcacatatcagcagccagggcct

SEQ ID NO: 443461 - DNA, 140 bp, Artificial Sequence
  Synthetic
atacgccatgctgggtctcccactaaattgtgtacctccttcatgaaaaaaactaacacccctccttttgaaccatcccaaacatgagcaagatcttcgtcaaccccagcgcgatcagggcgtacttgggagtcggccat

SEQ ID NO: 443462 - DNA, 140 bp, Artificial Sequence
  Synthetic
atggccgactcccaagtacgccctgatcgcgctggggttgacgaagatcttgctcatgtttgggatggttcaaaaggaggggtgttagtttttttcatgaaggaggtacacaatttagtgggagacccagcatggcgtat

SEQ ID NO: 443463 - DNA, 140 bp, Artificial Sequence
  Synthetic
aggccctggctgctgatatgttgctaaccgaacctctcccctcagtccctctagacaataaagtccgagatgtcctaaagtcaacatgaaaaaaacaggcaacaccactgataaaatgaagaccttttgggacagcggtg

SEQ ID NO: 443464 - DNA, 140 bp, Artificial Sequence
  Synthetic
caccgctgtcccaaaaggtcttcattttatcagtggtgttgcctgtttttttcatgttgactttaggacatctcggactttattgtctagagggactgaggggagaggttcggttagcaacatatcagcagccagggcct

SEQ ID NO: 443465 - DNA, 140 bp, Artificial Sequence
  Synthetic
aggccctggctgctgatatggacgggaaggaaagtgtctgtcacctcccaaagcgggagggtcatatcttcctgggagtcatataaaagcgggggtgagactaagctgtaaaaacaggccgaccttttgggacagcggtg

SEQ ID NO: 443466 - DNA, 140 bp, Artificial Sequence
  Synthetic
caccgctgtcccaaaaggtcggcctgtttttacagcttagtctcacccccgcttttatatgactcccaggaagatatgaccctcccgctttgggaggtgacagacactttccttcccgtccatatcagcagccagggcct

SEQ ID NO: 443467 - DNA, 140 bp, Artificial Sequence
  Synthetic
atacgccatgctgggtctccggacagtctccctgatgacatgagacggcttcaattagatgatgaaaagtcttctggccttggcgaggcagccaaggcaggggagagcaagtgtcaggagcgtacttgggagtcggccat

SEQ ID NO: 443468 - DNA, 140 bp, Artificial Sequence
  Synthetic
atggccgactcccaagtacgctcctgacacttgctctcccctgccttggctgcctcgccaaggccagaagacttttcatcatctaattgaagccgtctcatgtcatcagggagactgtccggagacccagcatggcgtat

SEQ ID NO: 443469 - DNA, 140 bp, Artificial Sequence
  Synthetic
aggccctggctgctgatatgttttctaggactcatgaatttttccagaagtcttgggtctattattcagacagatcagaccttatcgggttatgggaggaccaaatatactgcttggacagaccttttgggacagcggtg

SEQ ID NO: 443470 - DNA, 140 bp, Artificial Sequence
  Synthetic
caccgctgtcccaaaaggtctgtccaagcagtatatttggtcctcccataacccgataaggtctgatctgtctgaataatagacccaagacttctggaaaaattcatgagtcctagaaaacatatcagcagccagggcct

SEQ ID NO: 443471 - DNA, 140 bp, Artificial Sequence
  Synthetic
aggccctggctgctgatatgattcaagagtcacaagacttccattaatcatctcaatcgatcagatatggttgtgtagattctcataatacaagagatcttctagcagttccagtgaccagaccttttgggacagcggtg

SEQ ID NO: 443472 - DNA, 140 bp, Artificial Sequence
  Synthetic
caccgctgtcccaaaaggtctggtcactggaactgctagaagatctcttgtattatgagaatctacacaaccatatctgatcgattgagatgattaatggaagtcttgtgactcttgaatcatatcagcagccagggcct

SEQ ID NO: 443473 - DNA, 140 bp, Artificial Sequence
  Synthetic
atacgccatgctgggtctccaacgggaaagtcaatcatccaaagtcagaatggcagctcaaacagcctctggccctcatgcattagaatggtctgccgccaatgaggaagaagatctgtccgtacttgggagtcggccat

SEQ ID NO: 443474 - DNA, 140 bp, Artificial Sequence
  Synthetic
atggccgactcccaagtacggacagatcttcttcctcattggcggcagaccattctaatgcatgagggccagaggctgtttgagctgccattctgactttggatgattgactttcccgttggagacccagcatggcgtat

SEQ ID NO: 443475 - DNA, 140 bp, Artificial Sequence
  Synthetic
atacgccatgctgggtctccagtttagagaagcgatcctcctatccaagactcatagggacaactttatactcttcttgaaatctgtcgagcctttgtttccccgatttctcagtgagctcgtacttgggagtcggccat

SEQ ID NO: 443476 - DNA, 140 bp, Artificial Sequence
  Synthetic
atggccgactcccaagtacgagctcactgagaaatcggggaaacaaaggctcgacagatttcaagaagagtataaagttgtccctatgagtcttggataggaggatcgcttctctaaactggagacccagcatggcgtat

SEQ ID NO: 443477 - DNA, 140 bp, Artificial Sequence
  Synthetic
atacgccatgctgggtctccctaaagatgaaccttgatgacatagtcaaagagtcaaagaatgtgccaggtgttacccgcttggcccacgaaggatctaaactccctctgagatgtgtgccgtacttgggagtcggccat

SEQ ID NO: 443478 - DNA, 140 bp, Artificial Sequence
  Synthetic
atggccgactcccaagtacggcacacatctcagagggagtttagatccttcgtgggccaagcgggtaacacctggcacattctttgactctttgactatgtcatcaaggttcatctttagggagacccagcatggcgtat

SEQ ID NO: 443479 - DNA, 140 bp, Artificial Sequence
  Synthetic
aggccctggctgctgatatgcagttgagtcagaggccgaacctcgaggagctcccactgtccccaacatcctgaggaactctgactacaatctcaactcccctttgatagaagatcctgcgaccttttgggacagcggtg

SEQ ID NO: 443480 - DNA, 140 bp, Artificial Sequence
  Synthetic
caccgctgtcccaaaaggtcgcaggatcttctatcaaaggggagttgagattgtagtcagagttcctcaggatgttggggacagtgggagctcctcgaggttcggcctctgactcaactgcatatcagcagccagggcct

SEQ ID NO: 443481 - DNA, 140 bp, Artificial Sequence
  Synthetic
atacgccatgctgggtctcctcgggtgggttgccctagccagttccaggaagttccagattctggttgagcctgacaagctaaacaaaataatgcaagatgacttgaaccgttatgtgtccgtacttgggagtcggccat

SEQ ID NO: 443482 - DNA, 140 bp, Artificial Sequence
  Synthetic
atggccgactcccaagtacggacacataacggttcaagtcatcttgcattattttgtttagcttgtcaggctcaaccagaatctggaacttcctggaactggctagggcaacccacccgaggagacccagcatggcgtat

SEQ ID NO: 443483 - DNA, 140 bp, Artificial Sequence
  Synthetic
atacgccatgctgggtctcctgatcgagccccaacgtgaaaaaaacaggcaacaccactgatacaatgaacttcctacgcaaaatagtgaaaaattgcagagatgaggacaccaataagccgtacttgggagtcggccat

SEQ ID NO: 443484 - DNA, 140 bp, Artificial Sequence
  Synthetic
atggccgactcccaagtacggcttattggtgtcctcatctctgcaatttttcactattttgcgtaggaagttcattgtatcagtggtgttgcctgtttttttcacgttggggctcgatcaggagacccagcatggcgtat

SEQ ID NO: 443485 - DNA, 140 bp, Artificial Sequence
  Synthetic
aggccctggctgctgatatgcttcctacgcaaaatagtgaaaaattgcagagatgaggacaccaataagccctctctcgtatcggcccctccagatgacgatgatttatggttgccccctgaccttttgggacagcggtg

SEQ ID NO: 443486 - DNA, 140 bp, Artificial Sequence
  Synthetic
caccgctgtcccaaaaggtcagggggcaaccataaatcatcgtcatctggaggggccgatacgagagagggcttattggtgtcctcatctctgcaatttttcactattttgcgtaggaagcatatcagcagccagggcct

SEQ ID NO: 443487 - DNA, 140 bp, Artificial Sequence
  Synthetic
atacgccatgctgggtctccttaggatcttgcgccatattttgagatcattcgatgagatctattctggaaatcaaagaatgatcggattggttaaagttgttgttggactggccttgtccgtacttgggagtcggccat

SEQ ID NO: 443488 - DNA, 140 bp, Artificial Sequence
  Synthetic
atggccgactcccaagtacggacaaggccagtccaacaacaactttaaccaatccgatcattctttgatttccagaatagatctcatcgaatgatctcaaaatatggcgcaagatcctaaggagacccagcatggcgtat

SEQ ID NO: 443489 - DNA, 140 bp, Artificial Sequence
  Synthetic
aggccctggctgctgatatgtttatggaaagatttgacttcagtcgatattggaaaagatttagtcaagttcaaagatcaaatctggggattgttaattgtgacgaaggactttgtgtacgaccttttgggacagcggtg

SEQ ID NO: 443490 - DNA, 140 bp, Artificial Sequence
  Synthetic
caccgctgtcccaaaaggtcgtacacaaagtccttcgtcacaattaacaatccccagatttgatctttgaacttgactaaatcttttccaatatcgactgaagtcaaatctttccataaacatatcagcagccagggcct

SEQ ID NO: 443491 - DNA, 140 bp, Artificial Sequence
  Synthetic
atacgccatgctgggtctccttggaatactctcaagagattacatgggatgatgatacagagttcgttgggctgcaaatgcgggtaagtgcaaggcaatgtcacatccagggcaggatctcgtacttgggagtcggccat

SEQ ID NO: 443492 - DNA, 140 bp, Artificial Sequence
  Synthetic
atggccgactcccaagtacgagatcctgccctggatgtgacattgccttgcacttacccgcatttgcagcccaacgaactctgtatcatcatcccatgtaatctcttgagagtattccaaggagacccagcatggcgtat

SEQ ID NO: 443493 - DNA, 140 bp, Artificial Sequence
  Synthetic
atacgccatgctgggtctccgtagttacagtacatcccacaagttcctcagttgtttacctctggaggagagaacacacaggcttcactccaaccttcaggagcaatagaacaaaaacatcgtacttgggagtcggccat

SEQ ID NO: 443494 - DNA, 140 bp, Artificial Sequence
  Synthetic
atggccgactcccaagtacgatgtttttgttctattgctcctgaaggttggagtgaagcctgtgtgttctctcctccagaggtaaacaactgaggaacttgtgggatgtactgtaactacggagacccagcatggcgtat

SEQ ID NO: 443495 - DNA, 140 bp, Artificial Sequence
  Synthetic
aggccctggctgctgatatgctgtgttcaagagaacagggtcagccttgcataggttcaaatctgccagatacagtgaaggaggatattcttctgtttgccctaatctcctctctcatatgaccttttgggacagcggtg

SEQ ID NO: 443496 - DNA, 140 bp, Artificial Sequence
  Synthetic
caccgctgtcccaaaaggtcatatgagagaggagattagggcaaacagaagaatatcctccttcactgtatctggcagatttgaacctatgcaaggctgaccctgttctcttgaacacagcatatcagcagccagggcct

SEQ ID NO: 443497 - DNA, 140 bp, Artificial Sequence
  Synthetic
atacgccatgctgggtctcctacagtgaaggaggatattcttctgtttgccctaatctcctctctcatatttctgtaagtacagacaccatgtctgatctgacccaggatgggaagaactcgtacttgggagtcggccat

SEQ ID NO: 443498 - DNA, 140 bp, Artificial Sequence
  Synthetic
atggccgactcccaagtacgagttcttcccatcctgggtcagatcagacatggtgtctgtacttacagaaatatgagagaggagattagggcaaacagaagaatatcctccttcactgtaggagacccagcatggcgtat

SEQ ID NO: 443499 - DNA, 140 bp, Artificial Sequence
  Synthetic
aggccctggctgctgatatgactttagaagctctaagatgacatacctgactctgatcacctaccagtctcatcttttacttcagagagttgataaaaatctctccaaaagtatgagagcgaccttttgggacagcggtg

SEQ ID NO: 443500 - DNA, 140 bp, Artificial Sequence
  Synthetic
caccgctgtcccaaaaggtcgctctcatacttttggagagatttttatcaactctctgaagtaaaagatgagactggtaggtgatcagagtcaggtatgtcatcttagagcttctaaagtcatatcagcagccagggcct

SEQ ID NO: 443501 - DNA, 140 bp, Artificial Sequence
  Synthetic
atacgccatgctgggtctccaagacttaagagaagatggtccctcaagctctcctatttgtgcctcttctgattccatcagtgtgcctggggaagttcccgatctacacaatcccagacacgtacttgggagtcggccat

SEQ ID NO: 443502 - DNA, 140 bp, Artificial Sequence
  Synthetic
atggccgactcccaagtacgtgtctgggattgtgtagatcgggaacttccccaggcacactgatggaatcagaagaggcacaaataggagagcttgagggaccatcttctcttaagtcttggagacccagcatggcgtat

SEQ ID NO: 443503 - DNA, 140 bp, Artificial Sequence
  Synthetic
atacgccatgctgggtctccagctaggtccttggagtcctatcgatatacatcatctcagttgtcctaacaatctggttgttgaagatgagggatgcagtaatctatcaggattttcttacgtacttgggagtcggccat

SEQ ID NO: 443504 - DNA, 140 bp, Artificial Sequence
  Synthetic
atggccgactcccaagtacgtaagaaaatcctgatagattactgcatccctcatcttcaacaaccagattgttaggacaactgagatgatgtatatcgataggactccaaggacctagctggagacccagcatggcgtat

SEQ ID NO: 443505 - DNA, 140 bp, Artificial Sequence
  Synthetic
atacgccatgctgggtctcctatgtcactacaacattcaagagaaaacacttccgcccgatgcctgatgcctgcagatctgcatataactggaaaatagcaggtgatcccaggtatgaagcgtacttgggagtcggccat

SEQ ID NO: 443506 - DNA, 140 bp, Artificial Sequence
  Synthetic
atggccgactcccaagtacgcttcatacctgggatcacctgctattttccagttatatgcagatctgcaggcatcaggcatcgggcggaagtgttttctcttgaatgttgtagtgacataggagacccagcatggcgtat

SEQ ID NO: 443507 - DNA, 140 bp, Artificial Sequence
  Synthetic
aggccctggctgctgatatgtttctataccccaaaaaattccagccgcttacccgactacaatgaaggaaggcaatagatctattttgtgttacctccaacatgtgctgcgatatgagcggaccttttgggacagcggtg

SEQ ID NO: 443508 - DNA, 140 bp, Artificial Sequence
  Synthetic
caccgctgtcccaaaaggtccgctcatatcgcagcacatgttggaggtaacacaaaatagatctattgccttccttcattgtagtcgggtaagcggctggaattttttggggtatagaaacatatcagcagccagggcct

SEQ ID NO: 443509 - DNA, 140 bp, Artificial Sequence
  Synthetic
atacgccatgctgggtctcccccatatgacaagtcccttcattcaatggttttccctaatggaaaatgttcgggaataacggtctactctacttactgctcaactaaccacgattatacccgtacttgggagtcggccat

SEQ ID NO: 443510 - DNA, 140 bp, Artificial Sequence
  Synthetic
atggccgactcccaagtacgggtataatcgtggttagttgagcagtaagtagagtagaccgttattcccgaacattttccattagggaaaaccattgaatgaagggacttgtcatatgggggagacccagcatggcgtat

SEQ ID NO: 443511 - DNA, 140 bp, Artificial Sequence
  Synthetic
atacgccatgctgggtctcctggatgaaagaggcttgtataagtctctgagaggagcatgtaagctcaagttatgcggagtgcctggactcaggctcatggatgggacttgggccacaatcgtacttgggagtcggccat

SEQ ID NO: 443512 - DNA, 140 bp, Artificial Sequence
  Synthetic
atggccgactcccaagtacgattgtggcccaagtcccatccatgagcctgagtccaggcactccgcataacttgagcttacatgctcctctcagagacttatacaagcctctttcatccaggagacccagcatggcgtat

SEQ ID NO: 443513 - DNA, 140 bp, Artificial Sequence
  Synthetic
aggccctggctgctgatatggttttttgctttgatgtcctggaatctgaggttgtattttgtcatcacagagaagctcctggccaattatatcttgccactttttgacgcattgactatggaccttttgggacagcggtg

SEQ ID NO: 443514 - DNA, 140 bp, Artificial Sequence
  Synthetic
caccgctgtcccaaaaggtccatagtcaatgcgtcaaaaagtggcaagatataattggccaggagcttctctgtgatgacaaaatacaacctcagattccaggacatcaaagcaaaaaaccatatcagcagccagggcct

SEQ ID NO: 443515 - DNA, 140 bp, Artificial Sequence
  Synthetic
atacgccatgctgggtctccgtcaagaaaagagaggaatgtctggatacactagagtctattatgaccactaaatcagtcagtttcagacgtctcagtcacttgaggaaacttgttcctgcgtacttgggagtcggccat

SEQ ID NO: 443516 - DNA, 140 bp, Artificial Sequence
  Synthetic
atggccgactcccaagtacgcaggaacaagtttcctcaagtgactgagacgtctgaaactgactgatttagtggtcataatagactctagtgtatccagacattcctctcttttcttgacggagacccagcatggcgtat

SEQ ID NO: 443517 - DNA, 140 bp, Artificial Sequence
  Synthetic
atacgccatgctgggtctccatgtccaatggcccgacctgttggaatggtcaatatggagggctagaaggcttgcggcagaagggctggagtttggttagcctattaatgatagacagagcgtacttgggagtcggccat

SEQ ID NO: 443518 - DNA, 140 bp, Artificial Sequence
  Synthetic
atggccgactcccaagtacgctctgtctatcattaataggctaaccaaactccagcccttctgccgcaagccttctagccctccatattgaccattccaacaggtcgggccattggacatggagacccagcatggcgtat

SEQ ID NO: 443519 - DNA, 140 bp, Artificial Sequence
  Synthetic
atacgccatgctgggtctccgtgtctgagagtgggagggaggtgtcatcctcatgtgaatggagtgttcttcaatggtgtgatcatgggtcctgacggtcatgtcctgatcccagagatgcgtacttgggagtcggccat

SEQ ID NO: 443520 - DNA, 140 bp, Artificial Sequence
  Synthetic
atggccgactcccaagtacgcatctctgggatcaggacatgaccgtcaggacccatgatcacaccattgaagaacactccattcacatgaggatgacacctccctcccactctcagacacggagacccagcatggcgtat

SEQ ID NO: 443521 - DNA, 140 bp, Artificial Sequence
  Synthetic
atacgccatgctgggtctcctcaagagatgaagaatgttcattaaccatctcaactgatcagacacggtcaagtagatctttatgaagtgtgatgtcttttgatagtatcattgactaatcgtacttgggagtcggccat

SEQ ID NO: 443522 - DNA, 140 bp, Artificial Sequence
  Synthetic
atggccgactcccaagtacgattagtcaatgatactatcaaaagacatcacacttcataaagatctacttgaccgtgtctgatcagttgagatggttaatgaacattcttcatctcttgaggagacccagcatggcgtat

SEQ ID NO: 443523 - DNA, 140 bp, Artificial Sequence
  Synthetic
atacgccatgctgggtctccatgaggctgaggactttgttgaagttcaccttccggatgttcacaaacaagtctctggaatagacctcggcctccccagctggggaaggtatttgttgatcgtacttgggagtcggccat

SEQ ID NO: 443524 - DNA, 140 bp, Artificial Sequence
  Synthetic
atggccgactcccaagtacgatcaacaaataccttccccagctggggaggccgaggtctattccagagacttgtttgtgaacatccggaaggtgaacttcaacaaagtcctcagcctcatggagacccagcatggcgtat

SEQ ID NO: 443525 - DNA, 140 bp, Artificial Sequence
  Synthetic
aggccctggctgctgatatggtctctggaatagacctcggcctccccagctggggaaggtatttgttgatgattgccggtgctctgatgactctaactctggtaatcttcttgatgatatgaccttttgggacagcggtg

SEQ ID NO: 443526 - DNA, 140 bp, Artificial Sequence
  Synthetic
caccgctgtcccaaaaggtcatatcatcaagaagattaccagagttagagtcatcagagcaccggcaatcatcaacaaataccttccccagctggggaggccgaggtctattccagagaccatatcagcagccagggcct

SEQ ID NO: 443527 - DNA, 140 bp, Artificial Sequence
  Synthetic
atacgccatgctgggtctccatgggaatcctataagagtggaagcgaaactcggctgtgagggcatgttatttcctctatgccttgcgttcagaagattgccaccctctctcagggacatcgtacttgggagtcggccat

SEQ ID NO: 443528 - DNA, 140 bp, Artificial Sequence
  Synthetic
atggccgactcccaagtacgatgtccctgagagagggtggcaatcttctgaacgcaaggcatagaggaaataacatgccctcacagccgagtttcgcttccactcttataggattcccatggagacccagcatggcgtat

SEQ ID NO: 443529 - DNA, 140 bp, Artificial Sequence
  Synthetic
aggccctggctgctgatatggaagttgaaagacaccttcaagggtataacaggtggatcaccctcgaagacctcagatctagatcttctctactagactacagctgcttataaactggacgaccttttgggacagcggtg

SEQ ID NO: 443530 - DNA, 140 bp, Artificial Sequence
  Synthetic
caccgctgtcccaaaaggtcgtccagtttataagcagctgtagtctagtagagaagatctagatctgaggtcttcgagggtgatccacctgttatacccttgaaggtgtctttcaacttccatatcagcagccagggcct

SEQ ID NO: 443531 - DNA, 140 bp, Artificial Sequence
  Synthetic
atacgccatgctgggtctccgggttaagaaaatgagggatttttcattaatcatcttgactaattggacatagtcatgtggatcctgataatgtataaagtatcccaatagcatcagcaacgtacttgggagtcggccat

SEQ ID NO: 443532 - DNA, 140 bp, Artificial Sequence
  Synthetic
atggccgactcccaagtacgttgctgatgctattgggatactttatacattatcaggatccacatgactatgtccaattagtcaagatgattaatgaaaaatccctcattttcttaacccggagacccagcatggcgtat

SEQ ID NO: 443533 - DNA, 140 bp, Artificial Sequence
  Synthetic
atacgccatgctgggtctcctgggatgggttgccctggcaaattccaaaaagttccagctgttggttgagcctgacaagctaaacaagataatgcaagatgacctgaaccgctatgtgtccgtacttgggagtcggccat

SEQ ID NO: 443534 - DNA, 140 bp, Artificial Sequence
  Synthetic
atggccgactcccaagtacggacacatagcggttcaggtcatcttgcattatcttgtttagcttgtcaggctcaaccaacagctggaactttttggaatttgccagggcaacccatcccaggagacccagcatggcgtat

SEQ ID NO: 443535 - DNA, 140 bp, Artificial Sequence
  Synthetic
atacgccatgctgggtctccacaagtccctctaaaccaaacaggggtcaactgagagaagtgatttgcctcctatgaaggacacaagtaatggatcataatcatctcacatccaattaagcgtacttgggagtcggccat

SEQ ID NO: 443536 - DNA, 140 bp, Artificial Sequence
  Synthetic
atggccgactcccaagtacgcttaattggatgtgagatgattatgatccattacttgtgtccttcataggaggcaaatcacttctctcagttgacccctgtttggtttagagggacttgtggagacccagcatggcgtat

SEQ ID NO: 443537 - DNA, 140 bp, Artificial Sequence
  Synthetic
atacgccatgctgggtctcctacttttcttgaagtctgttgaacccctatttccccgatttctcagtgagctcttcagctcatccttcttggggattcctgagtcaataattggactgatcgtacttgggagtcggccat

SEQ ID NO: 443538 - DNA, 140 bp, Artificial Sequence
  Synthetic
atggccgactcccaagtacgatcagtccaattattgactcaggaatccccaagaaggatgagctgaagagctcactgagaaatcggggaaataggggttcaacagacttcaagaaaagtaggagacccagcatggcgtat

SEQ ID NO: 443539 - DNA, 140 bp, Artificial Sequence
  Synthetic
atacgccatgctgggtctccggaccacaatgattgacccaggggatgtttacgatgaccctgttgatctgattgaatcagaggtcgagcccaaagggaactccaccatccctaacattttcgtacttgggagtcggccat

SEQ ID NO: 443540 - DNA, 140 bp, Artificial Sequence
  Synthetic
atggccgactcccaagtacgaaaatgttagggatggtggagttccctttgggctcgacctctgattcaatcagatcaacagggtcatcgtaaacatcccctgggtcaatcattgtggtccggagacccagcatggcgtat

SEQ ID NO: 443541 - DNA, 140 bp, Artificial Sequence
  Synthetic
atacgccatgctgggtctccttggtggttgattatttaagggttggagggttagaagtagtttgagttgttattttggtttttgaggattggttttttttttgagaaggagtgggtgttgcgtacttgggagtcggccat

SEQ ID NO: 443542 - DNA, 140 bp, Artificial Sequence
  Synthetic
atggccgactcccaagtacgcaacacccactccttctcaaaaaaaaaaccaatcctcaaaaaccaaaataacaactcaaactacttctaaccctccaacccttaaataatcaaccaccaaggagacccagcatggcgtat

SEQ ID NO: 443543 - DNA, 140 bp, Artificial Sequence
  Synthetic
aggccctggctgctgatatgcggtgcctcacccttctgagatgttgggcctgcttcctaagtcttccatctcttgcacttgtggaaccacaggaggagaaaatcccagagtttcagtatcgaccttttgggacagcggtg

SEQ ID NO: 443544 - DNA, 140 bp, Artificial Sequence
  Synthetic
caccgctgtcccaaaaggtcgatactgaaactctgggattttctcctcctgtggttccacaagtgcaagagatggaagacttaggaagcaggcccaacatctcagaagggtgaggcaccgcatatcagcagccagggcct

SEQ ID NO: 443545 - DNA, 140 bp, Artificial Sequence
  Synthetic
atacgccatgctgggtctccgaaagtggacttaggatctctcaaagtgggtggggctgcagcacaatccatgatctctctctggctacaaggtgctcactctgaatcaaccaggagccggcgtacttgggagtcggccat

SEQ ID NO: 443546 - DNA, 140 bp, Artificial Sequence
  Synthetic
atggccgactcccaagtacgccggctcctggttgattcagagtgagcaccttgtagccagagagagatcatggattgtgctgcagccccacccactttgagagatcctaagtccactttcggagacccagcatggcgtat

SEQ ID NO: 443547 - DNA, 140 bp, Artificial Sequence
  Synthetic
atacgccatgctgggtctccaaggggtactcagctgtctagagagggtggattacgataaagcatttggaaggtatctggctaacatatattcttcctatttgttctttcatgtaatcaccgtacttgggagtcggccat

SEQ ID NO: 443548 - DNA, 140 bp, Artificial Sequence
  Synthetic
atggccgactcccaagtacggtgattacatgaaagaacaaataggaagaatatatgttagccagataccttccaaatgctttatcgtaatccaccctctctagacagctgagtaccccttggagacccagcatggcgtat

SEQ ID NO: 443549 - DNA, 140 bp, Artificial Sequence
  Synthetic
atacgccatgctgggtctccaaagatcaaatatgggggcatctggttgtgaccaaagacttcatatattctcaaagttctgactgcctttttgataggaactatacacttatgctgaaagcgtacttgggagtcggccat

SEQ ID NO: 443550 - DNA, 140 bp, Artificial Sequence
  Synthetic
atggccgactcccaagtacgctttcagcataagtgtatagttcctatcaaaaaggcagtcagaactttgagaatatatgaagtctttggtcacaaccagatgcccccatatttgatctttggagacccagcatggcgtat

SEQ ID NO: 443551 - DNA, 140 bp, Artificial Sequence
  Synthetic
atacgccatgctgggtctccatcacactctttcactagaacaagactagcgtcatggctctcagaaaacagaggaggaccggttccaagcgagaaggtcattattacggctctctccaaacgtacttgggagtcggccat

SEQ ID NO: 443552 - DNA, 140 bp, Artificial Sequence
  Synthetic
atggccgactcccaagtacgtttggagagagccgtaataatgaccttctcgcttggaaccggtcctcctctgttttctgagagccatgacgctagtcttgttctagtgaaagagtgtgatggagacccagcatggcgtat

SEQ ID NO: 443553 - DNA, 140 bp, Artificial Sequence
  Synthetic
aggccctggctgctgatatgacctccgatgtaacaggtgtgtaaggcccatcgacgatatcatactggagacctctcaggtattcgagtttccggacgtgtcaaaaaggatatctaggatgaccttttgggacagcggtg

SEQ ID NO: 443554 - DNA, 140 bp, Artificial Sequence
  Synthetic
caccgctgtcccaaaaggtcatcctagatatcctttttgacacgtccggaaactcgaatacctgagaggtctccagtatgatatcgtcgatgggccttacacacctgttacatcggaggtcatatcagcagccagggcct

SEQ ID NO: 443555 - DNA, 140 bp, Artificial Sequence
  Synthetic
atacgccatgctgggtctcctaaaaatcttagagccttacgttgtgaacagtttagtcaatagagcagagagatttaggcctctcatccattctttaggagatttcccttcatttataagcgtacttgggagtcggccat

SEQ ID NO: 443556 - DNA, 140 bp, Artificial Sequence
  Synthetic
atggccgactcccaagtacgcttataaatgaagggaaatctcctaaagaatggatgagaggcctaaatctctctgctctattgactaaactgttcacaacgtaaggctctaagatttttaggagacccagcatggcgtat

SEQ ID NO: 443557 - DNA, 140 bp, Artificial Sequence
  Synthetic
aggccctggctgctgatatgtcctgattgcccgaaaaggagacaagatcaccccagattctctggtggagataaagcgtactgatgtcgaagggaattgggctctgacaggaggcgtggagaccttttgggacagcggtg

SEQ ID NO: 443558 - DNA, 140 bp, Artificial Sequence
  Synthetic
caccgctgtcccaaaaggtctccacgcctcctgtcagagcccaattcccttcgacatcagtacgctttatctccaccagagaatctggggtgatcttgtctccttttcgggcaatcaggacatatcagcagccagggcct

SEQ ID NO: 443559 - DNA, 140 bp, Artificial Sequence
  Synthetic
aggccctggctgctgatatgcccccagagactatttaagagggctcgcaagaggggtcctgatagggtcttcgatctgcttcttgaccagaatgaccaacatcaacataaatagacctctgaccttttgggacagcggtg

SEQ ID NO: 443560 - DNA, 140 bp, Artificial Sequence
  Synthetic
caccgctgtcccaaaaggtcagaggtctatttatgttgatgttggtcattctggtcaagaagcagatcgaagaccctatcaggacccctcttgcgagccctcttaaatagtctctgggggcatatcagcagccagggcct

SEQ ID NO: 443561 - DNA, 140 bp, Artificial Sequence
  Synthetic
atacgccatgctgggtctcctatggctgttataggcactgggggcacccttatatagattacagaaagggtctttcaaagttgtacgaccaagtccacatcaagaaggtaatagataagccgtacttgggagtcggccat

SEQ ID NO: 443562 - DNA, 140 bp, Artificial Sequence
  Synthetic
atggccgactcccaagtacggcttatctattaccttcttgatgtggacttggtcgtacaactttgaaagaccctttctgtaatctatataagggtgcccccagtgcctataacagccataggagacccagcatggcgtat

SEQ ID NO: 443563 - DNA, 140 bp, Artificial Sequence
  Synthetic
atacgccatgctgggtctccttttatggtttgtgattatattttgagaaattttttttttgattttatttgtttgattatttggattttaatattgtttaggtatgattggaataggaggcgtacttgggagtcggccat

SEQ ID NO: 443564 - DNA, 140 bp, Artificial Sequence
  Synthetic
atggccgactcccaagtacgcctcctattccaatcatacctaaacaatattaaaatccaaataatcaaacaaataaaatcaaaaaaaaaatttctcaaaatataatcacaaaccataaaaggagacccagcatggcgtat

SEQ ID NO: 443565 - DNA, 140 bp, Artificial Sequence
  Synthetic
atacgccatgctgggtctccggaccatcctctgaccccctatattaagacacaaacatggcctcccaaacatatcgtagatttagtaggtgacacctggcacaggcttccaatcacacaacgtacttgggagtcggccat

SEQ ID NO: 443566 - DNA, 140 bp, Artificial Sequence
  Synthetic
atggccgactcccaagtacgttgtgtgattggaagcctgtgccaggtgtcacctactaaatctacgatatgtttgggaggccatgtttgtgtcttaatatagggggtcagaggatggtccggagacccagcatggcgtat

SEQ ID NO: 443567 - DNA, 140 bp, Artificial Sequence
  Synthetic
aggccctggctgctgatatggacttccgaagctctaaaatgacgtacctaaccctcatcacttatcagtctcatcttctacttcagagggttgaaagaaatttgtcaaaaagcatgaggagaccttttgggacagcggtg

SEQ ID NO: 443568 - DNA, 140 bp, Artificial Sequence
  Synthetic
caccgctgtcccaaaaggtctcctcatgctttttgacaaatttctttcaaccctctgaagtagaagatgagactgataagtgatgagggttaggtacgtcattttagagcttcggaagtccatatcagcagccagggcct

SEQ ID NO: 443569 - DNA, 140 bp, Artificial Sequence
  Synthetic
aggccctggctgctgatatggccagatgaagacttaataattggcctcaaaccaaaggagcgagaattgaagattgagggtagattctttgctctaatgtcatggaatctaagattatatgaccttttgggacagcggtg

SEQ ID NO: 443570 - DNA, 140 bp, Artificial Sequence
  Synthetic
caccgctgtcccaaaaggtcatataatcttagattccatgacattagagcaaagaatctaccctcaatcttcaattctcgctcctttggtttgaggccaattattaagtcttcatctggccatatcagcagccagggcct

SEQ ID NO: 443571 - DNA, 140 bp, Artificial Sequence
  Synthetic
atacgccatgctgggtctccgagggggaccggttcccagcgagaaggtcattattacagctctttctaagccccctgtcaaccccagagaattcttgaaatctatagacctgggagggttcgtacttgggagtcggccat

SEQ ID NO: 443572 - DNA, 140 bp, Artificial Sequence
  Synthetic
atggccgactcccaagtacgaaccctcccaggtctatagatttcaagaattctctggggttgacagggggcttagaaagagctgtaataatgaccttctcgctgggaaccggtccccctcggagacccagcatggcgtat

SEQ ID NO: 443573 - DNA, 140 bp, Artificial Sequence
  Synthetic
atacgccatgctgggtctcctttgttatcacagagaagcttttggccaattacatcttaccactgtttgatgcactaactatgacagacaacctgaacaaagtgttcaaaaagcttattgcgtacttgggagtcggccat

SEQ ID NO: 443574 - DNA, 140 bp, Artificial Sequence
  Synthetic
atggccgactcccaagtacgcaataagctttttgaacactttgttcaggttgtctgtcatagttagtgcatcaaacagtggtaagatgtaattggccaaaagcttctctgtgataacaaaggagacccagcatggcgtat

SEQ ID NO: 443575 - DNA, 140 bp, Artificial Sequence
  Synthetic
atacgccatgctgggtctccacagggtcaccggacaggggctcttagattattcaagagtcacatatgctttccatctagactatgaaaagtggaacaatcatcagaggctggaatcgaccgtacttgggagtcggccat

SEQ ID NO: 443576 - DNA, 140 bp, Artificial Sequence
  Synthetic
atggccgactcccaagtacggtcgattccagcctctgatgattgttccacttttcatagtctagatggaaagcatatgtgactcttgaataatctaagagcccctgtccggtgaccctgtggagacccagcatggcgtat

SEQ ID NO: 443577 - DNA, 140 bp, Artificial Sequence
  Synthetic
atacgccatgctgggtctcctgacttcatgttccaaccattgatgctttatgcgcaaacatggacgtccgaactggtacaaaaagacacacggctgaaggactctacttttcattggcatcgtacttgggagtcggccat

SEQ ID NO: 443578 - DNA, 140 bp, Artificial Sequence
  Synthetic
atggccgactcccaagtacgatgccaatgaaaagtagagtccttcagccgtgtgtctttttgtaccagttcggacgtccatgtttgcgcataaagcatcaatggttggaacatgaagtcaggagacccagcatggcgtat

SEQ ID NO: 443579 - DNA, 140 bp, Artificial Sequence
  Synthetic
atacgccatgctgggtctccagatccgacctcattggattgtgggaggaccagatatattgtttagacatgtcaaatggcccgacttgctggaacggccaagatggcgggctggagggtccgtacttgggagtcggccat

SEQ ID NO: 443580 - DNA, 140 bp, Artificial Sequence
  Synthetic
atggccgactcccaagtacggaccctccagcccgccatcttggccgttccagcaagtcgggccatttgacatgtctaaacaatatatctggtcctcccacaatccaatgaggtcggatctggagacccagcatggcgtat

SEQ ID NO: 443581 - DNA, 140 bp, Artificial Sequence
  Synthetic
atacgccatgctgggtctccagttctgtgcccgacgtacatgttgtcacctgggctttctagagagggacttctctatgagttggagagtatctccagaaacgcactctcgatatatcgacgtacttgggagtcggccat

SEQ ID NO: 443582 - DNA, 140 bp, Artificial Sequence
  Synthetic
atggccgactcccaagtacgtcgatatatcgagagtgcgtttctggagatactctccaactcatagagaagtccctctctagaaagcccaggtgacaacatgtacgtcgggcacagaactggagacccagcatggcgtat

SEQ ID NO: 443583 - DNA, 140 bp, Artificial Sequence
  Synthetic
aggccctggctgctgatatgttctctatgagttggagagtatctccagaaacgcactctcgatatatcgagccattgaggagggggcatctaaattggggctcatcataaagaaagaagagaccttttgggacagcggtg

SEQ ID NO: 443584 - DNA, 140 bp, Artificial Sequence
  Synthetic
caccgctgtcccaaaaggtctcttctttctttatgatgagccccaatttagatgccccctcctcaatggctcgatatatcgagagtgcgtttctggagatactctccaactcatagagaacatatcagcagccagggcct

SEQ ID NO: 443585 - DNA, 140 bp, Artificial Sequence
  Synthetic
aggccctggctgctgatatgactgacgagggaccccactgttcccgagcatgcgtctttagtcggtcttctcttgagtctgtacaggctgagcaaaatatctgggcaaaacaccggtaacgaccttttgggacagcggtg

SEQ ID NO: 443586 - DNA, 140 bp, Artificial Sequence
  Synthetic
caccgctgtcccaaaaggtcgttaccggtgttttgcccagatattttgctcagcctgtacagactcaagagaagaccgactaaagacgcatgctcgggaacagtggggtccctcgtcagtcatatcagcagccagggcct

SEQ ID NO: 443587 - DNA, 140 bp, Artificial Sequence
  Synthetic
atacgccatgctgggtctccatctctaacgaccaaatagttaaccttgcaaatataatgtcaacagtgtccaccaacgctttgactgtcgcacaacactcccagtctttgattaagccgacgtacttgggagtcggccat

SEQ ID NO: 443588 - DNA, 140 bp, Artificial Sequence
  Synthetic
atggccgactcccaagtacgtcggcttaatcaaagactgggagtgttgtgcgacagtcaaagcgttggtggacactgttgacattatatttgcaaggttaactatttggtcgttagagatggagacccagcatggcgtat

SEQ ID NO: 443589 - DNA, 140 bp, Artificial Sequence
  Synthetic
aggccctggctgctgatatgaggatctccagtccctgagggcatgaactgggtatacaaattgaggagaacccttatcttccagtgggctgattccaggggccctcttgaaggggaggaggaccttttgggacagcggtg

SEQ ID NO: 443590 - DNA, 140 bp, Artificial Sequence
  Synthetic
caccgctgtcccaaaaggtcctcctccccttcaagagggcccctggaatcagcccactggaagataagggttctcctcaatttgtatacccagttcatgccctcagggactggagatcctcatatcagcagccagggcct

SEQ ID NO: 443591 - DNA, 140 bp, Artificial Sequence
  Synthetic
aggccctggctgctgatatgggttcacaagatggtggatgatctagaattacagagaggaactctgtctaaaatgtctatcattatagccattatgatagttttctctaatagagttttcgaccttttgggacagcggtg

SEQ ID NO: 443592 - DNA, 140 bp, Artificial Sequence
  Synthetic
caccgctgtcccaaaaggtcgaaaactctattagagaaaactatcataatggctataatgatagacattttagacagagttcctctctgtaattctagatcatccaccatcttgtgaacccatatcagcagccagggcct

SEQ ID NO: 443593 - DNA, 140 bp, Artificial Sequence
  Synthetic
atacgccatgctgggtctccgttgcagaaagaataatagagcagagtcaatacaacacagtcctggagagacagggaggaaagtgtcggtaacttctcataacggaagggtcacatcttccgtacttgggagtcggccat

SEQ ID NO: 443594 - DNA, 140 bp, Artificial Sequence
  Synthetic
atggccgactcccaagtacggaagatgtgacccttccgttatgagaagttaccgacactttcctccctgtctctccaggactgtgttgtattgactctgctctattattctttctgcaacggagacccagcatggcgtat

SEQ ID NO: 443595 - DNA, 140 bp, Artificial Sequence
  Synthetic
atacgccatgctgggtctccaccactttgaatataaaaggaggagctagtcccaccattcttctcaaggatgcaatcagaagggccctgtacgatgaagtagacaaggtggaaaactcagcgtacttgggagtcggccat

SEQ ID NO: 443596 - DNA, 140 bp, Artificial Sequence
  Synthetic
atggccgactcccaagtacgctgagttttccaccttgtctacttcatcgtacagggcccttctgattgcatccttgagaagaatggtgggactagctcctccttttatattcaaagtggtggagacccagcatggcgtat

SEQ ID NO: 443597 - DNA, 140 bp, Artificial Sequence
  Synthetic
aggccctggctgctgatatgaagatagtgaaaaccaccagactcatcgggagcattgaagacctatctggggaagtagcgagacacctcccgggatataacaggtggattacccttgagggaccttttgggacagcggtg

SEQ ID NO: 443598 - DNA, 140 bp, Artificial Sequence
  Synthetic
caccgctgtcccaaaaggtccctcaagggtaatccacctgttatatcccgggaggtgtctcgctacttccccagataggtcttcaatgctcccgatgagtctggtggttttcactatcttcatatcagcagccagggcct

SEQ ID NO: 443599 - DNA, 140 bp, Artificial Sequence
  Synthetic
atacgccatgctgggtctcccttcagctcatccttcttggggatccctgagtccattattgggctgatacaaaattccagaacaatcagaagacagtttaggaggagtctttcaagaacacgtacttgggagtcggccat

SEQ ID NO: 443600 - DNA, 140 bp, Artificial Sequence
  Synthetic
atggccgactcccaagtacgtgttcttgaaagactcctcctaaactgtcttctgattgttctggaattttgtatcagcccaataatggactcagggatccccaagaaggatgagctgaagggagacccagcatggcgtat

SEQ ID NO: 443601 - DNA, 140 bp, Artificial Sequence
  Synthetic
atacgccatgctgggtctcctttctgtgaatctgtatatcctaagattctcagacagtgtaccatgaaaaaaacgaagtctcaagtcagaacttctagctgtttgattactttttccatccgtacttgggagtcggccat

SEQ ID NO: 443602 - DNA, 140 bp, Artificial Sequence
  Synthetic
atggccgactcccaagtacggatggaaaaagtaatcaaacagctagaagttctgacttgagacttcgtttttttcatggtacactgtctgagaatcttaggatatacagattcacagaaaggagacccagcatggcgtat

SEQ ID NO: 443603 - DNA, 140 bp, Artificial Sequence
  Synthetic
aggccctggctgctgatatggaattctgaggatctgtatcgactaagattctcagacagtgtaccgtgaaaaaaacgaagtctcaagtcagaacctctagctgtttgattactttttcatgaccttttgggacagcggtg

SEQ ID NO: 443604 - DNA, 140 bp, Artificial Sequence
  Synthetic
caccgctgtcccaaaaggtcatgaaaaagtaatcaaacagctagaggttctgacttgagacttcgtttttttcacggtacactgtctgagaatcttagtcgatacagatcctcagaattccatatcagcagccagggcct

SEQ ID NO: 443605 - DNA, 140 bp, Artificial Sequence
  Synthetic
atacgccatgctgggtctcccagacctcctgagagagatctcatggggaagaaaggtagttggcacgactgtccctcacccctccgagatgctagggttacttcctaagtcctcgatctccgtacttgggagtcggccat

SEQ ID NO: 443606 - DNA, 140 bp, Artificial Sequence
  Synthetic
atggccgactcccaagtacggagatcgaggacttaggaagtaaccctagcatctcggaggggtgagggacagtcgtgccaactacctttcttccccatgagatctctctcaggaggtctgggagacccagcatggcgtat

SEQ ID NO: 443607 - DNA, 140 bp, Artificial Sequence
  Synthetic
atacgccatgctgggtctcctacttgggctcatccacatctatgtcaacccagttgttccatgcctgggagaaagttactaatgttcatgtggtgaaaagggctctctcactcaaagagtcgtacttgggagtcggccat

SEQ ID NO: 443608 - DNA, 140 bp, Artificial Sequence
  Synthetic
atggccgactcccaagtacgactctttgagtgagagagcccttttcaccacatgaacattagtaactttctcccaggcatggaacaactgggttgacatagatgtggatgagcccaagtaggagacccagcatggcgtat

SEQ ID NO: 443609 - DNA, 140 bp, Artificial Sequence
  Synthetic
atacgccatgctgggtctccgaggaactctgactataatctcaactctcctctaatagaagatcctgccaaattaatgctggagtggttgaaaacagggaatagaccctaccggatggcccgtacttgggagtcggccat

SEQ ID NO: 443610 - DNA, 140 bp, Artificial Sequence
  Synthetic
atggccgactcccaagtacgggccatccggtagggtctattccctgttttcaaccactccagcattaatttggcaggatcttctattagaggagagttgagattatagtcagagttcctcggagacccagcatggcgtat

SEQ ID NO: 443611 - DNA, 140 bp, Artificial Sequence
  Synthetic
atacgccatgctgggtctccatctggatgcctgaagaggcaagactcgggacatcttgtgacatttttacaaccagcaaagggaagagagcatctaagggagacaagatttgcggattcgcgtacttgggagtcggccat

SEQ ID NO: 443612 - DNA, 140 bp, Artificial Sequence
  Synthetic
atggccgactcccaagtacgcgaatccgcaaatcttgtctcccttagatgctctcttccctttgctggttgtaaaaatgtcacaagatgtcccgagtcttgcctcttcaggcatccagatggagacccagcatggcgtat

SEQ ID NO: 443613 - DNA, 140 bp, Artificial Sequence
  Synthetic
atacgccatgctgggtctcctgttttcaaaaggacagggtctgccctgcataggttcaagtcagccagatacagcgaagggggttattcttccgtttgtcccaatctcctctctcacattcgtacttgggagtcggccat

SEQ ID NO: 443614 - DNA, 140 bp, Artificial Sequence
  Synthetic
atggccgactcccaagtacgaatgtgagagaggagattgggacaaacggaagaataacccccttcgctgtatctggctgacttgaacctatgcagggcagaccctgtccttttgaaaacaggagacccagcatggcgtat

SEQ ID NO: 443615 - DNA, 140 bp, Artificial Sequence
  Synthetic
atacgccatgctgggtctccagctagtgcaaaaagacgctcggctgaaagattccacctttcactggcatcttcgatgcagtaagtgcattaggcccatcgacgatattacccttgagaccgtacttgggagtcggccat

SEQ ID NO: 443616 - DNA, 140 bp, Artificial Sequence
  Synthetic
atggccgactcccaagtacggtctcaagggtaatatcgtcgatgggcctaatgcacttactgcatcgaagatgccagtgaaaggtggaatctttcagccgagcgtctttttgcactagctggagacccagcatggcgtat

SEQ ID NO: 443617 - DNA, 140 bp, Artificial Sequence
  Synthetic
atacgccatgctgggtctcccctggtgacttcgagtctttgagtgacaaagagaggtcgcgccatatagggtctgcccaagggctcttgtattcaatcttggtcgcgattcacgactctgcgtacttgggagtcggccat

SEQ ID NO: 443618 - DNA, 140 bp, Artificial Sequence
  Synthetic
atggccgactcccaagtacgcagagtcgtgaatcgcgaccaagattgaatacaagagcccttgggcagaccctatatggcgcgacctctctttgtcactcaaagactcgaagtcaccaggggagacccagcatggcgtat

SEQ ID NO: 443619 - DNA, 140 bp, Artificial Sequence
  Synthetic
aggccctggctgctgatatggtctgcccaagggctcttgtattcaatcttggtcgcgattcacgactctgggtataatgatggcaccattttccctgttaacatatatagcaaggtctctgaccttttgggacagcggtg

SEQ ID NO: 443620 - DNA, 140 bp, Artificial Sequence
  Synthetic
caccgctgtcccaaaaggtcagagaccttgctatatatgttaacagggaaaatggtgccatcattatacccagagtcgtgaatcgcgaccaagattgaatacaagagcccttgggcagaccatatcagcagccagggcct

SEQ ID NO: 443621 - DNA, 140 bp, Artificial Sequence
  Synthetic
aggccctggctgctgatatgcgtccaactttggtgagatagccgaggtgggagaaagcaagtatcgagaagacttccaaatggatgaaggagaggaccctagcctcttgttccaatcatagaccttttgggacagcggtg

SEQ ID NO: 443622 - DNA, 140 bp, Artificial Sequence
  Synthetic
caccgctgtcccaaaaggtctatgattggaacaagaggctagggtcctctccttcatccatttggaagtcttctcgatacttgctttctcccacctcggctatctcaccaaagttggacgcatatcagcagccagggcct

SEQ ID NO: 443623 - DNA, 140 bp, Artificial Sequence
  Synthetic
atacgccatgctgggtctcccctagagactatttacgagggctcgcaagaggagttttgatcgggtcttcgatttgcttcctgacaagaatgacaaacattaacatcaataggcctctcgcgtacttgggagtcggccat

SEQ ID NO: 443624 - DNA, 140 bp, Artificial Sequence
  Synthetic
atggccgactcccaagtacgcgagaggcctattgatgttaatgtttgtcattcttgtcaggaagcaaatcgaagacccgatcaaaactcctcttgcgagccctcgtaaatagtctctaggggagacccagcatggcgtat

SEQ ID NO: 443625 - DNA, 140 bp, Artificial Sequence
  Synthetic
atacgccatgctgggtctcctgaaacggccctggcagatgacggaacagtcaattctgatgatgaggactacttctccagtgaaaccaggagtccagaagcagtttacacacgaatcatgcgtacttgggagtcggccat

SEQ ID NO: 443626 - DNA, 140 bp, Artificial Sequence
  Synthetic
atggccgactcccaagtacgcatgattcgtgtgtaaactgcttctggactcctggtttcactggagaagtagtcctcatcatcagaattgactgttccgtcatctgccagggccgtttcaggagacccagcatggcgtat

SEQ ID NO: 443627 - DNA, 140 bp, Artificial Sequence
  Synthetic
atacgccatgctgggtctccagactcttgtgtgatgtatcttgaaaaaaacaagatcttaaatcagaacctctggttgtttgattgtttttctcatttttgttgtttatttgttaagcgtcgtacttgggagtcggccat

SEQ ID NO: 443628 - DNA, 140 bp, Artificial Sequence
  Synthetic
atggccgactcccaagtacgacgcttaacaaataaacaacaaaaatgagaaaaacaatcaaacaaccagaggttctgatttaagatcttgtttttttcaagatacatcacacaagagtctggagacccagcatggcgtat

SEQ ID NO: 443629 - DNA, 140 bp, Artificial Sequence
  Synthetic
atacgccatgctgggtctccgaggtaatcacaacttcccctgagaatgactggttgtggatcttctcggattttagaagttccaaaatgacatatctaaccctcatcacgtatcagtctccgtacttgggagtcggccat

SEQ ID NO: 443630 - DNA, 140 bp, Artificial Sequence
  Synthetic
atggccgactcccaagtacggagactgatacgtgatgagggttagatatgtcattttggaacttctaaaatccgagaagatccacaaccagtcattctcaggggaagttgtgattacctcggagacccagcatggcgtat

SEQ ID NO: 443631 - DNA, 140 bp, Artificial Sequence
  Synthetic
aggccctggctgctgatatgttttagaagttccaaaatgacatatctaaccctcatcacgtatcagtctcacctcttacttcagagagttgagaagaatctctccaaaaacatgagggccgaccttttgggacagcggtg

SEQ ID NO: 443632 - DNA, 140 bp, Artificial Sequence
  Synthetic
caccgctgtcccaaaaggtcggccctcatgtttttggagagattcttctcaactctctgaagtaagaggtgagactgatacgtgatgagggttagatatgtcattttggaacttctaaaacatatcagcagccagggcct

SEQ ID NO: 443633 - DNA, 140 bp, Artificial Sequence
  Synthetic
atacgccatgctgggtctccccggcttggctgatctagagatggctgaagagactgtagatctcatcgctaggaacatcgaggacaatcaggctcatctccaaggagatcccatagaggtcgtacttgggagtcggccat

SEQ ID NO: 443634 - DNA, 140 bp, Artificial Sequence
  Synthetic
atggccgactcccaagtacgacctctatgggatctccttggagatgagcctgattgtcctcgatgttcctagcgatgagatctacagtctcttcagccatctctagatcagccaagccggggagacccagcatggcgtat

SEQ ID NO: 443635 - DNA, 140 bp, Artificial Sequence
  Synthetic
atacgccatgctgggtctccctttacgcaggacaagatgggtggatcaagaggtgcgccatgcagcaaagactatgaccgggggttatagccccaacaagaagacatcccgcaaagcgggcgtacttgggagtcggccat

SEQ ID NO: 443636 - DNA, 140 bp, Artificial Sequence
  Synthetic
atggccgactcccaagtacgcccgctttgcgggatgtcttcttgttggggctataacccccggtcatagtctttgctgcatggcgcacctcttgatccacccatcttgtcctgcgtaaagggagacccagcatggcgtat

SEQ ID NO: 443637 - DNA, 140 bp, Artificial Sequence
  Synthetic
aggccctggctgctgatatgatatttgaaatccctgaatccatggatccatcagagatactggatgacaagtcacactctttcaccagaacgagactagcctcctggctgtcagagaacagaccttttgggacagcggtg

SEQ ID NO: 443638 - DNA, 140 bp, Artificial Sequence
  Synthetic
caccgctgtcccaaaaggtctgttctctgacagccaggaggctagtctcgttctggtgaaagagtgtgacttgtcatccagtatctctgatggatccatggattcagggatttcaaatatcatatcagcagccagggcct

SEQ ID NO: 443639 - DNA, 140 bp, Artificial Sequence
  Synthetic
aggccctggctgctgatatgggttatgtcacaaccacgttcaaaagaaagcatttccgcccaacaccagatgcatgtagagccgcgtacaactggaagatggccggtgaccccagatatggaccttttgggacagcggtg

SEQ ID NO: 443640 - DNA, 140 bp, Artificial Sequence
  Synthetic
caccgctgtcccaaaaggtccatatctggggtcaccggccatcttccagttgtacgcggctctacatgcatctggtgttgggcggaaatgctttcttttgaacgtggttgtgacataacccatatcagcagccagggcct

SEQ ID NO: 443641 - DNA, 140 bp, Artificial Sequence
  Synthetic
atacgccatgctgggtctcccttcagaacccgttgatctctggtctgagagtggttcaatgggcaacaggtgcccattacaagctcaagcctattctggatgatctcaatgttttcccatcgtacttgggagtcggccat

SEQ ID NO: 443642 - DNA, 140 bp, Artificial Sequence
  Synthetic
atggccgactcccaagtacgatgggaaaacattgagatcatccagaataggcttgagcttgtaatgggcacctgttgcccattgaaccactctcagaccagagatcaacgggttctgaagggagacccagcatggcgtat

SEQ ID NO: 443643 - DNA, 140 bp, Artificial Sequence
  Synthetic
atacgccatgctgggtctccagcgagcaagtcaaccctcaaaagttaaaatggcagctcaaactgtctctggtcctcctgccttagaatggtctgtcgccaacgaagaggatgacccatccgtacttgggagtcggccat

SEQ ID NO: 443644 - DNA, 140 bp, Artificial Sequence
  Synthetic
atggccgactcccaagtacggatgggtcatcctcttcgttggcgacagaccattctaaggcaggaggaccagagacagtttgagctgccattttaacttttgagggttgacttgctcgctggagacccagcatggcgtat

SEQ ID NO: 443645 - DNA, 140 bp, Artificial Sequence
  Synthetic
aggccctggctgctgatatgtgctctgactatgacagacaacctgaacaaggtgtttaagaagctgattgacagggtgactgggcaagggcttttagactactcaagggttacatatgctgaccttttgggacagcggtg

SEQ ID NO: 443646 - DNA, 140 bp, Artificial Sequence
  Synthetic
caccgctgtcccaaaaggtcagcatatgtaacccttgagtagtctaaaagcccttgcccagtcaccctgtcaatcagcttcttaaacaccttgttcaggttgtctgtcatagtcagagcacatatcagcagccagggcct

SEQ ID NO: 443647 - DNA, 140 bp, Artificial Sequence
  Synthetic
atacgccatgctgggtctcccagaggtcacggacattgcatcaatcaacaggataactctgctaatgtctgactttgcattgtcgatagacggcccactttatttggtattcaaaacttacgtacttgggagtcggccat

SEQ ID NO: 443648 - DNA, 140 bp, Artificial Sequence
  Synthetic
atggccgactcccaagtacgtaagttttgaataccaaataaagtgggccgtctatcgacaatgcaaagtcagacattagcagagttatcctgttgattgatgcaatgtccgtgacctctgggagacccagcatggcgtat

SEQ ID NO: 443649 - DNA, 140 bp, Artificial Sequence
  Synthetic
atacgccatgctgggtctcctcatccgagctatacctaagattctctaaacggggaaagttctttagagatgcagaatatttaacctcctctactcttcgggaaatgagccttgtgttgtcgtacttgggagtcggccat

SEQ ID NO: 443650 - DNA, 140 bp, Artificial Sequence
  Synthetic
atggccgactcccaagtacgacaacacaaggctcatttcccgaagagtagaggaggttaaatattctgcatctctaaagaactttccccgtttagagaatcttaggtatagctcggatgaggagacccagcatggcgtat

SEQ ID NO: 443651 - DNA, 140 bp, Artificial Sequence
  Synthetic
atacgccatgctgggtctcccctctctcatatcagctcctccagatgacgatgacctatggttaccccctccggaatatgttccgttgaaggagctcacgggcaagaagaacatgagaaacgtacttgggagtcggccat

SEQ ID NO: 443652 - DNA, 140 bp, Artificial Sequence
  Synthetic
atggccgactcccaagtacgtttctcatgttcttcttgcccgtgagctccttcaacggaacatattccggagggggtaaccataggtcatcgtcatctggaggagctgatatgagagaggggagacccagcatggcgtat

SEQ ID NO: 443653 - DNA, 140 bp, Artificial Sequence
  Synthetic
atacgccatgctgggtctcccaatgagatgatcataactctgatcgacagcgatgtagaatctttccttgttcacaagatggtggatgatctagaattacagcgaggaactttgtccaaacgtacttgggagtcggccat

SEQ ID NO: 443654 - DNA, 140 bp, Artificial Sequence
  Synthetic
atggccgactcccaagtacgtttggacaaagttcctcgctgtaattctagatcatccaccatcttgtgaacaaggaaagattctacatcgctgtcgatcagagttatgatcatctcattgggagacccagcatggcgtat

SEQ ID NO: 443655 - DNA, 140 bp, Artificial Sequence
  Synthetic
aggccctggctgctgatatggtgacgaggctgaggattttgttgaagttcaccttcccgatgtgcacaaacaggtctcaggagttgacttgggtctcccgaactgggggaagtatgtattgaccttttgggacagcggtg

SEQ ID NO: 443656 - DNA, 140 bp, Artificial Sequence
  Synthetic
caccgctgtcccaaaaggtcaatacatacttcccccagttcgggagacccaagtcaactcctgagacctgtttgtgcacatcgggaaggtgaacttcaacaaaatcctcagcctcgtcaccatatcagcagccagggcct

SEQ ID NO: 443657 - DNA, 140 bp, Artificial Sequence
  Synthetic
atacgccatgctgggtctccaaatcttgagacacttcaatatatgctgtagtaccatgatgtatttgtccaccgccttgggggatgtgcccagctttgcgagacttcatgacctgtacaacgtacttgggagtcggccat

SEQ ID NO: 443658 - DNA, 140 bp, Artificial Sequence
  Synthetic
atggccgactcccaagtacgttgtacaggtcatgaagtctcgcaaagctgggcacatcccccaaggcggtggacaaatacatcatggtactacagcatatattgaagtgtctcaagatttggagacccagcatggcgtat

SEQ ID NO: 443659 - DNA, 140 bp, Artificial Sequence
  Synthetic
atacgccatgctgggtctccggtttggaaaggcatacaccatattcaacaaaaccttaatggaggctgatgctcactacaagtcagttcggacctggaacgaggtcatcccctcaaaaggcgtacttgggagtcggccat

SEQ ID NO: 443660 - DNA, 140 bp, Artificial Sequence
  Synthetic
atggccgactcccaagtacgccttttgaggggatgacctcgttccaggtccgaactgacttgtagtgagcatcagcctccattaaggttttgttgaatatggtgtatgcctttccaaaccggagacccagcatggcgtat

SEQ ID NO: 443661 - DNA, 140 bp, Artificial Sequence
  Synthetic
aggccctggctgctgatatggggacagggagggaggtgtcagtcactccccaaagcgggaagatcatatcttcatgggaatcatacaagagtgggggtgagaccagactgtgaggactgggaccttttgggacagcggtg

SEQ ID NO: 443662 - DNA, 140 bp, Artificial Sequence
  Synthetic
caccgctgtcccaaaaggtcccagtcctcacagtctggtctcacccccactcttgtatgattcccatgaagatatgatcttcccgctttggggagtgactgacacctccctccctgtccccatatcagcagccagggcct

SEQ ID NO: 443663 - DNA, 140 bp, Artificial Sequence
  Synthetic
atacgccatgctgggtctccaatagtgaagaccaccagacttgtaggcagcacagaagacctatctggggagataaagaagcaccttcgaggatacaacagatggatcactttagacgatcgtacttgggagtcggccat

SEQ ID NO: 443664 - DNA, 140 bp, Artificial Sequence
  Synthetic
atggccgactcccaagtacgatcgtctaaagtgatccatctgttgtatcctcgaaggtgcttctttatctccccagataggtcttctgtgctgcctacaagtctggtggtcttcactattggagacccagcatggcgtat

SEQ ID NO: 443665 - DNA, 140 bp, Artificial Sequence
  Synthetic
aggccctggctgctgatatggtcatggtgccgttgaatcgctgcattttgtcagagtagactctattacttttacattctaggcttctctgatgtgaaaaaaactatcaacatccctcaagaccttttgggacagcggtg

SEQ ID NO: 443666 - DNA, 140 bp, Artificial Sequence
  Synthetic
caccgctgtcccaaaaggtcttgagggatgttgatagtttttttcacatcagagaagcctagaatgtaaaagtaatagagtctactctgacaaaatgcagcgattcaacggcaccatgaccatatcagcagccagggcct

SEQ ID NO: 443667 - DNA, 140 bp, Artificial Sequence
  Synthetic
atacgccatgctgggtctccctcctgtgaaaatatacagaccaatattcttgaatggtgtaccctgaaaaaaacaagacactgattcatgacctctatttgcttgattatttctccttttcgtacttgggagtcggccat

SEQ ID NO: 443668 - DNA, 140 bp, Artificial Sequence
  Synthetic
atggccgactcccaagtacgaaaaggagaaataatcaagcaaatagaggtcatgaatcagtgtcttgtttttttcagggtacaccattcaagaatattggtctgtatattttcacaggagggagacccagcatggcgtat

SEQ ID NO: 443669 - DNA, 140 bp, Artificial Sequence
  Synthetic
aggccctggctgctgatatgatctgggggaggagttttttggaaaagggacttttgaaagaagattcttcagggatgagaaagaacttcaggaacatgaggcagctgaattaacgaagatgaccttttgggacagcggtg

SEQ ID NO: 443670 - DNA, 140 bp, Artificial Sequence
  Synthetic
caccgctgtcccaaaaggtcatcttcgttaattcagctgcctcatgttcctgaagttctttctcatccctgaagaatcttctttcaaaagtcccttttccaaaaaactcctcccccagatcatatcagcagccagggcct

SEQ ID NO: 443671 - DNA, 140 bp, Artificial Sequence
  Synthetic
atacgccatgctgggtctccgttatggtgccattaaaccgctgcattttatccaagtcaagttgattacctttacattttaagcctctaggatgtgaaaaaaactattaacatccctcaacgtacttgggagtcggccat

SEQ ID NO: 443672 - DNA, 140 bp, Artificial Sequence
  Synthetic
atggccgactcccaagtacgttgagggatgttaatagtttttttcacatcctagaggcttaaaatgtaaaggtaatcaacttgacttggataaaatgcagcggtttaatggcaccataacggagacccagcatggcgtat

SEQ ID NO: 443673 - DNA, 140 bp, Artificial Sequence
  Synthetic
atacgccatgctgggtctcccagtcgtccctactccaacagcatatggaactgctggagtcctctgtaatccccctgatgcatcccttggcagacccatcaacagtcttcaaagacggtgcgtacttgggagtcggccat

SEQ ID NO: 443674 - DNA, 140 bp, Artificial Sequence
  Synthetic
atggccgactcccaagtacgcaccgtctttgaagactgttgatgggtctgccaagggatgcatcagggggattacagaggactccagcagttccatatgctgttggagtagggacgactgggagacccagcatggcgtat

SEQ ID NO: 443675 - DNA, 140 bp, Artificial Sequence
  Synthetic
atacgccatgctgggtctccatttgggagaggaattttttggaaaagggatgtttgaaagaaggttcttcagagatgagaaggagcttcaagaatatgaggcggctgaactgacaaagaccgtacttgggagtcggccat

SEQ ID NO: 443676 - DNA, 140 bp, Artificial Sequence
  Synthetic
atggccgactcccaagtacggtctttgtcagttcagccgcctcatattcttgaagctccttctcatctctgaagaaccttctttcaaacatcccttttccaaaaaattcctctcccaaatggagacccagcatggcgtat

SEQ ID NO: 443677 - DNA, 140 bp, Artificial Sequence
  Synthetic
atacgccatgctgggtctccagatttttgaaattcccgaatcaatggacccatcagaaatactggatgacaaatcacattctttcaccagaacaagactagcttcttggctgtcagagaacgtacttgggagtcggccat

SEQ ID NO: 443678 - DNA, 140 bp, Artificial Sequence
  Synthetic
atggccgactcccaagtacgttctctgacagccaagaagctagtcttgttctggtgaaagaatgtgatttgtcatccagtatttctgatgggtccattgattcgggaatttcaaaaatctggagacccagcatggcgtat

SEQ ID NO: 443679 - DNA, 140 bp, Artificial Sequence
  Synthetic
atacgccatgctgggtctccatgaatggaggtcgactaaagagatcgcatatacgaagatatgtttcagtcagttccaatcatcaagcccgtccaaactcattcgcagagtttctaaacacgtacttgggagtcggccat

SEQ ID NO: 443680 - DNA, 140 bp, Artificial Sequence
  Synthetic
atggccgactcccaagtacgtgtttagaaactctgcgaatgagtttggacgggcttgatgattggaactgactgaaacatatcttcgtatatgcgatctctttagtcgacctccattcatggagacccagcatggcgtat

SEQ ID NO: 443681 - DNA, 140 bp, Artificial Sequence
  Synthetic
atacgccatgctgggtctccctcccacgagtcctggattcacgcattgtgtcaagaggctgggaacccagatcttggagagagaacacttgagagcttcactcgccttctagaagatcctcgtacttgggagtcggccat

SEQ ID NO: 443682 - DNA, 140 bp, Artificial Sequence
  Synthetic
atggccgactcccaagtacgaggatcttctagaaggcgagtgaagctctcaagtgttctctctccaagatctgggttcccagcctcttgacacaatgcgtgaatccaggactcgtgggagggagacccagcatggcgtat

SEQ ID NO: 443683 - DNA, 140 bp, Artificial Sequence
  Synthetic
atacgccatgctgggtctcctcagagaaaaaggtaacggcaaccccccagactaggaaagtcgtatcttcatgggagttatacaagagtgaaggcgatgccaggctgtgatggcgggccacgtacttgggagtcggccat

SEQ ID NO: 443684 - DNA, 140 bp, Artificial Sequence
  Synthetic
atggccgactcccaagtacgtggcccgccatcacagcctggcatcgccttcactcttgtataactcccatgaagatacgactttcctagtctggggggttgccgttacctttttctctgaggagacccagcatggcgtat

SEQ ID NO: 443685 - DNA, 140 bp, Artificial Sequence
  Synthetic
atacgccatgctgggtctccaaccatcccaaatatgagcaagatctttgttaatccgagtgcaattagagccggtctggccgatcttgaaatggccgaggagactgtcgatctgatcaaccgtacttgggagtcggccat

SEQ ID NO: 443686 - DNA, 140 bp, Artificial Sequence
  Synthetic
atggccgactcccaagtacggttgatcagatcgacagtctcctcggccatttcaagatcggccagaccggctctaattgcactcggattaacaaagatcttgctcatatttgggatggttggagacccagcatggcgtat

SEQ ID NO: 443687 - DNA, 140 bp, Artificial Sequence
  Synthetic
aggccctggctgctgatatgccggtctggccgatcttgaaatggccgaggagactgtcgatctgatcaacaggaacatagaagacaatcaagctcatctccagggagaacccatagaagtgaccttttgggacagcggtg

SEQ ID NO: 443688 - DNA, 140 bp, Artificial Sequence
  Synthetic
caccgctgtcccaaaaggtcacttctatgggttctccctggagatgagcttgattgtcttctatgttcctgttgatcagatcgacagtctcctcggccatttcaagatcggccagaccggcatatcagcagccagggcct

SEQ ID NO: 443689 - DNA, 140 bp, Artificial Sequence
  Synthetic
atacgccatgctgggtctcctgccatctcaaacaactctatgattgagtccaagcagaggccatcgcgagttccactgcattagaccaggtagagattagtcgagaaagacgatttgcctcgtacttgggagtcggccat

SEQ ID NO: 443690 - DNA, 140 bp, Artificial Sequence
  Synthetic
atggccgactcccaagtacgaggcaaatcgtctttctcgactaatctctacctggtctaatgcagtggaactcgcgatggcctctgcttggactcaatcatagagttgtttgagatggcaggagacccagcatggcgtat

SEQ ID NO: 443691 - DNA, 140 bp, Artificial Sequence
  Synthetic
aggccctggctgctgatatgacggtcaactttcccaaccctccaggaaggtcttcggaggataaatcaacacagactactggccgagagctcaagaaggagacaacatctactcctcctcgaccttttgggacagcggtg

SEQ ID NO: 443692 - DNA, 140 bp, Artificial Sequence
  Synthetic
caccgctgtcccaaaaggtcgaggaggagtagatgttgtctccttcttgagctctcggccagtagtctgtgttgatttatcctccgaagaccttcctggagggttgggaaagttgaccgtcatatcagcagccagggcct

SEQ ID NO: 443693 - DNA, 140 bp, Artificial Sequence
  Synthetic
atacgccatgctgggtctccgattgcaggtgctctggcaaccctaatgctgacaatcttcctaatgacatgttgcagaaggactaagagagcggaatcaatacaatatggtctcggagagcgtacttgggagtcggccat

SEQ ID NO: 443694 - DNA, 140 bp, Artificial Sequence
  Synthetic
atggccgactcccaagtacgctctccgagaccatattgtattgattccgctctcttagtccttctgcaacatgtcattaggaagattgtcagcattagggttgccagagcacctgcaatcggagacccagcatggcgtat

SEQ ID NO: 443695 - DNA, 140 bp, Artificial Sequence
  Synthetic
atacgccatgctgggtctccagtagaggctgagatcgctcatcagattgctgaaagcttttccaagaagtacaagtttccctctcgatcctcaggaatattcttatataattttgagcaacgtacttgggagtcggccat

SEQ ID NO: 443696 - DNA, 140 bp, Artificial Sequence
  Synthetic
atggccgactcccaagtacgttgctcaaaattatataagaatattcctgaggatcgagagggaaacttgtacttcttggaaaagctttcagcaatctgatgagcgatctcagcctctactggagacccagcatggcgtat

SEQ ID NO: 443697 - DNA, 140 bp, Artificial Sequence
  Synthetic
atacgccatgctgggtctccaccctcgaggggatgtataaactagtaatcttgaacggtacaccgtgaaaaaaacgggatcccaattcttaacctctatttgcttgattgtttttccattcgtacttgggagtcggccat

SEQ ID NO: 443698 - DNA, 140 bp, Artificial Sequence
  Synthetic
atggccgactcccaagtacgaatggaaaaacaatcaagcaaatagaggttaagaattgggatcccgtttttttcacggtgtaccgttcaagattactagtttatacatcccctcgagggtggagacccagcatggcgtat

SEQ ID NO: 443699 - DNA, 140 bp, Artificial Sequence
  Synthetic
atacgccatgctgggtctcccgtgacccgtttggcccatgacggatccaaaatccccctaagatgtgtactgggatgggtcgctttggccaattctaagaaattccagttactagtcgagcgtacttgggagtcggccat

SEQ ID NO: 443700 - DNA, 140 bp, Artificial Sequence
  Synthetic
atggccgactcccaagtacgctcgactagtaactggaatttcttagaattggccaaagcgacccatcccagtacacatcttagggggattttggatccgtcatgggccaaacgggtcacgggagacccagcatggcgtat

SEQ ID NO: 443701 - DNA, 140 bp, Artificial Sequence
  Synthetic
atacgccatgctgggtctccagggggtcctaagctgtcttgagagggtcgattacgataaagcatttgggcggtatttggctaacatatattcctcttatttattctttcacgtgatcaccgtacttgggagtcggccat

SEQ ID NO: 443702 - DNA, 140 bp, Artificial Sequence
  Synthetic
atggccgactcccaagtacggtgatcacgtgaaagaataaataagaggaatatatgttagccaaataccgcccaaatgctttatcgtaatcgaccctctcaagacagcttaggaccccctggagacccagcatggcgtat

SEQ ID NO: 443703 - DNA, 140 bp, Artificial Sequence
  Synthetic
atacgccatgctgggtctcccccgagtacgtcccactaaaagaactcacaagcaagaagaacatgaggaacttttgtatcaacggggagattaaagtgtgtagcccgaatggttactcatcgtacttgggagtcggccat

SEQ ID NO: 443704 - DNA, 140 bp, Artificial Sequence
  Synthetic
atggccgactcccaagtacgatgagtaaccattcgggctacacactttaatctccccgttgatacaaaagttcctcatgttcttcttgcttgtgagttcttttagtgggacgtactcgggggagacccagcatggcgtat

SEQ ID NO: 443705 - DNA, 140 bp, Artificial Sequence
  Synthetic
aggccctggctgctgatatgcctgctgaccaatttttacactcaggctcactagacatttgagcctgagtcgttctgaactcgacatgaaaaaaacaggcaacaccactgataaaatgaagaccttttgggacagcggtg

SEQ ID NO: 443706 - DNA, 140 bp, Artificial Sequence
  Synthetic
caccgctgtcccaaaaggtcttcattttatcagtggtgttgcctgtttttttcatgtcgagttcagaacgactcaggctcaaatgtctagtgagcctgagtgtaaaaattggtcagcaggcatatcagcagccagggcct

SEQ ID NO: 443707 - DNA, 140 bp, Artificial Sequence
  Synthetic
atacgccatgctgggtctcctgagtctctcatctcactggatcaggctgatttacaaaatagtgaaaaccactagacttgtcggaaacatagaagatctgtctagggaggtcgagaagcacgtacttgggagtcggccat

SEQ ID NO: 443708 - DNA, 140 bp, Artificial Sequence
  Synthetic
atggccgactcccaagtacgtgcttctcgacctccctagacagatcttctatgtttccgacaagtctagtggttttcactattttgtaaatcagcctgatccagtgagatgagagactcaggagacccagcatggcgtat

SEQ ID NO: 443709 - DNA, 140 bp, Artificial Sequence
  Synthetic
atacgccatgctgggtctccgaacccagatattcagatgacttgatatctcagctgtgtcagctatatatcgccggagatcacgtcttgtctgtgtgtgggaattctggatatgaggtcacgtacttgggagtcggccat

SEQ ID NO: 443710 - DNA, 140 bp, Artificial Sequence
  Synthetic
atggccgactcccaagtacgtgacctcatatccagaattcccacacacagacaagacgtgatctccggcgatatatagctgacacagctgagatatcaagtcatctgaatatctgggttcggagacccagcatggcgtat

SEQ ID NO: 443711 - DNA, 140 bp, Artificial Sequence
  Synthetic
atacgccatgctgggtctccgacatgtttttctccaggattgaacatttgtattcagcaattagagtgggaacagttgttacggcttatgaggactgctcagggttggtgtcatttacagcgtacttgggagtcggccat

SEQ ID NO: 443712 - DNA, 140 bp, Artificial Sequence
  Synthetic
atggccgactcccaagtacgctgtaaatgacaccaaccctgagcagtcctcataagccgtaacaactgttcccactctaattgctgaatacaaatgttcaatcctggagaaaaacatgtcggagacccagcatggcgtat

SEQ ID NO: 443713 - DNA, 140 bp, Artificial Sequence
  Synthetic
aggccctggctgctgatatgagataaggtgggtcaacttgagggaacatttggtcctagtgcaaagaggttcttcaaggctctggatcaatttgacaatatacacgacttagtctttgtggaccttttgggacagcggtg

SEQ ID NO: 443714 - DNA, 140 bp, Artificial Sequence
  Synthetic
caccgctgtcccaaaaggtccacaaagactaagtcgtgtatattgtcaaattgatccagagccttgaagaacctctttgcactaggaccaaatgttccctcaagttgacccaccttatctcatatcagcagccagggcct

SEQ ID NO: 443715 - DNA, 140 bp, Artificial Sequence
  Synthetic
aggccctggctgctgatatgatctgtcatggagttggtctgacgacacttcagtatttaaaagggtggcctgtaactctagcttaagtctgtcatctcactggatcaggctgatttacaagaccttttgggacagcggtg

SEQ ID NO: 443716 - DNA, 140 bp, Artificial Sequence
  Synthetic
caccgctgtcccaaaaggtcttgtaaatcagcctgatccagtgagatgacagacttaagctagagttacaggccacccttttaaatactgaagtgtcgtcagaccaactccatgacagatcatatcagcagccagggcct

SEQ ID NO: 443717 - DNA, 140 bp, Artificial Sequence
  Synthetic
atacgccatgctgggtctccgctcctccataccttgcgttcataagatctcctctcttcgagattaggggggaattctttgcttcaacagtccttcatggaccccaggtaacagggtagacgtacttgggagtcggccat

SEQ ID NO: 443718 - DNA, 140 bp, Artificial Sequence
  Synthetic
atggccgactcccaagtacgtctaccctgttacctggggtccatgaaggactgttgaagcaaagaattcccccctaatctcgaagagaggagatcttatgaacgcaaggtatggaggagcggagacccagcatggcgtat

SEQ ID NO: 443719 - DNA, 140 bp, Artificial Sequence
  Synthetic
aggccctggctgctgatatgctttacattttgagcctcttggatgtgaaaaaaactattaacatccctcaaaaaaactcaaggaaagatggttcctcaggctctcttgtttgtaccccttgaccttttgggacagcggtg

SEQ ID NO: 443720 - DNA, 140 bp, Artificial Sequence
  Synthetic
caccgctgtcccaaaaggtcaaggggtacaaacaagagagcctgaggaaccatctttccttgagtttttttgagggatgttaatagtttttttcacatccaagaggctcaaaatgtaaagcatatcagcagccagggcct

SEQ ID NO: 443721 - DNA, 140 bp, Artificial Sequence
  Synthetic
atacgccatgctgggtctccctcagatctagatcttctctgctagactacagctgcttataaactggacccttttagaggtttgtaggtactaagacccttagacgatgcaactagaaaacgtacttgggagtcggccat

SEQ ID NO: 443722 - DNA, 140 bp, Artificial Sequence
  Synthetic
atggccgactcccaagtacgttttctagttgcatcgtctaagggtcttagtacctacaaacctctaaaagggtccagtttataagcagctgtagtctagcagagaagatctagatctgagggagacccagcatggcgtat

SEQ ID NO: 443723 - DNA, 140 bp, Artificial Sequence
  Synthetic
atacgccatgctgggtctccatatagtggatttggtgggtgacacttggcataagctcccgatcacccaaatttttgagatccccgaatcaatggacccatcggaaatactcgatgacaacgtacttgggagtcggccat

SEQ ID NO: 443724 - DNA, 140 bp, Artificial Sequence
  Synthetic
atggccgactcccaagtacgttgtcatcgagtatttccgatgggtccattgattcggggatctcaaaaatttgggtgatcgggagcttatgccaagtgtcacccaccaaatccactatatggagacccagcatggcgtat

SEQ ID NO: 443725 - DNA, 140 bp, Artificial Sequence
  Synthetic
atacgccatgctgggtctccataacttggtcgtggaggacgaaggatgcaccaacctgtccggattctcctacatggaacttaaagtgggatatatctcagccataaaagtgaacgggttcgtacttgggagtcggccat

SEQ ID NO: 443726 - DNA, 140 bp, Artificial Sequence
  Synthetic
atggccgactcccaagtacgaacccgttcacttttatggctgagatatatcccactttaagttccatgtaggagaatccggacaggttggtgcatccttcgtcctccacgaccaagttatggagacccagcatggcgtat

SEQ ID NO: 443727 - DNA, 140 bp, Artificial Sequence
  Synthetic
aggccctggctgctgatatgtacatggaacttaaagtgggatatatctcagccataaaagtgaacgggttcacttgtacaggtgttgtgacagaggcagaaacttacaccaactttgtcggaccttttgggacagcggtg

SEQ ID NO: 443728 - DNA, 140 bp, Artificial Sequence
  Synthetic
caccgctgtcccaaaaggtccgacaaagttggtgtaagtttctgcctctgtcacaacacctgtacaagtgaacccgttcacttttatggctgagatatatcccactttaagttccatgtacatatcagcagccagggcct

SEQ ID NO: 443729 - DNA, 140 bp, Artificial Sequence
  Synthetic
atacgccatgctgggtctccccccctgttaatcccagagaattcctgaaatctatagatcttggaggattgcctgatgaagatttgataattggcctcaaacctaaggaaagggagctaacgtacttgggagtcggccat

SEQ ID NO: 443730 - DNA, 140 bp, Artificial Sequence
  Synthetic
atggccgactcccaagtacgttagctccctttccttaggtttgaggccaattatcaaatcttcatcaggcaatcctccaagatctatagatttcaggaattctctgggattaacagggggggagacccagcatggcgtat

SEQ ID NO: 443731 - DNA, 140 bp, Artificial Sequence
  Synthetic
aggccctggctgctgatatgagagtctctacacaatccgtatcccgactaccattggcttcgaactgtgaaaaccaccaaagagtctctcgtcatcatatcccctagtgtggcagatttggaccttttgggacagcggtg

SEQ ID NO: 443732 - DNA, 140 bp, Artificial Sequence
  Synthetic
caccgctgtcccaaaaggtccaaatctgccacactaggggatatgatgacgagagactctttggtggttttcacagttcgaagccaatggtagtcgggatacggattgtgtagagactctcatatcagcagccagggcct

SEQ ID NO: 443733 - DNA, 140 bp, Artificial Sequence
  Synthetic
atacgccatgctgggtctccccatttggatgcccgagaatccgagactagggacatcttgtgacatttttgccaatagcagaggtaagagagcatccagagggagcaagacttgtggcttcgtacttgggagtcggccat

SEQ ID NO: 443734 - DNA, 140 bp, Artificial Sequence
  Synthetic
atggccgactcccaagtacgaagccacaagtcttgctccctctggatgctctcttacctctgctattggcaaaaatgtcacaagatgtccctagtctcggattctcgggcatccaaatggggagacccagcatggcgtat

SEQ ID NO: 443735 - DNA, 140 bp, Artificial Sequence
  Synthetic
atacgccatgctgggtctcctcagacgtcagatgagaccaaatggtgccctccagatcaattggtaaatctacatgactttcactcagatgaaatagagcatctcgtcgtggaggaattgcgtacttgggagtcggccat

SEQ ID NO: 443736 - DNA, 140 bp, Artificial Sequence
  Synthetic
atggccgactcccaagtacgcaattcctccacgacgagatgctctatttcatctgagtgaaagtcatgtagatttaccaattgatctggagggcaccatttggtctcatctgacgtctgaggagacccagcatggcgtat

SEQ ID NO: 443737 - DNA, 140 bp, Artificial Sequence
  Synthetic
atacgccatgctgggtctccagatctgacctcattgggttgtgggaagatcaaatatattgtctggacatgtcaggcggtccgacatgttggaatggtcaagatggcgggctagagggttcgtacttgggagtcggccat

SEQ ID NO: 443738 - DNA, 140 bp, Artificial Sequence
  Synthetic
atggccgactcccaagtacgaaccctctagcccgccatcttgaccattccaacatgtcggaccgcctgacatgtccagacaatatatttgatcttcccacaacccaatgaggtcagatctggagacccagcatggcgtat

SEQ ID NO: 443739 - DNA, 140 bp, Artificial Sequence
  Synthetic
aggccctggctgctgatatggtcaggcggtccgacatgttggaatggtcaagatggcgggctagagggtttgagacaaaagggctggagtctggtcagtctgttgatgatagaccgtgaagaccttttgggacagcggtg

SEQ ID NO: 443740 - DNA, 140 bp, Artificial Sequence
  Synthetic
caccgctgtcccaaaaggtcttcacggtctatcatcaacagactgaccagactccagcccttttgtctcaaaccctctagcccgccatcttgaccattccaacatgtcggaccgcctgaccatatcagcagccagggcct

SEQ ID NO: 443741 - DNA, 140 bp, Artificial Sequence
  Synthetic
aggccctggctgctgatatgaccaagtcggtgagcttcagacgtctcagtcacttaagaaaacttgtccctgggtttggaaaagcatacaccatattcaataaaaccttgatggaggctggaccttttgggacagcggtg

SEQ ID NO: 443742 - DNA, 140 bp, Artificial Sequence
  Synthetic
caccgctgtcccaaaaggtccagcctccatcaaggttttattgaatatggtgtatgcttttccaaacccagggacaagttttcttaagtgactgagacgtctgaagctcaccgacttggtcatatcagcagccagggcct

SEQ ID NO: 443743 - DNA, 140 bp, Artificial Sequence
  Synthetic
atacgccatgctgggtctccttctctacgagctggagagcatatcaagaaatgctctctcaatataccgtgccatcgaggagggggcgtccaaactggggctcattataaagaaggaagacgtacttgggagtcggccat

SEQ ID NO: 443744 - DNA, 140 bp, Artificial Sequence
  Synthetic
atggccgactcccaagtacgtcttccttctttataatgagccccagtttggacgccccctcctcgatggcacggtatattgagagagcatttcttgatatgctctccagctcgtagagaaggagacccagcatggcgtat

SEQ ID NO: 443745 - DNA, 140 bp, Artificial Sequence
  Synthetic
atacgccatgctgggtctccagctgatatcaggagtgatttcgtacatcctcttgagattggacaatcacccatctttatacatcatgcttagagagccatctctcagaggggagatattcgtacttgggagtcggccat

SEQ ID NO: 443746 - DNA, 140 bp, Artificial Sequence
  Synthetic
atggccgactcccaagtacgaatatctcccctctgagagatggctctctaagcatgatgtataaagatgggtgattgtccaatctcaagaggatgtacgaaatcactcctgatatcagctggagacccagcatggcgtat

SEQ ID NO: 443747 - DNA, 140 bp, Artificial Sequence
  Synthetic
atacgccatgctgggtctcctttcaatggtataatattggggcctgacggccatgttctaatcccagaaatgcaatcatcccttctccagcagcatatggagttgttggagtcctcagttcgtacttgggagtcggccat

SEQ ID NO: 443748 - DNA, 140 bp, Artificial Sequence
  Synthetic
atggccgactcccaagtacgaactgaggactccaacaactccatatgctgctggagaagggatgattgcatttctgggattagaacatggccgtcaggccccaatattataccattgaaaggagacccagcatggcgtat

SEQ ID NO: 443749 - DNA, 140 bp, Artificial Sequence
  Synthetic
atacgccatgctgggtctccaggtctcagaagttgacctgggtctccctaactggggaaagtatatattgatgattgcaggggccctgattgctctgatgttgataattttcctaatgaccgtacttgggagtcggccat

SEQ ID NO: 443750 - DNA, 140 bp, Artificial Sequence
  Synthetic
atggccgactcccaagtacggtcattaggaaaattatcaacatcagagcaatcagggcccctgcaatcatcaatatatactttccccagttagggagacccaggtcaacttctgagacctggagacccagcatggcgtat

SEQ ID NO: 443751 - DNA, 140 bp, Artificial Sequence
  Synthetic
atacgccatgctgggtctcctcatgggagtcatataaaagcggaggtgaaaccagactgtgaaggccggccatccttttgacgtttcaagtcctgaagacaacctcctctcgggggtgggcgtacttgggagtcggccat

SEQ ID NO: 443752 - DNA, 140 bp, Artificial Sequence
  Synthetic
atggccgactcccaagtacgcccacccccgagaggaggttgtcttcaggacttgaaacgtcaaaaggatggccggccttcacagtctggtttcacctccgcttttatatgactcccatgaggagacccagcatggcgtat

SEQ ID NO: 443753 - DNA, 140 bp, Artificial Sequence
  Synthetic
atacgccatgctgggtctccataagacgtactaatgtggaaggcaattgggctctcacagggggtatggagttgacaagggatcccactgttccagagcatgcatccttggttggtcttccgtacttgggagtcggccat

SEQ ID NO: 443754 - DNA, 140 bp, Artificial Sequence
  Synthetic
atggccgactcccaagtacggaagaccaaccaaggatgcatgctctggaacagtgggatcccttgtcaactccataccccctgtgagagcccaattgccttccacattagtacgtcttatggagacccagcatggcgtat

SEQ ID NO: 443755 - DNA, 140 bp, Artificial Sequence
  Synthetic
atacgccatgctgggtctccttttgtgaagattgtggagcatcacactttgatgacaacccacaaaatgtgcgctaactggagtaccataccgaacttcagattcctagctggaacctatcgtacttgggagtcggccat

SEQ ID NO: 443756 - DNA, 140 bp, Artificial Sequence
  Synthetic
atggccgactcccaagtacgataggttccagctaggaatctgaagttcggtatggtactccagttagcgcacattttgtgggttgtcatcaaagtgtgatgctccacaatcttcacaaaaggagacccagcatggcgtat

SEQ ID NO: 443757 - DNA, 140 bp, Artificial Sequence
  Synthetic
atacgccatgctgggtctccattttaggttttaaagagattatttgattattgattttgaatataattttgttggtatttattgtagaggtgttatatttttgttttgttattgatgttgcgtacttgggagtcggccat

SEQ ID NO: 443758 - DNA, 140 bp, Artificial Sequence
  Synthetic
atggccgactcccaagtacgcaacatcaataacaaaacaaaaatataacacctctacaataaataccaacaaaattatattcaaaatcaataatcaaataatctctttaaaacctaaaatggagacccagcatggcgtat

SEQ ID NO: 443759 - DNA, 140 bp, Artificial Sequence
  Synthetic
atacgccatgctgggtctcccaggctaatgttagaatggctgaagacagggaacagaccttaccggatgactttgacagacaattgttccaggtcttacaaagtcttgaaagattatttccgtacttgggagtcggccat

SEQ ID NO: 443760 - DNA, 140 bp, Artificial Sequence
  Synthetic
atggccgactcccaagtacggaaataatctttcaagactttgtaagacctggaacaattgtctgtcaaagtcatccggtaaggtctgttccctgtcttcagccattctaacattagcctgggagacccagcatggcgtat

SEQ ID NO: 443761 - DNA, 140 bp, Artificial Sequence
  Synthetic
atacgccatgctgggtctccctcattcactttgttggatgttacatgggtcaagtgagatctttgaatgcaactgttattgccacatgtgccccacatgagatgtctgtccttggaggttcgtacttgggagtcggccat

SEQ ID NO: 443762 - DNA, 140 bp, Artificial Sequence
  Synthetic
atggccgactcccaagtacgaacctccaaggacagacatctcatgtggggcacatgtggcaataacagttgcattcaaagatctcacttgacccatgtaacatccaacaaagtgaatgagggagacccagcatggcgtat

SEQ ID NO: 443763 - DNA, 140 bp, Artificial Sequence
  Synthetic
aggccctggctgctgatatgaactgttattgccacatgtgccccacatgagatgtctgtccttggaggttacttgggggaggagttttttggaaaagggacttttgagagaagattcttcgaccttttgggacagcggtg

SEQ ID NO: 443764 - DNA, 140 bp, Artificial Sequence
  Synthetic
caccgctgtcccaaaaggtcgaagaatcttctctcaaaagtcccttttccaaaaaactcctcccccaagtaacctccaaggacagacatctcatgtggggcacatgtggcaataacagttcatatcagcagccagggcct

SEQ ID NO: 443765 - DNA, 140 bp, Artificial Sequence
  Synthetic
aggccctggctgctgatatgacttctctagtgagaccaggagtcctgaggcagtttacacccgaatcatgatgaatggaggtagattgaaaagatcacacataaggaggtatgtctcagtgaccttttgggacagcggtg

SEQ ID NO: 443766 - DNA, 140 bp, Artificial Sequence
  Synthetic
caccgctgtcccaaaaggtcactgagacatacctccttatgtgtgatcttttcaatctacctccattcatcatgattcgggtgtaaactgcctcaggactcctggtctcactagagaagtcatatcagcagccagggcct

SEQ ID NO: 443767 - DNA, 140 bp, Artificial Sequence
  Synthetic
atacgccatgctgggtctcctttctggagccgtgcctcatttccgaaaactccctgatatccgtttaaggccgggcgactttgaatctctaagtggaaaggagaagtctcgccatataggcgtacttgggagtcggccat

SEQ ID NO: 443768 - DNA, 140 bp, Artificial Sequence
  Synthetic
atggccgactcccaagtacgcctatatggcgagacttctcctttccacttagagattcaaagtcgcccggccttaaacggatatcagggagttttcggaaatgaggcacggctccagaaaggagacccagcatggcgtat

SEQ ID NO: 443769 - DNA, 140 bp, Artificial Sequence
  Synthetic
atacgccatgctgggtctcccaataaattatgtacatccttcatgaaaaaaactaacacccctcctttcgaaccatctcagacatgagcaagatctttgtcaatccaagtgcgatcagggcgtacttgggagtcggccat

SEQ ID NO: 443770 - DNA, 140 bp, Artificial Sequence
  Synthetic
atggccgactcccaagtacgccctgatcgcacttggattgacaaagatcttgctcatgtctgagatggttcgaaaggaggggtgttagtttttttcatgaaggatgtacataatttattgggagacccagcatggcgtat

SEQ ID NO: 443771 - DNA, 140 bp, Artificial Sequence
  Synthetic
atacgccatgctgggtctccatcgctggggatcaagtcttgtctatgtgtgggaactccggttatgaagtcatcaaaattttggagccctatgtcgtgaacaatttagtccagagggcagcgtacttgggagtcggccat

SEQ ID NO: 443772 - DNA, 140 bp, Artificial Sequence
  Synthetic
atggccgactcccaagtacgctgccctctggactaaattgttcacgacatagggctccaaaattttgatgacttcataaccggagttcccacacatagacaagacttgatccccagcgatggagacccagcatggcgtat

SEQ ID NO: 443773 - DNA, 140 bp, Artificial Sequence
  Synthetic
aggccctggctgctgatatgcatcaaaattttggagccctatgtcgtgaacaatttagtccagagggcagaaaagtttaggcctctcatccactccttgggggactttcctgtgttcatagaccttttgggacagcggtg

SEQ ID NO: 443774 - DNA, 140 bp, Artificial Sequence
  Synthetic
caccgctgtcccaaaaggtctatgaacacaggaaagtcccccaaggagtggatgagaggcctaaacttttctgccctctggactaaattgttcacgacatagggctccaaaattttgatgcatatcagcagccagggcct

SEQ ID NO: 443775 - DNA, 140 bp, Artificial Sequence
  Synthetic
aggccctggctgctgatatgatgaatggaggcagactaagaaggtcacacataaggagatatgtctcagttagttccaatcatcaagctcgccctaattccttcgctgagtttctaaacagaccttttgggacagcggtg

SEQ ID NO: 443776 - DNA, 140 bp, Artificial Sequence
  Synthetic
caccgctgtcccaaaaggtctgtttagaaactcagcgaaggaattagggcgagcttgatgattggaactaactgagacatatctccttatgtgtgaccttcttagtctgcctccattcatcatatcagcagccagggcct

SEQ ID NO: 443777 - DNA, 140 bp, Artificial Sequence
  Synthetic
atacgccatgctgggtctccagcgagacagtcaatcatccaagaccaaagtggcggctcaaaccgcctctggtcctcctgctctagaatggtccactgctaatgaggaggatgatccatccgtacttgggagtcggccat

SEQ ID NO: 443778 - DNA, 140 bp, Artificial Sequence
  Synthetic
atggccgactcccaagtacggatggatcatcctcctcattagcagtggaccattctagagcaggaggaccagaggcggtttgagccgccactttggtcttggatgattgactgtctcgctggagacccagcatggcgtat

SEQ ID NO: 443779 - DNA, 140 bp, Artificial Sequence
  Synthetic
aggccctggctgctgatatgctttgcgtaggactaggtgggtagaccaggaagtacgccatgcagcgaggaccatggtaggatgttatagccccagcaagaggatgtcacgcaaagccgggaccttttgggacagcggtg

SEQ ID NO: 443780 - DNA, 140 bp, Artificial Sequence
  Synthetic
caccgctgtcccaaaaggtcccggctttgcgtgacatcctcttgctggggctataacatcctaccatggtcctcgctgcatggcgtacttcctggtctacccacctagtcctacgcaaagcatatcagcagccagggcct

SEQ ID NO: 443781 - DNA, 140 bp, Artificial Sequence
  Synthetic
atacgccatgctgggtctcccttcaaaacccattgatctcaggcctgagagtggttcaatgggcgacaggggctcattacaagctcaaacctattctggatgatctcaatgtattcccatcgtacttgggagtcggccat

SEQ ID NO: 443782 - DNA, 140 bp, Artificial Sequence
  Synthetic
atggccgactcccaagtacgatgggaatacattgagatcatccagaataggtttgagcttgtaatgagcccctgtcgcccattgaaccactctcaggcctgagatcaatgggttttgaagggagacccagcatggcgtat

SEQ ID NO: 443783 - DNA, 140 bp, Artificial Sequence
  Synthetic
atacgccatgctgggtctcctgctccaaattccatatgaaaaaaacaggcaacaccactgataagatgaactttctgcgcaaaatagtgaagacctgtagagatgaggacacccagaagccgtacttgggagtcggccat

SEQ ID NO: 443784 - DNA, 140 bp, Artificial Sequence
  Synthetic
atggccgactcccaagtacggcttctgggtgtcctcatctctacaggtcttcactattttgcgcagaaagttcatcttatcagtggtgttgcctgtttttttcatatggaatttggagcaggagacccagcatggcgtat

SEQ ID NO: 443785 - DNA, 140 bp, Artificial Sequence
  Synthetic
atacgccatgctgggtctcccccctctcgtgtcggctcctccagatgatgatgacctgtggttaccccctccggagtatattccgctgaaggagatcactggcaagaaaaacatgagaaacgtacttgggagtcggccat

SEQ ID NO: 443786 - DNA, 140 bp, Artificial Sequence
  Synthetic
atggccgactcccaagtacgtttctcatgtttttcttgccagtgatctccttcagcggaatatactccggagggggtaaccacaggtcatcatcatctggaggagccgacacgagaggggggagacccagcatggcgtat

SEQ ID NO: 443787 - DNA, 140 bp, Artificial Sequence
  Synthetic
atacgccatgctgggtctccgattttgcattgtctatagacggcccactctatctggttttcaaaacttacggcaccatgctggtaaatccggactacaaagctattcaacatctgtctacgtacttgggagtcggccat

SEQ ID NO: 443788 - DNA, 140 bp, Artificial Sequence
  Synthetic
atggccgactcccaagtacgtagacagatgttgaatagctttgtagtccggatttaccagcatggtgccgtaagttttgaaaaccagatagagtgggccgtctatagacaatgcaaaatcggagacccagcatggcgtat

SEQ ID NO: 443789 - DNA, 140 bp, Artificial Sequence
  Synthetic
atacgccatgctgggtctccattggaaatacgggtgagtgctagacaatgccatatccagggaaggatctggtgtattaatatgaattctcgggcatgtcaattttggtccgacatgtctcgtacttgggagtcggccat

SEQ ID NO: 443790 - DNA, 140 bp, Artificial Sequence
  Synthetic
atggccgactcccaagtacgagacatgtcggaccaaaattgacatgcccgagaattcatattaatacaccagatccttccctggatatggcattgtctagcactcacccgtatttccaatggagacccagcatggcgtat

SEQ ID NO: 443791 - DNA, 140 bp, Artificial Sequence
  Synthetic
atacgccatgctgggtctccgagctatcgaggaaggagcatctaaactgggattgatcatcaagaaagaagagaccatgtgtagttacgactttcttatatatggaaaaacccctttattcgtacttgggagtcggccat

SEQ ID NO: 443792 - DNA, 140 bp, Artificial Sequence
  Synthetic
atggccgactcccaagtacgaataaaggggtttttccatatataagaaagtcgtaactacacatggtctcttctttcttgatgatcaatcccagtttagatgctccttcctcgatagctcggagacccagcatggcgtat

SEQ ID NO: 443793 - DNA, 140 bp, Artificial Sequence
  Synthetic
atacgccatgctgggtctcctccacaagatggtagatgatctagaattacagcgaggtactttgtctaaagtttccattattatagctatcatgataatcttctccaatagagtattcaacgtacttgggagtcggccat

SEQ ID NO: 443794 - DNA, 140 bp, Artificial Sequence
  Synthetic
atggccgactcccaagtacgttgaatactctattggagaagattatcatgatagctataataatggaaactttagacaaagtacctcgctgtaattctagatcatctaccatcttgtggaggagacccagcatggcgtat

SEQ ID NO: 443795 - DNA, 140 bp, Artificial Sequence
  Synthetic
atacgccatgctgggtctccaaccacctcagacatgagcaagatttttgtcaacccaagtgcgatcagggcaggtttggctgatctagagatggcagaggaaactgtagatctgatcgctcgtacttgggagtcggccat

SEQ ID NO: 443796 - DNA, 140 bp, Artificial Sequence
  Synthetic
atggccgactcccaagtacgagcgatcagatctacagtttcctctgccatctctagatcagccaaacctgccctgatcgcacttgggttgacaaaaatcttgctcatgtctgaggtggttggagacccagcatggcgtat

SEQ ID NO: 443797 - DNA, 140 bp, Artificial Sequence
  Synthetic
atacgccatgctgggtctcctctaccaatgcgctgacagtagctcaacattctcaatctctgatcaaacctatgagggattttctgctcatgtcggtacaggcagtttaccactacctgtcgtacttgggagtcggccat

SEQ ID NO: 443798 - DNA, 140 bp, Artificial Sequence
  Synthetic
atggccgactcccaagtacgacaggtagtggtaaactgcctgtaccgacatgagcagaaaatccctcataggtttgatcagagattgagaatgttgagctactgtcagcgcattggtagaggagacccagcatggcgtat

SEQ ID NO: 443799 - DNA, 140 bp, Artificial Sequence
  Synthetic
aggccctggctgctgatatgaggatctcaggaaaaatgatcccccaggctcttctgtttgtgcctctcctgattccctcgctgtgtctcgggaagttccccatctacacgataccagacagaccttttgggacagcggtg

SEQ ID NO: 443800 - DNA, 140 bp, Artificial Sequence
  Synthetic
caccgctgtcccaaaaggtctgtctggtatcgtgtagatggggaacttcccgagacacagcgagggaatcaggagaggcacaaacagaagagcctgggggatcatttttcctgagatcctcatatcagcagccagggcct

SEQ ID NO: 443801 - DNA, 140 bp, Artificial Sequence
  Synthetic
aggccctggctgctgatatgacagactccccaaagggtcgggagggtctggacctgctcctcggagagggcagatctcttaagagagatctcgtggggaaggaaggtggttggtaccacagaccttttgggacagcggtg

SEQ ID NO: 443802 - DNA, 140 bp, Artificial Sequence
  Synthetic
caccgctgtcccaaaaggtctgtggtaccaaccaccttccttccccacgagatctctcttaagagatctgccctctccgaggagcaggtccagaccctcccgaccctttggggagtctgtcatatcagcagccagggcct

SEQ ID NO: 443803 - DNA, 140 bp, Artificial Sequence
  Synthetic
atacgccatgctgggtctccaatagtgaagaccaccagacttagaggaagtatagaggatctgtccaaggaggtggagaagcaccttcgaagatacaacaggtggatcaccctcaaagaccgtacttgggagtcggccat

SEQ ID NO: 443804 - DNA, 140 bp, Artificial Sequence
  Synthetic
atggccgactcccaagtacggtctttgagggtgatccacctgttgtatcttcgaaggtgcttctccacctccttggacagatcctctatacttcctctaagtctggtggtcttcactattggagacccagcatggcgtat

SEQ ID NO: 443805 - DNA, 140 bp, Artificial Sequence
  Synthetic
atacgccatgctgggtctcctatgtcaccaccacatttaagagaaaacacttccgcccgatgccagatgcctgcagagctgcacacgactggaagatagccggcgatcctagatatgaagcgtacttgggagtcggccat

SEQ ID NO: 443806 - DNA, 140 bp, Artificial Sequence
  Synthetic
atggccgactcccaagtacgcttcatatctaggatcgccggctatcttccagtcgtgtgcagctctgcaggcatctggcatcgggcggaagtgttttctcttaaatgtggtggtgacataggagacccagcatggcgtat

SEQ ID NO: 443807 - DNA, 140 bp, Artificial Sequence
  Synthetic
atacgccatgctgggtctcccccctgatagaatgtacagactgagactcctggacggtgaaccctgaaaaaaactagatcagaattccgaacctctgtcggctcgattgtttttccatctcgtacttgggagtcggccat

SEQ ID NO: 443808 - DNA, 140 bp, Artificial Sequence
  Synthetic
atggccgactcccaagtacgagatggaaaaacaatcgagccgacagaggttcggaattctgatctagtttttttcagggttcaccgtccaggagtctcagtctgtacattctatcaggggggagacccagcatggcgtat

SEQ ID NO: 443809 - DNA, 140 bp, Artificial Sequence
  Synthetic
aggccctggctgctgatatggatgctatcagaaaggctctatacgatgaggtggacaaggtggaaaattcagagtttcgagaggcaatcctgttgtccaaaacccatagagataacttcagaccttttgggacagcggtg

SEQ ID NO: 443810 - DNA, 140 bp, Artificial Sequence
  Synthetic
caccgctgtcccaaaaggtctgaagttatctctatgggttttggacaacaggattgcctctcgaaactctgaattttccaccttgtccacctcatcgtatagagcctttctgatagcatccatatcagcagccagggcct

SEQ ID NO: 443811 - DNA, 140 bp, Artificial Sequence
  Synthetic
atacgccatgctgggtctcccccctacgacaaatcccttcattcaagagttttccccagtgggaagtgtttggggataacagtctcctctacctactgcccaactaaccacgattacacccgtacttgggagtcggccat

SEQ ID NO: 443812 - DNA, 140 bp, Artificial Sequence
  Synthetic
atggccgactcccaagtacgggtgtaatcgtggttagttgggcagtaggtagaggagactgttatccccaaacacttcccactggggaaaactcttgaatgaagggatttgtcgtaggggggagacccagcatggcgtat

SEQ ID NO: 443813 - DNA, 140 bp, Artificial Sequence
  Synthetic
aggccctggctgctgatatgctatgcggagtccccgggctccggctgatgaatggaacctgggtctcaatccagacatcagatgatattaaatggtgccctcctgatcaattggtgaatcgaccttttgggacagcggtg

SEQ ID NO: 443814 - DNA, 140 bp, Artificial Sequence
  Synthetic
caccgctgtcccaaaaggtcgattcaccaattgatcaggagggcaccatttaatatcatctgatgtctggattgagacccaggttccattcatcagccggagcccggggactccgcatagcatatcagcagccagggcct

SEQ ID NO: 443815 - DNA, 140 bp, Artificial Sequence
  Synthetic
atacgccatgctgggtctcctctcctttatatcttgcaatcaggagattgcccatctttgagacccgagagactctcccattttgaaagtcattcaaagacctcatgtaacaagacaaatcgtacttgggagtcggccat

SEQ ID NO: 443816 - DNA, 140 bp, Artificial Sequence
  Synthetic
atggccgactcccaagtacgatttgtcttgttacatgaggtctttgaatgactttcaaaatgggagagtctctcgggtctcaaagatgggcaatctcctgattgcaagatataaaggagaggagacccagcatggcgtat

SEQ ID NO: 443817 - DNA, 140 bp, Artificial Sequence
  Synthetic
aggccctggctgctgatatgtaaatcagtgagcttcagacgtctcagccacttgagaaagcttgttcctgggtttgggaaggcatacaccatattcaataataccttaatggaagctgatgaccttttgggacagcggtg

SEQ ID NO: 443818 - DNA, 140 bp, Artificial Sequence
  Synthetic
caccgctgtcccaaaaggtcatcagcttccattaaggtattattgaatatggtgtatgccttcccaaacccaggaacaagctttctcaagtggctgagacgtctgaagctcactgatttacatatcagcagccagggcct

SEQ ID NO: 443819 - DNA, 140 bp, Artificial Sequence
  Synthetic
atacgccatgctgggtctccatgtcaccaccacgtttaagagaaagcacttccgaccaacgccggatgcatgcagatctgcatacaattggaagatggctggtgaccccagatatgaagacgtacttgggagtcggccat

SEQ ID NO: 443820 - DNA, 140 bp, Artificial Sequence
  Synthetic
atggccgactcccaagtacgtcttcatatctggggtcaccagccatcttccaattgtatgcagatctgcatgcatccggcgttggtcggaagtgctttctcttaaacgtggtggtgacatggagacccagcatggcgtat

SEQ ID NO: 443821 - DNA, 140 bp, Artificial Sequence
  Synthetic
atacgccatgctgggtctcctcaatggtataattttgggtccagatgggaatgttctgatccctgagatgcaatcgtccctgctccaacaacatatggaactgttggagtcttctgttatcgtacttgggagtcggccat

SEQ ID NO: 443822 - DNA, 140 bp, Artificial Sequence
  Synthetic
atggccgactcccaagtacgataacagaagactccaacagttccatatgttgttggagcagggacgattgcatctcagggatcagaacattcccatctggacccaaaattataccattgaggagacccagcatggcgtat

SEQ ID NO: 443823 - DNA, 140 bp, Artificial Sequence
  Synthetic
atacgccatgctgggtctccatcacattccttcacaaggacaagattggcttcctggctatcggagaacagaggaggaccggttccaagtgagaaagttattattacagctctttctaagcgtacttgggagtcggccat

SEQ ID NO: 443824 - DNA, 140 bp, Artificial Sequence
  Synthetic
atggccgactcccaagtacgcttagaaagagctgtaataataactttctcacttggaaccggtcctcctctgttctccgatagccaggaagccaatcttgtccttgtgaaggaatgtgatggagacccagcatggcgtat

SEQ ID NO: 443825 - DNA, 140 bp, Artificial Sequence
  Synthetic
atacgccatgctgggtctcctcaggagggaaagtgtcagtagcccctcaaaacgggaaaatcatatcctcatgggagttgtacaaaagtgaaagtgagaccgggatgtgaaggtgagtcacgtacttgggagtcggccat

SEQ ID NO: 443826 - DNA, 140 bp, Artificial Sequence
  Synthetic
atggccgactcccaagtacgtgactcaccttcacatcccggtctcactttcacttttgtacaactcccatgaggatatgattttcccgttttgaggggctactgacactttccctcctgaggagacccagcatggcgtat

SEQ ID NO: 443827 - DNA, 140 bp, Artificial Sequence
  Synthetic
atacgccatgctgggtctccgaccaggtgattttgaatctctaagtggtagagaaaagtctcgccatatagggtcggctcaggggctcttatactcaatcttagtagcaattcacgactccgtacttgggagtcggccat

SEQ ID NO: 443828 - DNA, 140 bp, Artificial Sequence
  Synthetic
atggccgactcccaagtacggagtcgtgaattgctactaagattgagtataagagcccctgagccgaccctatatggcgagacttttctctaccacttagagattcaaaatcacctggtcggagacccagcatggcgtat

SEQ ID NO: 443829 - DNA, 140 bp, Artificial Sequence
  Synthetic
atacgccatgctgggtctccttaagagtcaagaaactttcatcaatcatctcaactgatctaacacagtcatgtttattctggtaatgcatgacgtcctctgacagtatcatttactaatcgtacttgggagtcggccat

SEQ ID NO: 443830 - DNA, 140 bp, Artificial Sequence
  Synthetic
atggccgactcccaagtacgattagtaaatgatactgtcagaggacgtcatgcattaccagaataaacatgactgtgttagatcagttgagatgattgatgaaagtttcttgactcttaaggagacccagcatggcgtat

SEQ ID NO: 443831 - DNA, 140 bp, Artificial Sequence
  Synthetic
aggccctggctgctgatatgcagttcaaatcatcaagctcgtccaaactcatttgctgattttctaaacaagacatattcgaacgactcatgaggggctgaataacagtgtgccagaaatgaccttttgggacagcggtg

SEQ ID NO: 443832 - DNA, 140 bp, Artificial Sequence
  Synthetic
caccgctgtcccaaaaggtcatttctggcacactgttattcagcccctcatgagtcgttcgaatatgtcttgtttagaaaatcagcaaatgagtttggacgagcttgatgatttgaactgcatatcagcagccagggcct

SEQ ID NO: 443833 - DNA, 140 bp, Artificial Sequence
  Synthetic
atacgccatgctgggtctcccggaaactcagataactctatgcttgagtttgggtagatgccacagcatgttcccctacattagaccaaataggggtttagtcgaaagaagcgacttgcccgtacttgggagtcggccat

SEQ ID NO: 443834 - DNA, 140 bp, Artificial Sequence
  Synthetic
atggccgactcccaagtacgggcaagtcgcttctttcgactaaacccctatttggtctaatgtaggggaacatgctgtggcatctacccaaactcaagcatagagttatctgagtttccgggagacccagcatggcgtat

SEQ ID NO: 443835 - DNA, 140 bp, Artificial Sequence
  Synthetic
aggccctggctgctgatatgaaaaactgtggaatggaggagtaattaacaacacttctcctcctgataacggcaccatgatgattgatccaggggaggtttatgatgacccgattgatctgaccttttgggacagcggtg

SEQ ID NO: 443836 - DNA, 140 bp, Artificial Sequence
  Synthetic
caccgctgtcccaaaaggtcagatcaatcgggtcatcataaacctcccctggatcaatcatcatggtgccgttatcaggaggagaagtgttgttaattactcctccattccacagtttttcatatcagcagccagggcct

SEQ ID NO: 443837 - DNA, 140 bp, Artificial Sequence
  Synthetic
aggccctggctgctgatatgaggtggagaagcaccttcgaagatacaacaggtggatcaccctcaaagacatcagatccagatcatctctgttagattatagctgcttataaactgagcggaccttttgggacagcggtg

SEQ ID NO: 443838 - DNA, 140 bp, Artificial Sequence
  Synthetic
caccgctgtcccaaaaggtccgctcagtttataagcagctataatctaacagagatgatctggatctgatgtctttgagggtgatccacctgttgtatcttcgaaggtgcttctccacctcatatcagcagccagggcct

SEQ ID NO: 443839 - DNA, 140 bp, Artificial Sequence
  Synthetic
atacgccatgctgggtctcccatgcagttctttgagggatcatgtcctgatgactggaccagctatggaatcctgatagctcggaggggagataagatcaccccagattctcttgtggaccgtacttgggagtcggccat

SEQ ID NO: 443840 - DNA, 140 bp, Artificial Sequence
  Synthetic
atggccgactcccaagtacggtccacaagagaatctggggtgatcttatctcccctccgagctatcaggattccatagctggtccagtcatcaggacatgatccctcaaagaactgcatgggagacccagcatggcgtat

SEQ ID NO: 443841 - DNA, 140 bp, Artificial Sequence
  Synthetic
atacgccatgctgggtctccagattaatgttagaatggttgaaaacagggaataggcctctccggatgaccttgacagacaattgttctaggtctcacaaagttctgaaagattacttcacgtacttgggagtcggccat

SEQ ID NO: 443842 - DNA, 140 bp, Artificial Sequence
  Synthetic
atggccgactcccaagtacgtgaagtaatctttcagaactttgtgagacctagaacaattgtctgtcaaggtcatccggagaggcctattccctgttttcaaccattctaacattaatctggagacccagcatggcgtat

SEQ ID NO: 443843 - DNA, 140 bp, Artificial Sequence
  Synthetic
atacgccatgctgggtctccgattcctcaagatatggtcacagaccgtagaagagataatatcctatgtcacggtcaactttcccaaccctccaggaaggtcttcagaggacaaatcaaccgtacttgggagtcggccat

SEQ ID NO: 443844 - DNA, 140 bp, Artificial Sequence
  Synthetic
atggccgactcccaagtacggttgatttgtcctctgaagaccttcctggagggttgggaaagttgaccgtgacataggatattatctcttctacggtctgtgaccatatcttgaggaatcggagacccagcatggcgtat

SEQ ID NO: 443845 - DNA, 140 bp, Artificial Sequence
  Synthetic
atacgccatgctgggtctcctcttaagtttatataggttaagcaaaatttctggacagaacaccggcaattacaagacaaacatcgcagatagaatagagcagattttcgagacagcccccgtacttgggagtcggccat

SEQ ID NO: 443846 - DNA, 140 bp, Artificial Sequence
  Synthetic
atggccgactcccaagtacgggggctgtctcgaaaatctgctctattctatctgcgatgtttgtcttgtaattgccggtgttctgtccagaaattttgcttaacctatataaacttaagaggagacccagcatggcgtat

SEQ ID NO: 443847 - DNA, 140 bp, Artificial Sequence
  Synthetic
atacgccatgctgggtctccgaagtgtataaatgacttggctcagttctattataagtcctcccccatagaaaagctgttaaactgcacactcggaaatagagggctaaaaacccccccccgtacttgggagtcggccat

SEQ ID NO: 443848 - DNA, 140 bp, Artificial Sequence
  Synthetic
atggccgactcccaagtacgggggggggtttttagccctctatttccgagtgtgcagtttaacagcttttctatgggggaggacttataatagaactgagccaagtcatttatacacttcggagacccagcatggcgtat

SEQ ID NO: 443849 - DNA, 140 bp, Artificial Sequence
  Synthetic
atacgccatgctgggtctccgacatgtttttctccaggattgaacatctgtattcagcaattagagtgggcacagttgtaactgcttatgaagactgctcaggattggtgtcatttacagcgtacttgggagtcggccat

SEQ ID NO: 443850 - DNA, 140 bp, Artificial Sequence
  Synthetic
atggccgactcccaagtacgctgtaaatgacaccaatcctgagcagtcttcataagcagttacaactgtgcccactctaattgctgaatacagatgttcaatcctggagaaaaacatgtcggagacccagcatggcgtat

SEQ ID NO: 443851 - DNA, 140 bp, Artificial Sequence
  Synthetic
atacgccatgctgggtctccagagactgctgttcctcattcctatttcatccattttcgttcgttgggcttgagtgggaaatctccatactcatccaatgcagttggtcacgtgttcaaccgtacttgggagtcggccat

SEQ ID NO: 443852 - DNA, 140 bp, Artificial Sequence
  Synthetic
atggccgactcccaagtacggttgaacacgtgaccaactgcattggatgagtatggagatttcccactcaagcccaacgaacgaaaatggatgaaataggaatgaggaacagcagtctctggagacccagcatggcgtat

SEQ ID NO: 443853 - DNA, 140 bp, Artificial Sequence
  Synthetic
atacgccatgctgggtctccgacctttttttgtctcggttcaactctctaatgattcttctctctcctccggagcccagatattccgatgacctgatatctcagttgtgtcaactgtatacgtacttgggagtcggccat

SEQ ID NO: 443854 - DNA, 140 bp, Artificial Sequence
  Synthetic
atggccgactcccaagtacgtatacagttgacacaactgagatatcaggtcatcggaatatctgggctccggaggagagagaagaatcattagagagttgaaccgagacaaaaaaaggtcggagacccagcatggcgtat

SEQ ID NO: 443855 - DNA, 140 bp, Artificial Sequence
  Synthetic
atacgccatgctgggtctcctacgggactatgctagtaaacccagactacaaagctattcaacatctgtcaagagcgtttccttcggtgacgggatttataacccaagcaacttcgtcctcgtacttgggagtcggccat

SEQ ID NO: 443856 - DNA, 140 bp, Artificial Sequence
  Synthetic
atggccgactcccaagtacgaggacgaagttgcttgggttataaatcccgtcaccgaaggaaacgctcttgacagatgttgaatagctttgtagtctgggtttactagcatagtcccgtaggagacccagcatggcgtat

SEQ ID NO: 443857 - DNA, 140 bp, Artificial Sequence
  Synthetic
atacgccatgctgggtctccatctgggagaggagttttttggaaaaggaacttttgaaagaagattcttcagggacgagaaggaacttcaagaatatgaggcagctgaattgacaaaagccgtacttgggagtcggccat

SEQ ID NO: 443858 - DNA, 140 bp, Artificial Sequence
  Synthetic
atggccgactcccaagtacggcttttgtcaattcagctgcctcatattcttgaagttccttctcgtccctgaagaatcttctttcaaaagttccttttccaaaaaactcctctcccagatggagacccagcatggcgtat

SEQ ID NO: 443859 - DNA, 140 bp, Artificial Sequence
  Synthetic
atacgccatgctgggtctccaaaatttaggcctctcattcactctctgggggacttccctacatttataagagataaggtgggtcagcttgagggaacatttggtcctagtgcaaaaaggcgtacttgggagtcggccat

SEQ ID NO: 443860 - DNA, 140 bp, Artificial Sequence
  Synthetic
atggccgactcccaagtacgcctttttgcactaggaccaaatgttccctcaagctgacccaccttatctcttataaatgtagggaagtcccccagagagtgaatgagaggcctaaattttggagacccagcatggcgtat

SEQ ID NO: 443861 - DNA, 140 bp, Artificial Sequence
  Synthetic
atacgccatgctgggtctccaggagctccagtccctgagggcatgaactgggtatacaaactgaggagaacccttatcttccaatgggctgattccaggggtcctcttgaaggggaggagcgtacttgggagtcggccat

SEQ ID NO: 443862 - DNA, 140 bp, Artificial Sequence
  Synthetic
atggccgactcccaagtacgctcctccccttcaagaggacccctggaatcagcccattggaagataagggttctcctcagtttgtatacccagttcatgccctcagggactggagctcctggagacccagcatggcgtat

SEQ ID NO: 443863 - DNA, 140 bp, Artificial Sequence
  Synthetic
atacgccatgctgggtctcccttcagacacaaaggtccgaagaggacaaagactcctctctgcttctagaataatcagattatatcccgcaagtttatcacttgtatacctctggaggagcgtacttgggagtcggccat

SEQ ID NO: 443864 - DNA, 140 bp, Artificial Sequence
  Synthetic
atggccgactcccaagtacgctcctccagaggtatacaagtgataaacttgcgggatataatctgattattctagaagcagagaggagtctttgtcctcttcggacctttgtgtctgaagggagacccagcatggcgtat

SEQ ID NO: 443865 - DNA, 140 bp, Artificial Sequence
  Synthetic
aggccctggctgctgatatgcagacctataacttattacttcagaaagcaagtcattcgagggaatatttatttatcttggagttggtccgacgacacctcagtgttcaagagggtagccgaccttttgggacagcggtg

SEQ ID NO: 443866 - DNA, 140 bp, Artificial Sequence
  Synthetic
caccgctgtcccaaaaggtcggctaccctcttgaacactgaggtgtcgtcggaccaactccaagataaataaatattccctcgaatgacttgctttctgaagtaataagttataggtctgcatatcagcagccagggcct

SEQ ID NO: 443867 - DNA, 140 bp, Artificial Sequence
  Synthetic
atacgccatgctgggtctcctccgaccgaaagcctgtatatgctgagattattgtatgatgcatcttgaaaaaaacaagatcttgaatctgaacctctggttgtttgattgttttttttacgtacttgggagtcggccat

SEQ ID NO: 443868 - DNA, 140 bp, Artificial Sequence
  Synthetic
atggccgactcccaagtacgtaaaaaaaacaatcaaacaaccagaggttcagattcaagatcttgtttttttcaagatgcatcatacaataatctcagcatatacaggctttcggtcggaggagacccagcatggcgtat

SEQ ID NO: 443869 - DNA, 140 bp, Artificial Sequence
  Synthetic
aggccctggctgctgatatgttttcgcctggactacgagaagtggaacaatcatcagaggctggaatcaacagaggatgtattttctgtgctagatcaagtatttggattgaaaagggtggaccttttgggacagcggtg

SEQ ID NO: 443870 - DNA, 140 bp, Artificial Sequence
  Synthetic
caccgctgtcccaaaaggtccacccttttcaatccaaatacttgatctagcacagaaaatacatcctctgttgattccagcctctgatgattgttccacttctcgtagtccaggcgaaaacatatcagcagccagggcct

SEQ ID NO: 443871 - DNA, 140 bp, Artificial Sequence
  Synthetic
atacgccatgctgggtctcctgtcagacggcccgacatgttggaatggccaagatggagggctagagggtttacgacagaagggctggagtctggttagtttgttaatgatagatcgtgacgtacttgggagtcggccat

SEQ ID NO: 443872 - DNA, 140 bp, Artificial Sequence
  Synthetic
atggccgactcccaagtacgtcacgatctatcattaacaaactaaccagactccagcccttctgtcgtaaaccctctagccctccatcttggccattccaacatgtcgggccgtctgacaggagacccagcatggcgtat

SEQ ID NO: 443873 - DNA, 140 bp, Artificial Sequence
  Synthetic
atacgccatgctgggtctcccccgacaagctaaacaaaataatgcaggatgacctgaaccgttatgcgtctctctgaccacaccccatggctctgccacactgttgaatcagatctgattcgtacttgggagtcggccat

SEQ ID NO: 443874 - DNA, 140 bp, Artificial Sequence
  Synthetic
atggccgactcccaagtacgaatcagatctgattcaacagtgtggcagagccatggggtgtggtcagagagacgcataacggttcaggtcatcctgcattattttgtttagcttgtcgggggagacccagcatggcgtat

SEQ ID NO: 443875 - DNA, 140 bp, Artificial Sequence
  Synthetic
atacgccatgctgggtctccaggttttgtgtcctacatatatgctgtcaccagggctctcaagagaagggcttctctacgagttggagagcatatcaagaaatgctctctcaatctatcgcgtacttgggagtcggccat

SEQ ID NO: 443876 - DNA, 140 bp, Artificial Sequence
  Synthetic
atggccgactcccaagtacgcgatagattgagagagcatttcttgatatgctctccaactcgtagagaagcccttctcttgagagccctggtgacagcatatatgtaggacacaaaacctggagacccagcatggcgtat

SEQ ID NO: 443877 - DNA, 140 bp, Artificial Sequence
  Synthetic
atacgccatgctgggtctcccgtgacccgcttagcccatgatggatccaaactccctctgagatgtgtgctggggtgggttgctctagccaattccaaaaggttccagcttttagttgagcgtacttgggagtcggccat

SEQ ID NO: 443878 - DNA, 140 bp, Artificial Sequence
  Synthetic
atggccgactcccaagtacgctcaactaaaagctggaaccttttggaattggctagagcaacccaccccagcacacatctcagagggagtttggatccatcatgggctaagcgggtcacgggagacccagcatggcgtat

SEQ ID NO: 443879 - DNA, 140 bp, Artificial Sequence
  Synthetic
atacgccatgctgggtctcccttttgcatcaatggggaagtcaaagtgtgtagtccaaacggctattcatttaggattttacggcacattctgagatcattcgatgagatctattctgggcgtacttgggagtcggccat

SEQ ID NO: 443880 - DNA, 140 bp, Artificial Sequence
  Synthetic
atggccgactcccaagtacgcccagaatagatctcatcgaatgatctcagaatgtgccgtaaaatcctaaatgaatagccgtttggactacacactttgacttccccattgatgcaaaagggagacccagcatggcgtat

SEQ ID NO: 443881 - DNA, 140 bp, Artificial Sequence
  Synthetic
atacgccatgctgggtctccctctcattttccaatgggctgattccagaggccctctagaaggggaggagttggaatactctcaggaggtcacctgggatgatgatgcagagtttgtcggcgtacttgggagtcggccat

SEQ ID NO: 443882 - DNA, 140 bp, Artificial Sequence
  Synthetic
atggccgactcccaagtacgccgacaaactctgcatcatcatcccaggtgacctcctgagagtattccaactcctccccttctagagggcctctggaatcagcccattggaaaatgagagggagacccagcatggcgtat

SEQ ID NO: 443883 - DNA, 140 bp, Artificial Sequence
  Synthetic
aggccctggctgctgatatgtcccctgatgcaccccctggcagacccgtccacagttttcaaggacggtgatgaggctgaggattttgttgaagttcaccttcccgatgtgcacaaacaggaccttttgggacagcggtg

SEQ ID NO: 443884 - DNA, 140 bp, Artificial Sequence
  Synthetic
caccgctgtcccaaaaggtcctgtttgtgcacatcgggaaggtgaacttcaacaaaatcctcagcctcatcaccgtccttgaaaactgtggacgggtctgccagggggtgcatcaggggacatatcagcagccagggcct

SEQ ID NO: 443885 - DNA, 140 bp, Artificial Sequence
  Synthetic
aggccctggctgctgatatggatctgggagagagaacattggagagcttcactcgcctgctagaggaccccactaccctgaatataaaaggaggggccagtcccaccattcttctcaaaggaccttttgggacagcggtg

SEQ ID NO: 443886 - DNA, 140 bp, Artificial Sequence
  Synthetic
caccgctgtcccaaaaggtcctttgagaagaatggtgggactggcccctccttttatattcagggtagtggggtcctctagcaggcgagtgaagctctccaatgttctctctcccagatccatatcagcagccagggcct

SEQ ID NO: 443887 - DNA, 140 bp, Artificial Sequence
  Synthetic
aggccctggctgctgatatggtctcaggggttgacttgggcctcccaaactggggtaagtatgtattattgagtgcaggggccctggttgccttgatgttgataatcttcttaatgacatgaccttttgggacagcggtg

SEQ ID NO: 443888 - DNA, 140 bp, Artificial Sequence
  Synthetic
caccgctgtcccaaaaggtcatgtcattaagaagattatcaacatcaaggcaaccagggcccctgcactcaataatacatacttaccccagtttgggaggcccaagtcaacccctgagaccatatcagcagccagggcct

SEQ ID NO: 443889 - DNA, 140 bp, Artificial Sequence
  Synthetic
aggccctggctgctgatatggtcatggtgccgttgaatcgctgcattttgtcagagttgaatctattacttttacaatttaagcttctctgatgtgaaaaaaactgtcaacatccctcaagaccttttgggacagcggtg

SEQ ID NO: 443890 - DNA, 140 bp, Artificial Sequence
  Synthetic
caccgctgtcccaaaaggtcttgagggatgttgacagtttttttcacatcagagaagcttaaattgtaaaagtaatagattcaactctgacaaaatgcagcgattcaacggcaccatgaccatatcagcagccagggcct

SEQ ID NO: 443891 - DNA, 140 bp, Artificial Sequence
  Synthetic
atacgccatgctgggtctcctctttagttcttcttttttaggaattcctgagtcgatcattgggttgatacaaaactccagaacaataagaagacagtttcggaggagtctctcaaggaccgtacttgggagtcggccat

SEQ ID NO: 443892 - DNA, 140 bp, Artificial Sequence
  Synthetic
atggccgactcccaagtacggtccttgagagactcctccgaaactgtcttcttattgttctggagttttgtatcaacccaatgatcgactcaggaattcctaaaaaagaagaactaaagaggagacccagcatggcgtat

SEQ ID NO: 443893 - DNA, 140 bp, Artificial Sequence
  Synthetic
atacgccatgctgggtctccagcttggtccttggagccctattgacatacatcaccttagctgtccaaacaatctggttgtggaggacgaggggtgcactagtctgtcagggttttcttacgtacttgggagtcggccat

SEQ ID NO: 443894 - DNA, 140 bp, Artificial Sequence
  Synthetic
atggccgactcccaagtacgtaagaaaaccctgacagactagtgcacccctcgtcctccacaaccagattgtttggacagctaaggtgatgtatgtcaatagggctccaaggaccaagctggagacccagcatggcgtat

SEQ ID NO: 443895 - DNA, 140 bp, Artificial Sequence
  Synthetic
aggccctggctgctgatatgatctcctcctccaaagggttgagagaaatttgtctaagagtatgagggctaatctgcgacaaatgagttctttgatgaggcaggtgctgggtgggcacgggaccttttgggacagcggtg

SEQ ID NO: 443896 - DNA, 140 bp, Artificial Sequence
  Synthetic
caccgctgtcccaaaaggtcccgtgcccacccagcacctgcctcatcaaagaactcatttgtcgcagattagccctcatactcttagacaaatttctctcaaccctttggaggaggagatcatatcagcagccagggcct

SEQ ID NO: 443897 - DNA, 140 bp, Artificial Sequence
  Synthetic
atacgccatgctgggtctccgcagatctcttaagagagatttcgtgggggaggaaggtggtcggcacaacagtccctcacccctctgagatgttagggttaatcccaaaatcctctatttcgtacttgggagtcggccat

SEQ ID NO: 443898 - DNA, 140 bp, Artificial Sequence
  Synthetic
atggccgactcccaagtacgaaatagaggattttgggattaaccctaacatctcagaggggtgagggactgttgtgccgaccaccttcctcccccacgaaatctctcttaagagatctgcggagacccagcatggcgtat

SEQ ID NO: 443899 - DNA, 140 bp, Artificial Sequence
  Synthetic
aggccctggctgctgatatgtatgtcaccaccacattcaagaggaaacattttcgccctataccagatgcatgtagggctgcatacaactggaagatggctggtgatcccagatatgagggaccttttgggacagcggtg

SEQ ID NO: 443900 - DNA, 140 bp, Artificial Sequence
  Synthetic
caccgctgtcccaaaaggtccctcatatctgggatcaccagccatcttccagttgtatgcagccctacatgcatctggtatagggcgaaaatgtttcctcttgaatgtggtggtgacatacatatcagcagccagggcct

SEQ ID NO: 443901 - DNA, 140 bp, Artificial Sequence
  Synthetic
atacgccatgctgggtctccgtgcttccttcttttgatcagtcattcttctcaagaggtcccctgaagggatacctgggttcatccacttctatgtcgacccagctattccatgcgtgggcgtacttgggagtcggccat

SEQ ID NO: 443902 - DNA, 140 bp, Artificial Sequence
  Synthetic
atggccgactcccaagtacgcccacgcatggaatagctgggtcgacatagaagtggatgaacccaggtatcccttcaggggacctcttgagaagaatgactgatcaaaagaaggaagcacggagacccagcatggcgtat

SEQ ID NO: 443903 - DNA, 140 bp, Artificial Sequence
  Synthetic
aggccctggctgctgatatgaatctcttcaaaatccttatcctgattaccattggctacggaccgtaaagaccaccaaagagtctcttatcatcatatctccaagtgtggctgatttggagaccttttgggacagcggtg

SEQ ID NO: 443904 - DNA, 140 bp, Artificial Sequence
  Synthetic
caccgctgtcccaaaaggtctccaaatcagccacacttggagatatgatgataagagactctttggtggtctttacggtccgtagccaatggtaatcaggataaggattttgaagagattcatatcagcagccagggcct

SEQ ID NO: 443905 - DNA, 140 bp, Artificial Sequence
  Synthetic
aggccctggctgctgatatgaccaccaaagagtctcttatcatcatatctccaagtgtggctgatttggacccatatgacaaatcccttcattctagagtgttccctggtgggaagtgttgaccttttgggacagcggtg

SEQ ID NO: 443906 - DNA, 140 bp, Artificial Sequence
  Synthetic
caccgctgtcccaaaaggtcaacacttcccaccagggaacactctagaatgaagggatttgtcatatgggtccaaatcagccacacttggagatatgatgataagagactctttggtggtcatatcagcagccagggcct

SEQ ID NO: 443907 - DNA, 140 bp, Artificial Sequence
  Synthetic
atacgccatgctgggtctcccaatagcaaagggaaaaaggcatctaaagggggcaaggtttgcggattcgtggatgaaaggggcttgtataagtctctaaagggagcatgtaaactcaagcgtacttgggagtcggccat

SEQ ID NO: 443908 - DNA, 140 bp, Artificial Sequence
  Synthetic
atggccgactcccaagtacgcttgagtttacatgctccctttagagacttatacaagcccctttcatccacgaatccgcaaaccttgccccctttagatgcctttttccctttgctattgggagacccagcatggcgtat

SEQ ID NO: 443909 - DNA, 140 bp, Artificial Sequence
  Synthetic
aggccctggctgctgatatggaaagtagatttgggttctctgaaagtgggtgggactgctgcccagtcaatgatttctctttggttatatggtgcccactctgaatcaaacaggagccgggaccttttgggacagcggtg

SEQ ID NO: 443910 - DNA, 140 bp, Artificial Sequence
  Synthetic
caccgctgtcccaaaaggtcccggctcctgtttgattcagagtgggcaccatataaccaaagagaaatcattgactgggcagcagtcccacccactttcagagaacccaaatctactttccatatcagcagccagggcct

SEQ ID NO: 443911 - DNA, 140 bp, Artificial Sequence
  Synthetic
aggccctggctgctgatatgtttcatctgagctatacctccgattctctaaacgagggaagttttttagagatgccgagtacttgacctcctccacccttcgggaaatgagccttgtgttgaccttttgggacagcggtg

SEQ ID NO: 443912 - DNA, 140 bp, Artificial Sequence
  Synthetic
caccgctgtcccaaaaggtcaacacaaggctcatttcccgaagggtggaggaggtcaagtactcggcatctctaaaaaacttccctcgtttagagaatcggaggtatagctcagatgaaacatatcagcagccagggcct

SEQ ID NO: 443913 - DNA, 140 bp, Artificial Sequence
  Synthetic
aggccctggctgctgatatgcctacatggagcttaaggtgggatacatctcggccataaaagtaaacgggttcacgtgcacaggtgtggtgacagaggcagagacttacactaactttgtgaccttttgggacagcggtg

SEQ ID NO: 443914 - DNA, 140 bp, Artificial Sequence
  Synthetic
caccgctgtcccaaaaggtcacaaagttagtgtaagtctctgcctctgtcaccacacctgtgcacgtgaacccgtttacttttatggccgagatgtatcccaccttaagctccatgtaggcatatcagcagccagggcct

SEQ ID NO: 443915 - DNA, 140 bp, Artificial Sequence
  Synthetic
atacgccatgctgggtctcccaatcgtccttacttcaacaacatatggagctgttggagtcctctgtaatccctttgatgcatcccttggcagacccatcaacagtattcaaggacggagcgtacttgggagtcggccat

SEQ ID NO: 443916 - DNA, 140 bp, Artificial Sequence
  Synthetic
atggccgactcccaagtacgctccgtccttgaatactgttgatgggtctgccaagggatgcatcaaagggattacagaggactccaacagctccatatgttgttgaagtaaggacgattgggagacccagcatggcgtat

SEQ ID NO: 443917 - DNA, 140 bp, Artificial Sequence
  Synthetic
aggccctggctgctgatatgcccttctttgtacataatgctcagagagccctctcttagaggagagatattttctatcccccaaaaggttcccgctgcttacccgaccacaatgaaagaagaccttttgggacagcggtg

SEQ ID NO: 443918 - DNA, 140 bp, Artificial Sequence
  Synthetic
caccgctgtcccaaaaggtcttctttcattgtggtcgggtaagcagcgggaaccttttgggggatagaaaatatctctcctctaagagagggctctctgagcattatgtacaaagaagggcatatcagcagccagggcct

SEQ ID NO: 443919 - DNA, 140 bp, Artificial Sequence
  Synthetic
atacgccatgctgggtctcccgctggggatcaggtcttgtccacgtgtggaaactccggctatgaagtcattaaagtattggagccatatgtcgtgaacagtttggtccagagagcagaacgtacttgggagtcggccat

SEQ ID NO: 443920 - DNA, 140 bp, Artificial Sequence
  Synthetic
atggccgactcccaagtacgttctgctctctggaccaaactgttcacgacatatggctccaatactttaatgacttcatagccggagtttccacacgtggacaagacctgatccccagcgggagacccagcatggcgtat

SEQ ID NO: 443921 - DNA, 140 bp, Artificial Sequence
  Synthetic
atacgccatgctgggtctcctcaggaaagaaggtatcggtaactccccagaccagaaaggttgtatcttcatgggagttgtacaagagtgaaggcgatgccaggctgtgagggcaggccacgtacttgggagtcggccat

SEQ ID NO: 443922 - DNA, 140 bp, Artificial Sequence
  Synthetic
atggccgactcccaagtacgtggcctgccctcacagcctggcatcgccttcactcttgtacaactcccatgaagatacaacctttctggtctggggagttaccgataccttctttcctgaggagacccagcatggcgtat

SEQ ID NO: 443923 - DNA, 140 bp, Artificial Sequence
  Synthetic
aggccctggctgctgatatgtttttagggttctggatcagctcgacaacatacatgatttggtttttgtgtatggctgttacaggcattgggggcacccctatatagattatcgaaaggggaccttttgggacagcggtg

SEQ ID NO: 443924 - DNA, 140 bp, Artificial Sequence
  Synthetic
caccgctgtcccaaaaggtcccctttcgataatctatataggggtgcccccaatgcctgtaacagccatacacaaaaaccaaatcatgtatgttgtcgagctgatccagaaccctaaaaacatatcagcagccagggcct

SEQ ID NO: 443925 - DNA, 140 bp, Artificial Sequence
  Synthetic
atacgccatgctgggtctccggtctgtcgaaactctatgatcaagttcatatcaagaaagtgatagataagtcctaccaggagtgtttagcaagcgacctcgccaggaggatcctcagatcgtacttgggagtcggccat

SEQ ID NO: 443926 - DNA, 140 bp, Artificial Sequence
  Synthetic
atggccgactcccaagtacgatctgaggatcctcctggcgaggtcgcttgctaaacactcctggtaggacttatctatcactttcttgatatgaacttgatcatagagtttcgacagaccggagacccagcatggcgtat

SEQ ID NO: 443927 - DNA, 140 bp, Artificial Sequence
  Synthetic
atacgccatgctgggtctcctctttgcgcaggacaaggtgggtggatcaagaagtgcgccatgctgcaagaactatgacagggagttacagcccccacaggagggtgtcacgcaaagcggcgtacttgggagtcggccat

SEQ ID NO: 443928 - DNA, 140 bp, Artificial Sequence
  Synthetic
atggccgactcccaagtacgccgctttgcgtgacaccctcctgtgggggctgtaactccctgtcatagttcttgcagcatggcgcacttcttgatccacccaccttgtcctgcgcaaagaggagacccagcatggcgtat

SEQ ID NO: 443929 - DNA, 140 bp, Artificial Sequence
  Synthetic
aggccctggctgctgatatgcctgttttcaaaaggactgggtcagccttgcataggttcaagtctgccagatacagtgaaggagggtattcctctgtttgccctaatctcctctctcatagaccttttgggacagcggtg

SEQ ID NO: 443930 - DNA, 140 bp, Artificial Sequence
  Synthetic
caccgctgtcccaaaaggtctatgagagaggagattagggcaaacagaggaataccctccttcactgtatctggcagacttgaacctatgcaaggctgacccagtccttttgaaaacaggcatatcagcagccagggcct

SEQ ID NO: 443931 - DNA, 140 bp, Artificial Sequence
  Synthetic
atacgccatgctgggtctccttccactgcattgggccaagtagagattagttgagaaagacaatttacctcctatgaaggacacaaacaataggtcacaatcatcctacatcctgacaagcgtacttgggagtcggccat

SEQ ID NO: 443932 - DNA, 140 bp, Artificial Sequence
  Synthetic
atggccgactcccaagtacgcttgtcaggatgtaggatgattgtgacctattgtttgtgtccttcataggaggtaaattgtctttctcaactaatctctacttggcccaatgcagtggaaggagacccagcatggcgtat

SEQ ID NO: 443933 - DNA, 140 bp, Artificial Sequence
  Synthetic
atacgccatgctgggtctccgtaccatgatgattgatccgggggaggtttttgacgacaccatcgatccaatcgagtcggaggccgagtctagagggaacccaaccatccccaatatcttcgtacttgggagtcggccat

SEQ ID NO: 443934 - DNA, 140 bp, Artificial Sequence
  Synthetic
atggccgactcccaagtacgaagatattggggatggttgggttccctctagactcggcctccgactcgattggatcgatggtgtcgtcaaaaacctcccccggatcaatcatcatggtacggagacccagcatggcgtat

SEQ ID NO: 443935 - DNA, 140 bp, Artificial Sequence
  Synthetic
atacgccatgctgggtctccctgacagacaactgttccaggtcttacaaagtcttgaaagattatttcaagaaggtagacctaggatctatcaaagtgggtggaactgctgcacaatctacgtacttgggagtcggccat

SEQ ID NO: 443936 - DNA, 140 bp, Artificial Sequence
  Synthetic
atggccgactcccaagtacgtagattgtgcagcagttccacccactttgatagatcctaggtctaccttcttgaaataatctttcaagactttgtaagacctggaacagttgtctgtcagggagacccagcatggcgtat

SEQ ID NO: 443937 - DNA, 140 bp, Artificial Sequence
  Synthetic
aggccctggctgctgatatgtatgttacaaccacattcaaaagaaagcatttccgcccgacccccgatgcatgtagagccgcgtacaactggaagatggcaggtgacccaagatatgagggaccttttgggacagcggtg

SEQ ID NO: 443938 - DNA, 140 bp, Artificial Sequence
  Synthetic
caccgctgtcccaaaaggtccctcatatcttgggtcacctgccatcttccagttgtacgcggctctacatgcatcgggggtcgggcggaaatgctttcttttgaatgtggttgtaacatacatatcagcagccagggcct

SEQ ID NO: 443939 - DNA, 140 bp, Artificial Sequence
  Synthetic
atacgccatgctgggtctccgaagttattaaactacacgctcgagaatagagggctgagaatccctccagagggggtcttaggctgtcttgagagggtcgattacgataaagcatttgggcgtacttgggagtcggccat

SEQ ID NO: 443940 - DNA, 140 bp, Artificial Sequence
  Synthetic
atggccgactcccaagtacgcccaaatgctttatcgtaatcgaccctctcaagacagcctaagaccccctctggagggattctcagccctctattctcgagcgtgtagtttaataacttcggagacccagcatggcgtat

SEQ ID NO: 443941 - DNA, 140 bp, Artificial Sequence
  Synthetic
aggccctggctgctgatatggtccaacggcccaacttgctggaatggccaggacggcgggctagagggcttacggcagaagggctggagtctagtcagcttattgatgatagatagagaagaccttttgggacagcggtg

SEQ ID NO: 443942 - DNA, 140 bp, Artificial Sequence
  Synthetic
caccgctgtcccaaaaggtcttctctatctatcatcaataagctgactagactccagcccttctgccgtaagccctctagcccgccgtcctggccattccagcaagttgggccgttggaccatatcagcagccagggcct

SEQ ID NO: 443943 - DNA, 140 bp, Artificial Sequence
  Synthetic
atacgccatgctgggtctcctgtggaaagacttagcatcaatcgatgttgggaaggacttggtcaagtttagagacaagatatggggattgctgattgtgaccaaagactttgtgtattccgtacttgggagtcggccat

SEQ ID NO: 443944 - DNA, 140 bp, Artificial Sequence
  Synthetic
atggccgactcccaagtacggaatacacaaagtctttggtcacaatcagcaatccccatatcttgtctctaaacttgaccaagtccttcccaacatcgattgatgctaagtctttccacaggagacccagcatggcgtat

SEQ ID NO: 443945 - DNA, 140 bp, Artificial Sequence
  Synthetic
atacgccatgctgggtctccaaaatcttgagacacttcaatatatgctgcagtaccatgatgtacttgtccactgccttaggggatgtgcccagctttgcgagacttcatgacctgtacacgtacttgggagtcggccat

SEQ ID NO: 443946 - DNA, 140 bp, Artificial Sequence
  Synthetic
atggccgactcccaagtacgtgtacaggtcatgaagtctcgcaaagctgggcacatcccctaaggcagtggacaagtacatcatggtactgcagcatatattgaagtgtctcaagattttggagacccagcatggcgtat

SEQ ID NO: 443947 - DNA, 140 bp, Artificial Sequence
  Synthetic
atacgccatgctgggtctccggattaagaaaatgagggatttttcattaatcatcttgactaatcggacatagtcatgtggatcctgataatgtataaagtatctcaacagcatcagcgacgtacttgggagtcggccat

SEQ ID NO: 443948 - DNA, 140 bp, Artificial Sequence
  Synthetic
atggccgactcccaagtacgtcgctgatgctgttgagatactttatacattatcaggatccacatgactatgtccgattagtcaagatgattaatgaaaaatccctcattttcttaatccggagacccagcatggcgtat

SEQ ID NO: 443949 - DNA, 140 bp, Artificial Sequence
  Synthetic
atacgccatgctgggtctccagataaggtgggtcaacttgagggaacatttggtcctagtgcaatgaggttctttaaggctttggatcaatttgacaatatacatgacttagtctttgtgcgtacttgggagtcggccat

SEQ ID NO: 443950 - DNA, 140 bp, Artificial Sequence
  Synthetic
atggccgactcccaagtacgcacaaagactaagtcatgtatattgtcaaattgatccaaagccttaaagaacctcattgcactaggaccaaatgttccctcaagttgacccaccttatctggagacccagcatggcgtat

SEQ ID NO: 443951 - DNA, 140 bp, Artificial Sequence
  Synthetic
atacgccatgctgggtctccaaatagtaaagaccaccagacttgttggaagcatagaagacctgtccggggaaatagagaagcatcttcgaggttataacaggtggatcacccttgatgacgtacttgggagtcggccat

SEQ ID NO: 443952 - DNA, 140 bp, Artificial Sequence
  Synthetic
atggccgactcccaagtacgtcatcaagggtgatccacctgttataacctcgaagatgcttctctatttccccggacaggtcttctatgcttccaacaagtctggtggtctttactatttggagacccagcatggcgtat

SEQ ID NO: 443953 - DNA, 140 bp, Artificial Sequence
  Synthetic
atacgccatgctgggtctcccctatcaagaatgcttggcaagtgacttggccagaagaatcctcaggtggggatttgataagtactccaaatggtatcttgattcgcgacttctttcaagcgtacttgggagtcggccat

SEQ ID NO: 443954 - DNA, 140 bp, Artificial Sequence
  Synthetic
atggccgactcccaagtacgcttgaaagaagtcgcgaatcaagataccatttggagtacttatcaaatccccacctgaggattcttctggccaagtcacttgccaagcattcttgataggggagacccagcatggcgtat

SEQ ID NO: 443955 - DNA, 140 bp, Artificial Sequence
  Synthetic
atacgccatgctgggtctccggaccaccccttgactccttatatcaaaacccagacatggcctcccaaacatatagtagatttggtgggtgatacttggcacaagctcccgatcactcaacgtacttgggagtcggccat

SEQ ID NO: 443956 - DNA, 140 bp, Artificial Sequence
  Synthetic
atggccgactcccaagtacgttgagtgatcgggagcttgtgccaagtatcacccaccaaatctactatatgtttgggaggccatgtctgggttttgatataaggagtcaaggggtggtccggagacccagcatggcgtat

SEQ ID NO: 443957 - DNA, 140 bp, Artificial Sequence
  Synthetic
atacgccatgctgggtctccgaggagggccggtccccagtgaaaaggtcattattacggccctttctaaaccccctgttaatcccagagaattcctaaaatccatagacctgggaggattcgtacttgggagtcggccat

SEQ ID NO: 443958 - DNA, 140 bp, Artificial Sequence
  Synthetic
atggccgactcccaagtacgaatcctcccaggtctatggattttaggaattctctgggattaacagggggtttagaaagggccgtaataatgaccttttcactggggaccggccctcctcggagacccagcatggcgtat

SEQ ID NO: 443959 - DNA, 140 bp, Artificial Sequence
  Synthetic
aggccctggctgctgatatgagtccggaggcagtctacactcgaatcatgatgaatggaggtagactgaaaagatcacacataaggaggtatgtctcagtcagctccaatcatcaagctcgaccttttgggacagcggtg

SEQ ID NO: 443960 - DNA, 140 bp, Artificial Sequence
  Synthetic
caccgctgtcccaaaaggtcgagcttgatgattggagctgactgagacatacctccttatgtgtgatcttttcagtctacctccattcatcatgattcgagtgtagactgcctccggactcatatcagcagccagggcct

SEQ ID NO: 443961 - DNA, 140 bp, Artificial Sequence
  Synthetic
atacgccatgctgggtctccgtttggaaaagcatacaccatattcaacaagaccttgatggaggctgatgctcactacaagtcggtccgaacttggaatgagatcatcccctcaaaagggcgtacttgggagtcggccat

SEQ ID NO: 443962 - DNA, 140 bp, Artificial Sequence
  Synthetic
atggccgactcccaagtacgcccttttgaggggatgatctcattccaagttcggaccgacttgtagtgagcatcagcctccatcaaggtcttgttgaatatggtgtatgcttttccaaacggagacccagcatggcgtat

SEQ ID NO: 443963 - DNA, 140 bp, Artificial Sequence
  Synthetic
aggccctggctgctgatatgccagacacctcaaagggtcgggagggtgtggccttgctcttcagagagggcagatctacttagggagatctcttggggaagaaaagtggtaggcacgacagaccttttgggacagcggtg

SEQ ID NO: 443964 - DNA, 140 bp, Artificial Sequence
  Synthetic
caccgctgtcccaaaaggtctgtcgtgcctaccacttttcttccccaagagatctccctaagtagatctgccctctctgaagagcaaggccacaccctcccgaccctttgaggtgtctggcatatcagcagccagggcct

SEQ ID NO: 443965 - DNA, 140 bp, Artificial Sequence
  Synthetic
atacgccatgctgggtctcctttgtcatcacagagaaactcctcgcgaattatatcttgccactttttgacgcattgactatgacagacaacttgaataaggtgtttaaaaagttgatcgcgtacttgggagtcggccat

SEQ ID NO: 443966 - DNA, 140 bp, Artificial Sequence
  Synthetic
atggccgactcccaagtacgcgatcaactttttaaacaccttattcaagttgtctgtcatagtcaatgcgtcaaaaagtggcaagatataattcgcgaggagtttctctgtgatgacaaaggagacccagcatggcgtat

SEQ ID NO: 443967 - DNA, 140 bp, Artificial Sequence
  Synthetic
atacgccatgctgggtctccacagagtcaccggacaggggcttttggactattcaagggtcacatacgcctttcacctggactatgagaaatggaataatcatcagcggttggaatcgaccgtacttgggagtcggccat

SEQ ID NO: 443968 - DNA, 140 bp, Artificial Sequence
  Synthetic
atggccgactcccaagtacggtcgattccaaccgctgatgattattccatttctcatagtccaggtgaaaggcgtatgtgacccttgaatagtccaaaagcccctgtccggtgactctgtggagacccagcatggcgtat

SEQ ID NO: 443969 - DNA, 140 bp, Artificial Sequence
  Synthetic
aggccctggctgctgatatgggtctccggggccgtgcctcactttcagaagctccctgacatccgtctcagaccaggtgattttgaatctctaagtggtagagaaaagtctcgccatatcgaccttttgggacagcggtg

SEQ ID NO: 443970 - DNA, 140 bp, Artificial Sequence
  Synthetic
caccgctgtcccaaaaggtcgatatggcgagacttttctctaccacttagagattcaaaatcacctggtctgagacggatgtcagggagcttctgaaagtgaggcacggccccggagacccatatcagcagccagggcct

SEQ ID NO: 443971 - DNA, 140 bp, Artificial Sequence
  Synthetic
aggccctggctgctgatatggtcaggcggtccaacatgttggaatggccaagatggcgggctagagggtttgagacaaaagggctggagtctggtcagtctgttaatgatagaccgtgaagaccttttgggacagcggtg

SEQ ID NO: 443972 - DNA, 140 bp, Artificial Sequence
  Synthetic
caccgctgtcccaaaaggtcttcacggtctatcattaacagactgaccagactccagcccttttgtctcaaaccctctagcccgccatcttggccattccaacatgttggaccgcctgaccatatcagcagccagggcct

SEQ ID NO: 443973 - DNA, 140 bp, Artificial Sequence
  Synthetic
atacgccatgctgggtctccatctctaatgaccaaatagtcaacctcgccaacataatgtcaacagtatctaccaacgccttgactgtagcacaacactctcaatctttgatcaagccgacgtacttgggagtcggccat

SEQ ID NO: 443974 - DNA, 140 bp, Artificial Sequence
  Synthetic
atggccgactcccaagtacgtcggcttgatcaaagattgagagtgttgtgctacagtcaaggcgttggtagatactgttgacattatgttggcgaggttgactatttggtcattagagatggagacccagcatggcgtat

SEQ ID NO: 443975 - DNA, 140 bp, Artificial Sequence
  Synthetic
aggccctggctgctgatatgatcagctcagggactcttatactcaatcttagtggcaattcatgactcaggatataatgatggaaccatcttccctgtcaacatttacggcaaagtctccgaccttttgggacagcggtg

SEQ ID NO: 443976 - DNA, 140 bp, Artificial Sequence
  Synthetic
caccgctgtcccaaaaggtcggagactttgccgtaaatgttgacagggaagatggttccatcattatatcctgagtcatgaattgccactaagattgagtataagagtccctgagctgatcatatcagcagccagggcct

SEQ ID NO: 443977 - DNA, 140 bp, Artificial Sequence
  Synthetic
atacgccatgctgggtctcctgacaactttcttctagctatgtctagaattatttatctagacccctctttgggaggagtatctggaatgtctctcggaagattccatatacgtcagttccgtacttgggagtcggccat

SEQ ID NO: 443978 - DNA, 140 bp, Artificial Sequence
  Synthetic
atggccgactcccaagtacggaactgacgtatatggaatcttccgagagacattccagatactcctcccaaagaggggtctagataaataattctagacatagctagaagaaagttgtcaggagacccagcatggcgtat

SEQ ID NO: 443979 - DNA, 140 bp, Artificial Sequence
  Synthetic
atacgccatgctgggtctccatctaggagagaggacactggagagttttactcgtctgctcgaagatcctaccactctgaacataagaggaggagccagtcccaccattcttctcaaggacgtacttgggagtcggccat

SEQ ID NO: 443980 - DNA, 140 bp, Artificial Sequence
  Synthetic
atggccgactcccaagtacgtccttgagaagaatggtgggactggctcctcctcttatgttcagagtggtaggatcttcgagcagacgagtaaaactctccagtgtcctctctcctagatggagacccagcatggcgtat

SEQ ID NO: 443981 - DNA, 140 bp, Artificial Sequence
  Synthetic
atacgccatgctgggtctccctcttcttaaagtccgttgaaccgttgtttcccagatttctcagtgaactattcagctcatcattcttggggattcctgagtcaattatcgggctaataccgtacttgggagtcggccat

SEQ ID NO: 443982 - DNA, 140 bp, Artificial Sequence
  Synthetic
atggccgactcccaagtacggtattagcccgataattgactcaggaatccccaagaatgatgagctgaatagttcactgagaaatctgggaaacaacggttcaacggactttaagaagagggagacccagcatggcgtat

SEQ ID NO: 443983 - DNA, 140 bp, Artificial Sequence
  Synthetic
atacgccatgctgggtctccgaccatgtgtagctatgactttctcatctatggaaaaacccctctgtttcgaggtaacattttggtgcctgagtccaaaagatgggctagagtctcctgtcgtacttgggagtcggccat

SEQ ID NO: 443984 - DNA, 140 bp, Artificial Sequence
  Synthetic
atggccgactcccaagtacgacaggagactctagcccatcttttggactcaggcaccaaaatgttacctcgaaacagaggggtttttccatagatgagaaagtcatagctacacatggtcggagacccagcatggcgtat

SEQ ID NO: 443985 - DNA, 140 bp, Artificial Sequence
  Synthetic
atacgccatgctgggtctccctgcccctgtggagtgacaggagggggaaatcctcgaatatcagtgtctgtgcttccgtcttttgatcagtcatttttctcgagaggccctctaaagggacgtacttgggagtcggccat

SEQ ID NO: 443986 - DNA, 140 bp, Artificial Sequence
  Synthetic
atggccgactcccaagtacgtccctttagagggcctctcgagaaaaatgactgatcaaaagacggaagcacagacactgatattcgaggatttccccctcctgtcactccacaggggcagggagacccagcatggcgtat

SEQ ID NO: 443987 - DNA, 140 bp, Artificial Sequence
  Synthetic
aggccctggctgctgatatgccaaagtggctatcattatagccattatgatagtcttttccaatagagtattcaacgtttccaaaccgttgactgaccctttgttctatccgccatctgagaccttttgggacagcggtg

SEQ ID NO: 443988 - DNA, 140 bp, Artificial Sequence
  Synthetic
caccgctgtcccaaaaggtctcagatggcggatagaacaaagggtcagtcaacggtttggaaacgttgaatactctattggaaaagactatcataatggctataatgatagccactttggcatatcagcagccagggcct

SEQ ID NO: 443989 - DNA, 140 bp, Artificial Sequence
  Synthetic
atacgccatgctgggtctccctataaactggttcattacaagaaattcaaatctggcccaaaccttagtccggaacataatgtccctgacaggtccagattttccgctggaagaggctcccgtacttgggagtcggccat

SEQ ID NO: 443990 - DNA, 140 bp, Artificial Sequence
  Synthetic
atggccgactcccaagtacgggagcctcttccagcggaaaatctggacctgtcagggacattatgttccggactaaggtttgggccagatttgaatttcttgtaatgaaccagtttatagggagacccagcatggcgtat

SEQ ID NO: 443991 - DNA, 140 bp, Artificial Sequence
  Synthetic
atacgccatgctgggtctcctggggggagtatccggaatgtctctaggaaggttccacatacgtcagttctcagatcccgtctccgaagggttatctttctggagagaaatctggctgagcgtacttgggagtcggccat

SEQ ID NO: 443992 - DNA, 140 bp, Artificial Sequence
  Synthetic
atggccgactcccaagtacgctcagccagatttctctccagaaagataacccttcggagacgggatctgagaactgacgtatgtggaaccttcctagagacattccggatactccccccaggagacccagcatggcgtat

SEQ ID NO: 443993 - DNA, 140 bp, Artificial Sequence
  Synthetic
atacgccatgctgggtctcctctgtcagtacagacacaatgtctgacttgactcatgatgggcgaaactatgactttatgttccaaccactgatgctttatgcacagacatggacgtcagcgtacttgggagtcggccat

SEQ ID NO: 443994 - DNA, 140 bp, Artificial Sequence
  Synthetic
atggccgactcccaagtacgctgacgtccatgtctgtgcataaagcatcagtggttggaacataaagtcatagtttcgcccatcatgagtcaagtcagacattgtgtctgtactgacagaggagacccagcatggcgtat

SEQ ID NO: 443995 - DNA, 140 bp, Artificial Sequence
  Synthetic
atacgccatgctgggtctccttctcaggtttttgatttcccggacgtatcaagaagaatttctagaatggtttctggagccgtgcctcatttcagaaaactccctgacatccgtttgaaacgtacttgggagtcggccat

SEQ ID NO: 443996 - DNA, 140 bp, Artificial Sequence
  Synthetic
atggccgactcccaagtacgtttcaaacggatgtcagggagttttctgaaatgaggcacggctccagaaaccattctagaaattcttcttgatacgtccgggaaatcaaaaacctgagaaggagacccagcatggcgtat

SEQ ID NO: 443997 - DNA, 140 bp, Artificial Sequence
  Synthetic
aggccctggctgctgatatgtttctggagccgtgcctcatttcagaaaactccctgacatccgtttgaaaccgggcgactttgaatctctaagcgaaaaggaaaaatctcgccatatagggaccttttgggacagcggtg

SEQ ID NO: 443998 - DNA, 140 bp, Artificial Sequence
  Synthetic
caccgctgtcccaaaaggtccctatatggcgagatttttccttttcgcttagagattcaaagtcgcccggtttcaaacggatgtcagggagttttctgaaatgaggcacggctccagaaacatatcagcagccagggcct

SEQ ID NO: 443999 - DNA, 140 bp, Artificial Sequence
  Synthetic
aggccctggctgctgatatgaaaactgtagatcaaaagagcaactggcaacacttctcatcctgaagcccacatcaagatgctggatccaggagaagtctatgatgaccccattgatccagaccttttgggacagcggtg

SEQ ID NO: 444000 - DNA, 140 bp, Artificial Sequence
  Synthetic
caccgctgtcccaaaaggtctggatcaatggggtcatcatagacttctcctggatccagcatcttgatgtgggcttcaggatgagaagtgttgccagttgctcttttgatctacagttttcatatcagcagccagggcct

SEQ ID NO: 444001 - DNA, 140 bp, Artificial Sequence
  Synthetic
atacgccatgctgggtctccctctattccccagaaggttcctgcagcttacccgaccacaatgagggaaggtaacagatctattctgtgttacctccaacacgtgctgcgctatgaacgacgtacttgggagtcggccat

SEQ ID NO: 444002 - DNA, 140 bp, Artificial Sequence
  Synthetic
atggccgactcccaagtacgtcgttcatagcgcagcacgtgttggaggtaacacagaatagatctgttaccttccctcattgtggtcgggtaagctgcaggaaccttctggggaatagagggagacccagcatggcgtat

SEQ ID NO: 444003 - DNA, 140 bp, Artificial Sequence
  Synthetic
atacgccatgctgggtctccctttagaagctctaagatgacgtatttgactcttatcacttaccagtctcatcttttacttcagaaagttgagaaaaatctctccaaaagtatgagagcccgtacttgggagtcggccat

SEQ ID NO: 444004 - DNA, 140 bp, Artificial Sequence
  Synthetic
atggccgactcccaagtacgggctctcatacttttggagagatttttctcaactttctgaagtaaaagatgagactggtaagtgataagagtcaaatacgtcatcttagagcttctaaagggagacccagcatggcgtat

SEQ ID NO: 444005 - DNA, 140 bp, Artificial Sequence
  Synthetic
aggccctggctgctgatatgagactcttgtgcgatgtatcttgaaaaaaacaagatcttgaatccgaacctctggctgtttgattgttttttccatctttattgtttttttgttaagcgtgaccttttgggacagcggtg

SEQ ID NO: 444006 - DNA, 140 bp, Artificial Sequence
  Synthetic
caccgctgtcccaaaaggtcacgcttaacaaaaaaacaataaagatggaaaaaacaatcaaacagccagaggttcggattcaagatcttgtttttttcaagatacatcgcacaagagtctcatatcagcagccagggcct

SEQ ID NO: 444007 - DNA, 140 bp, Artificial Sequence
  Synthetic
atacgccatgctgggtctccgtgttcagaatggatttgctctgctcagcaggtagcggtttcgacctcggcgaacccggcccctgcttccgagctggacatcaggaccctctctagaagacgtacttgggagtcggccat

SEQ ID NO: 444008 - DNA, 140 bp, Artificial Sequence
  Synthetic
atggccgactcccaagtacgtcttctagagagggtcctgatgtccagctcggaagcaggggccgggttcgccgaggtcgaaaccgctacctgctgagcagagcaaatccattctgaacacggagacccagcatggcgtat

SEQ ID NO: 444009 - DNA, 140 bp, Artificial Sequence
  Synthetic
aggccctggctgctgatatgcgaacccggcccctgcttccgagctggacatcaggaccctctctagaagacttcagaacccattgatctcaggcctgagagtggttcagtgggcgacagggaccttttgggacagcggtg

SEQ ID NO: 444010 - DNA, 140 bp, Artificial Sequence
  Synthetic
caccgctgtcccaaaaggtccctgtcgcccactgaaccactctcaggcctgagatcaatgggttctgaagtcttctagagagggtcctgatgtccagctcggaagcaggggccgggttcgcatatcagcagccagggcct

SEQ ID NO: 444011 - DNA, 140 bp, Artificial Sequence
  Synthetic
atacgccatgctgggtctccgaaaagcccctgacttgaacaaagcatacaaatcagttttatccggcatgaatgcagccaagctagaccctggagacgtgtgctcttatctggctgccgccgtacttgggagtcggccat

SEQ ID NO: 444012 - DNA, 140 bp, Artificial Sequence
  Synthetic
atggccgactcccaagtacggcggcagccagataagagcacacgtctccagggtctagcttggctgcattcatgccggataaaactgatttgtatgctttgttcaagtcaggggcttttcggagacccagcatggcgtat

SEQ ID NO: 444013 - DNA, 140 bp, Artificial Sequence
  Synthetic
atacgccatgctgggtctccataagacgtactaatgtggaaggaaattgggctctgacagggggcatggagttgacgagggaccccacggtttcagagcatgcatctttggtcggtcttccgtacttgggagtcggccat

SEQ ID NO: 444014 - DNA, 140 bp, Artificial Sequence
  Synthetic
atggccgactcccaagtacggaagaccgaccaaagatgcatgctctgaaaccgtggggtccctcgtcaactccatgccccctgtcagagcccaatttccttccacattagtacgtcttatggagacccagcatggcgtat

SEQ ID NO: 444015 - DNA, 140 bp, Artificial Sequence
  Synthetic
aggccctggctgctgatatgttttagaagttccaaaatgacatatctaaccctcatcacataccagtctcacctcttacttcagagagttgagaagaatctctccaaaaacatgagagcagaccttttgggacagcggtg

SEQ ID NO: 444016 - DNA, 140 bp, Artificial Sequence
  Synthetic
caccgctgtcccaaaaggtctgctctcatgtttttggagagattcttctcaactctctgaagtaagaggtgagactggtatgtgatgagggttagatatgtcattttggaacttctaaaacatatcagcagccagggcct

SEQ ID NO: 444017 - DNA, 140 bp, Artificial Sequence
  Synthetic
atacgccatgctgggtctccatcagtccaagagcaggtaaatatgtcttatgacctcatcatttgtgatgcagaggtcactgacattgcatcgatcaaccgaataaccttgctgatgtctcgtacttgggagtcggccat

SEQ ID NO: 444018 - DNA, 140 bp, Artificial Sequence
  Synthetic
atggccgactcccaagtacgagacatcagcaaggttattcggttgatcgatgcaatgtcagtgacctctgcatcacaaatgatgaggtcataagacatatttacctgctcttggactgatggagacccagcatggcgtat

SEQ ID NO: 444019 - DNA, 140 bp, Artificial Sequence
  Synthetic
atacgccatgctgggtctccgttttatttttgtttttgtatgatttttatgaagatatgatttttttgttttggggagtgattgatatttttttttttgtttttttgagattgtgttgtgcgtacttgggagtcggccat

SEQ ID NO: 444020 - DNA, 140 bp, Artificial Sequence
  Synthetic
atggccgactcccaagtacgcacaacacaatctcaaaaaaacaaaaaaaaaaatatcaatcactccccaaaacaaaaaaatcatatcttcataaaaatcatacaaaaacaaaaataaaacggagacccagcatggcgtat

SEQ ID NO: 444021 - DNA, 140 bp, Artificial Sequence
  Synthetic
atacgccatgctgggtctccgagcgtttcctgcagtcaccgggtttataactcaaatgacctcatctttttcatctgagctgtacctcagattctccaaacggggaaagttcttccgagacgtacttgggagtcggccat

SEQ ID NO: 444022 - DNA, 140 bp, Artificial Sequence
  Synthetic
atggccgactcccaagtacgtctcggaagaactttccccgtttggagaatctgaggtacagctcagatgaaaaagatgaggtcatttgagttataaacccggtgactgcaggaaacgctcggagacccagcatggcgtat

SEQ ID NO: 444023 - DNA, 140 bp, Artificial Sequence
  Synthetic
atacgccatgctgggtctccagagactgcagttcctcattcctatttcatccattttcgttccttgggcttgagcgggaaatctccgtactcatcaaatgcagttggccacgttttcaaccgtacttgggagtcggccat

SEQ ID NO: 444024 - DNA, 140 bp, Artificial Sequence
  Synthetic
atggccgactcccaagtacggttgaaaacgtggccaactgcatttgatgagtacggagatttcccgctcaagcccaaggaacgaaaatggatgaaataggaatgaggaactgcagtctctggagacccagcatggcgtat

SEQ ID NO: 444025 - DNA, 140 bp, Artificial Sequence
  Synthetic
atacgccatgctgggtctcctccacaagatggtagatgatctagaattacagcggggaactttgtctaaagtttctattattatagccatcatgatagtcttctccaatagggtattcaacgtacttgggagtcggccat

SEQ ID NO: 444026 - DNA, 140 bp, Artificial Sequence
  Synthetic
atggccgactcccaagtacgttgaataccctattggagaagactatcatgatggctataataatagaaactttagacaaagttccccgctgtaattctagatcatctaccatcttgtggaggagacccagcatggcgtat

SEQ ID NO: 444027 - DNA, 140 bp, Artificial Sequence
  Synthetic
atacgccatgctgggtctccatttgggggaggagttctttggaaaagggacttttgagagaagattcttcagggacgagaaggagcttcaggaatatgaggcagctgaattgacaaagaccgtacttgggagtcggccat

SEQ ID NO: 444028 - DNA, 140 bp, Artificial Sequence
  Synthetic
atggccgactcccaagtacggtctttgtcaattcagctgcctcatattcctgaagctccttctcgtccctgaagaatcttctctcaaaagtcccttttccaaagaactcctcccccaaatggagacccagcatggcgtat

SEQ ID NO: 444029 - DNA, 140 bp, Artificial Sequence
  Synthetic
atacgccatgctgggtctccatgaatggaggtagactaaaaagatcacacataagaaggtatgtctcagtcagctccaatcatcaagctcgccccaattcgttcgctgagtttttaaacacgtacttgggagtcggccat

SEQ ID NO: 444030 - DNA, 140 bp, Artificial Sequence
  Synthetic
atggccgactcccaagtacgtgtttaaaaactcagcgaacgaattggggcgagcttgatgattggagctgactgagacataccttcttatgtgtgatctttttagtctacctccattcatggagacccagcatggcgtat

SEQ ID NO: 444031 - DNA, 140 bp, Artificial Sequence
  Synthetic
atacgccatgctgggtctcctgcaactctagcttgagtctttcatctcactggatcagactgatctacaaaatagtaaagaccaccagacttagaggaagtatagaggatctatctaaggcgtacttgggagtcggccat

SEQ ID NO: 444032 - DNA, 140 bp, Artificial Sequence
  Synthetic
atggccgactcccaagtacgccttagatagatcctctatacttcctctaagtctggtggtctttactattttgtagatcagtctgatccagtgagatgaaagactcaagctagagttgcaggagacccagcatggcgtat

SEQ ID NO: 444033 - DNA, 140 bp, Artificial Sequence
  Synthetic
atacgccatgctgggtctcccaacaagatatgtatgtctctcatgaaaaaaactaacacccctccttttgaaccatctcagacatgagcaagatttttgtcaacccaagtgcgatcagagcgtacttgggagtcggccat

SEQ ID NO: 444034 - DNA, 140 bp, Artificial Sequence
  Synthetic
atggccgactcccaagtacgctctgatcgcacttgggttgacaaaaatcttgctcatgtctgagatggttcaaaaggaggggtgttagtttttttcatgagagacatacatatcttgttgggagacccagcatggcgtat

SEQ ID NO: 444035 - DNA, 140 bp, Artificial Sequence
  Synthetic
atacgccatgctgggtctcccccctgagagaacatacaaactgatactcttaaacggtgcaccctgaaaaaaacaggatcaaaattctgaacctctgtcggcttgattatttttccatctcgtacttgggagtcggccat

SEQ ID NO: 444036 - DNA, 140 bp, Artificial Sequence
  Synthetic
atggccgactcccaagtacgagatggaaaaataatcaagccgacagaggttcagaattttgatcctgtttttttcagggtgcaccgtttaagagtatcagtttgtatgttctctcaggggggagacccagcatggcgtat

SEQ ID NO: 444037 - DNA, 140 bp, Artificial Sequence
  Synthetic
aggccctggctgctgatatgggacaatcttcccgaagacatgagacggcttcaattagatgatgaaaaaccatctgacctcggcggcaaagccaaggttggggagaggaagtgtcaggaagaccttttgggacagcggtg

SEQ ID NO: 444038 - DNA, 140 bp, Artificial Sequence
  Synthetic
caccgctgtcccaaaaggtcttcctgacacttcctctccccaaccttggctttgccgccgaggtcagatggtttttcatcatctaattgaagccgtctcatgtcttcgggaagattgtcccatatcagcagccagggcct

SEQ ID NO: 444039 - DNA, 140 bp, Artificial Sequence
  Synthetic
atacgccatgctgggtctccgattcttgaagatatggtctcagactgttgaggagatcatatcctatgtcacagtcaactttcccagtatgccgaggaaatcctcagaggagaaagctaccgtacttgggagtcggccat

SEQ ID NO: 444040 - DNA, 140 bp, Artificial Sequence
  Synthetic
atggccgactcccaagtacggtagctttctcctctgaggatttcctcggcatactgggaaagttgactgtgacataggatatgatctcctcaacagtctgagaccatatcttcaagaatcggagacccagcatggcgtat

SEQ ID NO: 444041 - DNA, 140 bp, Artificial Sequence
  Synthetic
aggccctggctgctgatatgaatgctgctaagcttgatcctgatgatgtgtgttcttacttagcagccgcaatgcaattttttgagggaacatgccctgaggactggaccagttatggaagaccttttgggacagcggtg

SEQ ID NO: 444042 - DNA, 140 bp, Artificial Sequence
  Synthetic
caccgctgtcccaaaaggtcttccataactggtccagtcctcagggcatgttccctcaaaaaattgcattgcggctgctaagtaagaacacacatcatcaggatcaagcttagcagcattcatatcagcagccagggcct

SEQ ID NO: 444043 - DNA, 140 bp, Artificial Sequence
  Synthetic
atacgccatgctgggtctccctcctgtgaaaatatacagaccgatattcttgaagggtgtaccctgaaaaaaacgagacactgattcattacctctatttgcttgattatttctccttttcgtacttgggagtcggccat

SEQ ID NO: 444044 - DNA, 140 bp, Artificial Sequence
  Synthetic
atggccgactcccaagtacgaaaaggagaaataatcaagcaaatagaggtaatgaatcagtgtctcgtttttttcagggtacacccttcaagaatatcggtctgtatattttcacaggagggagacccagcatggcgtat

SEQ ID NO: 444045 - DNA, 140 bp, Artificial Sequence
  Synthetic
atacgccatgctgggtctccggtcctcctgctctcgagtggtctgtcgccaacgaagaggatgacccatctgtggaggctgaaatcgctcaccagattgctgagagcttttccaagaagtcgtacttgggagtcggccat

SEQ ID NO: 444046 - DNA, 140 bp, Artificial Sequence
  Synthetic
atggccgactcccaagtacgacttcttggaaaagctctcagcaatctggtgagcgatttcagcctccacagatgggtcatcctcttcgttggcgacagaccactcgagagcaggaggaccggagacccagcatggcgtat

SEQ ID NO: 444047 - DNA, 140 bp, Artificial Sequence
  Synthetic
atacgccatgctgggtctcccgtgactcgcttggcccatgacggatccaaactccctctgagatgtgtgctggggtgggttgccctagccaactccaaaaagttccagctgttggttgagcgtacttgggagtcggccat

SEQ ID NO: 444048 - DNA, 140 bp, Artificial Sequence
  Synthetic
atggccgactcccaagtacgctcaaccaacagctggaactttttggagttggctagggcaacccaccccagcacacatctcagagggagtttggatccgtcatgggccaagcgagtcacgggagacccagcatggcgtat

SEQ ID NO: 444049 - DNA, 140 bp, Artificial Sequence
  Synthetic
atacgccatgctgggtctccacagtcaacttctctggtgcgccggggaggtccgtaaaagacaaggctactcagactgtgggccgtgaactcgcgaaagagacaaagtctgcttcttctccgtacttgggagtcggccat

SEQ ID NO: 444050 - DNA, 140 bp, Artificial Sequence
  Synthetic
atggccgactcccaagtacggagaagaagcagactttgtctctttcgcgagttcacggcccacagtctgagtagccttgtcttttacggacctccccggcgcaccagagaagttgactgtggagacccagcatggcgtat

SEQ ID NO: 444051 - DNA, 140 bp, Artificial Sequence
  Synthetic
atacgccatgctgggtctcctgattcaaatccaccatgaaaaaaacaggcaacaccactgataagatgaactttctacgtaagatagtgaagaactgcagagatgaggacactcagaagccgtacttgggagtcggccat

SEQ ID NO: 444052 - DNA, 140 bp, Artificial Sequence
  Synthetic
atggccgactcccaagtacggcttctgagtgtcctcatctctgcagttcttcactatcttacgtagaaagttcatcttatcagtggtgttgcctgtttttttcatggtggatttgaatcaggagacccagcatggcgtat

SEQ ID NO: 444053 - DNA, 140 bp, Artificial Sequence
  Synthetic
aggccctggctgctgatatgtcttatcttccaatgggctgattctaggggtcctctcgagggggaggaattggagtactctcaagagatcacctgggatgacgatacggagtttgtcggagaccttttgggacagcggtg

SEQ ID NO: 444054 - DNA, 140 bp, Artificial Sequence
  Synthetic
caccgctgtcccaaaaggtctccgacaaactccgtatcgtcatcccaggtgatctcttgagagtactccaattcctccccctcgagaggacccctagaatcagcccattggaagataagacatatcagcagccagggcct

SEQ ID NO: 444055 - DNA, 140 bp, Artificial Sequence
  Synthetic
aggccctggctgctgatatgagagacgagaaagaacttcaagagtatgaggcggctgaattgacgaagactgatgtggcattggctgatgatgggaccgtcaattctgatgacgaggactgaccttttgggacagcggtg

SEQ ID NO: 444056 - DNA, 140 bp, Artificial Sequence
  Synthetic
caccgctgtcccaaaaggtcagtcctcgtcatcagaattgacggtcccatcatcagccaatgccacatcagtcttcgtcaattcagccgcctcatactcttgaagttctttctcgtctctcatatcagcagccagggcct

SEQ ID NO: 444057 - DNA, 140 bp, Artificial Sequence
  Synthetic
aggccctggctgctgatatgcagttccaaccatcaagcccgtccaaattcgttcgccgagtttctaaataagacgtattctagtgactcgtaaagagttgaacaaccagattgtgtatatgaccttttgggacagcggtg

SEQ ID NO: 444058 - DNA, 140 bp, Artificial Sequence
  Synthetic
caccgctgtcccaaaaggtcatatacacaatctggttgttcaactctttacgagtcactagaatacgtcttatttagaaactcggcgaacgaatttggacgggcttgatggttggaactgcatatcagcagccagggcct

SEQ ID NO: 444059 - DNA, 140 bp, Artificial Sequence
  Synthetic
atacgccatgctgggtctccatagtctaattgcatcataaaccttcctcaattgtttacctctggaggagagagcacaggggcttgactccagtcttcaggagcaatagaacaaaaatatcgtacttgggagtcggccat

SEQ ID NO: 444060 - DNA, 140 bp, Artificial Sequence
  Synthetic
atggccgactcccaagtacgatatttttgttctattgctcctgaagactggagtcaagcccctgtgctctctcctccagaggtaaacaattgaggaaggtttatgatgcaattagactatggagacccagcatggcgtat

SEQ ID NO: 444061 - DNA, 140 bp, Artificial Sequence
  Synthetic
aggccctggctgctgatatggaaatggctgaggagactgttgatctgatcaataggaacatagaagacaatcaggctcacctccagggagagcctatagaagtggacaatctccctgatggaccttttgggacagcggtg

SEQ ID NO: 444062 - DNA, 140 bp, Artificial Sequence
  Synthetic
caccgctgtcccaaaaggtccatcagggagattgtccacttctataggctctccctggaggtgagcctgattgtcttctatgttcctattgatcagatcaacagtctcctcagccatttccatatcagcagccagggcct

SEQ ID NO: 444063 - DNA, 140 bp, Artificial Sequence
  Synthetic
atacgccatgctgggtctccaaaaacctaaggaaagatgatccttcaggctcttctgtttgtgcctctcctgatttcttcattgtgtttcgggaagttccccatctacacgataccagaccgtacttgggagtcggccat

SEQ ID NO: 444064 - DNA, 140 bp, Artificial Sequence
  Synthetic
atggccgactcccaagtacggtctggtatcgtgtagatggggaacttcccgaaacacaatgaagaaatcaggagaggcacaaacagaagagcctgaaggatcatctttccttaggtttttggagacccagcatggcgtat

SEQ ID NO: 444065 - DNA, 140 bp, Artificial Sequence
  Synthetic
aggccctggctgctgatatggggggaggaccccggtctcttgttccagtcctacctggacaatgttggagtccaaatagtcagacaaatgagatcaggagagagattccttaagatctgggaccttttgggacagcggtg

SEQ ID NO: 444066 - DNA, 140 bp, Artificial Sequence
  Synthetic
caccgctgtcccaaaaggtcccagatcttaaggaatctctctcctgatctcatttgtctgactatttggactccaacattgtccaggtaggactggaacaagagaccggggtcctccccccatatcagcagccagggcct

SEQ ID NO: 444067 - DNA, 140 bp, Artificial Sequence
  Synthetic
atacgccatgctgggtctccacatggaattgaaggtgggatacatatctgccataaaagtgaacgggttcacctgtacaggtgttgtgacagaagctgagacctacaccaactttgttggcgtacttgggagtcggccat

SEQ ID NO: 444068 - DNA, 140 bp, Artificial Sequence
  Synthetic
atggccgactcccaagtacgccaacaaagttggtgtaggtctcagcttctgtcacaacacctgtacaggtgaacccgttcacttttatggcagatatgtatcccaccttcaattccatgtggagacccagcatggcgtat

SEQ ID NO: 444069 - DNA, 140 bp, Artificial Sequence
  Synthetic
aggccctggctgctgatatgaactcaagaaggagacaccgcctgcgtcttctcagagagaaagccaattttcgaaggctcgaatgatggctcaaactgcctctggtcctccagctctcgagaccttttgggacagcggtg

SEQ ID NO: 444070 - DNA, 140 bp, Artificial Sequence
  Synthetic
caccgctgtcccaaaaggtctcgagagctggaggaccagaggcagtttgagccatcattcgagccttcgaaaattggctttctctctgagaagacgcaggcggtgtctccttcttgagttcatatcagcagccagggcct

SEQ ID NO: 444071 - DNA, 140 bp, Artificial Sequence
  Synthetic
atacgccatgctgggtctccgagtctcttcaaaatccttatcccgattaccattggctacggactgtaaagaccaccaaggagtctcttatcatcatatctccaagtgtggctgatttggcgtacttgggagtcggccat

SEQ ID NO: 444072 - DNA, 140 bp, Artificial Sequence
  Synthetic
atggccgactcccaagtacgccaaatcagccacacttggagatatgatgataagagactccttggtggtctttacagtccgtagccaatggtaatcgggataaggattttgaagagactcggagacccagcatggcgtat

SEQ ID NO: 444073 - DNA, 140 bp, Artificial Sequence
  Synthetic
aggccctggctgctgatatgtcatcagggatattcttatacaactttgagcagttgaaaatgaaccttgatgacatagtcaaggagtcaaaaaatgtgcctggtgtgacccgtctggctcgaccttttgggacagcggtg

SEQ ID NO: 444074 - DNA, 140 bp, Artificial Sequence
  Synthetic
caccgctgtcccaaaaggtcgagccagacgggtcacaccaggcacattttttgactccttgactatgtcatcaaggttcattttcaactgctcaaagttgtataagaatatccctgatgacatatcagcagccagggcct

SEQ ID NO: 444075 - DNA, 140 bp, Artificial Sequence
  Synthetic
atacgccatgctgggtctcctgacatagtcaaggagtcaaaaaatgtgcctggtgtgacccgtctggctcatgacggatctaaaatccctctaagatgtgtcctggggtgggttgctctgcgtacttgggagtcggccat

SEQ ID NO: 444076 - DNA, 140 bp, Artificial Sequence
  Synthetic
atggccgactcccaagtacgcagagcaacccaccccaggacacatcttagagggattttagatccgtcatgagccagacgggtcacaccaggcacattttttgactccttgactatgtcaggagacccagcatggcgtat

SEQ ID NO: 444077 - DNA, 140 bp, Artificial Sequence
  Synthetic
atacgccatgctgggtctcccatctggatgcccgaagaagcgagactcgggacatcttgtgacatctttaccaacagcaaagggaagaaagcctctaaagggggcaggacttgcggattccgtacttgggagtcggccat

SEQ ID NO: 444078 - DNA, 140 bp, Artificial Sequence
  Synthetic
atggccgactcccaagtacggaatccgcaagtcctgccccctttagaggctttcttccctttgctgttggtaaagatgtcacaagatgtcccgagtctcgcttcttcgggcatccagatgggagacccagcatggcgtat

SEQ ID NO: 444079 - DNA, 140 bp, Artificial Sequence
  Synthetic
atacgccatgctgggtctcccactcaggctcactagacatttgagcctgagtcgttctgaactcgacatgaaaaaaacaggcaacaccactgataaaatgaactttctacgcaagatagtcgtacttgggagtcggccat

SEQ ID NO: 444080 - DNA, 140 bp, Artificial Sequence
  Synthetic
atggccgactcccaagtacgactatcttgcgtagaaagttcattttatcagtggtgttgcctgtttttttcatgtcgagttcagaacgactcaggctcaaatgtctagtgagcctgagtgggagacccagcatggcgtat

SEQ ID NO: 444081 - DNA, 140 bp, Artificial Sequence
  Synthetic
atacgccatgctgggtctccttcagacatcagatgagaccaaatggtgccctcctgatcaattggtgaatctacatgactttcactcagatgagatagagcatctcgtcgtggaggagttcgtacttgggagtcggccat

SEQ ID NO: 444082 - DNA, 140 bp, Artificial Sequence
  Synthetic
atggccgactcccaagtacgaactcctccacgacgagatgctctatctcatctgagtgaaagtcatgtagattcaccaattgatcaggagggcaccatttggtctcatctgatgtctgaaggagacccagcatggcgtat

SEQ ID NO: 444083 - DNA, 140 bp, Artificial Sequence
  Synthetic
aggccctggctgctgatatgaaagaactcactagcaaaaaaaacatgaggaacttttgtatcaatggagaggtcaaagtgtgcagtccgaacggctattcgttcaggatcctgcggcacagaccttttgggacagcggtg

SEQ ID NO: 444084 - DNA, 140 bp, Artificial Sequence
  Synthetic
caccgctgtcccaaaaggtctgtgccgcaggatcctgaacgaatagccgttcggactgcacactttgacctctccattgatacaaaagttcctcatgttttttttgctagtgagttctttcatatcagcagccagggcct

SEQ ID NO: 444085 - DNA, 140 bp, Artificial Sequence
  Synthetic
aggccctggctgctgatatgtgctcactacaagtcagttcgaacttggaacgagatcatcccctcaaaggggtgcttaaaagtcggagggaggtgtcatcctcatgtggacggagtatttgaccttttgggacagcggtg

SEQ ID NO: 444086 - DNA, 140 bp, Artificial Sequence
  Synthetic
caccgctgtcccaaaaggtcaaatactccgtccacatgaggatgacacctccctccgacttttaagcacccctttgaggggatgatctcgttccaagttcgaactgacttgtagtgagcacatatcagcagccagggcct

SEQ ID NO: 444087 - DNA, 140 bp, Artificial Sequence
  Synthetic
aggccctggctgctgatatggggcatgaactgggtgtacaaattgaggaggactcttatcttccaatgggccgactcaagaggccctcttgaaggggaggaattggaatactctcaagaagaccttttgggacagcggtg

SEQ ID NO: 444088 - DNA, 140 bp, Artificial Sequence
  Synthetic
caccgctgtcccaaaaggtcttcttgagagtattccaattcctccccttcaagagggcctcttgagtcggcccattggaagataagagtcctcctcaatttgtacacccagttcatgccccatatcagcagccagggcct

SEQ ID NO: 444089 - DNA, 140 bp, Artificial Sequence
  Synthetic
aggccctggctgctgatatgtccctctaatgcatcccttggcagacccatcaacagtcttcaaggacggtgatgaggcggaggattttgttgaagttcaccttccggatgttcacaagcagaccttttgggacagcggtg

SEQ ID NO: 444090 - DNA, 140 bp, Artificial Sequence
  Synthetic
caccgctgtcccaaaaggtctgcttgtgaacatccggaaggtgaacttcaacaaaatcctccgcctcatcaccgtccttgaagactgttgatgggtctgccaagggatgcattagagggacatatcagcagccagggcct

SEQ ID NO: 444091 - DNA, 140 bp, Artificial Sequence
  Synthetic
atacgccatgctgggtctcccttcgatgtaacaagtgtataaggcccattgacgatattaccctcgagacctctcaggtctttgatttcccggatgtttcgaaaagaatatctagaatggcgtacttgggagtcggccat

SEQ ID NO: 444092 - DNA, 140 bp, Artificial Sequence
  Synthetic
atggccgactcccaagtacgccattctagatattcttttcgaaacatccgggaaatcaaagacctgagaggtctcgagggtaatatcgtcaatgggccttatacacttgttacatcgaagggagacccagcatggcgtat

SEQ ID NO: 444093 - DNA, 140 bp, Artificial Sequence
  Synthetic
aggccctggctgctgatatgctagagcgtgtcagttgtggtccgacatgtctcttcagacacaaaggtcagaggaggacaaggactcttctctgcttctagaatagttaaattatctctcgaccttttgggacagcggtg

SEQ ID NO: 444094 - DNA, 140 bp, Artificial Sequence
  Synthetic
caccgctgtcccaaaaggtcgagagataatttaactattctagaagcagagaagagtccttgtcctcctctgacctttgtgtctgaagagacatgtcggaccacaactgacacgctctagcatatcagcagccagggcct

SEQ ID NO: 444095 - DNA, 140 bp, Artificial Sequence
  Synthetic
atacgccatgctgggtctcctgttgtagaagggccaagagaacagagtcaagacgacgaggttctggggagtcagaaaggaaagtgccagtacctccccaaaacgggaaagtcatatcttcgtacttgggagtcggccat

SEQ ID NO: 444096 - DNA, 140 bp, Artificial Sequence
  Synthetic
atggccgactcccaagtacgaagatatgactttcccgttttggggaggtactggcactttcctttctgactccccagaacctcgtcgtcttgactctgttctcttggcccttctacaacaggagacccagcatggcgtat

SEQ ID NO: 444097 - DNA, 140 bp, Artificial Sequence
  Synthetic
atacgccatgctgggtctcccgctgcattttatcaaaatcaaattaattacctttacattttaagcctcttggatgtgaaaaaaactattaacatccctcaaaagacttaaggaaagatgcgtacttgggagtcggccat

SEQ ID NO: 444098 - DNA, 140 bp, Artificial Sequence
  Synthetic
atggccgactcccaagtacgcatctttccttaagtcttttgagggatgttaatagtttttttcacatccaagaggcttaaaatgtaaaggtaattaatttgattttgataaaatgcagcgggagacccagcatggcgtat

SEQ ID NO: 444099 - DNA, 140 bp, Artificial Sequence
  Synthetic
atacgccatgctgggtctccggactctctcattttaacggtccttcatgaacttcatgtaacaggatgaacttaagagtcgagaaacgtccattaatcatctcaactgatcagacacagtcgtacttgggagtcggccat

SEQ ID NO: 444100 - DNA, 140 bp, Artificial Sequence
  Synthetic
atggccgactcccaagtacgactgtgtctgatcagttgagatgattaatggacgtttctcgactcttaagttcatcctgttacatgaagttcatgaaggaccgttaaaatgagagagtccggagacccagcatggcgtat

SEQ ID NO: 444101 - DNA, 140 bp, Artificial Sequence
  Synthetic
aggccctggctgctgatatgccattgacatacatcatctcagctgtccaaacaatttggttgtggaggatgaaggatgcaccaatctgtctggattttcctacatggaactcaaagtagggaccttttgggacagcggtg

SEQ ID NO: 444102 - DNA, 140 bp, Artificial Sequence
  Synthetic
caccgctgtcccaaaaggtccctactttgagttccatgtaggaaaatccagacagattggtgcatccttcatcctccacaaccaaattgtttggacagctgagatgatgtatgtcaatggcatatcagcagccagggcct

SEQ ID NO: 444103 - DNA, 140 bp, Artificial Sequence
  Synthetic
atacgccatgctgggtctccctgatctcccaaataactctatgattgagttttggtaaaggccatcgtaagttctatggcattagaccaaatcgagattagttgagagaagcgacttgcccgtacttgggagtcggccat

SEQ ID NO: 444104 - DNA, 140 bp, Artificial Sequence
  Synthetic
atggccgactcccaagtacgggcaagtcgcttctctcaactaatctcgatttggtctaatgccatagaacttacgatggcctttaccaaaactcaatcatagagttatttgggagatcagggagacccagcatggcgtat

SEQ ID NO: 444105 - DNA, 140 bp, Artificial Sequence
  Synthetic
aggccctggctgctgatatgaagagaaagcacttccgcccaacgccagatgcgtgcagagccgcatacaactggaagatggctggtgaccccaggtatgaggagtctctacacaatccgtgaccttttgggacagcggtg

SEQ ID NO: 444106 - DNA, 140 bp, Artificial Sequence
  Synthetic
caccgctgtcccaaaaggtcacggattgtgtagagactcctcatacctggggtcaccagccatcttccagttgtatgcggctctgcacgcatctggcgttgggcggaagtgctttctcttcatatcagcagccagggcct

SEQ ID NO: 444107 - DNA, 140 bp, Artificial Sequence
  Synthetic
aggccctggctgctgatatgtcactcgagagtttttcctagcggaaaatgctcaggaataacagtgtcctctacctactgctctactaaccacgactacaccatctggatgcctgagaatgaccttttgggacagcggtg

SEQ ID NO: 444108 - DNA, 140 bp, Artificial Sequence
  Synthetic
caccgctgtcccaaaaggtcattctcaggcatccagatggtgtagtcgtggttagtagagcagtaggtagaggacactgttattcctgagcattttccgctaggaaaaactctcgagtgacatatcagcagccagggcct

SEQ ID NO: 444109 - DNA, 140 bp, Artificial Sequence
  Synthetic
aggccctggctgctgatatgacaagtctctaaaaggggcatgcaaactaaaactatgtggggttcttgggcttagacttatggatggaacatgggtcgcaattcagacgtcagatgagacgaccttttgggacagcggtg

SEQ ID NO: 444110 - DNA, 140 bp, Artificial Sequence
  Synthetic
caccgctgtcccaaaaggtcgtctcatctgacgtctgaattgcgacccatgttccatccataagtctaagcccaagaaccccacatagttttagtttgcatgccccttttagagacttgtcatatcagcagccagggcct

SEQ ID NO: 444111 - DNA, 140 bp, Artificial Sequence
  Synthetic
atacgccatgctgggtctccgaagtgtataaccgacttggctcaattctactccaaatcctcccccgtagaaaaactgttaaactgcacactcggaaatagagggctgagaatccccccacgtacttgggagtcggccat

SEQ ID NO: 444112 - DNA, 140 bp, Artificial Sequence
  Synthetic
atggccgactcccaagtacgtggggggattctcagccctctatttccgagtgtgcagtttaacagtttttctacgggggaggatttggagtagaattgagccaagtcggttatacacttcggagacccagcatggcgtat

SEQ ID NO: 444113 - DNA, 140 bp, Artificial Sequence
  Synthetic
aggccctggctgctgatatgtgtctggatgcactggagtccatcatgaccacaaagtccgtgagttttagacgccttagtcacttgaggaagcttgtccctgggtttggaaaggcgtatagaccttttgggacagcggtg

SEQ ID NO: 444114 - DNA, 140 bp, Artificial Sequence
  Synthetic
caccgctgtcccaaaaggtctatacgcctttccaaacccagggacaagcttcctcaagtgactaaggcgtctaaaactcacggactttgtggtcatgatggactccagtgcatccagacacatatcagcagccagggcct

SEQ ID NO: 444115 - DNA, 140 bp, Artificial Sequence
  Synthetic
atacgccatgctgggtctccgcagacctcctaagagagatctcttgggggaggaaggtggtcggcacaacagtccctcacccttctgagatgctgtggttgcttcccaaatcctcgatttcgtacttgggagtcggccat

SEQ ID NO: 444116 - DNA, 140 bp, Artificial Sequence
  Synthetic
atggccgactcccaagtacgaaatcgaggatttgggaagcaaccacagcatctcagaagggtgagggactgttgtgccgaccaccttcctcccccaagagatctctcttaggaggtctgcggagacccagcatggcgtat

SEQ ID NO: 444117 - DNA, 140 bp, Artificial Sequence
  Synthetic
aggccctggctgctgatatgccctctacatgaacgccttggattgggatgaggagaagaccatcctagcgctgtggaaggatttaacatcaatcgatacggggaaggacttggtcaagttgaccttttgggacagcggtg

SEQ ID NO: 444118 - DNA, 140 bp, Artificial Sequence
  Synthetic
caccgctgtcccaaaaggtcaacttgaccaagtccttccccgtatcgattgatgttaaatccttccacagcgctaggatggtcttctcctcatcccaatccaaggcgttcatgtagagggcatatcagcagccagggcct

SEQ ID NO: 444119 - DNA, 140 bp, Artificial Sequence
  Synthetic
aggccctggctgctgatatggagatgtcatcctcatgtgaatggggtgttcttcaatggtatcatactgggtcctgacggacatgtcctgattccagagatgcaatcatccctcctccaggaccttttgggacagcggtg

SEQ ID NO: 444120 - DNA, 140 bp, Artificial Sequence
  Synthetic
caccgctgtcccaaaaggtcctggaggagggatgattgcatctctggaatcaggacatgtccgtcaggacccagtatgataccattgaagaacaccccattcacatgaggatgacatctccatatcagcagccagggcct

SEQ ID NO: 444121 - DNA, 140 bp, Artificial Sequence
  Synthetic
atacgccatgctgggtctccgtcctgacggacatgtcctgattccagagatgcaatcatccctcctccagcagcatatggagttgttggagtcctcagtcatcccattgatgcatcccttcgtacttgggagtcggccat

SEQ ID NO: 444122 - DNA, 140 bp, Artificial Sequence
  Synthetic
atggccgactcccaagtacgaagggatgcatcaatgggatgactgaggactccaacaactccatatgctgctggaggagggatgattgcatctctggaatcaggacatgtccgtcaggacggagacccagcatggcgtat

SEQ ID NO: 444123 - DNA, 140 bp, Artificial Sequence
  Synthetic
aggccctggctgctgatatggacctttttttgtctcggttcaactctctaatgattcttctttctcctccggaacccagatattcagatgacctgatatctcagctgtgtcagttatatagaccttttgggacagcggtg

SEQ ID NO: 444124 - DNA, 140 bp, Artificial Sequence
  Synthetic
caccgctgtcccaaaaggtctatataactgacacagctgagatatcaggtcatctgaatatctgggttccggaggagaaagaagaatcattagagagttgaaccgagacaaaaaaaggtccatatcagcagccagggcct

SEQ ID NO: 444125 - DNA, 140 bp, Artificial Sequence
  Synthetic
aggccctggctgctgatatgggtctcccaaactgggggaagtatgtgctaatgagcgcaggcgctctaactgcattgatgttgatgattttcttaatgacgtgttgcaggaagactgatagaccttttgggacagcggtg

SEQ ID NO: 444126 - DNA, 140 bp, Artificial Sequence
  Synthetic
caccgctgtcccaaaaggtctatcagtcttcctgcaacacgtcattaagaaaatcatcaacatcaatgcagttagagcgcctgcgctcattagcacatacttcccccagtttgggagacccatatcagcagccagggcct

SEQ ID NO: 444127 - DNA, 140 bp, Artificial Sequence
  Synthetic
atacgccatgctgggtctccaaaatttaggcctctcattcattccctaggagatttccctgcatttataagagataaggtgggtcaacttgagggaacatttggtcctagtgcaaaaaggcgtacttgggagtcggccat

SEQ ID NO: 444128 - DNA, 140 bp, Artificial Sequence
  Synthetic
atggccgactcccaagtacgcctttttgcactaggaccaaatgttccctcaagttgacccaccttatctcttataaatgcagggaaatctcctagggaatgaatgagaggcctaaattttggagacccagcatggcgtat

SEQ ID NO: 444129 - DNA, 140 bp, Artificial Sequence
  Synthetic
aggccctggctgctgatatggtaacttcccaaaacgggagggtcatagcttcatgggagtcatacaaaagcggaggtgaaaccaagctgtgagggcaagtcatctcttctatacttcgaggaccttttgggacagcggtg

SEQ ID NO: 444130 - DNA, 140 bp, Artificial Sequence
  Synthetic
caccgctgtcccaaaaggtcctcgaagtatagaagagatgacttgccctcacagcttggtttcacctccgcttttgtatgactcccatgaagctatgaccctcccgttttgggaagttaccatatcagcagccagggcct

SEQ ID NO: 444131 - DNA, 140 bp, Artificial Sequence
  Synthetic
atacgccatgctgggtctccggttgtcgaagctatatgatcaagtccacatcaagaaggtaatagataaatcttatcaggagtgtttggcaagcgacctggccagaaggatccttaggtgcgtacttgggagtcggccat

SEQ ID NO: 444132 - DNA, 140 bp, Artificial Sequence
  Synthetic
atggccgactcccaagtacgcacctaaggatccttctggccaggtcgcttgccaaacactcctgataagatttatctattaccttcttgatgtggacttgatcatatagcttcgacaaccggagacccagcatggcgtat

SEQ ID NO: 444133 - DNA, 140 bp, Artificial Sequence
  Synthetic
atacgccatgctgggtctcccttccattaatcatctcaaccgaccagacacggtcacgtagattcttataataagagaaatcttctagcagttccagtgactaacggtgcttttaccctccgtacttgggagtcggccat

SEQ ID NO: 444134 - DNA, 140 bp, Artificial Sequence
  Synthetic
atggccgactcccaagtacggagggtaaaagcaccgttagtcactggaactgctagaagatttctcttattataagaatctacgtgaccgtgtctggtcggttgagatgattaatggaagggagacccagcatggcgtat

SEQ ID NO: 444135 - DNA, 140 bp, Artificial Sequence
  Synthetic
atacgccatgctgggtctcccatatagtagatttggtgggcgactcttggcacaagctccctatcactcagatcttcgagatccccgaatcaatggacccgtccgagatactcgatgatacgtacttgggagtcggccat

SEQ ID NO: 444136 - DNA, 140 bp, Artificial Sequence
  Synthetic
atggccgactcccaagtacgtatcatcgagtatctcggacgggtccattgattcggggatctcgaagatctgagtgatagggagcttgtgccaagagtcgcccaccaaatctactatatgggagacccagcatggcgtat

SEQ ID NO: 444137 - DNA, 140 bp, Artificial Sequence
  Synthetic
aggccctggctgctgatatgctgggtaagagtggattgagaaaggagacttacttcctataaaggacataagcaatagatcaccatcatcttgcatccctgcaaagtgtgtataattatagaccttttgggacagcggtg

SEQ ID NO: 444138 - DNA, 140 bp, Artificial Sequence
  Synthetic
caccgctgtcccaaaaggtctataattatacacactttgcagggatgcaagatgatggtgatctattgcttatgtcctttataggaagtaagtctcctttctcaatccactcttacccagcatatcagcagccagggcct

SEQ ID NO: 444139 - DNA, 140 bp, Artificial Sequence
  Synthetic
atacgccatgctgggtctccaccccctgtcaaccccagagaattcttgaaatctatagaccttggaggactgccggacgaagatctgataatcggcctcaaacctaaggagagggagctacgtacttgggagtcggccat

SEQ ID NO: 444140 - DNA, 140 bp, Artificial Sequence
  Synthetic
atggccgactcccaagtacgtagctccctctccttaggtttgaggccgattatcagatcttcgtccggcagtcctccaaggtctatagatttcaagaattctctggggttgacagggggtggagacccagcatggcgtat

SEQ ID NO: 444141 - DNA, 140 bp, Artificial Sequence
  Synthetic
atacgccatgctgggtctcctcttgagtctatataggttgagcaaaatctctggacagaacaccggcaattacaagacaaacatcgcagatagaatagaacaaatttttgagacagcccccgtacttgggagtcggccat

SEQ ID NO: 444142 - DNA, 140 bp, Artificial Sequence
  Synthetic
atggccgactcccaagtacgggggctgtctcaaaaatttgttctattctatctgcgatgtttgtcttgtaattgccggtgttctgtccagagattttgctcaacctatatagactcaagaggagacccagcatggcgtat

SEQ ID NO: 444143 - DNA, 140 bp, Artificial Sequence
  Synthetic
aggccctggctgctgatatggattcaggggaggtttacgatgacccagttgatccgattgaatcagaggccgagcctagagggactccaactgttcccaacatcttgaggaactctgactgaccttttgggacagcggtg

SEQ ID NO: 444144 - DNA, 140 bp, Artificial Sequence
  Synthetic
caccgctgtcccaaaaggtcagtcagagttcctcaagatgttgggaacagttggagtccctctaggctcggcctctgattcaatcggatcaactgggtcatcgtaaacctcccctgaatccatatcagcagccagggcct

SEQ ID NO: 444145 - DNA, 140 bp, Artificial Sequence
  Synthetic
aggccctggctgctgatatgttctaggtcttacaaagtcttgaaagattactttaagaagttagatttgggatctctcaaagtgggtggaactgcagcccagtcaatgatctctctctgggaccttttgggacagcggtg

SEQ ID NO: 444146 - DNA, 140 bp, Artificial Sequence
  Synthetic
caccgctgtcccaaaaggtcccagagagagatcattgactgggctgcagttccacccactttgagagatcccaaatctaacttcttaaagtaatctttcaagactttgtaagacctagaacatatcagcagccagggcct

SEQ ID NO: 444147 - DNA, 140 bp, Artificial Sequence
  Synthetic
aggccctggctgctgatatgacatggaactgaaggtgggatacatctctgccataaaagttaatgggttcacttgtactggtgttgtgacagaagctgagacctacaccaactttgttgggaccttttgggacagcggtg

SEQ ID NO: 444148 - DNA, 140 bp, Artificial Sequence
  Synthetic
caccgctgtcccaaaaggtcccaacaaagttggtgtaggtctcagcttctgtcacaacaccagtacaagtgaacccattaacttttatggcagagatgtatcccaccttcagttccatgtcatatcagcagccagggcct

SEQ ID NO: 444149 - DNA, 140 bp, Artificial Sequence
  Synthetic
aggccctggctgctgatatgttttccagaactcatgagttttttcaaaagtcttggatctattattcagacagatccgaccttatcgggttatgggaggatcaaatatactgtctggacagaccttttgggacagcggtg

SEQ ID NO: 444150 - DNA, 140 bp, Artificial Sequence
  Synthetic
caccgctgtcccaaaaggtctgtccagacagtatatttgatcctcccataacccgataaggtcggatctgtctgaataatagatccaagacttttgaaaaaactcatgagttctggaaaacatatcagcagccagggcct

SEQ ID NO: 444151 - DNA, 140 bp, Artificial Sequence
  Synthetic
aggccctggctgctgatatggcacactcggaaatagaggactaagagtccctccggagggtgtgttgagttgccttgaaagggtagactatgataaggcatttggaaggtatctcgctaagaccttttgggacagcggtg

SEQ ID NO: 444152 - DNA, 140 bp, Artificial Sequence
  Synthetic
caccgctgtcccaaaaggtcttagcgagataccttccaaatgccttatcatagtctaccctttcaaggcaactcaacacaccctccggagggactcttagtcctctatttccgagtgtgccatatcagcagccagggcct

SEQ ID NO: 444153 - DNA, 140 bp, Artificial Sequence
  Synthetic
atacgccatgctgggtctcctacaatgaaatgatcataaccctgattgacagcgatgtagaatctttcctagtccacaaaatggttgatgatctcgagttacaaaggggaactctatccacgtacttgggagtcggccat

SEQ ID NO: 444154 - DNA, 140 bp, Artificial Sequence
  Synthetic
atggccgactcccaagtacgtggatagagttcccctttgtaactcgagatcatcaaccattttgtggactaggaaagattctacatcgctgtcaatcagggttatgatcatttcattgtaggagacccagcatggcgtat

SEQ ID NO: 444155 - DNA, 140 bp, Artificial Sequence
  Synthetic
atacgccatgctgggtctccatctcaaaccaggaacacaagaactaagatattagcccagggggacaaccaggttctgtgcccaacgtatatgttgtcaccggggctctccagagaggggcgtacttgggagtcggccat

SEQ ID NO: 444156 - DNA, 140 bp, Artificial Sequence
  Synthetic
atggccgactcccaagtacgcccctctctggagagccccggtgacaacatatacgttgggcacagaacctggttgtccccctgggctaatatcttagttcttgtgttcctggtttgagatggagacccagcatggcgtat

SEQ ID NO: 444157 - DNA, 140 bp, Artificial Sequence
  Synthetic
atacgccatgctgggtctccctttctacgtaagatagtgaaaaattgtagggatgaggacactcaaaaaccctctcctgcttcagcccctccggatgacgacgacctgtggctcccaccccgtacttgggagtcggccat

SEQ ID NO: 444158 - DNA, 140 bp, Artificial Sequence
  Synthetic
atggccgactcccaagtacggggtgggagccacaggtcgtcgtcatccggaggggctgaagcaggagagggtttttgagtgtcctcatccctacaatttttcactatcttacgtagaaagggagacccagcatggcgtat

SEQ ID NO: 444159 - DNA, 140 bp, Artificial Sequence
  Synthetic
aggccctggctgctgatatgacgtcagtagatattgggaaggatttggtcaagttcaaagatcaaatatggggactactaattgtgacgaaggactttgtgtactctcagagctcaaattgaccttttgggacagcggtg

SEQ ID NO: 444160 - DNA, 140 bp, Artificial Sequence
  Synthetic
caccgctgtcccaaaaggtcaatttgagctctgagagtacacaaagtccttcgtcacaattagtagtccccatatttgatctttgaacttgaccaaatccttcccaatatctactgacgtcatatcagcagccagggcct

SEQ ID NO: 444161 - DNA, 140 bp, Artificial Sequence
  Synthetic
atacgccatgctgggtctccagaccatgtgtagttatgactttctcatctacggaaaaacccccttgtttcgaggtaacattttagtgcctgagtccaaaagatgggctagagtctcctgcgtacttgggagtcggccat

SEQ ID NO: 444162 - DNA, 140 bp, Artificial Sequence
  Synthetic
atggccgactcccaagtacgcaggagactctagcccatcttttggactcaggcactaaaatgttacctcgaaacaagggggtttttccgtagatgagaaagtcataactacacatggtctggagacccagcatggcgtat

SEQ ID NO: 444163 - DNA, 140 bp, Artificial Sequence
  Synthetic
atacgccatgctgggtctccttaagatactggaaccctatgtcgtgaacagcttagtccagagggcagaaaagtttaggcccctcatccactctttgggggactttcctgtttttataaacgtacttgggagtcggccat

SEQ ID NO: 444164 - DNA, 140 bp, Artificial Sequence
  Synthetic
atggccgactcccaagtacgtttataaaaacaggaaagtcccccaaagagtggatgaggggcctaaacttttctgccctctggactaagctgttcacgacatagggttccagtatcttaaggagacccagcatggcgtat

SEQ ID NO: 444165 - DNA, 140 bp, Artificial Sequence
  Synthetic
aggccctggctgctgatatgagacgacctgatatctcagttgtgccaactgtacattgccggggatcaagtcttgtccatgtgcggaaactccggttatgaagtcatcaaaatattagaggaccttttgggacagcggtg

SEQ ID NO: 444166 - DNA, 140 bp, Artificial Sequence
  Synthetic
caccgctgtcccaaaaggtcctctaatattttgatgacttcataaccggagtttccgcacatggacaagacttgatccccggcaatgtacagttggcacaactgagatatcaggtcgtctcatatcagcagccagggcct

SEQ ID NO: 444167 - DNA, 140 bp, Artificial Sequence
  Synthetic
atacgccatgctgggtctccatgagggattttttactcatgtcagttcaagctgtcttccattacctgctgttcagccctatcctgaaaggcagagtttacaagatcttgagtgcagaggcgtacttgggagtcggccat

SEQ ID NO: 444168 - DNA, 140 bp, Artificial Sequence
  Synthetic
atggccgactcccaagtacgcctctgcactcaagatcttgtaaactctgcctttcaggatagggctgaacagcaggtaatggaagacagcttgaactgacatgagtaaaaaatccctcatggagacccagcatggcgtat

SEQ ID NO: 444169 - DNA, 140 bp, Artificial Sequence
  Synthetic
aggccctggctgctgatatgaactcgaaggaacatttggtcctagtgcaaaaaggttttttagagttctggatcaattcgacaacatacatgacctggtttttgtgtatggatgttacaggaccttttgggacagcggtg

SEQ ID NO: 444170 - DNA, 140 bp, Artificial Sequence
  Synthetic
caccgctgtcccaaaaggtcctgtaacatccatacacaaaaaccaggtcatgtatgttgtcgaattgatccagaactctaaaaaacctttttgcactaggaccaaatgttccttcgagttcatatcagcagccagggcct

SEQ ID NO: 444171 - DNA, 140 bp, Artificial Sequence
  Synthetic
atacgccatgctgggtctccggtgtatcaacatgaactcgagagcatgtcaactatggtctgacatgtctcttcagacacaaaggtctgaagaggacaaagactcctctctgcttctagacgtacttgggagtcggccat

SEQ ID NO: 444172 - DNA, 140 bp, Artificial Sequence
  Synthetic
atggccgactcccaagtacgtctagaagcagagaggagtctttgtcctcttcagacctttgtgtctgaagagacatgtcagaccatagttgacatgctctcgagttcatgttgatacaccggagacccagcatggcgtat

SEQ ID NO: 444173 - DNA, 140 bp, Artificial Sequence
  Synthetic
atacgccatgctgggtctccctccgatcctgtctcagaagggttgtctttctggagagagatctggctaagttctaatgagtcatggattcacgcgttgtgtcaagaagcgggaaacccacgtacttgggagtcggccat

SEQ ID NO: 444174 - DNA, 140 bp, Artificial Sequence
  Synthetic
atggccgactcccaagtacgtgggtttcccgcttcttgacacaacgcgtgaatccatgactcattagaacttagccagatctctctccagaaagacaacccttctgagacaggatcggagggagacccagcatggcgtat

SEQ ID NO: 444175 - DNA, 140 bp, Artificial Sequence
  Synthetic
aggccctggctgctgatatgagattgagggtcgattctttgctctgatgtcatggaatctaagattgtattttgtcatcaccgaaaagctcttggctaactacatcttgccactttttgagaccttttgggacagcggtg

SEQ ID NO: 444176 - DNA, 140 bp, Artificial Sequence
  Synthetic
caccgctgtcccaaaaggtctcaaaaagtggcaagatgtagttagccaagagcttttcggtgatgacaaaatacaatcttagattccatgacatcagagcaaagaatcgaccctcaatctcatatcagcagccagggcct

SEQ ID NO: 444177 - DNA, 140 bp, Artificial Sequence
  Synthetic
aggccctggctgctgatatgttagctagtgatctggctagaaggatcctcaggtgggggtttgacaaatactccaagtggtatattgactcgagactccttgcaagagaccatcccttgagaccttttgggacagcggtg

SEQ ID NO: 444178 - DNA, 140 bp, Artificial Sequence
  Synthetic
caccgctgtcccaaaaggtctcaagggatggtctcttgcaaggagtctcgagtcaatataccacttggagtatttgtcaaacccccacctgaggatccttctagccagatcactagctaacatatcagcagccagggcct

SEQ ID NO: 444179 - DNA, 140 bp, Artificial Sequence
  Synthetic
aggccctggctgctgatatgacggttattgctgcatgtgctcctcatgaaatgtctgttctagggggctatctgggagaggaattcttcgggaaagggacatttgaaagaagattcttcagaccttttgggacagcggtg

SEQ ID NO: 444180 - DNA, 140 bp, Artificial Sequence
  Synthetic
caccgctgtcccaaaaggtctgaagaatcttctttcaaatgtccctttcccgaagaattcctctcccagatagccccctagaacagacatttcatgaggagcacatgcagcaataaccgtcatatcagcagccagggcct

SEQ ID NO: 444181 - DNA, 140 bp, Artificial Sequence
  Synthetic
aggccctggctgctgatatggagtttagagaagcgatcctcttgtccaagacccatagggataactttatacttttcttgaagtctatagagcctctatttccccgatttctcagtgaacgaccttttgggacagcggtg

SEQ ID NO: 444182 - DNA, 140 bp, Artificial Sequence
  Synthetic
caccgctgtcccaaaaggtcgttcactgagaaatcggggaaatagaggctctatagacttcaagaaaagtataaagttatccctatgggtcttggacaagaggatcgcttctctaaactccatatcagcagccagggcct

SEQ ID NO: 444183 - DNA, 140 bp, Artificial Sequence
  Synthetic
aggccctggctgctgatatgtgaatccatggatccatcagaaatattggatgacaagtcacactctttcaccagaacgagactagcctcttggctatcagagaacagaggggggcctgtcgaccttttgggacagcggtg

SEQ ID NO: 444184 - DNA, 140 bp, Artificial Sequence
  Synthetic
caccgctgtcccaaaaggtcgacaggcccccctctgttctctgatagccaagaggctagtctcgttctggtgaaagagtgtgacttgtcatccaatatttctgatggatccatggattcacatatcagcagccagggcct

SEQ ID NO: 444185 - DNA, 140 bp, Artificial Sequence
  Synthetic
atacgccatgctgggtctccactggaggagtccttttataactcagagatccatgggatcaacaggatgacacagactccccaaagggtcggaagggtttggctctgctcctcagagaggcgtacttgggagtcggccat

SEQ ID NO: 444186 - DNA, 140 bp, Artificial Sequence
  Synthetic
atggccgactcccaagtacgcctctctgaggagcagagccaaacccttccgaccctttggggagtctgtgtcatcctgttgatcccatggatctctgagttataaaaggactcctccagtggagacccagcatggcgtat

SEQ ID NO: 444187 - DNA, 140 bp, Artificial Sequence
  Synthetic
aggccctggctgctgatatgtgataattggtctcaagccgaaggaaagagaattgaagattgaaggccgattttttgctttaatgtcttggaatttgaggttgtatttcgttatcaccgagaccttttgggacagcggtg

SEQ ID NO: 444188 - DNA, 140 bp, Artificial Sequence
  Synthetic
caccgctgtcccaaaaggtctcggtgataacgaaatacaacctcaaattccaagacattaaagcaaaaaatcggccttcaatcttcaattctctttccttcggcttgagaccaattatcacatatcagcagccagggcct

SEQ ID NO: 444189 - DNA, 140 bp, Artificial Sequence
  Synthetic
atacgccatgctgggtctcccctgcacatgtggagtaacaggagggggaaatcctcgaatatcagtgtctgtgcttccgtcctttgatcagtcatttttctcgagaggccctctgaagggcgtacttgggagtcggccat

SEQ ID NO: 444190 - DNA, 140 bp, Artificial Sequence
  Synthetic
atggccgactcccaagtacgcccttcagagggcctctcgagaaaaatgactgatcaaaggacggaagcacagacactgatattcgaggatttccccctcctgttactccacatgtgcaggggagacccagcatggcgtat

SEQ ID NO: 444191 - DNA, 140 bp, Artificial Sequence
  Synthetic
aggccctggctgctgatatgcaggggctcttggactattcaagggttacatatgctttccatttggactatgaaaaatggaacaatcatcaaaggttggagtcgacagaagatgtattctgaccttttgggacagcggtg

SEQ ID NO: 444192 - DNA, 140 bp, Artificial Sequence
  Synthetic
caccgctgtcccaaaaggtcagaatacatcttctgtcgactccaacctttgatgattgttccatttttcatagtccaaatggaaagcatatgtaacccttgaatagtccaagagcccctgcatatcagcagccagggcct

SEQ ID NO: 444193 - DNA, 140 bp, Artificial Sequence
  Synthetic
atacgccatgctgggtctcctctataaactggttcattacaagaaactcaaatcttgctcaaactctaattagaaacataatgtctctgacaggtccagactttccgctggaagaggccccgtacttgggagtcggccat

SEQ ID NO: 444194 - DNA, 140 bp, Artificial Sequence
  Synthetic
atggccgactcccaagtacggggcctcttccagcggaaagtctggacctgtcagagacattatgtttctaattagagtttgagcaagatttgagtttcttgtaatgaaccagtttatagaggagacccagcatggcgtat

SEQ ID NO: 444195 - DNA, 140 bp, Artificial Sequence
  Synthetic
aggccctggctgctgatatgtgggttacgggaggaccaaatatactgtttagacatgtccaacggaccgacctgctggaatggtcaggatggcgggttggagggcttacggcagaaaggcgaccttttgggacagcggtg

SEQ ID NO: 444196 - DNA, 140 bp, Artificial Sequence
  Synthetic
caccgctgtcccaaaaggtcgcctttctgccgtaagccctccaacccgccatcctgaccattccagcaggtcggtccgttggacatgtctaaacagtatatttggtcctcccgtaacccacatatcagcagccagggcct

SEQ ID NO: 444197 - DNA, 140 bp, Artificial Sequence
  Synthetic
atacgccatgctgggtctccgccagatgaggacttaataattggcctcaagcctaaggaacgagaattgaagattgagggtcgattctttgctctaatgtcatggaatctaagattgtatcgtacttgggagtcggccat

SEQ ID NO: 444198 - DNA, 140 bp, Artificial Sequence
  Synthetic
atggccgactcccaagtacgatacaatcttagattccatgacattagagcaaagaatcgaccctcaatcttcaattctcgttccttaggcttgaggccaattattaagtcctcatctggcggagacccagcatggcgtat

SEQ ID NO: 444199 - DNA, 140 bp, Artificial Sequence
  Synthetic
atacgccatgctgggtctccctctgtcagtacagacactatgtcggatttgactcatgatggaagaaactatgacttcatgtttcaaccgctgatgctttatgcgcaaacatggacgtcgcgtacttgggagtcggccat

SEQ ID NO: 444200 - DNA, 140 bp, Artificial Sequence
  Synthetic
atggccgactcccaagtacgcgacgtccatgtttgcgcataaagcatcagcggttgaaacatgaagtcatagtttcttccatcatgagtcaaatccgacatagtgtctgtactgacagagggagacccagcatggcgtat

SEQ ID NO: 444201 - DNA, 140 bp, Artificial Sequence
  Synthetic
aggccctggctgctgatatgcatatatgttgtcacctgggctatcaagagaggggcttctctatgagttggagagcatatcgagaaatgctctttctatataccgagctatagaggaagggaccttttgggacagcggtg

SEQ ID NO: 444202 - DNA, 140 bp, Artificial Sequence
  Synthetic
caccgctgtcccaaaaggtcccttcctctatagctcggtatatagaaagagcatttctcgatatgctctccaactcatagagaagcccctctcttgatagcccaggtgacaacatatatgcatatcagcagccagggcct

SEQ ID NO: 444203 - DNA, 140 bp, Artificial Sequence
  Synthetic
atacgccatgctgggtctcccctctcagatcttcgagttcccggatgtttcaagaagaatatctagaatggtttctggagctgtgcctcatttccgaaaacttcctgatattcgtttaaacgtacttgggagtcggccat

SEQ ID NO: 444204 - DNA, 140 bp, Artificial Sequence
  Synthetic
atggccgactcccaagtacgtttaaacgaatatcaggaagttttcggaaatgaggcacagctccagaaaccattctagatattcttcttgaaacatccgggaactcgaagatctgagaggggagacccagcatggcgtat

SEQ ID NO: 444205 - DNA, 140 bp, Artificial Sequence
  Synthetic
atacgccatgctgggtctccgtaccggagtcaaagagatgggccagagtctcttgcatctcgaacgaccagatagtcaaccttgccaatataatgtcaacggtgtccaccaatgcattgacgtacttgggagtcggccat

SEQ ID NO: 444206 - DNA, 140 bp, Artificial Sequence
  Synthetic
atggccgactcccaagtacgtcaatgcattggtggacaccgttgacattatattggcaaggttgactatctggtcgttcgagatgcaagagactctggcccatctctttgactccggtacggagacccagcatggcgtat

SEQ ID NO: 444207 - DNA, 140 bp, Artificial Sequence
  Synthetic
aggccctggctgctgatatggaaaggcagagtttacaagattttgagtgcagaaggggacaattttcttctagcaatgtcgagaataatctatctagatccttccttagggggagtgtcggaccttttgggacagcggtg

SEQ ID NO: 444208 - DNA, 140 bp, Artificial Sequence
  Synthetic
caccgctgtcccaaaaggtccgacactccccctaaggaaggatctagatagattattctcgacattgctagaagaaaattgtccccttctgcactcaaaatcttgtaaactctgcctttccatatcagcagccagggcct

SEQ ID NO: 444209 - DNA, 140 bp, Artificial Sequence
  Synthetic
atacgccatgctgggtctccgaactgatatccggagtgatttcatacattctcttgagactggacaatcacccatctctgtacataatgctcagagagccatctcttagaggagagatctcgtacttgggagtcggccat

SEQ ID NO: 444210 - DNA, 140 bp, Artificial Sequence
  Synthetic
atggccgactcccaagtacgagatctctcctctaagagatggctctctgagcattatgtacagagatgggtgattgtccagtctcaagagaatgtatgaaatcactccggatatcagttcggagacccagcatggcgtat

SEQ ID NO: 444211 - DNA, 140 bp, Artificial Sequence
  Synthetic
atacgccatgctgggtctccagagcacacgggcttgaccccaactttcaggagcaatagaacaaaaatatgtcatggtgccgtcgagtcgctgcattttgtcagagtaggctctgttactcgtacttgggagtcggccat

SEQ ID NO: 444212 - DNA, 140 bp, Artificial Sequence
  Synthetic
atggccgactcccaagtacgagtaacagagcctactctgacaaaatgcagcgactcgacggcaccatgacatatttttgttctattgctcctgaaagttggggtcaagcccgtgtgctctggagacccagcatggcgtat

SEQ ID NO: 444213 - DNA, 140 bp, Artificial Sequence
  Synthetic
aggccctggctgctgatatgggattcatgccctgtgtcaggaggcagggaacccagacctcggagagagaacacttgagagcttcactcgacttctagaggatcccactactttaaatatgaccttttgggacagcggtg

SEQ ID NO: 444214 - DNA, 140 bp, Artificial Sequence
  Synthetic
caccgctgtcccaaaaggtcatatttaaagtagtgggatcctctagaagtcgagtgaagctctcaagtgttctctctccgaggtctgggttccctgcctcctgacacagggcatgaatcccatatcagcagccagggcct

SEQ ID NO: 444215 - DNA, 140 bp, Artificial Sequence
  Synthetic
aggccctggctgctgatatgcctgcaattctagcctgagtctgtcatctcactggatcaggctgatttacaaggtagtgaagactaccagactcgttggtagcatcgaggacctatctgggaccttttgggacagcggtg

SEQ ID NO: 444216 - DNA, 140 bp, Artificial Sequence
  Synthetic
caccgctgtcccaaaaggtcccagataggtcctcgatgctaccaacgagtctggtagtcttcactaccttgtaaatcagcctgatccagtgagatgacagactcaggctagaattgcaggcatatcagcagccagggcct

SEQ ID NO: 444217 - DNA, 140 bp, Artificial Sequence
  Synthetic
atacgccatgctgggtctcccgaggcaatcacagcatctccagagaacgaatggttgtggatcttctcagactttagaagctccaagatgacgtatctgactctcatcacttaccaatctcgtacttgggagtcggccat

SEQ ID NO: 444218 - DNA, 140 bp, Artificial Sequence
  Synthetic
atggccgactcccaagtacgagattggtaagtgatgagagtcagatacgtcatcttggagcttctaaagtctgagaagatccacaaccattcgttctctggagatgctgtgattgcctcgggagacccagcatggcgtat

SEQ ID NO: 444219 - DNA, 140 bp, Artificial Sequence
  Synthetic
atacgccatgctgggtctccgtgaagacaccttggagtcagacgaagacattcagaggctgttaaaagactctttgcgcaggacaaggtgggtagaccaggaagtgcgccatgcagcgagcgtacttgggagtcggccat

SEQ ID NO: 444220 - DNA, 140 bp, Artificial Sequence
  Synthetic
atggccgactcccaagtacgctcgctgcatggcgcacttcctggtctacccaccttgtcctgcgcaaagagtcttttaacagcctctgaatgtcttcgtctgactccaaggtgtcttcacggagacccagcatggcgtat

SEQ ID NO: 444221 - DNA, 140 bp, Artificial Sequence
  Synthetic
aggccctggctgctgatatgtcccatgatagcagactcaacatgagttaattgagaaaggcaatatgcctcccatgaaggacataagcaatagctcacaatcatcttacatcttagcaaagaccttttgggacagcggtg

SEQ ID NO: 444222 - DNA, 140 bp, Artificial Sequence
  Synthetic
caccgctgtcccaaaaggtctttgctaagatgtaagatgattgtgagctattgcttatgtccttcatgggaggcatattgcctttctcaattaactcatgttgagtctgctatcatgggacatatcagcagccagggcct

SEQ ID NO: 444223 - DNA, 140 bp, Artificial Sequence
  Synthetic
aggccctggctgctgatatggagatttcttgggggaggaaagtggtgggcacgacagttcctcacccttctgagatgttgggactgcttcccaagtcttccatctcctgtacttgtggaagaccttttgggacagcggtg

SEQ ID NO: 444224 - DNA, 140 bp, Artificial Sequence
  Synthetic
caccgctgtcccaaaaggtcttccacaagtacaggagatggaagacttgggaagcagtcccaacatctcagaagggtgaggaactgtcgtgcccaccactttcctcccccaagaaatctccatatcagcagccagggcct

SEQ ID NO: 444225 - DNA, 140 bp, Artificial Sequence
  Synthetic
atacgccatgctgggtctccgaggaactctgactacaatctcaactctcctttgatagaagatcctgctagactgatgttagagtggttgaaaacagggaatagaccttatcggatgactcgtacttgggagtcggccat

SEQ ID NO: 444226 - DNA, 140 bp, Artificial Sequence
  Synthetic
atggccgactcccaagtacgagtcatccgataaggtctattccctgttttcaaccactctaacatcagtctagcaggatcttctatcaaaggagagttgagattgtagtcagagttcctcggagacccagcatggcgtat

SEQ ID NO: 444227 - DNA, 140 bp, Artificial Sequence
  Synthetic
aggccctggctgctgatatgcacctccatgtcgacccagctgttccatgcgtgggaaaaagtcaccaatgttcacgtggtaaaaagggccctatcactaaaagaatctataaactggttcgaccttttgggacagcggtg

SEQ ID NO: 444228 - DNA, 140 bp, Artificial Sequence
  Synthetic
caccgctgtcccaaaaggtcgaaccagtttatagattcttttagtgatagggccctttttaccacgtgaacattggtgactttttcccacgcatggaacagctgggtcgacatggaggtgcatatcagcagccagggcct

SEQ ID NO: 444229 - DNA, 140 bp, Artificial Sequence
  Synthetic
aggccctggctgctgatatgatgagcggaggagatgacatcatctccagggtgattgactttgactccatctgggagaaaccctctgacttgaggaacttgaccacatggaagtacttccgaccttttgggacagcggtg

SEQ ID NO: 444230 - DNA, 140 bp, Artificial Sequence
  Synthetic
caccgctgtcccaaaaggtcggaagtacttccatgtggtcaagttcctcaagtcagagggtttctcccagatggagtcaaagtcaatcaccctggagatgatgtcatctcctccgctcatcatatcagcagccagggcct

SEQ ID NO: 444231 - DNA, 140 bp, Artificial Sequence
  Synthetic
aggccctggctgctgatatgcagggtcagccttgcatatgttcaagtctgccagatacaatgaaggggggtattcttctgtgtgccctaatctcctctctcacatctctgtgagtacacagaccttttgggacagcggtg

SEQ ID NO: 444232 - DNA, 140 bp, Artificial Sequence
  Synthetic
caccgctgtcccaaaaggtctgtgtactcacagagatgtgagagaggagattagggcacacagaagaataccccccttcattgtatctggcagacttgaacatatgcaaggctgaccctgcatatcagcagccagggcct

SEQ ID NO: 444233 - DNA, 140 bp, Artificial Sequence
  Synthetic
atacgccatgctgggtctcctattcttctgtgtgccctaatctcctctctcacatctctgtgagtacacataccatgtctgatctaacccaggacgggaagaattacgatttcatgttcccgtacttgggagtcggccat

SEQ ID NO: 444234 - DNA, 140 bp, Artificial Sequence
  Synthetic
atggccgactcccaagtacgggaacatgaaatcgtaattcttcccgtcctgggttagatcagacatggtatgtgtactcacagagatgtgagagaggagattagggcacacagaagaataggagacccagcatggcgtat

SEQ ID NO: 444235 - DNA, 140 bp, Artificial Sequence
  Synthetic
atacgccatgctgggtctcctgattttgcattgtctatagatggtccactttatttggttttcaaaacttatgggactatgctcgtaaatccggactacagagcaattcaacatctatctcgtacttgggagtcggccat

SEQ ID NO: 444236 - DNA, 140 bp, Artificial Sequence
  Synthetic
atggccgactcccaagtacgagatagatgttgaattgctctgtagtccggatttacgagcatagtcccataagttttgaaaaccaaataaagtggaccatctatagacaatgcaaaatcaggagacccagcatggcgtat

SEQ ID NO: 444237 - DNA, 140 bp, Artificial Sequence
  Synthetic
atacgccatgctgggtctccgtgtgtaaggcccatcgatgatatcacactggagaccccccagatctttgagtttccagatgtgtcaaaaagaatatctaggatggtttccggtgctgtgcgtacttgggagtcggccat

SEQ ID NO: 444238 - DNA, 140 bp, Artificial Sequence
  Synthetic
atggccgactcccaagtacgcacagcaccggaaaccatcctagatattctttttgacacatctggaaactcaaagatctggggggtctccagtgtgatatcatcgatgggccttacacacggagacccagcatggcgtat

SEQ ID NO: 444239 - DNA, 140 bp, Artificial Sequence
  Synthetic
atacgccatgctgggtctccatgctgaatatttgacctcttccactcttagagaaatgagccttgtattattcaactgtagcagccccaaaagtgagatgcagagggcccgctctctcaacgtacttgggagtcggccat

SEQ ID NO: 444240 - DNA, 140 bp, Artificial Sequence
  Synthetic
atggccgactcccaagtacgttgagagagcgggccctctgcatctcacttttggggctgctacagttgaataatacaaggctcatttctctaagagtggaagaggtcaaatattcagcatggagacccagcatggcgtat

SEQ ID NO: 444241 - DNA, 140 bp, Artificial Sequence
  Synthetic
aggccctggctgctgatatgtcttatattcgatcttggttgcaatccatgactctggatataatgatggcaccatattccctgtcaacatatatggcaaggtatcccctagagactatttgaccttttgggacagcggtg

SEQ ID NO: 444242 - DNA, 140 bp, Artificial Sequence
  Synthetic
caccgctgtcccaaaaggtcaaatagtctctaggggataccttgccatatatgttgacagggaatatggtgccatcattatatccagagtcatggattgcaaccaagatcgaatataagacatatcagcagccagggcct

SEQ ID NO: 444243 - DNA, 140 bp, Artificial Sequence
  Synthetic
atacgccatgctgggtctccgttcacaagatggtagatgatctagaattacagcgaggaactttgtccaaagtttctattattatcgccatcatgatagtcttctccaatagagtgttcacgtacttgggagtcggccat

SEQ ID NO: 444244 - DNA, 140 bp, Artificial Sequence
  Synthetic
atggccgactcccaagtacgtgaacactctattggagaagactatcatgatggcgataataatagaaactttggacaaagttcctcgctgtaattctagatcatctaccatcttgtgaacggagacccagcatggcgtat

SEQ ID NO: 444245 - DNA, 140 bp, Artificial Sequence
  Synthetic
aggccctggctgctgatatggtgatctcatatatcctcctgagactggataatcacccgtctttgtacgtaatgctccgagagccgtctcttagaggagagatattttctataccccagagaccttttgggacagcggtg

SEQ ID NO: 444246 - DNA, 140 bp, Artificial Sequence
  Synthetic
caccgctgtcccaaaaggtctctggggtatagaaaatatctctcctctaagagacggctctcggagcattacgtacaaagacgggtgattatccagtctcaggaggatatatgagatcaccatatcagcagccagggcct

SEQ ID NO: 444247 - DNA, 140 bp, Artificial Sequence
  Synthetic
atacgccatgctgggtctcccactgccttaggggatgtgcccagctttgcaaggcttcatgatttgtacaacagacccataacttattatttcatgaaacaggtcattcggggggatactcgtacttgggagtcggccat

SEQ ID NO: 444248 - DNA, 140 bp, Artificial Sequence
  Synthetic
atggccgactcccaagtacgagtatccccccgaatgacctgtttcatgaaataataagttatgggtctgttgtacaaatcatgaagccttgcaaagctgggcacatcccctaaggcagtgggagacccagcatggcgtat

SEQ ID NO: 444249 - DNA, 140 bp, Artificial Sequence
  Synthetic
aggccctggctgctgatatgatcccctgagaatgactggttgtggattttctctgactttagaagctccaaaatgacgtacctaactcttattacttatcaatctcatctactacttcaagaccttttgggacagcggtg

SEQ ID NO: 444250 - DNA, 140 bp, Artificial Sequence
  Synthetic
caccgctgtcccaaaaggtcttgaagtagtagatgagattgataagtaataagagttaggtacgtcattttggagcttctaaagtcagagaaaatccacaaccagtcattctcaggggatcatatcagcagccagggcct

SEQ ID NO: 444251 - DNA, 140 bp, Artificial Sequence
  Synthetic
atacgccatgctgggtctccaaatagtaaagaccaccagacttgttggaagaatagaagacctgtccagggaggtagagaagcaccttcgggggtacaacaggtggatcaccctcgatgacgtacttgggagtcggccat

SEQ ID NO: 444252 - DNA, 140 bp, Artificial Sequence
  Synthetic
atggccgactcccaagtacgtcatcgagggtgatccacctgttgtacccccgaaggtgcttctctacctccctggacaggtcttctattcttccaacaagtctggtggtctttactatttggagacccagcatggcgtat

SEQ ID NO: 444253 - DNA, 140 bp, Artificial Sequence
  Synthetic
aggccctggctgctgatatgaatcagacgatgacattcaaagactattgaaagactctctgcacagaacaaggtgggtggatcaagaagtgcgccatgcagctagaaccatgacaggggagaccttttgggacagcggtg

SEQ ID NO: 444254 - DNA, 140 bp, Artificial Sequence
  Synthetic
caccgctgtcccaaaaggtctcccctgtcatggttctagctgcatggcgcacttcttgatccacccaccttgttctgtgcagagagtctttcaatagtctttgaatgtcatcgtctgattcatatcagcagccagggcct

SEQ ID NO: 444255 - DNA, 140 bp, Artificial Sequence
  Synthetic
aggccctggctgctgatatggtctcagagcttgatataagagccctctctaagaggtttcagaaccctcttatctccggcttgagagtggttcagtgggcaactggtgcccattataagcgaccttttgggacagcggtg

SEQ ID NO: 444256 - DNA, 140 bp, Artificial Sequence
  Synthetic
caccgctgtcccaaaaggtcgcttataatgggcaccagttgcccactgaaccactctcaagccggagataagagggttctgaaacctcttagagagggctcttatatcaagctctgagaccatatcagcagccagggcct

SEQ ID NO: 444257 - DNA, 140 bp, Artificial Sequence
  Synthetic
atacgccatgctgggtctccgaaaagcccctgacttgaacaaggcatacaagtcaattttatccggcatgaatgcagccaagctcgaccctgatgatgtttgctcttatctagcagctgccgtacttgggagtcggccat

SEQ ID NO: 444258 - DNA, 140 bp, Artificial Sequence
  Synthetic
atggccgactcccaagtacggcagctgctagataagagcaaacatcatcagggtcgagcttggctgcattcatgccggataaaattgacttgtatgccttgttcaagtcaggggcttttcggagacccagcatggcgtat

SEQ ID NO: 444259 - DNA, 140 bp, Artificial Sequence
  Synthetic
aggccctggctgctgatatgagatgctaaacttgtattcaacagtctgttggaggtgaatgacctgatggcgtcaggaacacatccgttgcctccctcagcaatcatgagtggaggagatgaccttttgggacagcggtg

SEQ ID NO: 444260 - DNA, 140 bp, Artificial Sequence
  Synthetic
caccgctgtcccaaaaggtcatctcctccactcatgattgctgagggaggcaacggatgtgttcctgacgccatcaggtcattcacctccaacagactgttgaatacaagtttagcatctcatatcagcagccagggcct

SEQ ID NO: 444261 - DNA, 140 bp, Artificial Sequence
  Synthetic
atacgccatgctgggtctcctcctgattgcacggaagggagacaagatcaccccggattctcttgtggacataagacgtactcatgtagaagggaattgggctctaacagggggtatggacgtacttgggagtcggccat

SEQ ID NO: 444262 - DNA, 140 bp, Artificial Sequence
  Synthetic
atggccgactcccaagtacgtccataccccctgttagagcccaattcccttctacatgagtacgtcttatgtccacaagagaatccggggtgatcttgtctcccttccgtgcaatcaggaggagacccagcatggcgtat

SEQ ID NO: 444263 - DNA, 140 bp, Artificial Sequence
  Synthetic
aggccctggctgctgatatggacattgtctccagagtgatagactttgactcaatctgggagaaaccatcagacctgaggaacttgaccacatggaagtactttcagtcagtccaaaaaagaccttttgggacagcggtg

SEQ ID NO: 444264 - DNA, 140 bp, Artificial Sequence
  Synthetic
caccgctgtcccaaaaggtcttttttggactgactgaaagtacttccatgtggtcaagttcctcaggtctgatggtttctcccagattgagtcaaagtctatcactctggagacaatgtccatatcagcagccagggcct

SEQ ID NO: 444265 - DNA, 140 bp, Artificial Sequence
  Synthetic
aggccctggctgctgatatgtcttgagtctgtataggttgagcaaaatatctggacagaacaccggcaattacaagacaaacatcgcagatagaatagagcagattttcgagacggccccgaccttttgggacagcggtg

SEQ ID NO: 444266 - DNA, 140 bp, Artificial Sequence
  Synthetic
caccgctgtcccaaaaggtcggggccgtctcgaaaatctgctctattctatctgcgatgtttgtcttgtaattgccggtgttctgtccagatattttgctcaacctatacagactcaagacatatcagcagccagggcct

SEQ ID NO: 444267 - DNA, 140 bp, Artificial Sequence
  Synthetic
aggccctggctgctgatatgcatagaaggcccgctttatctggtcttcaaaacttacggaactatgctagtaaatccagaatatcgagccattcaacacctatcgagagcattcccctcagaccttttgggacagcggtg

SEQ ID NO: 444268 - DNA, 140 bp, Artificial Sequence
  Synthetic
caccgctgtcccaaaaggtctgaggggaatgctctcgataggtgttgaatggctcgatattctggatttactagcatagttccgtaagttttgaagaccagataaagcgggccttctatgcatatcagcagccagggcct

SEQ ID NO: 444269 - DNA, 140 bp, Artificial Sequence
  Synthetic
atacgccatgctgggtctccgtgctaactggagtaccataccgaacttcagattcctggcaggagcctatgacatgtttttctctcggattgaacatttgtattcagcaattagagtgggcgtacttgggagtcggccat

SEQ ID NO: 444270 - DNA, 140 bp, Artificial Sequence
  Synthetic
atggccgactcccaagtacgcccactctaattgctgaatacaaatgttcaatccgagagaaaaacatgtcataggctcctgccaggaatctgaagttcggtatggtactccagttagcacggagacccagcatggcgtat

SEQ ID NO: 444271 - DNA, 140 bp, Artificial Sequence
  Synthetic
atacgccatgctgggtctccgccatcgaggaaggggcatctaaactaggactgatcatcaaaaaagaagagaccatgtgtagttatgactttctcatctatgggaaaactcccttgtttccgtacttgggagtcggccat

SEQ ID NO: 444272 - DNA, 140 bp, Artificial Sequence
  Synthetic
atggccgactcccaagtacggaaacaagggagttttcccatagatgagaaagtcataactacacatggtctcttcttttttgatgatcagtcctagtttagatgccccttcctcgatggcggagacccagcatggcgtat

SEQ ID NO: 444273 - DNA, 140 bp, Artificial Sequence
  Synthetic
aggccctggctgctgatatgcatcttccacccttagagagatgagccttgtgttgttcaactgtagcagccccaagagtgagatgcagagagcccgctctttgaattatcaagatcttgtgaccttttgggacagcggtg

SEQ ID NO: 444274 - DNA, 140 bp, Artificial Sequence
  Synthetic
caccgctgtcccaaaaggtcacaagatcttgataattcaaagagcgggctctctgcatctcactcttggggctgctacagttgaacaacacaaggctcatctctctaagggtggaagatgcatatcagcagccagggcct

SEQ ID NO: 444275 - DNA, 140 bp, Artificial Sequence
  Synthetic
aggccctggctgctgatatggacgatctagagttacagagaggaactctatccaagatgtctatcattatagctattatgatagttttctccaacagagtcttcaatgtttctaaaccgcgaccttttgggacagcggtg

SEQ ID NO: 444276 - DNA, 140 bp, Artificial Sequence
  Synthetic
caccgctgtcccaaaaggtcgcggtttagaaacattgaagactctgttggagaaaactatcataatagctataatgatagacatcttggatagagttcctctctgtaactctagatcgtccatatcagcagccagggcct

SEQ ID NO: 444277 - DNA, 140 bp, Artificial Sequence
  Synthetic
atacgccatgctgggtctccatttgggggaagagttttttggaaaaggaacttttgagagaagattctttagagacgagaaggagcttcaggaatatgaggcagctgaattaacgaagaccgtacttgggagtcggccat

SEQ ID NO: 444278 - DNA, 140 bp, Artificial Sequence
  Synthetic
atggccgactcccaagtacggtcttcgttaattcagctgcctcatattcctgaagctccttctcgtctctaaagaatcttctctcaaaagttccttttccaaaaaactcttcccccaaatggagacccagcatggcgtat

SEQ ID NO: 444279 - DNA, 140 bp, Artificial Sequence
  Synthetic
aggccctggctgctgatatgtgtccccagctttgcaagacttcatgacttatacaatagaccaataacatattatttcaaaaagcaggtcattcgagggaatatctatttgtcttggagtgaccttttgggacagcggtg

SEQ ID NO: 444280 - DNA, 140 bp, Artificial Sequence
  Synthetic
caccgctgtcccaaaaggtcactccaagacaaatagatattccctcgaatgacctgctttttgaaataatatgttattggtctattgtataagtcatgaagtcttgcaaagctggggacacatatcagcagccagggcct

SEQ ID NO: 444281 - DNA, 140 bp, Artificial Sequence
  Synthetic
aggccctggctgctgatatgtggtctgacgacacctcagtattcaagagggtggcctgtaactctagcttgagtctatcatctcactggatcaggctgatttacaagatagtgaagaccagaccttttgggacagcggtg

SEQ ID NO: 444282 - DNA, 140 bp, Artificial Sequence
  Synthetic
caccgctgtcccaaaaggtctggtcttcactatcttgtaaatcagcctgatccagtgagatgatagactcaagctagagttacaggccaccctcttgaatactgaggtgtcgtcagaccacatatcagcagccagggcct

SEQ ID NO: 444283 - DNA, 140 bp, Artificial Sequence
  Synthetic
aggccctggctgctgatatggaccacctcagacatgagcaagatttttgtcaatccaagtgcgatcagggcaggtttggctgatctagagatggcagaggaaacggtagatctgatcgctgaccttttgggacagcggtg

SEQ ID NO: 444284 - DNA, 140 bp, Artificial Sequence
  Synthetic
caccgctgtcccaaaaggtcagcgatcagatctaccgtttcctctgccatctctagatcagccaaacctgccctgatcgcacttggattgacaaaaatcttgctcatgtctgaggtggtccatatcagcagccagggcct

SEQ ID NO: 444285 - DNA, 140 bp, Artificial Sequence
  Synthetic
atacgccatgctgggtctcctaagtaccaaggctttcggacgatgcgccttgaaaaaacgagatcccgaatcagaacctctggttgtttgattattttttttatctttattgtttttttgcgtacttgggagtcggccat

SEQ ID NO: 444286 - DNA, 140 bp, Artificial Sequence
  Synthetic
atggccgactcccaagtacgcaaaaaaacaataaagataaaaaaaataatcaaacaaccagaggttctgattcgggatctcgttttttcaaggcgcatcgtccgaaagccttggtacttaggagacccagcatggcgtat

SEQ ID NO: 444287 - DNA, 140 bp, Artificial Sequence
  Synthetic
atacgccatgctgggtctccgactttcagatggatgagggggaggatcccgccctcttgttccagtcttacctggacaatgttggagttcaaatagtcagacaaatgaggtcaggagagacgtacttgggagtcggccat

SEQ ID NO: 444288 - DNA, 140 bp, Artificial Sequence
  Synthetic
atggccgactcccaagtacgtctctcctgacctcatttgtctgactatttgaactccaacattgtccaggtaagactggaacaagagggcgggatcctccccctcatccatctgaaagtcggagacccagcatggcgtat

SEQ ID NO: 444289 - DNA, 140 bp, Artificial Sequence
  Synthetic
atacgccatgctgggtctccttgcacttgtggagcaacaggaggaggcaatcctagagtctctgtatcagtactcccatcctttgatcagtcttttttttcaagaggccccctaaagggacgtacttgggagtcggccat

SEQ ID NO: 444290 - DNA, 140 bp, Artificial Sequence
  Synthetic
atggccgactcccaagtacgtccctttagggggcctcttgaaaaaaaagactgatcaaaggatgggagtactgatacagagactctaggattgcctcctcctgttgctccacaagtgcaaggagacccagcatggcgtat

SEQ ID NO: 444291 - DNA, 140 bp, Artificial Sequence
  Synthetic
atacgccatgctgggtctccgattcctcaagatatggtctcagaccgttgaggaaatcatatcttatgtcactgtcaacttccccagtctgtcggggaagtcttcagaagacaaggctaccgtacttgggagtcggccat

SEQ ID NO: 444292 - DNA, 140 bp, Artificial Sequence
  Synthetic
atggccgactcccaagtacggtagccttgtcttctgaagacttccccgacagactggggaagttgacagtgacataagatatgatttcctcaacggtctgagaccatatcttgaggaatcggagacccagcatggcgtat

SEQ ID NO: 444293 - DNA, 140 bp, Artificial Sequence
  Synthetic
atacgccatgctgggtctccggtcctcctgctctagagtggtccgctgccaacgaagaggatgacttatccgtggaggctgaaatcgctcaccagattgctgagagcttttccaagaagtcgtacttgggagtcggccat

SEQ ID NO: 444294 - DNA, 140 bp, Artificial Sequence
  Synthetic
atggccgactcccaagtacgacttcttggaaaagctctcagcaatctggtgagcgatttcagcctccacggataagtcatcctcttcgttggcagcggaccactctagagcaggaggaccggagacccagcatggcgtat

SEQ ID NO: 444295 - DNA, 140 bp, Artificial Sequence
  Synthetic
atacgccatgctgggtctcccgtgacccgcctagcccatgatgggtccaagctccctctgagatgtgtgctaggatgggttgctctagccaattccaaaaagttccaactgttggttgagcgtacttgggagtcggccat

SEQ ID NO: 444296 - DNA, 140 bp, Artificial Sequence
  Synthetic
atggccgactcccaagtacgctcaaccaacagttggaactttttggaattggctagagcaacccatcctagcacacatctcagagggagcttggacccatcatgggctaggcgggtcacgggagacccagcatggcgtat

SEQ ID NO: 444297 - DNA, 140 bp, Artificial Sequence
  Synthetic
aggccctggctgctgatatgccaggggatttcgagtctctaagtggtagagaaaagtctcgccatatagggtcggctcaggggctcttatactcaatcttagtggcaattcatgactcaggaccttttgggacagcggtg

SEQ ID NO: 444298 - DNA, 140 bp, Artificial Sequence
  Synthetic
caccgctgtcccaaaaggtcctgagtcatgaattgccactaagattgagtataagagcccctgagccgaccctatatggcgagacttttctctaccacttagagactcgaaatcccctggcatatcagcagccagggcct

SEQ ID NO: 444299 - DNA, 140 bp, Artificial Sequence
  Synthetic
aggccctggctgctgatatgctttctacgcaagatagtgaagaactgtagagatgaggacaatcaaaagtcctctctcgcatcggctcctccggatgatgatgatctgtggttaccccctgaccttttgggacagcggtg

SEQ ID NO: 444300 - DNA, 140 bp, Artificial Sequence
  Synthetic
caccgctgtcccaaaaggtcagggggtaaccacagatcatcatcatccggaggagccgatgcgagagaggacttttgattgtcctcatctctacagttcttcactatcttgcgtagaaagcatatcagcagccagggcct

SEQ ID NO: 444301 - DNA, 140 bp, Artificial Sequence
  Synthetic
atacgccatgctgggtctcctctgtcagcacagacacgatgtctgatttgactcatgatggaagaaactatgacttcatgttccaaccgttgatgctttacgcgcaaacatggacgtcggcgtacttgggagtcggccat

SEQ ID NO: 444302 - DNA, 140 bp, Artificial Sequence
  Synthetic
atggccgactcccaagtacgccgacgtccatgtttgcgcgtaaagcatcaacggttggaacatgaagtcatagtttcttccatcatgagtcaaatcagacatcgtgtctgtgctgacagaggagacccagcatggcgtat

SEQ ID NO: 444303 - DNA, 140 bp, Artificial Sequence
  Synthetic
atacgccatgctgggtctccataatcaaattacatcctacaacttcctcaattatttacctctggaggagagaacacatgggcttaactccaaccttcaggagcaatagaacaaaaacatcgtacttgggagtcggccat

SEQ ID NO: 444304 - DNA, 140 bp, Artificial Sequence
  Synthetic
atggccgactcccaagtacgatgtttttgttctattgctcctgaaggttggagttaagcccatgtgttctctcctccagaggtaaataattgaggaagttgtaggatgtaatttgattatggagacccagcatggcgtat

SEQ ID NO: 444305 - DNA, 140 bp, Artificial Sequence
  Synthetic
aggccctggctgctgatatgaccatgactggagattacagccccaacaagaaagtgtcccgtaaggcaggatgttcagaatgggtctgctctgctcaacaggttgcagtctctacctcaggaccttttgggacagcggtg

SEQ ID NO: 444306 - DNA, 140 bp, Artificial Sequence
  Synthetic
caccgctgtcccaaaaggtcctgaggtagagactgcaacctgttgagcagagcagacccattctgaacatcctgccttacgggacactttcttgttggggctgtaatctccagtcatggtcatatcagcagccagggcct

SEQ ID NO: 444307 - DNA, 140 bp, Artificial Sequence
  Synthetic
atacgccatgctgggtctccaagatctaaggaaaaatgatccctcaggctattctgtcagtgcctcttctgatttcctcgctgtgttttgggaaattccccatctacacgataccagaaacgtacttgggagtcggccat

SEQ ID NO: 444308 - DNA, 140 bp, Artificial Sequence
  Synthetic
atggccgactcccaagtacgtttctggtatcgtgtagatggggaatttcccaaaacacagcgaggaaatcagaagaggcactgacagaatagcctgagggatcatttttccttagatcttggagacccagcatggcgtat

SEQ ID NO: 444309 - DNA, 140 bp, Artificial Sequence
  Synthetic
aggccctggctgctgatatgagaggggggcctgttcctagcgagaaggtcattattacggctctgtctaagcctcctgtgaatccccgggagtttttgaaatctatagacctcggaggatgaccttttgggacagcggtg

SEQ ID NO: 444310 - DNA, 140 bp, Artificial Sequence
  Synthetic
caccgctgtcccaaaaggtcatcctccgaggtctatagatttcaaaaactcccggggattcacaggaggcttagacagagccgtaataatgaccttctcgctaggaacaggcccccctctcatatcagcagccagggcct

SEQ ID NO: 444311 - DNA, 140 bp, Artificial Sequence
  Synthetic
atacgccatgctgggtctcccatagaactgaaggtgggatatatttctgccataaaagtgaacggattcacctgtaccggtgtcgtgacagaagctgagacttacaccaactttgttggtcgtacttgggagtcggccat

SEQ ID NO: 444312 - DNA, 140 bp, Artificial Sequence
  Synthetic
atggccgactcccaagtacgaccaacaaagttggtgtaagtctcagcttctgtcacgacaccggtacaggtgaatccgttcacttttatggcagaaatatatcccaccttcagttctatgggagacccagcatggcgtat

SEQ ID NO: 444313 - DNA, 140 bp, Artificial Sequence
  Synthetic
atacgccatgctgggtctccttctcaggttttcgattttccggacgtttcaagaagaatttctagaatggtttctggagctgtgcctcatttccgaaaactccctgatatccgtttaaaacgtacttgggagtcggccat

SEQ ID NO: 444314 - DNA, 140 bp, Artificial Sequence
  Synthetic
atggccgactcccaagtacgttttaaacggatatcagggagttttcggaaatgaggcacagctccagaaaccattctagaaattcttcttgaaacgtccggaaaatcgaaaacctgagaaggagacccagcatggcgtat

SEQ ID NO: 444315 - DNA, 140 bp, Artificial Sequence
  Synthetic
atacgccatgctgggtctccatctggatgcccgaagaagctagactcgggacatcttgtgacatttttatcaacagcagagggaaaagagcatctaaggggggcaggacttgcggatttgcgtacttgggagtcggccat

SEQ ID NO: 444316 - DNA, 140 bp, Artificial Sequence
  Synthetic
atggccgactcccaagtacgcaaatccgcaagtcctgccccccttagatgctcttttccctctgctgttgataaaaatgtcacaagatgtcccgagtctagcttcttcgggcatccagatggagacccagcatggcgtat

SEQ ID NO: 444317 - DNA, 140 bp, Artificial Sequence
  Synthetic
atacgccatgctgggtctcctccggcatcagatgagaccaagtggtgctcccctgatcaactggtgaatgtacatgattttcactcagatgagatagaacatctagtcgtagaggagttgcgtacttgggagtcggccat

SEQ ID NO: 444318 - DNA, 140 bp, Artificial Sequence
  Synthetic
atggccgactcccaagtacgcaactcctctacgactagatgttctatctcatctgagtgaaaatcatgtacattcaccagttgatcaggggagcaccacttggtctcatctgatgccggaggagacccagcatggcgtat

SEQ ID NO: 444319 - DNA, 140 bp, Artificial Sequence
  Synthetic
atacgccatgctgggtctccggttcggaaaggcatatactatattcaacaaaaccttgatggaggctgatgcccactacaaatcagttcggacttggaacgagatcataccctcaaaaggcgtacttgggagtcggccat

SEQ ID NO: 444320 - DNA, 140 bp, Artificial Sequence
  Synthetic
atggccgactcccaagtacgccttttgagggtatgatctcgttccaagtccgaactgatttgtagtgggcatcagcctccatcaaggttttgttgaatatagtatatgcctttccgaaccggagacccagcatggcgtat

SEQ ID NO: 444321 - DNA, 140 bp, Artificial Sequence
  Synthetic
atacgccatgctgggtctcccaatcgtccctacttcaacagcatatggagctgttagagtcttctgtaatccccctaatgcatcccttggcagacccatcaacagtctttaaggacggtgcgtacttgggagtcggccat

SEQ ID NO: 444322 - DNA, 140 bp, Artificial Sequence
  Synthetic
atggccgactcccaagtacgcaccgtccttaaagactgttgatgggtctgccaagggatgcattagggggattacagaagactctaacagctccatatgctgttgaagtagggacgattgggagacccagcatggcgtat

SEQ ID NO: 444323 - DNA, 140 bp, Artificial Sequence
  Synthetic
aggccctggctgctgatatggatagtaaaaactaccagactcgttggcagcgccgaggacctatccagagaggtggaaagacaccttcatgggtataataggtggatcacccttgaggatgaccttttgggacagcggtg

SEQ ID NO: 444324 - DNA, 140 bp, Artificial Sequence
  Synthetic
caccgctgtcccaaaaggtcatcctcaagggtgatccacctattatacccatgaaggtgtctttccacctctctggataggtcctcggcgctgccaacgagtctggtagtttttactatccatatcagcagccagggcct

SEQ ID NO: 444325 - DNA, 140 bp, Artificial Sequence
  Synthetic
atacgccatgctgggtctccgagtgcaggtgctctggcaattcttatactgacaatcttcttaataacatgttgtagaagggctgataaaacaaaatcaatacaacaaggtcttggggggcgtacttgggagtcggccat

SEQ ID NO: 444326 - DNA, 140 bp, Artificial Sequence
  Synthetic
atggccgactcccaagtacgccccccaagaccttgttgtattgattttgttttatcagcccttctacaacatgttattaagaagattgtcagtataagaattgccagagcacctgcactcggagacccagcatggcgtat

SEQ ID NO: 444327 - DNA, 140 bp, Artificial Sequence
  Synthetic
atacgccatgctgggtctccgagcgtttcctgcggtcactggatttataactcagatgacttcttctttctcatccgagctatacctcagattctcaaaacggggaaaattctttcgggacgtacttgggagtcggccat

SEQ ID NO: 444328 - DNA, 140 bp, Artificial Sequence
  Synthetic
atggccgactcccaagtacgtcccgaaagaattttccccgttttgagaatctgaggtatagctcggatgagaaagaagaagtcatctgagttataaatccagtgaccgcaggaaacgctcggagacccagcatggcgtat

SEQ ID NO: 444329 - DNA, 140 bp, Artificial Sequence
  Synthetic
atacgccatgctgggtctcctctcctctatgccttgcgttcaaaacatcgcatctcctagagatcagggggaatctcttgattcgacagtccttcatggactccatgccacggggtagatcgtacttgggagtcggccat

SEQ ID NO: 444330 - DNA, 140 bp, Artificial Sequence
  Synthetic
atggccgactcccaagtacgatctaccccgtggcatggagtccatgaaggactgtcgaatcaagagattccccctgatctctaggagatgcgatgttttgaacgcaaggcatagaggagaggagacccagcatggcgtat

SEQ ID NO: 444331 - DNA, 140 bp, Artificial Sequence
  Synthetic
atacgccatgctgggtctccggtgctctcatctcccagggactgataccaaatgttgtggacggtccaattgatatctcagatgattctgtgcttgggctaaggcagaacccatcgcaagcgtacttgggagtcggccat

SEQ ID NO: 444332 - DNA, 140 bp, Artificial Sequence
  Synthetic
atggccgactcccaagtacgcttgcgatgggttctgccttagcccaagcacagaatcatctgagatatcaattggaccgtccacaacatttggtatcagtccctgggagatgagagcaccggagacccagcatggcgtat

SEQ ID NO: 444333 - DNA, 140 bp, Artificial Sequence
  Synthetic
aggccctggctgctgatatgtgatatctcagatgattctgtgcttgggctaaggcagaacccatcgcaagttccctcacaatagactaaacaggggttgactgagagaaatgattcgcctgaccttttgggacagcggtg

SEQ ID NO: 444334 - DNA, 140 bp, Artificial Sequence
  Synthetic
caccgctgtcccaaaaggtcaggcgaatcatttctctcagtcaacccctgtttagtctattgtgagggaacttgcgatgggttctgccttagcccaagcacagaatcatctgagatatcacatatcagcagccagggcct

SEQ ID NO: 444335 - DNA, 140 bp, Artificial Sequence
  Synthetic
aggccctggctgctgatatgggtgttttcccgaacacacgagttttttcagaggtcctggatctactactcagatagatcggacctcatcgggttgtgggaggatcagatatattgcttagaccttttgggacagcggtg

SEQ ID NO: 444336 - DNA, 140 bp, Artificial Sequence
  Synthetic
caccgctgtcccaaaaggtctaagcaatatatctgatcctcccacaacccgatgaggtccgatctatctgagtagtagatccaggacctctgaaaaaactcgtgtgttcgggaaaacacccatatcagcagccagggcct

SEQ ID NO: 444337 - DNA, 140 bp, Artificial Sequence
  Synthetic
atacgccatgctgggtctccaaaactgtggaatggagaagtaattgacaacacttctcatcctaagaattgcaccatgatgattgatccaggggaggtttatgatgaccccattgatccacgtacttgggagtcggccat

SEQ ID NO: 444338 - DNA, 140 bp, Artificial Sequence
  Synthetic
atggccgactcccaagtacgtggatcaatggggtcatcataaacctcccctggatcaatcatcatggtgcaattcttaggatgagaagtgttgtcaattacttctccattccacagttttggagacccagcatggcgtat

SEQ ID NO: 444339 - DNA, 140 bp, Artificial Sequence
  Synthetic
aggccctggctgctgatatgatttcacctagactatgagaagtggaacaatcatcaaagattggagtcaacagaggatgtattttctgtcctagatcatgtgtttggattgaagagggtggaccttttgggacagcggtg

SEQ ID NO: 444340 - DNA, 140 bp, Artificial Sequence
  Synthetic
caccgctgtcccaaaaggtccaccctcttcaatccaaacacatgatctaggacagaaaatacatcctctgttgactccaatctttgatgattgttccacttctcatagtctaggtgaaatcatatcagcagccagggcct

SEQ ID NO: 444341 - DNA, 140 bp, Artificial Sequence
  Synthetic
atacgccatgctgggtctccagttgatgttagaatggttgaaaacaggaaataggcctctccggatgactctgacagacaattgttctagatcttacaaagtattgaaggactacttcagcgtacttgggagtcggccat

SEQ ID NO: 444342 - DNA, 140 bp, Artificial Sequence
  Synthetic
atggccgactcccaagtacgctgaagtagtccttcaatactttgtaagatctagaacaattgtctgtcagagtcatccggagaggcctatttcctgttttcaaccattctaacatcaactggagacccagcatggcgtat

SEQ ID NO: 444343 - DNA, 140 bp, Artificial Sequence
  Synthetic
aggccctggctgctgatatgctttattaagatcgtggaacatcacactctgatgacaactcataagatgtgtgccaactggagtaccataccaaacttcagatttttagctgggacctatgaccttttgggacagcggtg

SEQ ID NO: 444344 - DNA, 140 bp, Artificial Sequence
  Synthetic
caccgctgtcccaaaaggtcataggtcccagctaaaaatctgaagtttggtatggtactccagttggcacacatcttatgagttgtcatcagagtgtgatgttccacgatcttaataaagcatatcagcagccagggcct

SEQ ID NO: 444345 - DNA, 140 bp, Artificial Sequence
  Synthetic
atacgccatgctgggtctccaagtgtataactgacttggctcagttctattccaagtcttcccctatagaaaaactgttaaactgcacactaggaaatagagggatgagaatccccccagcgtacttgggagtcggccat

SEQ ID NO: 444346 - DNA, 140 bp, Artificial Sequence
  Synthetic
atggccgactcccaagtacgctggggggattctcatccctctatttcctagtgtgcagtttaacagtttttctataggggaagacttggaatagaactgagccaagtcagttatacacttggagacccagcatggcgtat

SEQ ID NO: 444347 - DNA, 140 bp, Artificial Sequence
  Synthetic
atacgccatgctgggtctcctctttacatgaacgccttggactgggatgaggagaagaccatcctagcactgtggagggatctaacctcagtggatgttggaaaggacttggtcaagtttcgtacttgggagtcggccat

SEQ ID NO: 444348 - DNA, 140 bp, Artificial Sequence
  Synthetic
atggccgactcccaagtacgaaacttgaccaagtcctttccaacatccactgaggttagatccctccacagtgctaggatggtcttctcctcatcccagtccaaggcgttcatgtaaagaggagacccagcatggcgtat

SEQ ID NO: 444349 - DNA, 140 bp, Artificial Sequence
  Synthetic
aggccctggctgctgatatgttttctagaacacacgagttcttccaaaagtcttggatctattattcagacagatcagacctcattggattacgggaggatcaaatatactgtttggatagaccttttgggacagcggtg

SEQ ID NO: 444350 - DNA, 140 bp, Artificial Sequence
  Synthetic
caccgctgtcccaaaaggtctatccaaacagtatatttgatcctcccgtaatccaatgaggtctgatctgtctgaataatagatccaagacttttggaagaactcgtgtgttctagaaaacatatcagcagccagggcct

SEQ ID NO: 444351 - DNA, 140 bp, Artificial Sequence
  Synthetic
atacgccatgctgggtctccacctttttttgtctcggttcaactctctaatgattctcctttcccctccagaacccagatattcagatgacctaatatctcagctgtgtcagctatacatcgtacttgggagtcggccat

SEQ ID NO: 444352 - DNA, 140 bp, Artificial Sequence
  Synthetic
atggccgactcccaagtacgatgtatagctgacacagctgagatattaggtcatctgaatatctgggttctggaggggaaaggagaatcattagagagttgaaccgagacaaaaaaaggtggagacccagcatggcgtat

SEQ ID NO: 444353 - DNA, 140 bp, Artificial Sequence
  Synthetic
aggccctggctgctgatatgaaatttaggcctctcattcattccctaggagatttccctgtatttataagagataaggtgggtcaacttgaggggacatttggtcctagtgcaaacaggtgaccttttgggacagcggtg

SEQ ID NO: 444354 - DNA, 140 bp, Artificial Sequence
  Synthetic
caccgctgtcccaaaaggtcacctgtttgcactaggaccaaatgtcccctcaagttgacccaccttatctcttataaatacagggaaatctcctagggaatgaatgagaggcctaaatttcatatcagcagccagggcct

SEQ ID NO: 444355 - DNA, 140 bp, Artificial Sequence
  Synthetic
aggccctggctgctgatatgaggactttcaaatggatgaaggagaggatcctagtctccttctccagtcatacctggacaatgttggagtccaaatagtcagacaaatgaggtcaggagagaccttttgggacagcggtg

SEQ ID NO: 444356 - DNA, 140 bp, Artificial Sequence
  Synthetic
caccgctgtcccaaaaggtctctcctgacctcatttgtctgactatttggactccaacattgtccaggtatgactggagaaggagactaggatcctctccttcatccatttgaaagtcctcatatcagcagccagggcct

SEQ ID NO: 444357 - DNA, 140 bp, Artificial Sequence
  Synthetic
aggccctggctgctgatatgcactaccctgaatataaaaggaggggccagtcccaccattcttctcaaagatgcaattaggaaagccctatatgatgaggtagacgaagtagaaaactcagaccttttgggacagcggtg

SEQ ID NO: 444358 - DNA, 140 bp, Artificial Sequence
  Synthetic
caccgctgtcccaaaaggtctgagttttctacttcgtctacctcatcatatagggctttcctaattgcatctttgagaagaatggtgggactggcccctccttttatattcagggtagtgcatatcagcagccagggcct

SEQ ID NO: 444359 - DNA, 140 bp, Artificial Sequence
  Synthetic
atacgccatgctgggtctcccttgtcgaagctatatgatcaagtccatatcaagaaggttatagataaatcctatcaagagtgcttggcaagtgaccttgccagaagaatcctcaggtggcgtacttgggagtcggccat

SEQ ID NO: 444360 - DNA, 140 bp, Artificial Sequence
  Synthetic
atggccgactcccaagtacgccacctgaggattcttctggcaaggtcacttgccaagcactcttgataggatttatctataaccttcttgatatggacttgatcatatagcttcgacaagggagacccagcatggcgtat

SEQ ID NO: 444361 - DNA, 140 bp, Artificial Sequence
  Synthetic
atacgccatgctgggtctccatatagtggatttggtgggtgacgcttggcataagcttccaatcacccagatattcgagatccccgaatcaatggacccatctgagatactagatgataacgtacttgggagtcggccat

SEQ ID NO: 444362 - DNA, 140 bp, Artificial Sequence
  Synthetic
atggccgactcccaagtacgttatcatctagtatctcagatgggtccattgattcggggatctcgaatatctgggtgattggaagcttatgccaagcgtcacccaccaaatccactatatggagacccagcatggcgtat

SEQ ID NO: 444363 - DNA, 140 bp, Artificial Sequence
  Synthetic
aggccctggctgctgatatgcctcctgtcaaccccagagaattcttaaaatctatagaccttggaggattgccagacgaggatttgatcatcggcctcaagcccaaagaaagggagctgagaccttttgggacagcggtg

SEQ ID NO: 444364 - DNA, 140 bp, Artificial Sequence
  Synthetic
caccgctgtcccaaaaggtctcagctccctttctttgggcttgaggccgatgatcaaatcctcgtctggcaatcctccaaggtctatagattttaagaattctctggggttgacaggaggcatatcagcagccagggcct

SEQ ID NO: 444365 - DNA, 140 bp, Artificial Sequence
  Synthetic
aggccctggctgctgatatggatgtcctagagtcgacatgaaaaaaacaggcaacaccactgataaaatgaactttctacgtaagatagtgaaaaactgtagggatgaggacactcaaaagaccttttgggacagcggtg

SEQ ID NO: 444366 - DNA, 140 bp, Artificial Sequence
  Synthetic
caccgctgtcccaaaaggtcttttgagtgtcctcatccctacagtttttcactatcttacgtagaaagttcattttatcagtggtgttgcctgtttttttcatgtcgactctaggacatccatatcagcagccagggcct

SEQ ID NO: 444367 - DNA, 140 bp, Artificial Sequence
  Synthetic
atacgccatgctgggtctccaacttttgtatcaacggagaggttaaagtatgtagcccgaatggttactcgttcaggatcctgcggcacattctgagatcattcgacgagatatactctgcgtacttgggagtcggccat

SEQ ID NO: 444368 - DNA, 140 bp, Artificial Sequence
  Synthetic
atggccgactcccaagtacgcagagtatatctcgtcgaatgatctcagaatgtgccgcaggatcctgaacgagtaaccattcgggctacatactttaacctctccgttgatacaaaagttggagacccagcatggcgtat

SEQ ID NO: 444369 - DNA, 140 bp, Artificial Sequence
  Synthetic
aggccctggctgctgatatggttcaggatcctgcggcacattctgagatcattcgacgagatatactctgggaatcataggatgatcgggttagttaaagttgttattggactagctttggaccttttgggacagcggtg

SEQ ID NO: 444370 - DNA, 140 bp, Artificial Sequence
  Synthetic
caccgctgtcccaaaaggtccaaagctagtccaataacaactttaactaacccgatcatcctatgattcccagagtatatctcgtcgaatgatctcagaatgtgccgcaggatcctgaaccatatcagcagccagggcct

SEQ ID NO: 444371 - DNA, 140 bp, Artificial Sequence
  Synthetic
atacgccatgctgggtctcctgcgacagaaaggctggagtctagttagcttattaatgatagatcgtgaatctcagaccagaaacacaagaaccaagatactagctcagggtgacaaccacgtacttgggagtcggccat

SEQ ID NO: 444372 - DNA, 140 bp, Artificial Sequence
  Synthetic
atggccgactcccaagtacgtggttgtcaccctgagctagtatcttggttcttgtgtttctggtctgagattcacgatctatcattaataagctaactagactccagcctttctgtcgcaggagacccagcatggcgtat

SEQ ID NO: 444373 - DNA, 140 bp, Artificial Sequence
  Synthetic
atacgccatgctgggtctccgccattgaggagggggcatccaaactggggctcatcataaagaaggaagagaccatgtgtagctatgacttcctcatctatgggaaaactcctttatttccgtacttgggagtcggccat

SEQ ID NO: 444374 - DNA, 140 bp, Artificial Sequence
  Synthetic
atggccgactcccaagtacggaaataaaggagttttcccatagatgaggaagtcatagctacacatggtctcttccttctttatgatgagccccagtttggatgccccctcctcaatggcggagacccagcatggcgtat

SEQ ID NO: 444375 - DNA, 140 bp, Artificial Sequence
  Synthetic
atacgccatgctgggtctcccaccaatgcattgactgtagcacaacactctcagtctttggttaagccgatgagggattttttacttatgtcagtacaagctgtctttcattacttgctgcgtacttgggagtcggccat

SEQ ID NO: 444376 - DNA, 140 bp, Artificial Sequence
  Synthetic
atggccgactcccaagtacgcagcaagtaatgaaagacagcttgtactgacataagtaaaaaatccctcatcggcttaaccaaagactgagagtgttgtgctacagtcaatgcattggtgggagacccagcatggcgtat

SEQ ID NO: 444377 - DNA, 140 bp, Artificial Sequence
  Synthetic
aggccctggctgctgatatgtcagatcctgtctcagaagggttgtctttctggagagagatctggctaagttccaatgaatcttggattcatgctctgtgtcaggaagcgggaaacccaggaccttttgggacagcggtg

SEQ ID NO: 444378 - DNA, 140 bp, Artificial Sequence
  Synthetic
caccgctgtcccaaaaggtcctgggtttcccgcttcctgacacagagcatgaatccaagattcattggaacttagccagatctctctccagaaagacaacccttctgagacaggatctgacatatcagcagccagggcct

SEQ ID NO: 444379 - DNA, 140 bp, Artificial Sequence
  Synthetic
aggccctggctgctgatatgataatgagatgatcataaccctgatcgacagtgacgtagaatctttcctggttcacaagatggtagacgatctagaattacagagaggaactctgtctaagaccttttgggacagcggtg

SEQ ID NO: 444380 - DNA, 140 bp, Artificial Sequence
  Synthetic
caccgctgtcccaaaaggtcttagacagagttcctctctgtaattctagatcgtctaccatcttgtgaaccaggaaagattctacgtcactgtcgatcagggttatgatcatctcattatcatatcagcagccagggcct

SEQ ID NO: 444381 - DNA, 140 bp, Artificial Sequence
  Synthetic
aggccctggctgctgatatggacccatatgacaaatcccttcactcgagggtcttccctagcggaaaatgctcaggaataacggtgtcttctacctactgttcaactaaccatgattacagaccttttgggacagcggtg

SEQ ID NO: 444382 - DNA, 140 bp, Artificial Sequence
  Synthetic
caccgctgtcccaaaaggtctgtaatcatggttagttgaacagtaggtagaagacaccgttattcctgagcattttccgctagggaagaccctcgagtgaagggatttgtcatatgggtccatatcagcagccagggcct

SEQ ID NO: 444383 - DNA, 140 bp, Artificial Sequence
  Synthetic
atacgccatgctgggtctccaaaattccagaaccataagaagacagtttaggagaagtctctcgagaaacttagaggagtccttttataactcagagatccatgggctcaatcggatgaccgtacttgggagtcggccat

SEQ ID NO: 444384 - DNA, 140 bp, Artificial Sequence
  Synthetic
atggccgactcccaagtacggtcatccgattgagcccatggatctctgagttataaaaggactcctctaagtttctcgagagacttctcctaaactgtcttcttatggttctggaattttggagacccagcatggcgtat

SEQ ID NO: 444385 - DNA, 140 bp, Artificial Sequence
  Synthetic
atacgccatgctgggtctcctttgggcggtatctggctaacatatactcctcttatttattctttcacgtgatcaccctgtacatgaacgccttggactgggatgaggagaagaccatcccgtacttgggagtcggccat

SEQ ID NO: 444386 - DNA, 140 bp, Artificial Sequence
  Synthetic
atggccgactcccaagtacgggatggtcttctcctcatcccagtccaaggcgttcatgtacagggtgatcacgtgaaagaataaataagaggagtatatgttagccagataccgcccaaaggagacccagcatggcgtat

SEQ ID NO: 444387 - DNA, 140 bp, Artificial Sequence
  Synthetic
atacgccatgctgggtctcccaaaaatgtaacacccctacaatggatgccgacaagattgtattcagagtcaataatcaggtggtctccttgaagcccgagattattgtggatcaatatgcgtacttgggagtcggccat

SEQ ID NO: 444388 - DNA, 140 bp, Artificial Sequence
  Synthetic
atggccgactcccaagtacgcatattgatccacaataatctcgggcttcaaggagaccacctgattattgactctgaatacaatcttgtcggcatccattgtaggggtgttacatttttgggagacccagcatggcgtat

SEQ ID NO: 444389 - DNA, 140 bp, Artificial Sequence
  Synthetic
atacgccatgctgggtctccgaaagtcaccaatgttcatgtggtgaaaagagctctgtcactcaaggaatctataaactggttcattgctagaaactcaaatttggcacaaactttgatccgtacttgggagtcggccat

SEQ ID NO: 444390 - DNA, 140 bp, Artificial Sequence
  Synthetic
atggccgactcccaagtacggatcaaagtttgtgccaaatttgagtttctagcaatgaaccagtttatagattccttgagtgacagagctcttttcaccacatgaacattggtgactttcggagacccagcatggcgtat

SEQ ID NO: 444391 - DNA, 140 bp, Artificial Sequence
  Synthetic
atacgccatgctgggtctcccgaaacataatgtctctgacaggccctgacttccctctagaagaggcccccgtcttcaagaggacagggtctgccctgcataggttcaagtcagccagatcgtacttgggagtcggccat

SEQ ID NO: 444392 - DNA, 140 bp, Artificial Sequence
  Synthetic
atggccgactcccaagtacgatctggctgacttgaacctatgcagggcagaccctgtcctcttgaagacgggggcctcttctagagggaagtcagggcctgtcagagacattatgtttcgggagacccagcatggcgtat

SEQ ID NO: 444393 - DNA, 140 bp, Artificial Sequence
  Synthetic
aggccctggctgctgatatgcaatgcaattctttgaggggacatgccctgaagactggaatagctacgggatcttgattgcacgaaaaggagacaaaatcacccctgattctcttgtagagaccttttgggacagcggtg

SEQ ID NO: 444394 - DNA, 140 bp, Artificial Sequence
  Synthetic
caccgctgtcccaaaaggtctctacaagagaatcaggggtgattttgtctccttttcgtgcaatcaagatcccgtagctattccagtcttcagggcatgtcccctcaaagaattgcattgcatatcagcagccagggcct

SEQ ID NO: 444395 - DNA, 140 bp, Artificial Sequence
  Synthetic
aggccctggctgctgatatgaggtctcgggggttgacctgggtctcccgaactgggggaagtatgtatcactgagtgcaggggccctgactgccttgatgttgataattttcctaatggcgaccttttgggacagcggtg

SEQ ID NO: 444396 - DNA, 140 bp, Artificial Sequence
  Synthetic
caccgctgtcccaaaaggtcgccattaggaaaattatcaacatcaaggcagtcagggcccctgcactcagtgatacatacttcccccagttcgggagacccaggtcaacccccgagacctcatatcagcagccagggcct

SEQ ID NO: 444397 - DNA, 140 bp, Artificial Sequence
  Synthetic
aggccctggctgctgatatgctcttgagtctttataggttgagcaaaatatcgggacaaaacacaggcaactacaagacaaacattgcggacaggatagagcagattttcgagactgcccgaccttttgggacagcggtg

SEQ ID NO: 444398 - DNA, 140 bp, Artificial Sequence
  Synthetic
caccgctgtcccaaaaggtcgggcagtctcgaaaatctgctctatcctgtccgcaatgtttgtcttgtagttgcctgtgttttgtcccgatattttgctcaacctataaagactcaagagcatatcagcagccagggcct

SEQ ID NO: 444399 - DNA, 140 bp, Artificial Sequence
  Synthetic
atacgccatgctgggtctcctttccggagctgtacctcattttcgacaacttcctgatattcgtttgagaccaggtgacttcgaatctctaagtggtagggagaagtcacggcatataggcgtacttgggagtcggccat

SEQ ID NO: 444400 - DNA, 140 bp, Artificial Sequence
  Synthetic
atggccgactcccaagtacgcctatatgccgtgacttctccctaccacttagagattcgaagtcacctggtctcaaacgaatatcaggaagttgtcgaaaatgaggtacagctccggaaaggagacccagcatggcgtat

SEQ ID NO: 444401 - DNA, 140 bp, Artificial Sequence
  Synthetic
aggccctggctgctgatatgtcatgggagtcatataaaagcgggggtgagaccagactgtgaaggctggtcatcctttcaatgcttcaagttctgaaaatcacatccccttggggttggggaccttttgggacagcggtg

SEQ ID NO: 444402 - DNA, 140 bp, Artificial Sequence
  Synthetic
caccgctgtcccaaaaggtccccaaccccaaggggatgtgattttcagaacttgaagcattgaaaggatgaccagccttcacagtctggtctcacccccgcttttatatgactcccatgacatatcagcagccagggcct

SEQ ID NO: 444403 - DNA, 140 bp, Artificial Sequence
  Synthetic
aggccctggctgctgatatgcgatatgtttttctcccggattgaacatctgtattcagctattagagtgggtacagtcgtcactgcttatgaagactgctcagggctagtatcgtttacagaccttttgggacagcggtg

SEQ ID NO: 444404 - DNA, 140 bp, Artificial Sequence
  Synthetic
caccgctgtcccaaaaggtctgtaaacgatactagccctgagcagtcttcataagcagtgacgactgtacccactctaatagctgaatacagatgttcaatccgggagaaaaacatatcgcatatcagcagccagggcct

SEQ ID NO: 444405 - DNA, 140 bp, Artificial Sequence
  Synthetic
atacgccatgctgggtctccggtataatgatggaaccatatttcctgtcaacatatacagcaaggtctcccctagagactatctgagagggcttgcgagaggagttttgatagggtcctccgtacttgggagtcggccat

SEQ ID NO: 444406 - DNA, 140 bp, Artificial Sequence
  Synthetic
atggccgactcccaagtacggaggaccctatcaaaactcctctcgcaagccctctcagatagtctctaggggagaccttgctgtatatgttgacaggaaatatggttccatcattataccggagacccagcatggcgtat

SEQ ID NO: 444407 - DNA, 140 bp, Artificial Sequence
  Synthetic
aggccctggctgctgatatgtcatgtggattctcataatacgggagatctgctagcagtttcagtgaccaacggtgctttcattctccaaggcctgacaccagaggttgcggacatgccagaccttttgggacagcggtg

SEQ ID NO: 444408 - DNA, 140 bp, Artificial Sequence
  Synthetic
caccgctgtcccaaaaggtctggcatgtccgcaacctctggtgtcaggccttggagaatgaaagcaccgttggtcactgaaactgctagcagatctcccgtattatgagaatccacatgacatatcagcagccagggcct

SEQ ID NO: 444409 - DNA, 140 bp, Artificial Sequence
  Synthetic
atacgccatgctgggtctccccgtctttgtacataatgctcagagagccgtctcttagaggagagatattttctattccccaaaaagtccccgctgcttacccgactacaatgaaagaagcgtacttgggagtcggccat

SEQ ID NO: 444410 - DNA, 140 bp, Artificial Sequence
  Synthetic
atggccgactcccaagtacgcttctttcattgtagtcgggtaagcagcggggactttttggggaatagaaaatatctctcctctaagagacggctctctgagcattatgtacaaagacggggagacccagcatggcgtat

SEQ ID NO: 444411 - DNA, 140 bp, Artificial Sequence
  Synthetic
aggccctggctgctgatatgctcccataaaagacataaacaacagctcacaatcatcttacatctcagcaaagtgtgcataattataaagggctaggtcatccaaacttctcagtcgagagaccttttgggacagcggtg

SEQ ID NO: 444412 - DNA, 140 bp, Artificial Sequence
  Synthetic
caccgctgtcccaaaaggtctctcgactgagaagtttggatgacctagccctttataattatgcacactttgctgagatgtaagatgattgtgagctgttgtttatgtcttttatgggagcatatcagcagccagggcct

SEQ ID NO: 444413 - DNA, 140 bp, Artificial Sequence
  Synthetic
aggccctggctgctgatatgcaatcgagtcagagactgaacccaggggatcccccactgtccccaacatcttgaggaactctgactacaatctcaactctcctttgatagaagatcctgcgaccttttgggacagcggtg

SEQ ID NO: 444414 - DNA, 140 bp, Artificial Sequence
  Synthetic
caccgctgtcccaaaaggtcgcaggatcttctatcaaaggagagttgagattgtagtcagagttcctcaagatgttggggacagtgggggatcccctgggttcagtctctgactcgattgcatatcagcagccagggcct

SEQ ID NO: 444415 - DNA, 140 bp, Artificial Sequence
  Synthetic
atacgccatgctgggtctccctttgcgcaggacgaggtgggtagatcaagaggtacgccatgcagcgagaactatgacagggagttacagccctaataagaagatgccacgcaaggcaggcgtacttgggagtcggccat

SEQ ID NO: 444416 - DNA, 140 bp, Artificial Sequence
  Synthetic
atggccgactcccaagtacgcctgccttgcgtggcatcttcttattagggctgtaactccctgtcatagttctcgctgcatggcgtacctcttgatctacccacctcgtcctgcgcaaagggagacccagcatggcgtat

SEQ ID NO: 444417 - DNA, 140 bp, Artificial Sequence
  Synthetic
aggccctggctgctgatatgacctacaaagtgtgtatatccttcatgaaaaaaactaacacccctccttttgaaccatctcaacgatgagcaagatcttcgtcaatccgagtgcaatcaggaccttttgggacagcggtg

SEQ ID NO: 444418 - DNA, 140 bp, Artificial Sequence
  Synthetic
caccgctgtcccaaaaggtcctgattgcactcggattgacgaagatcttgctcatcgttgagatggttcaaaaggaggggtgttagtttttttcatgaaggatatacacactttgtaggtcatatcagcagccagggcct

SEQ ID NO: 444419 - DNA, 140 bp, Artificial Sequence
  Synthetic
atacgccatgctgggtctcccttcagaatccgttgatctccggcttgagagtagttcagtgggcgacaggggcccattataagctcaaacccattctggatgatctcaatgtcttcccatcgtacttgggagtcggccat

SEQ ID NO: 444420 - DNA, 140 bp, Artificial Sequence
  Synthetic
atggccgactcccaagtacgatgggaagacattgagatcatccagaatgggtttgagcttataatgggcccctgtcgcccactgaactactctcaagccggagatcaacggattctgaagggagacccagcatggcgtat

SEQ ID NO: 444421 - DNA, 140 bp, Artificial Sequence
  Synthetic
aggccctggctgctgatatggagaagctgttaaactgtacgctaggaaatagggggctgagaatccccccagagggggtgttaagttgccttgagagggtcgattatgataaggcatttggaccttttgggacagcggtg

SEQ ID NO: 444422 - DNA, 140 bp, Artificial Sequence
  Synthetic
caccgctgtcccaaaaggtccaaatgccttatcataatcgaccctctcaaggcaacttaacaccccctctggggggattctcagccccctatttcctagcgtacagtttaacagcttctccatatcagcagccagggcct

SEQ ID NO: 444423 - DNA, 140 bp, Artificial Sequence
  Synthetic
atacgccatgctgggtctccgtggacaatctccctgaggacatgaggcggcttcagttagatgatgggaagccgtcggacctcagtgagatggccccggcgggagagagcaagtatcgggcgtacttgggagtcggccat

SEQ ID NO: 444424 - DNA, 140 bp, Artificial Sequence
  Synthetic
atggccgactcccaagtacgcccgatacttgctctctcccgccggggccatctcactgaggtccgacggcttcccatcatctaactgaagccgcctcatgtcctcagggagattgtccacggagacccagcatggcgtat

SEQ ID NO: 444425 - DNA, 140 bp, Artificial Sequence
  Synthetic
aggccctggctgctgatatgattatggaaagatttaacctcagtggacatcgggaaggacttggtcaagttcaaagatcaaatatggggactgctgattgtgacaaaggactttgtttacgaccttttgggacagcggtg

SEQ ID NO: 444426 - DNA, 140 bp, Artificial Sequence
  Synthetic
caccgctgtcccaaaaggtcgtaaacaaagtcctttgtcacaatcagcagtccccatatttgatctttgaacttgaccaagtccttcccgatgtccactgaggttaaatctttccataatcatatcagcagccagggcct

SEQ ID NO: 444427 - DNA, 140 bp, Artificial Sequence
  Synthetic
aggccctggctgctgatatgcagaggttactgacattgcatcaatcaaccgaataaccctgctgatgtctgattttgcattgtccattgatggcccactttacctggttttcaaaacttagaccttttgggacagcggtg

SEQ ID NO: 444428 - DNA, 140 bp, Artificial Sequence
  Synthetic
caccgctgtcccaaaaggtctaagttttgaaaaccaggtaaagtgggccatcaatggacaatgcaaaatcagacatcagcagggttattcggttgattgatgcaatgtcagtaacctctgcatatcagcagccagggcct

SEQ ID NO: 444429 - DNA, 140 bp, Artificial Sequence
  Synthetic
atacgccatgctgggtctcctcatccgagatatacctccgattctcaaaacggggaaagttctttcgggatgcagaatatttgacctcttctactcttcgagaaatgagccttgtgttgtcgtacttgggagtcggccat

SEQ ID NO: 444430 - DNA, 140 bp, Artificial Sequence
  Synthetic
atggccgactcccaagtacgacaacacaaggctcatttctcgaagagtagaagaggtcaaatattctgcatcccgaaagaactttccccgttttgagaatcggaggtatatctcggatgaggagacccagcatggcgtat

SEQ ID NO: 444431 - DNA, 140 bp, Artificial Sequence
  Synthetic
atacgccatgctgggtctcctcaattgcagcagccctaagagtgagatgcagagggcccgctctctaaactaccaagatctggtgagaggatttccagatgagatcatatccaatccttacgtacttgggagtcggccat

SEQ ID NO: 444432 - DNA, 140 bp, Artificial Sequence
  Synthetic
atggccgactcccaagtacgtaaggattggatatgatctcatctggaaatcctctcaccagatcttggtagtttagagagcgggccctctgcatctcactcttagggctgctgcaattgaggagacccagcatggcgtat

SEQ ID NO: 444433 - DNA, 140 bp, Artificial Sequence
  Synthetic
aggccctggctgctgatatgagccagacaagttgaataaagttatgcaggatgatctaaatcgttatacatcttgctgacaatttttaaactcaggcctaccagactatagggcctgagcgaccttttgggacagcggtg

SEQ ID NO: 444434 - DNA, 140 bp, Artificial Sequence
  Synthetic
caccgctgtcccaaaaggtcgctcaggccctatagtctggtaggcctgagtttaaaaattgtcagcaagatgtataacgatttagatcatcctgcataactttattcaacttgtctggctcatatcagcagccagggcct

SEQ ID NO: 444435 - DNA, 140 bp, Artificial Sequence
  Synthetic
atacgccatgctgggtctcccagacccataacttattatttcagaaagcaagtcatccgggggaatgtttatctgtcctggagttggtccgatgacacttcagtatttaagagggtggcccgtacttgggagtcggccat

SEQ ID NO: 444436 - DNA, 140 bp, Artificial Sequence
  Synthetic
atggccgactcccaagtacgggccaccctcttaaatactgaagtgtcatcggaccaactccaggacagataaacattcccccggatgacttgctttctgaaataataagttatgggtctgggagacccagcatggcgtat

SEQ ID NO: 444437 - DNA, 140 bp, Artificial Sequence
  Synthetic
atacgccatgctgggtctcctgtcctagagtcgacatgaaaaaaacaggcaacaccactgataaaatgaactttctacgcaagatagtgaaaaactgtagggatgaggacactcaaaaaccgtacttgggagtcggccat

SEQ ID NO: 444438 - DNA, 140 bp, Artificial Sequence
  Synthetic
atggccgactcccaagtacggtttttgagtgtcctcatccctacagtttttcactatcttgcgtagaaagttcattttatcagtggtgttgcctgtttttttcatgtcgactctaggacaggagacccagcatggcgtat

SEQ ID NO: 444439 - DNA, 140 bp, Artificial Sequence
  Synthetic
aggccctggctgctgatatgcaggggctccggtccctgagggcatgaactgggtgtacaaattgaggagaactcttatcttccaatgggctgattctagaggtcccctcgagggggaggagaccttttgggacagcggtg

SEQ ID NO: 444440 - DNA, 140 bp, Artificial Sequence
  Synthetic
caccgctgtcccaaaaggtctcctccccctcgaggggacctctagaatcagcccattggaagataagagttctcctcaatttgtacacccagttcatgccctcagggaccggagcccctgcatatcagcagccagggcct

SEQ ID NO: 444441 - DNA, 140 bp, Artificial Sequence
  Synthetic
atacgccatgctgggtctccaggtagagagacaccttcgggggtacaacaggtggatcaccctcgatgacattaggtccagatcatctcttctagattatagctgcttgtaaaataggctcgtacttgggagtcggccat

SEQ ID NO: 444442 - DNA, 140 bp, Artificial Sequence
  Synthetic
atggccgactcccaagtacgagcctattttacaagcagctataatctagaagagatgatctggacctaatgtcatcgagggtgatccacctgttgtacccccgaaggtgtctctctacctggagacccagcatggcgtat

SEQ ID NO: 444443 - DNA, 140 bp, Artificial Sequence
  Synthetic
atacgccatgctgggtctccctctcgaaggagtgtacagaccaaaactcttggactatataccctgaaaaaaacgaaatcccgatccgtaacctctgtttacttgattgtgtttttcatccgtacttgggagtcggccat

SEQ ID NO: 444444 - DNA, 140 bp, Artificial Sequence
  Synthetic
atggccgactcccaagtacggatgaaaaacacaatcaagtaaacagaggttacggatcgggatttcgtttttttcagggtatatagtccaagagttttggtctgtacactccttcgagagggagacccagcatggcgtat

SEQ ID NO: 444445 - DNA, 140 bp, Artificial Sequence
  Synthetic
atacgccatgctgggtctcctttctggggctgtgcctcacttccagaagcttcctgatatccgtctgagaccaggtgattttgaatctctaagtggtagagaaaagtcccgccatataggcgtacttgggagtcggccat

SEQ ID NO: 444446 - DNA, 140 bp, Artificial Sequence
  Synthetic
atggccgactcccaagtacgcctatatggcgggacttttctctaccacttagagattcaaaatcacctggtctcagacggatatcaggaagcttctggaagtgaggcacagccccagaaaggagacccagcatggcgtat

SEQ ID NO: 444447 - DNA, 140 bp, Artificial Sequence
  Synthetic
aggccctggctgctgatatgaaactcggcccctggagtcccatcgatatacatcacctcagctgtccgaacaatctggttgtggaggacgaaggatgtaccaatctgtcaggattctcatgaccttttgggacagcggtg

SEQ ID NO: 444448 - DNA, 140 bp, Artificial Sequence
  Synthetic
caccgctgtcccaaaaggtcatgagaatcctgacagattggtacatccttcgtcctccacaaccagattgttcggacagctgaggtgatgtatatcgatgggactccaggggccgagtttcatatcagcagccagggcct

SEQ ID NO: 444449 - DNA, 140 bp, Artificial Sequence
  Synthetic
atacgccatgctgggtctcccaatctggttgtggaggacgaaggatgtaccaatctgtcaggattctcatacatggagcttaaagtaggatatatttcggccataaaggtgaacgggttccgtacttgggagtcggccat

SEQ ID NO: 444450 - DNA, 140 bp, Artificial Sequence
  Synthetic
atggccgactcccaagtacggaacccgttcacctttatggccgaaatatatcctactttaagctccatgtatgagaatcctgacagattggtacatccttcgtcctccacaaccagattgggagacccagcatggcgtat

SEQ ID NO: 444451 - DNA, 140 bp, Artificial Sequence
  Synthetic
atacgccatgctgggtctccatgaatggaggcaggctaaaaagatcacacataaggagatatgtctcagttagttccaatcatcaagctcgccctaattcattcgctgagtttctaaacacgtacttgggagtcggccat

SEQ ID NO: 444452 - DNA, 140 bp, Artificial Sequence
  Synthetic
atggccgactcccaagtacgtgtttagaaactcagcgaatgaattagggcgagcttgatgattggaactaactgagacatatctccttatgtgtgatctttttagcctgcctccattcatggagacccagcatggcgtat

SEQ ID NO: 444453 - DNA, 140 bp, Artificial Sequence
  Synthetic
aggccctggctgctgatatgacccgtacgataaatcacttcattcgagagtttttcctagaggaaaatgctcaggaataacggtgtcttctgcctactgctctaccaaccatgattatacgaccttttgggacagcggtg

SEQ ID NO: 444454 - DNA, 140 bp, Artificial Sequence
  Synthetic
caccgctgtcccaaaaggtcgtataatcatggttggtagagcagtaggcagaagacaccgttattcctgagcattttcctctaggaaaaactctcgaatgaagtgatttatcgtacgggtcatatcagcagccagggcct

SEQ ID NO: 444455 - DNA, 140 bp, Artificial Sequence
  Synthetic
atacgccatgctgggtctcctctcagaccctgtctctgaagggttgtctttctggagagagatctggttaagctcccacgagtcctggattcacgcgttgtgtcaagaagctgggaaccccgtacttgggagtcggccat

SEQ ID NO: 444456 - DNA, 140 bp, Artificial Sequence
  Synthetic
atggccgactcccaagtacggggttcccagcttcttgacacaacgcgtgaatccaggactcgtgggagcttaaccagatctctctccagaaagacaacccttcagagacagggtctgagaggagacccagcatggcgtat

SEQ ID NO: 444457 - DNA, 140 bp, Artificial Sequence
  Synthetic
atacgccatgctgggtctcccagttcctcacccttctgagatgttggggttacttcccaaatcctccatttcttgcacttgtggagcaacaggaggaggcaatcctagagtttctgtatccgtacttgggagtcggccat

SEQ ID NO: 444458 - DNA, 140 bp, Artificial Sequence
  Synthetic
atggccgactcccaagtacggatacagaaactctaggattgcctcctcctgttgctccacaagtgcaagaaatggaggatttgggaagtaaccccaacatctcagaagggtgaggaactgggagacccagcatggcgtat

SEQ ID NO: 444459 - DNA, 140 bp, Artificial Sequence
  Synthetic
aggccctggctgctgatatgtcttgcacttgtggagcaacaggaggaggcaatcctagagtttctgtatcagtactcccgtccttcgatcagtcatttttttcaagaggccccctaaagggaccttttgggacagcggtg

SEQ ID NO: 444460 - DNA, 140 bp, Artificial Sequence
  Synthetic
caccgctgtcccaaaaggtccctttagggggcctcttgaaaaaaatgactgatcgaaggacgggagtactgatacagaaactctaggattgcctcctcctgttgctccacaagtgcaagacatatcagcagccagggcct

SEQ ID NO: 444461 - DNA, 140 bp, Artificial Sequence
  Synthetic
aggccctggctgctgatatgtgttgccgaaggactaatagagcagaatcaatacaacacagtcttggagagacagggaggaaagtgtcggtgacctcccaaagcgggagggtcatatcttgaccttttgggacagcggtg

SEQ ID NO: 444462 - DNA, 140 bp, Artificial Sequence
  Synthetic
caccgctgtcccaaaaggtcaagatatgaccctcccgctttgggaggtcaccgacactttcctccctgtctctccaagactgtgttgtattgattctgctctattagtccttcggcaacacatatcagcagccagggcct

SEQ ID NO: 444463 - DNA, 140 bp, Artificial Sequence
  Synthetic
aggccctggctgctgatatgatctataaactggttcattactagaaattccaacctggctcaaaccctaattaggaacattatgtctctgacaggccccgatttccctctagaggaggctgaccttttgggacagcggtg

SEQ ID NO: 444464 - DNA, 140 bp, Artificial Sequence
  Synthetic
caccgctgtcccaaaaggtcagcctcctctagagggaaatcggggcctgtcagagacataatgttcctaattagggtttgagccaggttggaatttctagtaatgaaccagtttatagatcatatcagcagccagggcct

SEQ ID NO: 444465 - DNA, 140 bp, Artificial Sequence
  Synthetic
aggccctggctgctgatatgatctccttcatatttcaagtcccgaggatcccatccccttgaggtgaaggggacatctctggattcaatggtcctctttggactcctcacaacagggtaggaccttttgggacagcggtg

SEQ ID NO: 444466 - DNA, 140 bp, Artificial Sequence
  Synthetic
caccgctgtcccaaaaggtcctaccctgttgtgaggagtccaaagaggaccattgaatccagagatgtccccttcacctcaaggggatgggatcctcgggacttgaaatatgaaggagatcatatcagcagccagggcct

SEQ ID NO: 444467 - DNA, 140 bp, Artificial Sequence
  Synthetic
atacgccatgctgggtctccttgaggaactctgactataatctcaactctcctctaatagaggatcctgccaaattaatgttagaatggttgaagacaggaaatagaccttaccggatgacgtacttgggagtcggccat

SEQ ID NO: 444468 - DNA, 140 bp, Artificial Sequence
  Synthetic
atggccgactcccaagtacgtcatccggtaaggtctatttcctgtcttcaaccattctaacattaatttggcaggatcctctattagaggagagttgagattatagtcagagttcctcaaggagacccagcatggcgtat

SEQ ID NO: 444469 - DNA, 140 bp, Artificial Sequence
  Synthetic
aggccctggctgctgatatgaatgatctccctttggttgtatggtgctcactctgaatcaaacaggagccggaaatgtataactgacttggcccatttttattccaagtcctcccccatagaccttttgggacagcggtg

SEQ ID NO: 444470 - DNA, 140 bp, Artificial Sequence
  Synthetic
caccgctgtcccaaaaggtctatgggggaggacttggaataaaaatgggccaagtcagttatacatttccggctcctgtttgattcagagtgagcaccatacaaccaaagggagatcattcatatcagcagccagggcct

SEQ ID NO: 444471 - DNA, 140 bp, Artificial Sequence
  Synthetic
atacgccatgctgggtctccggaaatgtataactgacttggcccatttttattccaagtcctcccccatagagaagctgttgaattgcacacttggaaatagagggctaagaatccctcccgtacttgggagtcggccat

SEQ ID NO: 444472 - DNA, 140 bp, Artificial Sequence
  Synthetic
atggccgactcccaagtacgggagggattcttagccctctatttccaagtgtgcaattcaacagcttctctatgggggaggacttggaataaaaatgggccaagtcagttatacatttccggagacccagcatggcgtat

SEQ ID NO: 444473 - DNA, 140 bp, Artificial Sequence
  Synthetic
aggccctggctgctgatatgccctcaaaggacccaaaggaagatgatccctcaggctcttctgtatgtgcctctcctgatcccctcgttgtgtttcgggggattccccatctacacgatagaccttttgggacagcggtg

SEQ ID NO: 444474 - DNA, 140 bp, Artificial Sequence
  Synthetic
caccgctgtcccaaaaggtctatcgtgtagatggggaatcccccgaaacacaacgaggggatcaggagaggcacatacagaagagcctgagggatcatcttcctttgggtcctttgagggcatatcagcagccagggcct

SEQ ID NO: 444475 - DNA, 140 bp, Artificial Sequence
  Synthetic
aggccctggctgctgatatgatccctctgtcttgtagttggagacgggtcaggggggatctcaagggcagtcctcaacatgttcccagatgctaaacttgtgttcaacagccttttagaggaccttttgggacagcggtg

SEQ ID NO: 444476 - DNA, 140 bp, Artificial Sequence
  Synthetic
caccgctgtcccaaaaggtcctctaaaaggctgttgaacacaagtttagcatctgggaacatgttgaggactgcccttgagatcccccctgacccgtctccaactacaagacagagggatcatatcagcagccagggcct

SEQ ID NO: 444477 - DNA, 140 bp, Artificial Sequence
  Synthetic
atacgccatgctgggtctccgttttttcgggttttggatcaattcgacaacatacatgacctagtctttgtgtatggctgttatagacattgggggcatccttatatagattataggaagcgtacttgggagtcggccat

SEQ ID NO: 444478 - DNA, 140 bp, Artificial Sequence
  Synthetic
atggccgactcccaagtacgcttcctataatctatataaggatgcccccaatgtctataacagccatacacaaagactaggtcatgtatgttgtcgaattgatccaaaacccgaaaaaacggagacccagcatggcgtat

SEQ ID NO: 444479 - DNA, 140 bp, Artificial Sequence
  Synthetic
aggccctggctgctgatatgggggatttgacaagtactctaaatggtatattgactcacgattgctccccagagaccaccccttgactccttatataaaaactcagacatggccacccaagaccttttgggacagcggtg

SEQ ID NO: 444480 - DNA, 140 bp, Artificial Sequence
  Synthetic
caccgctgtcccaaaaggtcttgggtggccatgtctgagtttttatataaggagtcaaggggtggtctctggggagcaatcgtgagtcaatataccatttagagtacttgtcaaatcccccatatcagcagccagggcct

SEQ ID NO: 444481 - DNA, 140 bp, Artificial Sequence
  Synthetic
atacgccatgctgggtctccagagaccaccccttgactccttatataaaaactcagacatggccacccaaacatgtagtagatttggtaggggacacatggcacaggctaccaatcacaccgtacttgggagtcggccat

SEQ ID NO: 444482 - DNA, 140 bp, Artificial Sequence
  Synthetic
atggccgactcccaagtacggtgtgattggtagcctgtgccatgtgtcccctaccaaatctactacatgtttgggtggccatgtctgagtttttatataaggagtcaaggggtggtctctggagacccagcatggcgtat

SEQ ID NO: 444483 - DNA, 140 bp, Artificial Sequence
  Synthetic
atacgccatgctgggtctcctagaggggggcctgttcctagtgagaaggtcattatcacagctctgtccaagccgcctgtcaatcctagagagtttttaaaatctatcgacctcggaggacgtacttgggagtcggccat

SEQ ID NO: 444484 - DNA, 140 bp, Artificial Sequence
  Synthetic
atggccgactcccaagtacgtcctccgaggtcgatagattttaaaaactctctaggattgacaggcggcttggacagagctgtgataatgaccttctcactaggaacaggcccccctctaggagacccagcatggcgtat

SEQ ID NO: 444485 - DNA, 140 bp, Artificial Sequence
  Synthetic
atacgccatgctgggtctcctccctcatgattcttctttctcctccggaacctagatattcggatgacctgatatctcagttgtgtcagctatatatcgccggagatcatgtcttgtccacgtacttgggagtcggccat

SEQ ID NO: 444486 - DNA, 140 bp, Artificial Sequence
  Synthetic
atggccgactcccaagtacgtggacaagacatgatctccggcgatatatagctgacacaactgagatatcaggtcatccgaatatctaggttccggaggagaaagaagaatcatgagggaggagacccagcatggcgtat

SEQ ID NO: 444487 - DNA, 140 bp, Artificial Sequence
  Synthetic
aggccctggctgctgatatgacttcgttatcaccgaaaagctcttagctaattatatcttgccactctttgatgcgctgactatgacagacaacctgaacaaggtgtttaaaaagttgatgaccttttgggacagcggtg

SEQ ID NO: 444488 - DNA, 140 bp, Artificial Sequence
  Synthetic
caccgctgtcccaaaaggtcatcaactttttaaacaccttgttcaggttgtctgtcatagtcagcgcatcaaagagtggcaagatataattagctaagagcttttcggtgataacgaagtcatatcagcagccagggcct

SEQ ID NO: 444489 - DNA, 140 bp, Artificial Sequence
  Synthetic
aggccctggctgctgatatgcttttcacctagactatgagaagtggaacaatcatcaacggtcagagtcgacagaagatgtattttccgtcctagatcaggtgtttggattaaagagggtgaccttttgggacagcggtg

SEQ ID NO: 444490 - DNA, 140 bp, Artificial Sequence
  Synthetic
caccgctgtcccaaaaggtcaccctctttaatccaaacacctgatctaggacggaaaatacatcttctgtcgactctgaccgttgatgattgttccacttctcatagtctaggtgaaaagcatatcagcagccagggcct

SEQ ID NO: 444491 - DNA, 140 bp, Artificial Sequence
  Synthetic
aggccctggctgctgatatgcaggttctatgtccgacatatatgttgtctcctgggctgtcgagagaagggcttctttatgaactggagagcatatcaagaaatgccctatcaatataccgaccttttgggacagcggtg

SEQ ID NO: 444492 - DNA, 140 bp, Artificial Sequence
  Synthetic
caccgctgtcccaaaaggtcggtatattgatagggcatttcttgatatgctctccagttcataaagaagcccttctctcgacagcccaggagacaacatatatgtcggacatagaacctgcatatcagcagccagggcct

SEQ ID NO: 444493 - DNA, 140 bp, Artificial Sequence
  Synthetic
aggccctggctgctgatatgagaatcttgtgtgatgtgtcttgaaaaaaacaagatcttgaatctgagcctctggttgtttgattgtttttcccatctttattgtttttttgttaagcgtgaccttttgggacagcggtg

SEQ ID NO: 444494 - DNA, 140 bp, Artificial Sequence
  Synthetic
caccgctgtcccaaaaggtcacgcttaacaaaaaaacaataaagatgggaaaaacaatcaaacaaccagaggctcagattcaagatcttgtttttttcaagacacatcacacaagattctcatatcagcagccagggcct

SEQ ID NO: 444495 - DNA, 140 bp, Artificial Sequence
  Synthetic
aggccctggctgctgatatgtatgagagactttttgcttatgtcagtgcaggcagtctttcattacttgctgtttagccccatcttaaaaggcagagtctacaaaattctaagtgctgaggaccttttgggacagcggtg

SEQ ID NO: 444496 - DNA, 140 bp, Artificial Sequence
  Synthetic
caccgctgtcccaaaaggtcctcagcacttagaattttgtagactctgccttttaagatggggctaaacagcaagtaatgaaagactgcctgcactgacataagcaaaaagtctctcatacatatcagcagccagggcct

SEQ ID NO: 444497 - DNA, 140 bp, Artificial Sequence
  Synthetic
aggccctggctgctgatatgtctcagatcctgtctcagaagggttgtccttctggagagagatttggctgagctctcacgagtcttggattcacgccttgtgtcaggaggcagggaacccgaccttttgggacagcggtg

SEQ ID NO: 444498 - DNA, 140 bp, Artificial Sequence
  Synthetic
caccgctgtcccaaaaggtcgggttccctgcctcctgacacaaggcgtgaatccaagactcgtgagagctcagccaaatctctctccagaaggacaacccttctgagacaggatctgagacatatcagcagccagggcct

SEQ ID NO: 444499 - DNA, 140 bp, Artificial Sequence
  Synthetic
aggccctggctgctgatatgacaaaactctcggacgatcagaaggcagtttagaaaaagcctctcaagaactttggaggagtccttttacaactcagagatccatggaatcaaccggatggaccttttgggacagcggtg

SEQ ID NO: 444500 - DNA, 140 bp, Artificial Sequence
  Synthetic
caccgctgtcccaaaaggtccatccggttgattccatggatctctgagttgtaaaaggactcctccaaagttcttgagaggctttttctaaactgccttctgatcgtccgagagttttgtcatatcagcagccagggcct

SEQ ID NO: 444501 - DNA, 140 bp, Artificial Sequence
  Synthetic
atacgccatgctgggtctcctcttgtacttgtggagcaacaggaggagggaatcctagagtttcagtgtctgtgcttccgtcctttgatcagtcatccttttcaagaggccctctaaaggcgtacttgggagtcggccat

SEQ ID NO: 444502 - DNA, 140 bp, Artificial Sequence
  Synthetic
atggccgactcccaagtacgcctttagagggcctcttgaaaaggatgactgatcaaaggacggaagcacagacactgaaactctaggattccctcctcctgttgctccacaagtacaagaggagacccagcatggcgtat

SEQ ID NO: 444503 - DNA, 140 bp, Artificial Sequence
  Synthetic
aggccctggctgctgatatgctgaaagacctttttctgtctcggttcaactctctaatgattcttctttctcctccagaacccagatattcagatgacctgatatctcagctgtgtcagcgaccttttgggacagcggtg

SEQ ID NO: 444504 - DNA, 140 bp, Artificial Sequence
  Synthetic
caccgctgtcccaaaaggtcgctgacacagctgagatatcaggtcatctgaatatctgggttctggaggagaaagaagaatcattagagagttgaaccgagacagaaaaaggtctttcagcatatcagcagccagggcct

SEQ ID NO: 444505 - DNA, 140 bp, Artificial Sequence
  Synthetic
atacgccatgctgggtctcctagggggagtgtctgggatgtctcttggaaggttccacatacgtcagttctcagatcctgtctcagaagggttgtctttctggagagagatctggctaagcgtacttgggagtcggccat

SEQ ID NO: 444506 - DNA, 140 bp, Artificial Sequence
  Synthetic
atggccgactcccaagtacgcttagccagatctctctccagaaagacaacccttctgagacaggatctgagaactgacgtatgtggaaccttccaagagacatcccagacactccccctaggagacccagcatggcgtat

SEQ ID NO: 444507 - DNA, 140 bp, Artificial Sequence
  Synthetic
aggccctggctgctgatatggccggtctggccgatcttgagatggctgaagagactgttgatctgattaatagaaacatagaagacaatcaggctcacctccagggagaacctatagaaggaccttttgggacagcggtg

SEQ ID NO: 444508 - DNA, 140 bp, Artificial Sequence
  Synthetic
caccgctgtcccaaaaggtccttctataggttctccctggaggtgagcctgattgtcttctatgtttctattaatcagatcaacagtctcttcagccatctcaagatcggccagaccggccatatcagcagccagggcct

SEQ ID NO: 444509 - DNA, 140 bp, Artificial Sequence
  Synthetic
atacgccatgctgggtctcctgcaatcagaaaagccctgtatgatgaggtagacaaggtggagaattcagagtttagagaagctatcctcttgtccaagacccatagggataactttatacgtacttgggagtcggccat

SEQ ID NO: 444510 - DNA, 140 bp, Artificial Sequence
  Synthetic
atggccgactcccaagtacgtataaagttatccctatgggtcttggacaagaggatagcttctctaaactctgaattctccaccttgtctacctcatcatacagggcttttctgattgcaggagacccagcatggcgtat

SEQ ID NO: 444511 - DNA, 140 bp, Artificial Sequence
  Synthetic
atacgccatgctgggtctccccttcggtgcaacaggtgtgtgaggccaatagacgacataacactggagacttctcagatcttcgagttcccggatgtttcgaaaagaatatccagaatgcgtacttgggagtcggccat

SEQ ID NO: 444512 - DNA, 140 bp, Artificial Sequence
  Synthetic
atggccgactcccaagtacgcattctggatattcttttcgaaacatccgggaactcgaagatctgagaagtctccagtgttatgtcgtctattggcctcacacacctgttgcaccgaaggggagacccagcatggcgtat

SEQ ID NO: 444513 - DNA, 140 bp, Artificial Sequence
  Synthetic
aggccctggctgctgatatggcagctagaactatgactagagatcacagccccaacaagaaagtatctcgcaagacaggatgttcagaatgggtctgctctgcccaacaagttgcagtctgaccttttgggacagcggtg

SEQ ID NO: 444514 - DNA, 140 bp, Artificial Sequence
  Synthetic
caccgctgtcccaaaaggtcagactgcaacttgttgggcagagcagacccattctgaacatcctgtcttgcgagatactttcttgttggggctgtgatctctagtcatagttctagctgccatatcagcagccagggcct

SEQ ID NO: 444515 - DNA, 140 bp, Artificial Sequence
  Synthetic
atacgccatgctgggtctccgtccctcacccctctgagatgttggggttgcttcccaagtcctcgatttcctgcacttgtggagtcacagggggtggaaatcctagaatatcagtgtctgcgtacttgggagtcggccat

SEQ ID NO: 444516 - DNA, 140 bp, Artificial Sequence
  Synthetic
atggccgactcccaagtacgcagacactgatattctaggatttccaccccctgtgactccacaagtgcaggaaatcgaggacttgggaagcaaccccaacatctcagaggggtgagggacggagacccagcatggcgtat

SEQ ID NO: 444517 - DNA, 140 bp, Artificial Sequence
  Synthetic
aggccctggctgctgatatgcatccgagctatacctcagattctcaaaacgaggaaaattctttcgggatgcagaatatttgacatcctctactcttcgagaaatgagcctagtactgttgaccttttgggacagcggtg

SEQ ID NO: 444518 - DNA, 140 bp, Artificial Sequence
  Synthetic
caccgctgtcccaaaaggtcaacagtactaggctcatttctcgaagagtagaggatgtcaaatattctgcatcccgaaagaattttcctcgttttgagaatctgaggtatagctcggatgcatatcagcagccagggcct

SEQ ID NO: 444519 - DNA, 140 bp, Artificial Sequence
  Synthetic
aggccctggctgctgatatggcgtaacccgtttggcccatgacggatccaaactccccctaagatgtgtactgggatgggtcgctctggccaattctaagaaattccaattgttagtcgagaccttttgggacagcggtg

SEQ ID NO: 444520 - DNA, 140 bp, Artificial Sequence
  Synthetic
caccgctgtcccaaaaggtctcgactaacaattggaatttcttagaattggccagagcgacccatcccagtacacatcttagggggagtttggatccgtcatgggccaaacgggttacgccatatcagcagccagggcct

SEQ ID NO: 444521 - DNA, 140 bp, Artificial Sequence
  Synthetic
atacgccatgctgggtctccaatttggttgtggaggacgaggggtgcaccagtctgtcagggttttcttacatggaactgaaggtgggatacatctctgccataaaggtgaacgggttcacgtacttgggagtcggccat

SEQ ID NO: 444522 - DNA, 140 bp, Artificial Sequence
  Synthetic
atggccgactcccaagtacgtgaacccgttcacctttatggcagagatgtatcccaccttcagttccatgtaagaaaaccctgacagactggtgcacccctcgtcctccacaaccaaattggagacccagcatggcgtat

SEQ ID NO: 444523 - DNA, 140 bp, Artificial Sequence
  Synthetic
atacgccatgctgggtctcctgactttatgtttcaacccttgatgctttatgcgcaaacatggacatcggaactggtgcagagagacacacggctgaaagactccacttttcattggcatcgtacttgggagtcggccat

SEQ ID NO: 444524 - DNA, 140 bp, Artificial Sequence
  Synthetic
atggccgactcccaagtacgatgccaatgaaaagtggagtctttcagccgtgtgtctctctgcaccagttccgatgtccatgtttgcgcataaagcatcaagggttgaaacataaagtcaggagacccagcatggcgtat

SEQ ID NO: 444525 - DNA, 140 bp, Artificial Sequence
  Synthetic
atacgccatgctgggtctccctctctgcgtagaacgaggtgggtggatcaagaagtgcgccatgcagccagaactatgacgggggattacagccccaataagaagatgtcacgcaaggcgcgtacttgggagtcggccat

SEQ ID NO: 444526 - DNA, 140 bp, Artificial Sequence
  Synthetic
atggccgactcccaagtacgcgccttgcgtgacatcttcttattggggctgtaatcccccgtcatagttctggctgcatggcgcacttcttgatccacccacctcgttctacgcagagagggagacccagcatggcgtat

SEQ ID NO: 444527 - DNA, 140 bp, Artificial Sequence
  Synthetic
aggccctggctgctgatatgaccgtcaacttccccaatcctctaggaaggtctttggaagataaatcaacccagactactggccgagagcccaagaaggagacaacatctactcattctcgaccttttgggacagcggtg

SEQ ID NO: 444528 - DNA, 140 bp, Artificial Sequence
  Synthetic
caccgctgtcccaaaaggtcgagaatgagtagatgttgtctccttcttgggctctcggccagtagtctgggttgatttatcttccaaagaccttcctagaggattggggaagttgacggtcatatcagcagccagggcct

SEQ ID NO: 444529 - DNA, 140 bp, Artificial Sequence
  Synthetic
aggccctggctgctgatatggtgaatgacctgatggcatccggaacacatccgttgcctccctcagccatcatgagtggaggagatgatattgtctccagagtcatagacttcgactcaagaccttttgggacagcggtg

SEQ ID NO: 444530 - DNA, 140 bp, Artificial Sequence
  Synthetic
caccgctgtcccaaaaggtcttgagtcgaagtctatgactctggagacaatatcatctcctccactcatgatggctgagggaggcaacggatgtgttccggatgccatcaggtcattcaccatatcagcagccagggcct

SEQ ID NO: 444531 - DNA, 140 bp, Artificial Sequence
  Synthetic
aggccctggctgctgatatgtgttatggtgccattaaaccgctgcatttcatcaaagtcaagttaattacctttacattttgagcctcttggatgtgaaaaaaactattaacatccctcagaccttttgggacagcggtg

SEQ ID NO: 444532 - DNA, 140 bp, Artificial Sequence
  Synthetic
caccgctgtcccaaaaggtctgagggatgttaatagtttttttcacatccaagaggctcaaaatgtaaaggtaattaacttgactttgatgaaatgcagcggtttaatggcaccataacacatatcagcagccagggcct

SEQ ID NO: 444533 - DNA, 140 bp, Artificial Sequence
  Synthetic
aggccctggctgctgatatgtgcagaagtcactgacatagcatcaatcaatcggataacactgttgatgtccgacttcgcattgtcaatagacggcccactgtatctggtcttcaaaactgaccttttgggacagcggtg

SEQ ID NO: 444534 - DNA, 140 bp, Artificial Sequence
  Synthetic
caccgctgtcccaaaaggtcagttttgaagaccagatacagtgggccgtctattgacaatgcgaagtcggacatcaacagtgttatccgattgattgatgctatgtcagtgacttctgcacatatcagcagccagggcct

SEQ ID NO: 444535 - DNA, 140 bp, Artificial Sequence
  Synthetic
aggccctggctgctgatatgtcaggtcctgtccatgtgtggaaactccggatatgaagtcatcaaaatattggagccatatgttgtgaacagtttagtccagagagcagaaaagtttagggaccttttgggacagcggtg

SEQ ID NO: 444536 - DNA, 140 bp, Artificial Sequence
  Synthetic
caccgctgtcccaaaaggtccctaaacttttctgctctctggactaaactgttcacaacatatggctccaatattttgatgacttcatatccggagtttccacacatggacaggacctgacatatcagcagccagggcct

SEQ ID NO: 444537 - DNA, 140 bp, Artificial Sequence
  Synthetic
aggccctggctgctgatatgtctcatccgaactatacctccgattttccaagcgaggaaaattcttccgagatgccgagtacttaacttcttctacccttcgagagatgagcctcgtcttgaccttttgggacagcggtg

SEQ ID NO: 444538 - DNA, 140 bp, Artificial Sequence
  Synthetic
caccgctgtcccaaaaggtcaagacgaggctcatctctcgaagggtagaagaagttaagtactcggcatctcggaagaattttcctcgcttggaaaatcggaggtatagttcggatgagacatatcagcagccagggcct

SEQ ID NO: 444539 - DNA, 140 bp, Artificial Sequence
  Synthetic
atacgccatgctgggtctccggttcataagatggtagatgacctagaattacaaagagggactttatctaagatggctgtcattatagccattatgatagttttctccaatagagttttccgtacttgggagtcggccat

SEQ ID NO: 444540 - DNA, 140 bp, Artificial Sequence
  Synthetic
atggccgactcccaagtacggaaaactctattggagaaaactatcataatggctataatgacagccatcttagataaagtccctctttgtaattctaggtcatctaccatcttatgaaccggagacccagcatggcgtat

SEQ ID NO: 444541 - DNA, 140 bp, Artificial Sequence
  Synthetic
atacgccatgctgggtctccaataggcctataacttattactttaagaagcaggttattcgagggagtatttatctgtcttggagttggtctgacgatacctcagtgttcaagagggtggcgtacttgggagtcggccat

SEQ ID NO: 444542 - DNA, 140 bp, Artificial Sequence
  Synthetic
atggccgactcccaagtacgccaccctcttgaacactgaggtatcgtcagaccaactccaagacagataaatactccctcgaataacctgcttcttaaagtaataagttataggcctattggagacccagcatggcgtat

SEQ ID NO: 444543 - DNA, 140 bp, Artificial Sequence
  Synthetic
aggccctggctgctgatatgtgcagacatcaaatgagaccaaatggtgtcctcccgatcagttggttaatctgcacgaccttcgctcagatgaaatcgagcatcttgttatagaggaattgaccttttgggacagcggtg

SEQ ID NO: 444544 - DNA, 140 bp, Artificial Sequence
  Synthetic
caccgctgtcccaaaaggtcaattcctctataacaagatgctcgatttcatctgagcgaaggtcgtgcagattaaccaactgatcgggaggacaccatttggtctcatttgatgtctgcacatatcagcagccagggcct

SEQ ID NO: 444545 - DNA, 140 bp, Artificial Sequence
  Synthetic
aggccctggctgctgatatgagaggtggtgagacatcttcaagggtataacaggtggattaccctcgaggacatcagatctagatcatctctattagactacagctgcttatgaactgaagaccttttgggacagcggtg

SEQ ID NO: 444546 - DNA, 140 bp, Artificial Sequence
  Synthetic
caccgctgtcccaaaaggtcttcagttcataagcagctgtagtctaatagagatgatctagatctgatgtcctcgagggtaatccacctgttatacccttgaagatgtctcaccacctctcatatcagcagccagggcct

SEQ ID NO: 444547 - DNA, 140 bp, Artificial Sequence
  Synthetic
aggccctggctgctgatatgcattattggggcttgtaaataccgaaactcttaggcgatgcaccttgaaaaaaacaagatctcaaatcagaacctctggttgcttgattatttttttcatgaccttttgggacagcggtg

SEQ ID NO: 444548 - DNA, 140 bp, Artificial Sequence
  Synthetic
caccgctgtcccaaaaggtcatgaaaaaaataatcaagcaaccagaggttctgatttgagatcttgtttttttcaaggtgcatcgcctaagagtttcggtatttacaagccccaataatgcatatcagcagccagggcct

SEQ ID NO: 444549 - DNA, 140 bp, Artificial Sequence
  Synthetic
aggccctggctgctgatatgagtctcaggggttgacctgggtctcccgaactggggggagtatgtattactaagtgcagggaccttgattgccttgatgttgataattttcctaatgacagaccttttgggacagcggtg

SEQ ID NO: 444550 - DNA, 140 bp, Artificial Sequence
  Synthetic
caccgctgtcccaaaaggtctgtcattaggaaaattatcaacatcaaggcaatcaaggtccctgcacttagtaatacatactccccccagttcgggagacccaggtcaacccctgagactcatatcagcagccagggcct

SEQ ID NO: 444551 - DNA, 140 bp, Artificial Sequence
  Synthetic
atacgccatgctgggtctccctctcgaaggagtgtacagaccgaaacccttggacgatataccctgaaaaaaacaagatcctgatccgtaacctctgtttacttgattgtgtttttcatccgtacttgggagtcggccat

SEQ ID NO: 444552 - DNA, 140 bp, Artificial Sequence
  Synthetic
atggccgactcccaagtacggatgaaaaacacaatcaagtaaacagaggttacggatcaggatcttgtttttttcagggtatatcgtccaagggtttcggtctgtacactccttcgagagggagacccagcatggcgtat

SEQ ID NO: 444553 - DNA, 140 bp, Artificial Sequence
  Synthetic
aggccctggctgctgatatgtgttgtagaaaagtcgatcggccagaatctacacaacgcagtctcagagggacaggaaggaatgtgtcagtcacctcccaaagcgggaaattcataccttgaccttttgggacagcggtg

SEQ ID NO: 444554 - DNA, 140 bp, Artificial Sequence
  Synthetic
caccgctgtcccaaaaggtcaaggtatgaatttcccgctttgggaggtgactgacacattccttcctgtccctctgagactgcgttgtgtagattctggccgatcgacttttctacaacacatatcagcagccagggcct

SEQ ID NO: 444555 - DNA, 140 bp, Artificial Sequence
  Synthetic
aggccctggctgctgatatgcttccataagaactttgaggaagagataagaagaatgttcgagccagggcaggagacggctgttcctcactcttatttcattcacttccgttcactaggcgaccttttgggacagcggtg

SEQ ID NO: 444556 - DNA, 140 bp, Artificial Sequence
  Synthetic
caccgctgtcccaaaaggtcgcctagtgaacggaagtgaatgaaataagagtgaggaacagccgtctcctgccctggctcgaacattcttcttatctcttcctcaaagttcttatggaagcatatcagcagccagggcct

SEQ ID NO: 444557 - DNA, 140 bp, Artificial Sequence
  Synthetic
atacgccatgctgggtctccaggagacggctgttcctcactcttatttcattcacttccgttcactaggcttgagtgggaagtctccttattcatcgaatgccgttggtcatgtgttcaacgtacttgggagtcggccat

SEQ ID NO: 444558 - DNA, 140 bp, Artificial Sequence
  Synthetic
atggccgactcccaagtacgttgaacacatgaccaacggcattcgatgaataaggagacttcccactcaagcctagtgaacggaagtgaatgaaataagagtgaggaacagccgtctcctggagacccagcatggcgtat

SEQ ID NO: 444559 - DNA, 140 bp, Artificial Sequence
  Synthetic
aggccctggctgctgatatgaaaaaaactgtagatcgagatagcaactggcaacacctctcatcctgaaacctacatcaagatgctagacccaggagaggtctatgatgaccccattgatgaccttttgggacagcggtg

SEQ ID NO: 444560 - DNA, 140 bp, Artificial Sequence
  Synthetic
caccgctgtcccaaaaggtcatcaatggggtcatcatagacctctcctgggtctagcatcttgatgtaggtttcaggatgagaggtgttgccagttgctatctcgatctacagtttttttcatatcagcagccagggcct

SEQ ID NO: 444561 - DNA, 140 bp, Artificial Sequence
  Synthetic
aggccctggctgctgatatgcgagactgatgttggagtggctgaaaacagggaatagacctcgtcggatgactctgacagacaattgctcaaggtcttacaaagttttgaaagattatttgaccttttgggacagcggtg

SEQ ID NO: 444562 - DNA, 140 bp, Artificial Sequence
  Synthetic
caccgctgtcccaaaaggtcaaataatctttcaaaactttgtaagaccttgagcaattgtctgtcagagtcatccgacgaggtctattccctgttttcagccactccaacatcagtctcgcatatcagcagccagggcct

SEQ ID NO: 444563 - DNA, 140 bp, Artificial Sequence
  Synthetic
aggccctggctgctgatatgctgctaaccaagcttctcagctcagtccctctagacaataaggtctgagatgtcctagagtcgacatgaaaaaaacaggcaacaccactaataaaatgaagaccttttgggacagcggtg

SEQ ID NO: 444564 - DNA, 140 bp, Artificial Sequence
  Synthetic
caccgctgtcccaaaaggtcttcattttattagtggtgttgcctgtttttttcatgtcgactctaggacatctcagaccttattgtctagagggactgagctgagaagcttggttagcagcatatcagcagccagggcct

SEQ ID NO: 444565 - DNA, 140 bp, Artificial Sequence
  Synthetic
aggccctggctgctgatatgcaaatctttgagattcctgaatcaatggacccgtcagagatattggacgacaagtcacattctctcaccaggacgagactagcttcttggctgtcagagagaccttttgggacagcggtg

SEQ ID NO: 444566 - DNA, 140 bp, Artificial Sequence
  Synthetic
caccgctgtcccaaaaggtctctctgacagccaagaagctagtctcgtcctggtgagagaatgtgacttgtcgtccaatatctctgacgggtccattgattcaggaatctcaaagatttgcatatcagcagccagggcct

SEQ ID NO: 444567 - DNA, 140 bp, Artificial Sequence
  Synthetic
atacgccatgctgggtctcctcctatgaaggaccctagcaatatgtcacaatcatcttacatcccgacaaggtgtgcataactacaaagggctggaccatccaagccttctagtcaggaacgtacttgggagtcggccat

SEQ ID NO: 444568 - DNA, 140 bp, Artificial Sequence
  Synthetic
atggccgactcccaagtacgttcctgactagaaggcttggatggtccagccctttgtagttatgcacaccttgtcgggatgtaagatgattgtgacatattgctagggtccttcataggaggagacccagcatggcgtat

SEQ ID NO: 444569 - DNA, 140 bp, Artificial Sequence
  Synthetic
aggccctggctgctgatatgacaaattcccttcccgatcgtcagggatattcttgtataactttgagcagttgaaaatgaatctcgatgacatagtcaaagagtcgaaaaatgtgccaaggaccttttgggacagcggtg

SEQ ID NO: 444570 - DNA, 140 bp, Artificial Sequence
  Synthetic
caccgctgtcccaaaaggtccttggcacatttttcgactctttgactatgtcatcgagattcattttcaactgctcaaagttatacaagaatatccctgacgatcgggaagggaatttgtcatatcagcagccagggcct

SEQ ID NO: 444571 - DNA, 140 bp, Artificial Sequence
  Synthetic
aggccctggctgctgatatgcagagagagaaccaatcctcaaaagcccgaatggcagctcaaactgcctctggtcctcctgctctcgaatggtctgcgaccaacgacgaagatgatctgtgaccttttgggacagcggtg

SEQ ID NO: 444572 - DNA, 140 bp, Artificial Sequence
  Synthetic
caccgctgtcccaaaaggtcacagatcatcttcgtcgttggtcgcagaccattcgagagcaggaggaccagaggcagtttgagctgccattcgggcttttgaggattggttctctctctgcatatcagcagccagggcct

SEQ ID NO: 444573 - DNA, 140 bp, Artificial Sequence
  Synthetic
aggccctggctgctgatatgggctcctctatgagttggagagcatatcaaggaatgcactttcaatataccgagccatcgaggaaggggcatctaaactagggctgatcatcaaaaaagagaccttttgggacagcggtg

SEQ ID NO: 444574 - DNA, 140 bp, Artificial Sequence
  Synthetic
caccgctgtcccaaaaggtctcttttttgatgatcagccctagtttagatgccccttcctcgatggctcggtatattgaaagtgcattccttgatatgctctccaactcatagaggagcccatatcagcagccagggcct

SEQ ID NO: 444575 - DNA, 140 bp, Artificial Sequence
  Synthetic
aggccctggctgctgatatgcccgacaagctaaataaaataatgcaggacgacctgaaccgttatgcattcttctgaccacacccccgagctcagtcacactatgcaatcaaatctgaccgaccttttgggacagcggtg

SEQ ID NO: 444576 - DNA, 140 bp, Artificial Sequence
  Synthetic
caccgctgtcccaaaaggtcggtcagatttgattgcatagtgtgactgagctcgggggtgtggtcagaagaatgcataacggttcaggtcgtcctgcattattttatttagcttgtcgggcatatcagcagccagggcct

SEQ ID NO: 444577 - DNA, 140 bp, Artificial Sequence
  Synthetic
atacgccatgctgggtctccttagaggtaacatattggtgcctgaatctaaaagatgggccagagtctcctgcatctctaacgaccaaatagtcaacctcgccaatataatgtcgacagtcgtacttgggagtcggccat

SEQ ID NO: 444578 - DNA, 140 bp, Artificial Sequence
  Synthetic
atggccgactcccaagtacgactgtcgacattatattggcgaggttgactatttggtcgttagagatgcaggagactctggcccatcttttagattcaggcaccaatatgttacctctaaggagacccagcatggcgtat

SEQ ID NO: 444579 - DNA, 140 bp, Artificial Sequence
  Synthetic
aggccctggctgctgatatgctttgggaggggtgtctggaatgtctcttggaaggttccatatacgtcagttctcagaccctgtctctgaagggttgtccttctggagagagatctggttgaccttttgggacagcggtg

SEQ ID NO: 444580 - DNA, 140 bp, Artificial Sequence
  Synthetic
caccgctgtcccaaaaggtcaaccagatctctctccagaaggacaacccttcagagacagggtctgagaactgacgtatatggaaccttccaagagacattccagacacccctcccaaagcatatcagcagccagggcct

SEQ ID NO: 444581 - DNA, 140 bp, Artificial Sequence
  Synthetic
atacgccatgctgggtctccgttatggtgccattaaatcgctgcattttatcaaaatcagattaattacctttacattttaagcctcttggatgtgaaaaaaactattaacatccctcaacgtacttgggagtcggccat

SEQ ID NO: 444582 - DNA, 140 bp, Artificial Sequence
  Synthetic
atggccgactcccaagtacgttgagggatgttaatagtttttttcacatccaagaggcttaaaatgtaaaggtaattaatctgattttgataaaatgcagcgatttaatggcaccataacggagacccagcatggcgtat

SEQ ID NO: 444583 - DNA, 140 bp, Artificial Sequence
  Synthetic
atacgccatgctgggtctccaagttcccaggagtcctggattcacgcgttgtgtcaagaggctggaaacccagatcttggagagagaacactcgagagcttcactcgccttctagaagatcgtacttgggagtcggccat

SEQ ID NO: 444584 - DNA, 140 bp, Artificial Sequence
  Synthetic
atggccgactcccaagtacgatcttctagaaggcgagtgaagctctcgagtgttctctctccaagatctgggtttccagcctcttgacacaacgcgtgaatccaggactcctgggaacttggagacccagcatggcgtat

SEQ ID NO: 444585 - DNA, 140 bp, Artificial Sequence
  Synthetic
aggccctggctgctgatatggattgagtcagaggctgagtcaagagggaaccccaccattcccaacatcttaagaaactctgactacaacctcaactctcctctaatagaggatccagccgaccttttgggacagcggtg

SEQ ID NO: 444586 - DNA, 140 bp, Artificial Sequence
  Synthetic
caccgctgtcccaaaaggtcggctggatcctctattagaggagagttgaggttgtagtcagagtttcttaagatgttgggaatggtggggttccctcttgactcagcctctgactcaatccatatcagcagccagggcct

SEQ ID NO: 444587 - DNA, 140 bp, Artificial Sequence
  Synthetic
atacgccatgctgggtctcccagtactcccgtccttcgatcagtcatttttctcacgaggccccctgaagggatacttgggctcgtccacctccatgtcaacccagctattccatgcatgcgtacttgggagtcggccat

SEQ ID NO: 444588 - DNA, 140 bp, Artificial Sequence
  Synthetic
atggccgactcccaagtacgcatgcatggaatagctgggttgacatggaggtggacgagcccaagtatcccttcagggggcctcgtgagaaaaatgactgatcgaaggacgggagtactgggagacccagcatggcgtat

SEQ ID NO: 444589 - DNA, 140 bp, Artificial Sequence
  Synthetic
atacgccatgctgggtctcctatgtcaccaccacgtttaagagaaagcacttccgaccaacaccggatgcatgcagatcagcatacaattggaagatggcaggtgaccccagatatgaagcgtacttgggagtcggccat

SEQ ID NO: 444590 - DNA, 140 bp, Artificial Sequence
  Synthetic
atggccgactcccaagtacgcttcatatctggggtcacctgccatcttccaattgtatgctgatctgcatgcatccggtgttggtcggaagtgctttctcttaaacgtggtggtgacataggagacccagcatggcgtat

SEQ ID NO: 444591 - DNA, 140 bp, Artificial Sequence
  Synthetic
aggccctggctgctgatatgtggaaggtatcttgccaacacgtattcctcttacttgttcttccatgtaatcaccttatacatgaacgccctagactgggatgaagaaaagaccatcctagaccttttgggacagcggtg

SEQ ID NO: 444592 - DNA, 140 bp, Artificial Sequence
  Synthetic
caccgctgtcccaaaaggtctaggatggtcttttcttcatcccagtctagggcgttcatgtataaggtgattacatggaagaacaagtaagaggaatacgtgttggcaagataccttccacatatcagcagccagggcct

SEQ ID NO: 444593 - DNA, 140 bp, Artificial Sequence
  Synthetic
aggccctggctgctgatatgtggtttccggggctgtgcctcacttccggaagcttcctgatatccgtctgagaccaggtgattttgaatctctaagtggtagagaaaagtctcgccatatgaccttttgggacagcggtg

SEQ ID NO: 444594 - DNA, 140 bp, Artificial Sequence
  Synthetic
caccgctgtcccaaaaggtcatatggcgagacttttctctaccacttagagattcaaaatcacctggtctcagacggatatcaggaagcttccggaagtgaggcacagccccggaaaccacatatcagcagccagggcct

SEQ ID NO: 444595 - DNA, 140 bp, Artificial Sequence
  Synthetic
atacgccatgctgggtctcctacatgactttcattcagatgagattgaacatcttgttgtggaggagttggttgagaagagggaggagtgtctagatgcactggagtccatcatgaccaccgtacttgggagtcggccat

SEQ ID NO: 444596 - DNA, 140 bp, Artificial Sequence
  Synthetic
atggccgactcccaagtacggtggtcatgatggactccagtgcatctagacactcctccctcttctcaaccaactcctccacaacaagatgttcaatctcatctgaatgaaagtcatgtaggagacccagcatggcgtat

SEQ ID NO: 444597 - DNA, 140 bp, Artificial Sequence
  Synthetic
atacgccatgctgggtctccagaaggtggatctaggatctatcaaagtgggcggaactgctgcacaatctatgatctccctttggctgtacggtgcctactctgaatcgaacaggagccgcgtacttgggagtcggccat

SEQ ID NO: 444598 - DNA, 140 bp, Artificial Sequence
  Synthetic
atggccgactcccaagtacgcggctcctgttcgattcagagtaggcaccgtacagccaaagggagatcatagattgtgcagcagttccgcccactttgatagatcctagatccaccttctggagacccagcatggcgtat

SEQ ID NO: 444599 - DNA, 140 bp, Artificial Sequence
  Synthetic
aggccctggctgctgatatggctcactacaaatcggtccaaacttgggatgagatcatcccctcgaaagggtgtttaagagtcggggcgagatgtcatcctcatgtgaacggagtattttgaccttttgggacagcggtg

SEQ ID NO: 444600 - DNA, 140 bp, Artificial Sequence
  Synthetic
caccgctgtcccaaaaggtcaaaatactccgttcacatgaggatgacatctcgccccgactcttaaacaccctttcgaggggatgatctcatcccaagtttggaccgatttgtagtgagccatatcagcagccagggcct

SEQ ID NO: 444601 - DNA, 140 bp, Artificial Sequence
  Synthetic
aggccctggctgctgatatgcagtcatccctcctccagcagcatatggagttgttggaatcctcggtcatccccttaatgcatcccttggcagatccatcaacggtttttaaagatggtggaccttttgggacagcggtg

SEQ ID NO: 444602 - DNA, 140 bp, Artificial Sequence
  Synthetic
caccgctgtcccaaaaggtccaccatctttaaaaaccgttgatggatctgccaagggatgcattaaggggatgaccgaggattccaacaactccatatgctgctggaggagggatgactgcatatcagcagccagggcct

SEQ ID NO: 444603 - DNA, 140 bp, Artificial Sequence
  Synthetic
aggccctggctgctgatatgcagcaaacccagcccctgtctcagagcttgacataagggccctctctaagaggtttcaaaaccctctgatctcgggcctgagagtggttcagtgggcaacgaccttttgggacagcggtg

SEQ ID NO: 444604 - DNA, 140 bp, Artificial Sequence
  Synthetic
caccgctgtcccaaaaggtcgttgcccactgaaccactctcaggcccgagatcagagggttttgaaacctcttagagagggcccttatgtcaagctctgagacaggggctgggtttgctgcatatcagcagccagggcct

SEQ ID NO: 444605 - DNA, 140 bp, Artificial Sequence
  Synthetic
aggccctggctgctgatatgagaacatacggacttaactccaaccctcgggagcaatagaacaaaaacatgctatggtgccattaaaccgctgcatttatcaatgtcaagttaattacctgaccttttgggacagcggtg

SEQ ID NO: 444606 - DNA, 140 bp, Artificial Sequence
  Synthetic
caccgctgtcccaaaaggtcaggtaattaacttgacattgataaatgcagcggtttaatggcaccatagcatgtttttgttctattgctcccgagggttggagttaagtccgtatgttctcatatcagcagccagggcct

SEQ ID NO: 444607 - DNA, 140 bp, Artificial Sequence
  Synthetic
atacgccatgctgggtctccaaattgaaggtcggtttttcgccttaatgtcctggaatctgaggttgtattttgtcatcacagagaagctcctagccaattatatcttgccactttttgacgtacttgggagtcggccat

SEQ ID NO: 444608 - DNA, 140 bp, Artificial Sequence
  Synthetic
atggccgactcccaagtacgtcaaaaagtggcaagatataattggctaggagcttctctgtgatgacaaaatacaacctcagattccaggacattaaggcgaaaaaccgaccttcaatttggagacccagcatggcgtat

SEQ ID NO: 444609 - DNA, 140 bp, Artificial Sequence
  Synthetic
atacgccatgctgggtctccttctctacgagttggagagcatatcaagaaatgctctgtcaatataccgtgctattgaggagggggcatccaaactggggcttatcataaagaaggaagacgtacttgggagtcggccat

SEQ ID NO: 444610 - DNA, 140 bp, Artificial Sequence
  Synthetic
atggccgactcccaagtacgtcttccttctttatgataagccccagtttggatgccccctcctcaatagcacggtatattgacagagcatttcttgatatgctctccaactcgtagagaaggagacccagcatggcgtat

SEQ ID NO: 444611 - DNA, 140 bp, Artificial Sequence
  Synthetic
aggccctggctgctgatatgagtttagagaagcgatcctcttgtccaagacccatagggataactttatacttttcttgaagtctgttgagcctttgtttccccgatttctcagtgaactgaccttttgggacagcggtg

SEQ ID NO: 444612 - DNA, 140 bp, Artificial Sequence
  Synthetic
caccgctgtcccaaaaggtcagttcactgagaaatcggggaaacaaaggctcaacagacttcaagaaaagtataaagttatccctatgggtcttggacaagaggatcgcttctctaaactcatatcagcagccagggcct

SEQ ID NO: 444613 - DNA, 140 bp, Artificial Sequence
  Synthetic
aggccctggctgctgatatggagaggtggaaagacaccttcatggatacaacaggtggatcaccctcaaggacatcagatccagatcatctttattagactacagctgcttgtaaaccaggaccttttgggacagcggtg

SEQ ID NO: 444614 - DNA, 140 bp, Artificial Sequence
  Synthetic
caccgctgtcccaaaaggtcctggtttacaagcagctgtagtctaataaagatgatctggatctgatgtccttgagggtgatccacctgttgtatccatgaaggtgtctttccacctctccatatcagcagccagggcct

SEQ ID NO: 444615 - DNA, 140 bp, Artificial Sequence
  Synthetic
aggccctggctgctgatatgagactcttgggtgatgtgtctcgaaaaaaacaagatcttgaatctggacctctggctgtttgattgtttcttttgtctttgttgtttgtttgttaagcgtgaccttttgggacagcggtg

SEQ ID NO: 444616 - DNA, 140 bp, Artificial Sequence
  Synthetic
caccgctgtcccaaaaggtcacgcttaacaaacaaacaacaaagacaaaagaaacaatcaaacagccagaggtccagattcaagatcttgtttttttcgagacacatcacccaagagtctcatatcagcagccagggcct

SEQ ID NO: 444617 - DNA, 140 bp, Artificial Sequence
  Synthetic
atacgccatgctgggtctcccagatctcctaagagagatctcatgggggaggaaggtggttggaacaacagtccctcacccctctgagatgttggggctacttccaaagtcctcgatctccgtacttgggagtcggccat

SEQ ID NO: 444618 - DNA, 140 bp, Artificial Sequence
  Synthetic
atggccgactcccaagtacggagatcgaggactttggaagtagccccaacatctcagaggggtgagggactgttgttccaaccaccttcctcccccatgagatctctcttaggagatctgggagacccagcatggcgtat

SEQ ID NO: 444619 - DNA, 140 bp, Artificial Sequence
  Synthetic
aggccctggctgctgatatgtacctgggctcatccacttccatgtcgacccagctattccacgcctgggagaaagtcaccaatgttcatgtggtgaaaagagccctgtcactcaaggaatgaccttttgggacagcggtg

SEQ ID NO: 444620 - DNA, 140 bp, Artificial Sequence
  Synthetic
caccgctgtcccaaaaggtcattccttgagtgacagggctcttttcaccacatgaacattggtgactttctcccaggcgtggaatagctgggtcgacatggaagtggatgagcccaggtacatatcagcagccagggcct

SEQ ID NO: 444621 - DNA, 140 bp, Artificial Sequence
  Synthetic
atacgccatgctgggtctcctagaaacatagaagacaatcaggctcacctccagggagaacctatagaagtggacagtctccctgaggacatgagccgacttcacttggatgatggaaaacgtacttgggagtcggccat

SEQ ID NO: 444622 - DNA, 140 bp, Artificial Sequence
  Synthetic
atggccgactcccaagtacgttttccatcatccaagtgaagtcggctcatgtcctcagggagactgtccacttctataggttctccctggaggtgagcctgattgtcttctatgtttctaggagacccagcatggcgtat

SEQ ID NO: 444623 - DNA, 140 bp, Artificial Sequence
  Synthetic
atacgccatgctgggtctcccccctctcgtgtcagctcctccagatgatgatgatctgtggttaccccctcccgaatacgttccgttaaaggaactcacgggcaagaaaaacatgagaaacgtacttgggagtcggccat

SEQ ID NO: 444624 - DNA, 140 bp, Artificial Sequence
  Synthetic
atggccgactcccaagtacgtttctcatgtttttcttgcccgtgagttcctttaacggaacgtattcgggagggggtaaccacagatcatcatcatctggaggagctgacacgagaggggggagacccagcatggcgtat

SEQ ID NO: 444625 - DNA, 140 bp, Artificial Sequence
  Synthetic
atacgccatgctgggtctcccaatttggttgtagaggacgaaggatgcaccaacctgtcagggttctcctacatggaacttaaagttggatacatctcagccataaaggtgaacgggttccgtacttgggagtcggccat

SEQ ID NO: 444626 - DNA, 140 bp, Artificial Sequence
  Synthetic
atggccgactcccaagtacggaacccgttcacctttatggctgagatgtatccaactttaagttccatgtaggagaaccctgacaggttggtgcatccttcgtcctctacaaccaaattgggagacccagcatggcgtat

SEQ ID NO: 444627 - DNA, 140 bp, Artificial Sequence
  Synthetic
atacgccatgctgggtctccctctcgaaggaatgtacagactccgactcttagacaatgcaccctgaaaaaaacgaggtcccaattcatgacctctgtttacttgattgttttttttgtccgtacttgggagtcggccat

SEQ ID NO: 444628 - DNA, 140 bp, Artificial Sequence
  Synthetic
atggccgactcccaagtacggacaaaaaaaacaatcaagtaaacagaggtcatgaattgggacctcgtttttttcagggtgcattgtctaagagtcggagtctgtacattccttcgagagggagacccagcatggcgtat

SEQ ID NO: 444629 - DNA, 140 bp, Artificial Sequence
  Synthetic
aggccctggctgctgatatgggatgagagaggcttgtataagtctttaaagggagcatgcaaactcaagttatgcggagttcttggacttagacttgtggatggaacatggatagcgatggaccttttgggacagcggtg

SEQ ID NO: 444630 - DNA, 140 bp, Artificial Sequence
  Synthetic
caccgctgtcccaaaaggtccatcgctatccatgttccatccacaagtctaagtccaagaactccgcataacttgagtttgcatgctccctttaaagacttatacaagcctctctcatcccatatcagcagccagggcct

SEQ ID NO: 444631 - DNA, 140 bp, Artificial Sequence
  Synthetic
atacgccatgctgggtctccgaaaagcccctgacttgaacaaagcatacaagtcaattttgtctggcatgaatgcagccaagctcgaccctgacgatgtatgctcttatctagcagctgccgtacttgggagtcggccat

SEQ ID NO: 444632 - DNA, 140 bp, Artificial Sequence
  Synthetic
atggccgactcccaagtacggcagctgctagataagagcatacatcgtcagggtcgagcttggctgcattcatgccagacaaaattgacttgtatgctttgttcaagtcaggggcttttcggagacccagcatggcgtat

SEQ ID NO: 444633 - DNA, 140 bp, Artificial Sequence
  Synthetic
aggccctggctgctgatatgggtataatgatggaaccatcttccctgtcaacatatataacaaggtatcccctagagactatttgagagggcttgcgagaggagtcttgatagggtcctcgaccttttgggacagcggtg

SEQ ID NO: 444634 - DNA, 140 bp, Artificial Sequence
  Synthetic
caccgctgtcccaaaaggtcgaggaccctatcaagactcctctcgcaagccctctcaaatagtctctaggggataccttgttatatatgttgacagggaagatggttccatcattatacccatatcagcagccagggcct

SEQ ID NO: 444635 - DNA, 140 bp, Artificial Sequence
  Synthetic
atacgccatgctgggtctccaaatatgtaacacccctacaatggatgctgacaagattgtcttcaaagtcaataatcatgtggtctctttgaagcctgagattatcgtggatcaatatgacgtacttgggagtcggccat

SEQ ID NO: 444636 - DNA, 140 bp, Artificial Sequence
  Synthetic
atggccgactcccaagtacgtcatattgatccacgataatctcaggcttcaaagagaccacatgattattgactttgaagacaatcttgtcagcatccattgtaggggtgttacatatttggagacccagcatggcgtat

SEQ ID NO: 444637 - DNA, 140 bp, Artificial Sequence
  Synthetic
atacgccatgctgggtctccgacatgtttttctcccggattgagcatctatattcagcaatcagggtgggcacagttgttactgcttatgaagactgttcagggctggtatcgtttactgcgtacttgggagtcggccat

SEQ ID NO: 444638 - DNA, 140 bp, Artificial Sequence
  Synthetic
atggccgactcccaagtacgcagtaaacgataccagccctgaacagtcttcataagcagtaacaactgtgcccaccctgattgctgaatatagatgctcaatccgggagaaaaacatgtcggagacccagcatggcgtat

SEQ ID NO: 444639 - DNA, 140 bp, Artificial Sequence
  Synthetic
atacgccatgctgggtctccgggtctggacctgctcttcagagagggcagatctcttaagagagatctcgtggggaaggaaggtggttggtaccacagtacctcatccttcggaaatgttcgtacttgggagtcggccat

SEQ ID NO: 444640 - DNA, 140 bp, Artificial Sequence
  Synthetic
atggccgactcccaagtacgaacatttccgaaggatgaggtactgtggtaccaaccaccttccttccccacgagatctctcttaagagatctgccctctctgaagagcaggtccagacccggagacccagcatggcgtat

SEQ ID NO: 444641 - DNA, 140 bp, Artificial Sequence
  Synthetic
atacgccatgctgggtctccaatgctgccaaacttgatcctgatgatgtatgctcctacttggcggctgcaatgcagttctttgagggaacatgtccagaagattggaccagctatggaacgtacttgggagtcggccat

SEQ ID NO: 444642 - DNA, 140 bp, Artificial Sequence
  Synthetic
atggccgactcccaagtacgttccatagctggtccaatcttctggacatgttccctcaaagaactgcattgcagccgccaagtaggagcatacatcatcaggatcaagtttggcagcattggagacccagcatggcgtat

SEQ ID NO: 444643 - DNA, 140 bp, Artificial Sequence
  Synthetic
atacgccatgctgggtctccaggaacataatatccctgacaggtccagattttccactggaagaggctccggttttcaagagaacggggtccgccttacataggttcaagtcagccagatcgtacttgggagtcggccat

SEQ ID NO: 444644 - DNA, 140 bp, Artificial Sequence
  Synthetic
atggccgactcccaagtacgatctggctgacttgaacctatgtaaggcggaccccgttctcttgaaaaccggagcctcttccagtggaaaatctggacctgtcagggatattatgttcctggagacccagcatggcgtat

SEQ ID NO: 444645 - DNA, 140 bp, Artificial Sequence
  Synthetic
atacgccatgctgggtctccattgacaagggaccccactgtctctgagcacgcatctttagtcggtcttctcttgagtctgtacaggttgagcaagatatcaggacaaaacaccggtaaccgtacttgggagtcggccat

SEQ ID NO: 444646 - DNA, 140 bp, Artificial Sequence
  Synthetic
atggccgactcccaagtacggttaccggtgttttgtcctgatatcttgctcaacctgtacagactcaagagaagaccgactaaagatgcgtgctcagagacagtggggtcccttgtcaatggagacccagcatggcgtat

SEQ ID NO: 444647 - DNA, 140 bp, Artificial Sequence
  Synthetic
aggccctggctgctgatatgatttggatgccagagaatctaagactagggacatcttgtgacatttttactaatagtcgagggaagagagcatccagaggtagcaagacttgcggctttggaccttttgggacagcggtg

SEQ ID NO: 444648 - DNA, 140 bp, Artificial Sequence
  Synthetic
caccgctgtcccaaaaggtccaaagccgcaagtcttgctacctctggatgctctcttccctcgactattagtaaaaatgtcacaagatgtccctagtcttagattctctggcatccaaatcatatcagcagccagggcct

SEQ ID NO: 444649 - DNA, 140 bp, Artificial Sequence
  Synthetic
aggccctggctgctgatatggttcagctcaggggcttctatattcgatcttggtcgcgatacatgactcaggatacaatgacggaactatcttccctgtcaacatatatggcaaggtctcgaccttttgggacagcggtg

SEQ ID NO: 444650 - DNA, 140 bp, Artificial Sequence
  Synthetic
caccgctgtcccaaaaggtcgagaccttgccatatatgttgacagggaagatagttccgtcattgtatcctgagtcatgtatcgcgaccaagatcgaatatagaagcccctgagctgaaccatatcagcagccagggcct

SEQ ID NO: 444651 - DNA, 140 bp, Artificial Sequence
  Synthetic
aggccctggctgctgatatggacatgtttttctcacggattgagcatctgtattcagccatcagggtgggcacagttgtaaccgcttatgaagactgctcagggctggtatcgtttacaggaccttttgggacagcggtg

SEQ ID NO: 444652 - DNA, 140 bp, Artificial Sequence
  Synthetic
caccgctgtcccaaaaggtcctgtaaacgataccagccctgagcagtcttcataagcggttacaactgtgcccaccctgatggctgaatacagatgctcaatccgtgagaaaaacatgtccatatcagcagccagggcct

SEQ ID NO: 444653 - DNA, 140 bp, Artificial Sequence
  Synthetic
atacgccatgctgggtctccgattcctcaagatatggccccagaccgtcgaggagattatatcctatgtcacggtcaacttctccagtctgccagggaagtctacagaagacaaagccaccgtacttgggagtcggccat

SEQ ID NO: 444654 - DNA, 140 bp, Artificial Sequence
  Synthetic
atggccgactcccaagtacggtggctttgtcttctgtagacttccctggcagactggagaagttgaccgtgacataggatataatctcctcgacggtctggggccatatcttgaggaatcggagacccagcatggcgtat

SEQ ID NO: 444655 - DNA, 140 bp, Artificial Sequence
  Synthetic
atacgccatgctgggtctccagggatgaaaaagagcttcaagaatatgaggcggctgaactgacaaagactgacgtggcactggcagatgatggaactgtcaactccgacgacgaggattcgtacttgggagtcggccat

SEQ ID NO: 444656 - DNA, 140 bp, Artificial Sequence
  Synthetic
atggccgactcccaagtacgaatcctcgtcgtcggagttgacagttccatcatctgccagtgccacgtcagtctttgtcagttcagccgcctcatattcttgaagctctttttcatccctggagacccagcatggcgtat

SEQ ID NO: 444657 - DNA, 140 bp, Artificial Sequence
  Synthetic
aggccctggctgctgatatgccggtctggctgatcttgagatggctgaagagactgttgacctaatcaatagaaatatagaagacaatcaggcccatctccagggggaacctatagaagtgaccttttgggacagcggtg

SEQ ID NO: 444658 - DNA, 140 bp, Artificial Sequence
  Synthetic
caccgctgtcccaaaaggtcacttctataggttccccctggagatgggcctgattgtcttctatatttctattgattaggtcaacagtctcttcagccatctcaagatcagccagaccggcatatcagcagccagggcct

SEQ ID NO: 444659 - DNA, 140 bp, Artificial Sequence
  Synthetic
atacgccatgctgggtctcccagttccaatcatcaagcccgtccgaactcatttgctgagtttctaaacaagacgtattctagtgattcataaggagttgaatgacaaggtgccaaggatcgtacttgggagtcggccat

SEQ ID NO: 444660 - DNA, 140 bp, Artificial Sequence
  Synthetic
atggccgactcccaagtacgatccttggcaccttgtcattcaactccttatgaatcactagaatacgtcttgtttagaaactcagcaaatgagttcggacgggcttgatgattggaactgggagacccagcatggcgtat

SEQ ID NO: 444661 - DNA, 140 bp, Artificial Sequence
  Synthetic
aggccctggctgctgatatgagactcttatacgatataccttgaaaaaaacaagatcttgactctgagcctctggttgtttgattgttttttttatctttattgtttttttgttaagcgtgaccttttgggacagcggtg

SEQ ID NO: 444662 - DNA, 140 bp, Artificial Sequence
  Synthetic
caccgctgtcccaaaaggtcacgcttaacaaaaaaacaataaagataaaaaaaacaatcaaacaaccagaggctcagagtcaagatcttgtttttttcaaggtatatcgtataagagtctcatatcagcagccagggcct

SEQ ID NO: 444663 - DNA, 140 bp, Artificial Sequence
  Synthetic
atacgccatgctgggtctccgactttcagatggatgaaggagaggaccccaatctcctgctccaatcgtacctggacaatgttggagtccaaatagtcagacagatgaggtcaggagaaacgtacttgggagtcggccat

SEQ ID NO: 444664 - DNA, 140 bp, Artificial Sequence
  Synthetic
atggccgactcccaagtacgtttctcctgacctcatctgtctgactatttggactccaacattgtccaggtacgattggagcaggagattggggtcctctccttcatccatctgaaagtcggagacccagcatggcgtat

SEQ ID NO: 444665 - DNA, 140 bp, Artificial Sequence
  Synthetic
aggccctggctgctgatatggtcagacttgactcatgatgggagaaactatgactttatgtttcaaccgttgatgctttatgcgcaaacatggacatcagaactggtgcaaaaagacacagaccttttgggacagcggtg

SEQ ID NO: 444666 - DNA, 140 bp, Artificial Sequence
  Synthetic
caccgctgtcccaaaaggtctgtgtctttttgcaccagttctgatgtccatgtttgcgcataaagcatcaacggttgaaacataaagtcatagtttctcccatcatgagtcaagtctgaccatatcagcagccagggcct

SEQ ID NO: 444667 - DNA, 140 bp, Artificial Sequence
  Synthetic
atacgccatgctgggtctccacggtcaactttcctaaccctccaggaagttcttcagaagataaatcaacccagactactggccgagatcttaagaaagagacgacatctcctctttttccgtacttgggagtcggccat

SEQ ID NO: 444668 - DNA, 140 bp, Artificial Sequence
  Synthetic
atggccgactcccaagtacggaaaaagaggagatgtcgtctctttcttaagatctcggccagtagtctgggttgatttatcttctgaagaacttcctggagggttaggaaagttgaccgtggagacccagcatggcgtat

SEQ ID NO: 444669 - DNA, 140 bp, Artificial Sequence
  Synthetic
atacgccatgctgggtctccctttacattttaagcttctaggatgtgaaaaaaacaatcaacatccctcaaaggatctcaggaaaaatgatccctcaggctcttctgtttgtgcctctcccgtacttgggagtcggccat

SEQ ID NO: 444670 - DNA, 140 bp, Artificial Sequence
  Synthetic
atggccgactcccaagtacgggagaggcacaaacagaagagcctgagggatcatttttcctgagatcctttgagggatgttgattgtttttttcacatcctagaagcttaaaatgtaaagggagacccagcatggcgtat

SEQ ID NO: 444671 - DNA, 140 bp, Artificial Sequence
  Synthetic
atacgccatgctgggtctcctgggatgggtcgctttggccaattctaagaaattccaattattagtcgaggccgacaagctaagtaaaattatgcaagatgatttgaatcgctatacatccgtacttgggagtcggccat

SEQ ID NO: 444672 - DNA, 140 bp, Artificial Sequence
  Synthetic
atggccgactcccaagtacggatgtatagcgattcaaatcatcttgcataattttacttagcttgtcggcctcgactaataattggaatttcttagaattggccaaagcgacccatcccaggagacccagcatggcgtat

SEQ ID NO: 444673 - DNA, 140 bp, Artificial Sequence
  Synthetic
atacgccatgctgggtctccttatgtcactaccacattcaagagaaagcacttccgcccgacgccagatgcctgcagagctgcacacgactggaagatggccggtgatcccagatatgaacgtacttgggagtcggccat

SEQ ID NO: 444674 - DNA, 140 bp, Artificial Sequence
  Synthetic
atggccgactcccaagtacgttcatatctgggatcaccggccatcttccagtcgtgtgcagctctgcaggcatctggcgtcgggcggaagtgctttctcttgaatgtggtagtgacataaggagacccagcatggcgtat

SEQ ID NO: 444675 - DNA, 140 bp, Artificial Sequence
  Synthetic
aggccctggctgctgatatgctttctacgtaagatagtgaaaaactgtagggatgaggatactcaaaagccctctcctgtgtcagcccctccggatgatgatgatctgtggcttccacctgaccttttgggacagcggtg

SEQ ID NO: 444676 - DNA, 140 bp, Artificial Sequence
  Synthetic
caccgctgtcccaaaaggtcaggtggaagccacagatcatcatcatccggaggggctgacacaggagagggcttttgagtatcctcatccctacagtttttcactatcttacgtagaaagcatatcagcagccagggcct

SEQ ID NO: 444677 - DNA, 140 bp, Artificial Sequence
  Synthetic
aggccctggctgctgatatgaaaaagaaagtcaaccttcaaaaacccgaatggcggctcaggctgcctctggtcctccagctctcgactggtccgccaccaacgaagaggatgatctgtcgaccttttgggacagcggtg

SEQ ID NO: 444678 - DNA, 140 bp, Artificial Sequence
  Synthetic
caccgctgtcccaaaaggtcgacagatcatcctcttcgttggtggcggaccagtcgagagctggaggaccagaggcagcctgagccgccattcgggtttttgaaggttgactttctttttcatatcagcagccagggcct

SEQ ID NO: 444679 - DNA, 140 bp, Artificial Sequence
  Synthetic
atacgccatgctgggtctcctcaggatcttgcgacacattctgagatcattcgacgagatatactctgggaatcataggatgattgggttagttaaagttgttattggactagctttgtccgtacttgggagtcggccat

SEQ ID NO: 444680 - DNA, 140 bp, Artificial Sequence
  Synthetic
atggccgactcccaagtacggacaaagctagtccaataacaactttaactaacccaatcatcctatgattcccagagtatatctcgtcgaatgatctcagaatgtgtcgcaagatcctgaggagacccagcatggcgtat

SEQ ID NO: 444681 - DNA, 140 bp, Artificial Sequence
  Synthetic
atacgccatgctgggtctcccatctggatgcccgtagaaccaagacttggaacatcttgtgatatttttaccaatagcagagggaagagagcatctaaggggggcagggtttgcggatttcgtacttgggagtcggccat

SEQ ID NO: 444682 - DNA, 140 bp, Artificial Sequence
  Synthetic
atggccgactcccaagtacgaaatccgcaaaccctgccccccttagatgctctcttccctctgctattggtaaaaatatcacaagatgttccaagtcttggttctacgggcatccagatgggagacccagcatggcgtat

SEQ ID NO: 444683 - DNA, 140 bp, Artificial Sequence
  Synthetic
aggccctggctgctgatatgcggaaccatgctggtgaatccagaatatagagcgattcaacacctatcgagagcgttcccttcagttacaggatttataacccaaatgacctcatcttttgaccttttgggacagcggtg

SEQ ID NO: 444684 - DNA, 140 bp, Artificial Sequence
  Synthetic
caccgctgtcccaaaaggtcaaaagatgaggtcatttgggttataaatcctgtaactgaagggaacgctctcgataggtgttgaatcgctctatattctggattcaccagcatggttccgcatatcagcagccagggcct

SEQ ID NO: 444685 - DNA, 140 bp, Artificial Sequence
  Synthetic
atacgccatgctgggtctccattgcaaataagagtgagtgcaagacagtgtcatattcaaggcaggatctggtgtatcaatatgaactctagagcatgtcaattatggtctgacatgtctcgtacttgggagtcggccat

SEQ ID NO: 444686 - DNA, 140 bp, Artificial Sequence
  Synthetic
atggccgactcccaagtacgagacatgtcagaccataattgacatgctctagagttcatattgatacaccagatcctgccttgaatatgacactgtcttgcactcactcttatttgcaatggagacccagcatggcgtat

SEQ ID NO: 444687 - DNA, 140 bp, Artificial Sequence
  Synthetic
atacgccatgctgggtctccccaaatcagtgagcttcagacgtctcagccacttgaggaagcttgttcctgggtttgggaaggcatacaccatattcaacaataccttaatggaagctgacgtacttgggagtcggccat

SEQ ID NO: 444688 - DNA, 140 bp, Artificial Sequence
  Synthetic
atggccgactcccaagtacgtcagcttccattaaggtattgttgaatatggtgtatgccttcccaaacccaggaacaagcttcctcaagtggctgagacgtctgaagctcactgatttggggagacccagcatggcgtat

SEQ ID NO: 444689 - DNA, 140 bp, Artificial Sequence
  Synthetic
aggccctggctgctgatatgatggtcaactttcccaactctccaggaaggtcttcagaggacaaatcaacccaaactactggcagagtgcccaagaaggagacaacatccactccctcccgaccttttgggacagcggtg

SEQ ID NO: 444690 - DNA, 140 bp, Artificial Sequence
  Synthetic
caccgctgtcccaaaaggtcgggagggagtggatgttgtctccttcttgggcactctgccagtagtttgggttgatttgtcctctgaagaccttcctggagagttgggaaagttgaccatcatatcagcagccagggcct

SEQ ID NO: 444691 - DNA, 140 bp, Artificial Sequence
  Synthetic
atacgccatgctgggtctcctacatggaacttaaagtaggatacatctcagccataaaagtgaacgggttcacctgtacaggtgttgtgacagaggcagaaacctacaccaactttgttgcgtacttgggagtcggccat

SEQ ID NO: 444692 - DNA, 140 bp, Artificial Sequence
  Synthetic
atggccgactcccaagtacgcaacaaagttggtgtaggtttctgcctctgtcacaacacctgtacaggtgaacccgttcacttttatggctgagatgtatcctactttaagttccatgtaggagacccagcatggcgtat

SEQ ID NO: 444693 - DNA, 140 bp, Artificial Sequence
  Synthetic
atacgccatgctgggtctcctgttgtaggagggtcaacaagacaagatcatcacagagaggtcacagggaatcaggagggaaaatgtcagtagcacctcaaaacgggaagatcatatcctcgtacttgggagtcggccat

SEQ ID NO: 444694 - DNA, 140 bp, Artificial Sequence
  Synthetic
atggccgactcccaagtacgaggatatgatcttcccgttttgaggtgctactgacattttccctcctgattccctgtgacctctctgtgatgatcttgtcttgttgaccctcctacaacaggagacccagcatggcgtat

SEQ ID NO: 444695 - DNA, 140 bp, Artificial Sequence
  Synthetic
atacgccatgctgggtctccagagtctctacacaatccgtaccctgactaccattggcttcgaactgttaaaaccaccaaagagtctctcgtcatcatatccccaagtgtggcagatttacgtacttgggagtcggccat

SEQ ID NO: 444696 - DNA, 140 bp, Artificial Sequence
  Synthetic
atggccgactcccaagtacgtaaatctgccacacttggggatatgatgacgagagactctttggtggttttaacagttcgaagccaatggtagtcagggtacggattgtgtagagactctggagacccagcatggcgtat

SEQ ID NO: 444697 - DNA, 140 bp, Artificial Sequence
  Synthetic
atacgccatgctgggtctccggatcctatcttcttgacagtccctcatggaccctgtgccactggatagacttaagagtgaagaaactttcattaatcatctcaactaattaagcacagtcgtacttgggagtcggccat

SEQ ID NO: 444698 - DNA, 140 bp, Artificial Sequence
  Synthetic
atggccgactcccaagtacgactgtgcttaattagttgagatgattaatgaaagtttcttcactcttaagtctatccagtggcacagggtccatgagggactgtcaagaagataggatccggagacccagcatggcgtat

SEQ ID NO: 444699 - DNA, 140 bp, Artificial Sequence
  Synthetic
atacgccatgctgggtctccagtcttcaacgtttccaaacccctaactgaccccttgttctatccaccgtctgatcccaaaatcctgaggcacttcaacatatgttgcagtactatgatgcgtacttgggagtcggccat

SEQ ID NO: 444700 - DNA, 140 bp, Artificial Sequence
  Synthetic
atggccgactcccaagtacgcatcatagtactgcaacatatgttgaagtgcctcaggattttgggatcagacggtggatagaacaaggggtcagttaggggtttggaaacgttgaagactggagacccagcatggcgtat

SEQ ID NO: 444701 - DNA, 140 bp, Artificial Sequence
  Synthetic
atacgccatgctgggtctccccatttggatgcccgagaatccgagactagggacatcttgtgacattttcaccaatagcagagggaagagagcatccaaagggagcaagacttgcggcttcgtacttgggagtcggccat

SEQ ID NO: 444702 - DNA, 140 bp, Artificial Sequence
  Synthetic
atggccgactcccaagtacgaagccgcaagtcttgctccctttggatgctctcttccctctgctattggtgaaaatgtcacaagatgtccctagtctcggattctcgggcatccaaatggggagacccagcatggcgtat

SEQ ID NO: 444703 - DNA, 140 bp, Artificial Sequence
  Synthetic
aggccctggctgctgatatgaccaatagcagagggaagagagcatccaaagggagcaagacttgcggctttgtagatgaaagaggcctgtataagtctctaaaaggagcctgtaaactcagaccttttgggacagcggtg

SEQ ID NO: 444704 - DNA, 140 bp, Artificial Sequence
  Synthetic
caccgctgtcccaaaaggtctgagtttacaggctccttttagagacttatacaggcctctttcatctacaaagccgcaagtcttgctccctttggatgctctcttccctctgctattggtcatatcagcagccagggcct

SEQ ID NO: 444705 - DNA, 140 bp, Artificial Sequence
  Synthetic
aggccctggctgctgatatgggcccattataagctcaaacccattctggatgatctcaatgtcttcccatccctatgtcttgttgtcggggatggatcaggggggatatcaagagcggtagaccttttgggacagcggtg

SEQ ID NO: 444706 - DNA, 140 bp, Artificial Sequence
  Synthetic
caccgctgtcccaaaaggtctaccgctcttgatatcccccctgatccatccccgacaacaagacatagggatgggaagacattgagatcatccagaatgggtttgagcttataatgggcccatatcagcagccagggcct

SEQ ID NO: 444707 - DNA, 140 bp, Artificial Sequence
  Synthetic
aggccctggctgctgatatgagaacatacgggcttgactccaacccttgggagcaatagaacaaaaacatgttatggtgccattaaaccgctgcattttatcaaagtcaagttaattaccgaccttttgggacagcggtg

SEQ ID NO: 444708 - DNA, 140 bp, Artificial Sequence
  Synthetic
caccgctgtcccaaaaggtcggtaattaacttgactttgataaaatgcagcggtttaatggcaccataacatgtttttgttctattgctcccaagggttggagtcaagcccgtatgttctcatatcagcagccagggcct

SEQ ID NO: 444709 - DNA, 140 bp, Artificial Sequence
  Synthetic
atacgccatgctgggtctccggggttcggaaaggcatacaccatattcaacagaaccttgatggaggctgatgctcactacaagtcagtccggacctggaatgaggttatcccttcaaaacgtacttgggagtcggccat

SEQ ID NO: 444710 - DNA, 140 bp, Artificial Sequence
  Synthetic
atggccgactcccaagtacgttttgaagggataacctcattccaggtccggactgacttgtagtgagcatcagcctccatcaaggttctgttgaatatggtgtatgcctttccgaaccccggagacccagcatggcgtat

SEQ ID NO: 444711 - DNA, 140 bp, Artificial Sequence
  Synthetic
aggccctggctgctgatatgtttcaatggtataatattggggcctgacggtcatgttctaatcccagagatgcaatcatccctcctccagcaacatatggagttgttggagtcctcagttgaccttttgggacagcggtg

SEQ ID NO: 444712 - DNA, 140 bp, Artificial Sequence
  Synthetic
caccgctgtcccaaaaggtcaactgaggactccaacaactccatatgttgctggaggagggatgattgcatctctgggattagaacatgaccgtcaggccccaatattataccattgaaacatatcagcagccagggcct

SEQ ID NO: 444713 - DNA, 140 bp, Artificial Sequence
  Synthetic
aggccctggctgctgatatgaaatcttgagacacttcaacatatgctgcagtaccatgatgtacttgtccacagccttaggggatgtgcccagctttgcgagacttcatgacctgtacaagaccttttgggacagcggtg

SEQ ID NO: 444714 - DNA, 140 bp, Artificial Sequence
  Synthetic
caccgctgtcccaaaaggtcttgtacaggtcatgaagtctcgcaaagctgggcacatcccctaaggctgtggacaagtacatcatggtactgcagcatatgttgaagtgtctcaagatttcatatcagcagccagggcct

SEQ ID NO: 444715 - DNA, 140 bp, Artificial Sequence
  Synthetic
atacgccatgctgggtctccaagtctcaggggttgacctgggtctcccaaattggggtaagtatgtattgatgagtgcaggggccctgattgccctgatgttgataattttcctaatgaccgtacttgggagtcggccat

SEQ ID NO: 444716 - DNA, 140 bp, Artificial Sequence
  Synthetic
atggccgactcccaagtacggtcattaggaaaattatcaacatcagggcaatcagggcccctgcactcatcaatacatacttaccccaatttgggagacccaggtcaacccctgagacttggagacccagcatggcgtat

SEQ ID NO: 444717 - DNA, 140 bp, Artificial Sequence
  Synthetic
atacgccatgctgggtctccatgttgcagaagagtcaatcgaccagaatctacgcaacgcattcttggagggacagggaaaaaggtgtcggccgcttcccagagcgggaaggtcatatctcgtacttgggagtcggccat

SEQ ID NO: 444718 - DNA, 140 bp, Artificial Sequence
  Synthetic
atggccgactcccaagtacgagatatgaccttcccgctctgggaagcggccgacacctttttccctgtccctccaagaatgcgttgcgtagattctggtcgattgactcttctgcaacatggagacccagcatggcgtat

SEQ ID NO: 444719 - DNA, 140 bp, Artificial Sequence
  Synthetic
atacgccatgctgggtctccgggaatccctggatccaattgtcctccttgaactccatccaacagggtaaattcaagagtcgtgagactttcattaatcatctcagttgatcagacaaggcgtacttgggagtcggccat

SEQ ID NO: 444720 - DNA, 140 bp, Artificial Sequence
  Synthetic
atggccgactcccaagtacgccttgtctgatcaactgagatgattaatgaaagtctcacgactcttgaatttaccctgttggatggagttcaaggaggacaattggatccagggattcccggagacccagcatggcgtat

SEQ ID NO: 444721 - DNA, 140 bp, Artificial Sequence
  Synthetic
atacgccatgctgggtctccaggggcatttcaaatgactcagtgcttgggcacagaaagaagtcgtggtgtatcccctgatctgggactaaacatgggttgattgagaaaagcaatccgccgtacttgggagtcggccat

SEQ ID NO: 444722 - DNA, 140 bp, Artificial Sequence
  Synthetic
atggccgactcccaagtacggcggattgcttttctcaatcaacccatgtttagtcccagatcaggggatacaccacgacttctttctgtgcccaagcactgagtcatttgaaatgcccctggagacccagcatggcgtat

SEQ ID NO: 444723 - DNA, 140 bp, Artificial Sequence
  Synthetic
aggccctggctgctgatatgtcggatgggtcgctctggccaattcaaagaaattccaattgttagtcgagcccgacaagctgaataaaatcatgcaggatgatttgaatcgctatgcatcgaccttttgggacagcggtg

SEQ ID NO: 444724 - DNA, 140 bp, Artificial Sequence
  Synthetic
caccgctgtcccaaaaggtcgatgcatagcgattcaaatcatcctgcatgattttattcagcttgtcgggctcgactaacaattggaatttctttgaattggccagagcgacccatccgacatatcagcagccagggcct

SEQ ID NO: 444725 - DNA, 140 bp, Artificial Sequence
  Synthetic
atacgccatgctgggtctccaaaaaactatagaccaaaagaacaactagcaacacttctcatcctgagatccatatcaagatgctagatccgggagaggtctatgatgaccctattgatccgtacttgggagtcggccat

SEQ ID NO: 444726 - DNA, 140 bp, Artificial Sequence
  Synthetic
atggccgactcccaagtacggatcaatagggtcatcatagacctctcccggatctagcatcttgatatggatctcaggatgagaagtgttgctagttgttcttttggtctatagttttttggagacccagcatggcgtat

SEQ ID NO: 444727 - DNA, 140 bp, Artificial Sequence
  Synthetic
aggccctggctgctgatatgccatatcaagatgctagatccgggagaggtctatgatgaccctattgatccaatcgagtcagaggccgaacccagaggagcccccactgtcccaaacatcgaccttttgggacagcggtg

SEQ ID NO: 444728 - DNA, 140 bp, Artificial Sequence
  Synthetic
caccgctgtcccaaaaggtcgatgtttgggacagtgggggctcctctgggttcggcctctgactcgattggatcaatagggtcatcatagacctctcccggatctagcatcttgatatggcatatcagcagccagggcct

SEQ ID NO: 444729 - DNA, 140 bp, Artificial Sequence
  Synthetic
atacgccatgctgggtctcccagttccaatcatcaagcccgtccaaactcattcgccgaatttttaaacaagacgtattcgaatgactcataaggagttgattgacagggtgccagaaatcgtacttgggagtcggccat

SEQ ID NO: 444730 - DNA, 140 bp, Artificial Sequence
  Synthetic
atggccgactcccaagtacgatttctggcaccctgtcaatcaactccttatgagtcattcgaatacgtcttgtttaaaaattcggcgaatgagtttggacgggcttgatgattggaactgggagacccagcatggcgtat

SEQ ID NO: 444731 - DNA, 140 bp, Artificial Sequence
  Synthetic
atacgccatgctgggtctcctgcaactctagcttgagtctctcatctcactggattaggctgatttacaaaatagtaaagacaactagacttgtcggaagcatagaagacctatccggggcgtacttgggagtcggccat

SEQ ID NO: 444732 - DNA, 140 bp, Artificial Sequence
  Synthetic
atggccgactcccaagtacgccccggataggtcttctatgcttccgacaagtctagttgtctttactattttgtaaatcagcctaatccagtgagatgagagactcaagctagagttgcaggagacccagcatggcgtat

SEQ ID NO: 444733 - DNA, 140 bp, Artificial Sequence
  Synthetic
atacgccatgctgggtctccgagaagctgttgaattatacactaggaaacagagggctgagaatccccccagagggggtattaagttgccttgagagggtcgattatgataaggcatttgcgtacttgggagtcggccat

SEQ ID NO: 444734 - DNA, 140 bp, Artificial Sequence
  Synthetic
atggccgactcccaagtacgcaaatgccttatcataatcgaccctctcaaggcaacttaataccccctctggggggattctcagccctctgtttcctagtgtataattcaacagcttctcggagacccagcatggcgtat

SEQ ID NO: 444735 - DNA, 140 bp, Artificial Sequence
  Synthetic
atacgccatgctgggtctccaggagctccagtacctgagggcatgaactgggtatacaaattgaggagaacccttatattccagtgggctgattccaggggccctcttgaaggggaggagcgtacttgggagtcggccat

SEQ ID NO: 444736 - DNA, 140 bp, Artificial Sequence
  Synthetic
atggccgactcccaagtacgctcctccccttcaagagggcccctggaatcagcccactggaatataagggttctcctcaatttgtatacccagttcatgccctcaggtactggagctcctggagacccagcatggcgtat

SEQ ID NO: 444737 - DNA, 140 bp, Artificial Sequence
  Synthetic
atacgccatgctgggtctccggaggtatctggccaacacgtattcctcttatttgttttttcacgtaattacattatacatgaatgccctagactgggacgaggagaaaaccatcctagccgtacttgggagtcggccat

SEQ ID NO: 444738 - DNA, 140 bp, Artificial Sequence
  Synthetic
atggccgactcccaagtacggctaggatggttttctcctcgtcccagtctagggcattcatgtataatgtaattacgtgaaaaaacaaataagaggaatacgtgttggccagatacctccggagacccagcatggcgtat

SEQ ID NO: 444739 - DNA, 140 bp, Artificial Sequence
  Synthetic
atacgccatgctgggtctccccgagccccgatactcggatgatttgatatctcagctatgccagttatacatcgcgggggatcaagtcttgtccatgtgtgggaactccggctacgaaatcgtacttgggagtcggccat

SEQ ID NO: 444740 - DNA, 140 bp, Artificial Sequence
  Synthetic
atggccgactcccaagtacgatttcgtagccggagttcccacacatggacaagacttgatcccccgcgatgtataactggcatagctgagatatcaaatcatccgagtatcggggctcggggagacccagcatggcgtat

SEQ ID NO: 444741 - DNA, 140 bp, Artificial Sequence
  Synthetic
atacgccatgctgggtctccgaagagtccctacacaatccataccccgactaccactggcttcgaactgtaagaaccaccaaagagtccctcattatcatatccccaagtgtgacagattcgtacttgggagtcggccat

SEQ ID NO: 444742 - DNA, 140 bp, Artificial Sequence
  Synthetic
atggccgactcccaagtacgaatctgtcacacttggggatatgataatgagggactctttggtggttcttacagttcgaagccagtggtagtcggggtatggattgtgtagggactcttcggagacccagcatggcgtat

SEQ ID NO: 444743 - DNA, 140 bp, Artificial Sequence
  Synthetic
atacgccatgctgggtctccaaagacaaggtgaatcagcttgaagggactttcggtcccagtgcaaaaaggttttttagggttctagatcaattcgacaacatacatgacctagtttttgcgtacttgggagtcggccat

SEQ ID NO: 444744 - DNA, 140 bp, Artificial Sequence
  Synthetic
atggccgactcccaagtacgcaaaaactaggtcatgtatgttgtcgaattgatctagaaccctaaaaaacctttttgcactgggaccgaaagtcccttcaagctgattcaccttgtctttggagacccagcatggcgtat

SEQ ID NO: 444745 - DNA, 140 bp, Artificial Sequence
  Synthetic
atacgccatgctgggtctcccaccatttggatgcccgagaatccgagaccaaggacaccttgtgacatttttaccaatagcagagggaagagagcatccaacgggaacaagacttgcggccgtacttgggagtcggccat

SEQ ID NO: 444746 - DNA, 140 bp, Artificial Sequence
  Synthetic
atggccgactcccaagtacggccgcaagtcttgttcccgttggatgctctcttccctctgctattggtaaaaatgtcacaaggtgtccttggtctcggattctcgggcatccaaatggtgggagacccagcatggcgtat

SEQ ID NO: 444747 - DNA, 140 bp, Artificial Sequence
  Synthetic
atacgccatgctgggtctccgtcgtaccaggagtgtttagcaagtgacctagccagaaggatcctcagatggggatttgacaagtactccaagtggtatctagatttgagattccttgcccgtacttgggagtcggccat

SEQ ID NO: 444748 - DNA, 140 bp, Artificial Sequence
  Synthetic
atggccgactcccaagtacgggcaaggaatctcaaatctagataccacttggagtacttgtcaaatccccatctgaggatccttctggctaggtcacttgctaaacactcctggtacgacggagacccagcatggcgtat

SEQ ID NO: 444749 - DNA, 140 bp, Artificial Sequence
  Synthetic
atacgccatgctgggtctccagatctttgagatccctgaatcgatggacccgtcagaaatactagatgacaaatcacattctttcaccaggacaagattagcttcttggctgtcagagaacgtacttgggagtcggccat

SEQ ID NO: 444750 - DNA, 140 bp, Artificial Sequence
  Synthetic
atggccgactcccaagtacgttctctgacagccaagaagctaatcttgtcctggtgaaagaatgtgatttgtcatctagtatttctgacgggtccatcgattcagggatctcaaagatctggagacccagcatggcgtat

SEQ ID NO: 444751 - DNA, 140 bp, Artificial Sequence
  Synthetic
atacgccatgctgggtctccaagccgcctgtcaacccccgagagtttttgaaatctatagaccttggaggattaccagatgaggacttgataattggcctcaagccgaaggaacgagaatcgtacttgggagtcggccat

SEQ ID NO: 444752 - DNA, 140 bp, Artificial Sequence
  Synthetic
atggccgactcccaagtacgattctcgttccttcggcttgaggccaattatcaagtcctcatctggtaatcctccaaggtctatagatttcaaaaactctcgggggttgacaggcggcttggagacccagcatggcgtat

SEQ ID NO: 444753 - DNA, 140 bp, Artificial Sequence
  Synthetic
atacgccatgctgggtctccctgccggatgaggacttgataattggcctcaaaccgaaggaacgagagttgaagattgagggccgattctttgccctgatgtcatggaatttaagattgtcgtacttgggagtcggccat

SEQ ID NO: 444754 - DNA, 140 bp, Artificial Sequence
  Synthetic
atggccgactcccaagtacgacaatcttaaattccatgacatcagggcaaagaatcggccctcaatcttcaactctcgttccttcggtttgaggccaattatcaagtcctcatccggcagggagacccagcatggcgtat

SEQ ID NO: 444755 - DNA, 140 bp, Artificial Sequence
  Synthetic
atacgccatgctgggtctccgactttgacagacaattgctccaggtcttacaaagttttgaaagattatttcaagaaagtagatttgggttctctcaaagtgggcggaactgctgcacagcgtacttgggagtcggccat

SEQ ID NO: 444756 - DNA, 140 bp, Artificial Sequence
  Synthetic
atggccgactcccaagtacgctgtgcagcagttccgcccactttgagagaacccaaatctactttcttgaaataatctttcaaaactttgtaagacctggagcaattgtctgtcaaagtcggagacccagcatggcgtat

SEQ ID NO: 444757 - DNA, 140 bp, Artificial Sequence
  Synthetic
atacgccatgctgggtctcccgacagagtcactggacaagggcttttggattattcgagggtcacatacgcatttcatctggactatgagaagtggaacaatcatcaaagattggagtcacgtacttgggagtcggccat

SEQ ID NO: 444758 - DNA, 140 bp, Artificial Sequence
  Synthetic
atggccgactcccaagtacgtgactccaatctttgatgattgttccacttctcatagtccagatgaaatgcgtatgtgaccctcgaataatccaaaagcccttgtccagtgactctgtcgggagacccagcatggcgtat

SEQ ID NO: 444759 - DNA, 140 bp, Artificial Sequence
  Synthetic
atacgccatgctgggtctccgttgcagaaagactaatagagcagagtcaatacaacacagtcctggagagacagggaggaaagtgtcggtgacttctcacaacggaagggtcatatcttccgtacttgggagtcggccat

SEQ ID NO: 444760 - DNA, 140 bp, Artificial Sequence
  Synthetic
atggccgactcccaagtacggaagatatgacccttccgttgtgagaagtcaccgacactttcctccctgtctctccaggactgtgttgtattgactctgctctattagtctttctgcaacggagacccagcatggcgtat

SEQ ID NO: 444761 - DNA, 140 bp, Artificial Sequence
  Synthetic
atacgccatgctgggtctccacttttccggtgagaccaggagtcctgaagctgtctatacgcgaatcatgatgaacggaggtcgactaaagagatcacacataaggagatatgtttccgtcgtacttgggagtcggccat

SEQ ID NO: 444762 - DNA, 140 bp, Artificial Sequence
  Synthetic
atggccgactcccaagtacgacggaaacatatctccttatgtgtgatctctttagtcgacctccgttcatcatgattcgcgtatagacagcttcaggactcctggtctcaccggaaaagtggagacccagcatggcgtat

SEQ ID NO: 444763 - DNA, 140 bp, Artificial Sequence
  Synthetic
atacgccatgctgggtctccacctctcaggtcttcgagttcccggacgtttcaagaaggatatctagaatggtttctggagcagtgcctcattttcgaaaacttcctgatattcgtctaacgtacttgggagtcggccat

SEQ ID NO: 444764 - DNA, 140 bp, Artificial Sequence
  Synthetic
atggccgactcccaagtacgttagacgaatatcaggaagttttcgaaaatgaggcactgctccagaaaccattctagatatccttcttgaaacgtccgggaactcgaagacctgagaggtggagacccagcatggcgtat

SEQ ID NO: 444765 - DNA, 140 bp, Artificial Sequence
  Synthetic
atacgccatgctgggtctcccgcatttcacctggactatgagaaatggaacaatcatcaaagattggagtcaacagaggatgtattctctgtcctagatcaggtgtttggattgaagaggcgtacttgggagtcggccat

SEQ ID NO: 444766 - DNA, 140 bp, Artificial Sequence
  Synthetic
atggccgactcccaagtacgcctcttcaatccaaacacctgatctaggacagagaatacatcctctgttgactccaatctttgatgattgttccatttctcatagtccaggtgaaatgcgggagacccagcatggcgtat

SEQ ID NO: 444767 - DNA, 140 bp, Artificial Sequence
  Synthetic
aggccctggctgctgatatggagctatcgaggaaggagcatctaaactggggctgatcatcaagaaagaggagaccatgtgtagttatgactttctcatatatgggaaaactcccttgttgaccttttgggacagcggtg

SEQ ID NO: 444768 - DNA, 140 bp, Artificial Sequence
  Synthetic
caccgctgtcccaaaaggtcaacaagggagttttcccatatatgagaaagtcataactacacatggtctcctctttcttgatgatcagccccagtttagatgctccttcctcgatagctccatatcagcagccagggcct

SEQ ID NO: 444769 - DNA, 140 bp, Artificial Sequence
  Synthetic
atacgccatgctgggtctcctagatgaaaggggcttgtacaagtctctgaaaggagcatgcaaactcaagctatgcggagtccccgggctccggctgatggatggaacctgggtctcaatcgtacttgggagtcggccat

SEQ ID NO: 444770 - DNA, 140 bp, Artificial Sequence
  Synthetic
atggccgactcccaagtacgattgagacccaggttccatccatcagccggagcccggggactccgcatagcttgagtttgcatgctcctttcagagacttgtacaagcccctttcatctaggagacccagcatggcgtat

SEQ ID NO: 444771 - DNA, 140 bp, Artificial Sequence
  Synthetic
atacgccatgctgggtctcctccaccaatgcgctaacagtggcacagcactctcaatctttgattaaaccgatgagggatttcctgctcatgtcagtacaggcagtttttcactacctgccgtacttgggagtcggccat

SEQ ID NO: 444772 - DNA, 140 bp, Artificial Sequence
  Synthetic
atggccgactcccaagtacggcaggtagtgaaaaactgcctgtactgacatgagcaggaaatccctcatcggtttaatcaaagattgagagtgctgtgccactgttagcgcattggtggaggagacccagcatggcgtat

SEQ ID NO: 444773 - DNA, 140 bp, Artificial Sequence
  Synthetic
aggccctggctgctgatatggatgagggatttcctgctcatgtcagtacaggcagtttttcactacctgctgtttagcccaatcttaaaggggagagtttacaagattctgagtgctgaagaccttttgggacagcggtg

SEQ ID NO: 444774 - DNA, 140 bp, Artificial Sequence
  Synthetic
caccgctgtcccaaaaggtcttcagcactcagaatcttgtaaactctcccctttaagattgggctaaacagcaggtagtgaaaaactgcctgtactgacatgagcaggaaatccctcatccatatcagcagccagggcct

SEQ ID NO: 444775 - DNA, 140 bp, Artificial Sequence
  Synthetic
atacgccatgctgggtctcctcctactaccttaaatatcaaaggaggggccagccctaccattctactcaaggatgctatcagaaaggctctgtacgacgaggtggacaaggtggaaaatcgtacttgggagtcggccat

SEQ ID NO: 444776 - DNA, 140 bp, Artificial Sequence
  Synthetic
atggccgactcccaagtacgattttccaccttgtccacctcgtcgtacagagcctttctgatagcatccttgagtagaatggtagggctggcccctcctttgatatttaaggtagtaggaggagacccagcatggcgtat

SEQ ID NO: 444777 - DNA, 140 bp, Artificial Sequence
  Synthetic
atacgccatgctgggtctccatacaaaactcccggacaataagaaggcagtttagaaagagtctctcaagaactttagaagagtccttctacaactcagagatccacgggattaatcggacgtacttgggagtcggccat

SEQ ID NO: 444778 - DNA, 140 bp, Artificial Sequence
  Synthetic
atggccgactcccaagtacgtccgattaatcccgtggatctctgagttgtagaaggactcttctaaagttcttgagagactctttctaaactgccttcttattgtccgggagttttgtatggagacccagcatggcgtat

SEQ ID NO: 444779 - DNA, 140 bp, Artificial Sequence
  Synthetic
atacgccatgctgggtctccagatcttggggagagaacacttgagagcttcactcgccttttagaagatcctaccaccttaaatatcaagggaggggccagccctaccatcttactcaagcgtacttgggagtcggccat

SEQ ID NO: 444780 - DNA, 140 bp, Artificial Sequence
  Synthetic
atggccgactcccaagtacgcttgagtaagatggtagggctggcccctcccttgatatttaaggtggtaggatcttctaaaaggcgagtgaagctctcaagtgttctctccccaagatctggagacccagcatggcgtat

SEQ ID NO: 444781 - DNA, 140 bp, Artificial Sequence
  Synthetic
atacgccatgctgggtctccctccttgcgcaggacaaggtgggtggatcaagaggtgcgccatgctgcaagaactatgacagggagttacagccccaacaggagggtgtcacgcaaagcacgtacttgggagtcggccat

SEQ ID NO: 444782 - DNA, 140 bp, Artificial Sequence
  Synthetic
atggccgactcccaagtacgtgctttgcgtgacaccctcctgttggggctgtaactccctgtcatagttcttgcagcatggcgcacctcttgatccacccaccttgtcctgcgcaaggagggagacccagcatggcgtat

SEQ ID NO: 444783 - DNA, 140 bp, Artificial Sequence
  Synthetic
atacgccatgctgggtctccgaggtttcaaaaccccttgatctcgggcctgagagtggttcagtgggcaaccggtgcccattataagcttaagcctattctagatgatctaaatgttttccgtacttgggagtcggccat

SEQ ID NO: 444784 - DNA, 140 bp, Artificial Sequence
  Synthetic
atggccgactcccaagtacggaaaacatttagatcatctagaataggcttaagcttataatgggcaccggttgcccactgaaccactctcaggcccgagatcaaggggttttgaaacctcggagacccagcatggcgtat

SEQ ID NO: 444785 - DNA, 140 bp, Artificial Sequence
  Synthetic
atacgccatgctgggtctcctactctttttaaaatctgttgagcccctcttccctagatttctcagtgagctcttcagttcatctttcttgggaatcccagaatcaatcatcggactaatcgtacttgggagtcggccat

SEQ ID NO: 444786 - DNA, 140 bp, Artificial Sequence
  Synthetic
atggccgactcccaagtacgattagtccgatgattgattctgggattcccaagaaagatgaactgaagagctcactgagaaatctagggaagaggggctcaacagattttaaaaagagtaggagacccagcatggcgtat

SEQ ID NO: 444787 - DNA, 140 bp, Artificial Sequence
  Synthetic
atacgccatgctgggtctcccagactaatgttagagtggttgaaaacaggaaatagaccttatcgaatgactctgacagacaattgctccaggtcctataaggttctgaaagattattttcgtacttgggagtcggccat

SEQ ID NO: 444788 - DNA, 140 bp, Artificial Sequence
  Synthetic
atggccgactcccaagtacgaaaataatctttcagaaccttataggacctggagcaattgtctgtcagagtcattcgataaggtctatttcctgttttcaaccactctaacattagtctgggagacccagcatggcgtat

SEQ ID NO: 444789 - DNA, 140 bp, Artificial Sequence
  Synthetic
atacgccatgctgggtctccacccaaacacctcaaagggtcggaagggtgtggccttgctcttcggagagggcagatctgcttagggaaatctcttgggggagaaaagtggtaggcacgacgtacttgggagtcggccat

SEQ ID NO: 444790 - DNA, 140 bp, Artificial Sequence
  Synthetic
atggccgactcccaagtacgtcgtgcctaccacttttctcccccaagagatttccctaagcagatctgccctctccgaagagcaaggccacacccttccgaccctttgaggtgtttgggtggagacccagcatggcgtat

SEQ ID NO: 444791 - DNA, 140 bp, Artificial Sequence
  Synthetic
atacgccatgctgggtctcccagtccctcacccctctgagatgttggggtcacttcctaaatcctccatctcctgcacttgtggggcaacaggggggggcaatcctagagtctccgtatccgtacttgggagtcggccat

SEQ ID NO: 444792 - DNA, 140 bp, Artificial Sequence
  Synthetic
atggccgactcccaagtacggatacggagactctaggattgcccccccctgttgccccacaagtgcaggagatggaggatttaggaagtgaccccaacatctcagaggggtgagggactgggagacccagcatggcgtat

SEQ ID NO: 444793 - DNA, 140 bp, Artificial Sequence
  Synthetic
atacgccatgctgggtctcctatggtaccatgcttgtaaatccggactacagagcaattcaacacctgtccagagcatttcccgcggtcacgggattcataactcagatgacatcgtcttcgtacttgggagtcggccat

SEQ ID NO: 444794 - DNA, 140 bp, Artificial Sequence
  Synthetic
atggccgactcccaagtacgaagacgatgtcatctgagttatgaatcccgtgaccgcgggaaatgctctggacaggtgttgaattgctctgtagtccggatttacaagcatggtaccataggagacccagcatggcgtat

SEQ ID NO: 444795 - DNA, 140 bp, Artificial Sequence
  Synthetic
aggccctggctgctgatatgagagctggtacagagagatacaaggttgagagactctacatttcactggcaccttcggtgcaacaggtgtgtgaggcccattgacgatacaacactggaagaccttttgggacagcggtg

SEQ ID NO: 444796 - DNA, 140 bp, Artificial Sequence
  Synthetic
caccgctgtcccaaaaggtcttccagtgttgtatcgtcaatgggcctcacacacctgttgcaccgaaggtgccagtgaaatgtagagtctctcaaccttgtatctctctgtaccagctctcatatcagcagccagggcct

SEQ ID NO: 444797 - DNA, 140 bp, Artificial Sequence
  Synthetic
atacgccatgctgggtctccacttctcaaatcttcgagtttccagatgtgtcaaaaaggatatccaggatggtatctggagccgtccctcactttcaaaagcttcctgatattcgtctgacgtacttgggagtcggccat

SEQ ID NO: 444798 - DNA, 140 bp, Artificial Sequence
  Synthetic
atggccgactcccaagtacgtcagacgaatatcaggaagcttttgaaagtgagggacggctccagataccatcctggatatcctttttgacacatctggaaactcgaagatttgagaagtggagacccagcatggcgtat

SEQ ID NO: 444799 - DNA, 140 bp, Artificial Sequence
  Synthetic
atacgccatgctgggtctccaaaatagtaaagactaccagactagttggaagcctagaagacttgtccagggaaatagagaagcaccttcgggggtataacaggtggatcacactggatgcgtacttgggagtcggccat

SEQ ID NO: 444800 - DNA, 140 bp, Artificial Sequence
  Synthetic
atggccgactcccaagtacgcatccagtgtgatccacctgttatacccccgaaggtgcttctctatttccctggacaagtcttctaggcttccaactagtctggtagtctttactattttggagacccagcatggcgtat

SEQ ID NO: 444801 - DNA, 140 bp, Artificial Sequence
  Synthetic
atacgccatgctgggtctcctatggaactgaaggtgggatacatctctgccataaaagtgaacgggttcacttgtacaggtgtcgtgacagaagctgagacctataccaactttgttggtcgtacttgggagtcggccat

SEQ ID NO: 444802 - DNA, 140 bp, Artificial Sequence
  Synthetic
atggccgactcccaagtacgaccaacaaagttggtataggtctcagcttctgtcacgacacctgtacaagtgaacccgttcacttttatggcagagatgtatcccaccttcagttccataggagacccagcatggcgtat

SEQ ID NO: 444803 - DNA, 140 bp, Artificial Sequence
  Synthetic
atacgccatgctgggtctccaggcaacagatcgatcttgtgttacctccaacatgtgctgcgctatgaacgagaggtaatcactgcgtccccggagaatgactggctgtggatcttctcacgtacttgggagtcggccat

SEQ ID NO: 444804 - DNA, 140 bp, Artificial Sequence
  Synthetic
atggccgactcccaagtacgtgagaagatccacagccagtcattctccggggacgcagtgattacctctcgttcatagcgcagcacatgttggaggtaacacaagatcgatctgttgcctggagacccagcatggcgtat

SEQ ID NO: 444805 - DNA, 140 bp, Artificial Sequence
  Synthetic
atacgccatgctgggtctccctactctgcgacaaatgagttccttaatgaggcaagtgctgggtgggcacggagaagataccttggagtcagacgacgacattcaacgattactaagagacgtacttgggagtcggccat

SEQ ID NO: 444806 - DNA, 140 bp, Artificial Sequence
  Synthetic
atggccgactcccaagtacgtctcttagtaatcgttgaatgtcgtcgtctgactccaaggtatcttctccgtgcccacccagcacttgcctcattaaggaactcatttgtcgcagagtagggagacccagcatggcgtat

SEQ ID NO: 444807 - DNA, 140 bp, Artificial Sequence
  Synthetic
atacgccatgctgggtctcctgagtggaggagacgacatcatatccagggtgattgactttgactccatctgggaaaaaccttctgacttgaggaacttgaccacatggaaatacttccacgtacttgggagtcggccat

SEQ ID NO: 444808 - DNA, 140 bp, Artificial Sequence
  Synthetic
atggccgactcccaagtacgtggaagtatttccatgtggtcaagttcctcaagtcagaaggtttttcccagatggagtcaaagtcaatcaccctggatatgatgtcgtctcctccactcaggagacccagcatggcgtat

SEQ ID NO: 444809 - DNA, 140 bp, Artificial Sequence
  Synthetic
atacgccatgctgggtctccggatgttcagaatgggtctgctctgctcaacaggttgcggtctccacttcagccaacccggcccctgtctcggagcttgacattagggccctctctaagacgtacttgggagtcggccat

SEQ ID NO: 444810 - DNA, 140 bp, Artificial Sequence
  Synthetic
atggccgactcccaagtacgtcttagagagggccctaatgtcaagctccgagacaggggccgggttggctgaagtggagaccgcaacctgttgagcagagcagacccattctgaacatccggagacccagcatggcgtat

SEQ ID NO: 444811 - DNA, 140 bp, Artificial Sequence
  Synthetic
atacgccatgctgggtctccatccctctgtcttgtagttggagacggatcagggggaatatcaagggcagttctcaacatgtttccagatgccaagcttgtgttcaacagcttattagagcgtacttgggagtcggccat

SEQ ID NO: 444812 - DNA, 140 bp, Artificial Sequence
  Synthetic
atggccgactcccaagtacgctctaataagctgttgaacacaagcttggcatctggaaacatgttgagaactgcccttgatattccccctgatccgtctccaactacaagacagagggatggagacccagcatggcgtat

SEQ ID NO: 444813 - DNA, 140 bp, Artificial Sequence
  Synthetic
aggccctggctgctgatatgatgaacggaggtcgattgaagagatcacacataaggagatatgttgctgtcagttctaaccatcaagcccgcccaaactcatttgccgagtttctaaacagaccttttgggacagcggtg

SEQ ID NO: 444814 - DNA, 140 bp, Artificial Sequence
  Synthetic
caccgctgtcccaaaaggtctgtttagaaactcggcaaatgagtttgggcgggcttgatggttagaactgacagcaacatatctccttatgtgtgatctcttcaatcgacctccgttcatcatatcagcagccagggcct

SEQ ID NO: 444815 - DNA, 140 bp, Artificial Sequence
  Synthetic
atacgccatgctgggtctcccatgagtggaggggatgacatcctctccagagtgatagacttcgactcgatttgggaaaagccttccgacctgaggaacttggctacctggagatacttccgtacttgggagtcggccat

SEQ ID NO: 444816 - DNA, 140 bp, Artificial Sequence
  Synthetic
atggccgactcccaagtacggaagtatctccaggtagccaagttcctcaggtcggaaggcttttcccaaatcgagtcgaagtctatcactctggagaggatgtcatcccctccactcatgggagacccagcatggcgtat

SEQ ID NO: 444817 - DNA, 140 bp, Artificial Sequence
  Synthetic
aggccctggctgctgatatgagaaacatagaagacaatcaagcccatctccagggagaacccatagaagtggataatctccctgaggatatgaggcgacttcagctggatgacggaaaacgaccttttgggacagcggtg

SEQ ID NO: 444818 - DNA, 140 bp, Artificial Sequence
  Synthetic
caccgctgtcccaaaaggtcgttttccgtcatccagctgaagtcgcctcatatcctcagggagattatccacttctatgggttctccctggagatgggcttgattgtcttctatgtttctcatatcagcagccagggcct

SEQ ID NO: 444819 - DNA, 140 bp, Artificial Sequence
  Synthetic
atacgccatgctgggtctccaagagcattcccttcggtcacagggtttataacacaagtaacctcgtctttctcgtctgaactatacctccggttctccaaacgagggaaattttttaggcgtacttgggagtcggccat

SEQ ID NO: 444820 - DNA, 140 bp, Artificial Sequence
  Synthetic
atggccgactcccaagtacgcctaaaaaatttccctcgtttggagaaccggaggtatagttcagacgagaaagacgaggttacttgtgttataaaccctgtgaccgaagggaatgctcttggagacccagcatggcgtat

SEQ ID NO: 444821 - DNA, 140 bp, Artificial Sequence
  Synthetic
aggccctggctgctgatatgatgaacggaggccgactaaagagatcgcacatacggagatatgtttcagtcagctccaatcaccaagctcgtccgaactcatttgccgagtttctaaatagaccttttgggacagcggtg

SEQ ID NO: 444822 - DNA, 140 bp, Artificial Sequence
  Synthetic
caccgctgtcccaaaaggtctatttagaaactcggcaaatgagttcggacgagcttggtgattggagctgactgaaacatatctccgtatgtgcgatctctttagtcggcctccgttcatcatatcagcagccagggcct

SEQ ID NO: 444823 - DNA, 140 bp, Artificial Sequence
  Synthetic
atacgccatgctgggtctccaatgtttccaaacccttgactgaccccctgttttatcccccatctgatcctaaaatcttgaggcacttcaatatatgctgcagtactatgatgtatctatcgtacttgggagtcggccat

SEQ ID NO: 444824 - DNA, 140 bp, Artificial Sequence
  Synthetic
atggccgactcccaagtacgatagatacatcatagtactgcagcatatattgaagtgcctcaagattttaggatcagatgggggataaaacagggggtcagtcaagggtttggaaacattggagacccagcatggcgtat

SEQ ID NO: 444825 - DNA, 140 bp, Artificial Sequence
  Synthetic
aggccctggctgctgatatgacaaattcccatcccggtcatcagggatattcttgtacaattttgagcagttgaaaatgaacctcgacgatatagtcaaagagtcaaaaaatgtgccagggaccttttgggacagcggtg

SEQ ID NO: 444826 - DNA, 140 bp, Artificial Sequence
  Synthetic
caccgctgtcccaaaaggtccctggcacattttttgactctttgactatatcgtcgaggttcattttcaactgctcaaaattgtacaagaatatccctgatgaccgggatgggaatttgtcatatcagcagccagggcct

SEQ ID NO: 444827 - DNA, 140 bp, Artificial Sequence
  Synthetic
atacgccatgctgggtctccttatctttcttggagctggtccaacgacaccttagtgttcaagcgggtagcctgtaattccagcttgagtctttcatctcattggatcaggttgatttaccgtacttgggagtcggccat

SEQ ID NO: 444828 - DNA, 140 bp, Artificial Sequence
  Synthetic
atggccgactcccaagtacggtaaatcaacctgatccaatgagatgaaagactcaagctggaattacaggctacccgcttgaacactaaggtgtcgttggaccagctccaagaaagataaggagacccagcatggcgtat

SEQ ID NO: 444829 - DNA, 140 bp, Artificial Sequence
  Synthetic
aggccctggctgctgatatggcttgtattcaatagcctattagaggtgaatgatctaatggcatcagggacacatccattacccccttcagcaatcatgagcggaggagatgacatcatcgaccttttgggacagcggtg

SEQ ID NO: 444830 - DNA, 140 bp, Artificial Sequence
  Synthetic
caccgctgtcccaaaaggtcgatgatgtcatctcctccgctcatgattgctgaagggggtaatggatgtgtccctgatgccattagatcattcacctctaataggctattgaatacaagccatatcagcagccagggcct

SEQ ID NO: 444831 - DNA, 140 bp, Artificial Sequence
  Synthetic
atacgccatgctgggtctccaagatagtgaagactaccagactcgtcggcagcttagaagacctattgggagaggtggaacgacatcttcacgggtacaacagatggatcaccctcgaggcgtacttgggagtcggccat

SEQ ID NO: 444832 - DNA, 140 bp, Artificial Sequence
  Synthetic
atggccgactcccaagtacgcctcgagggtgatccatctgttgtacccgtgaagatgtcgttccacctctcccaataggtcttctaagctgccgacgagtctggtagtcttcactatcttggagacccagcatggcgtat

SEQ ID NO: 444833 - DNA, 140 bp, Artificial Sequence
  Synthetic
atacgccatgctgggtctccagtcagtccaagaacaggtaaatatgtcctatgaccttatcatttgtgatgcggaggtcactgacattgcatcaatcaaccgaataaccctgctaatgtccgtacttgggagtcggccat

SEQ ID NO: 444834 - DNA, 140 bp, Artificial Sequence
  Synthetic
atggccgactcccaagtacggacattagcagggttattcggttgattgatgcaatgtcagtgacctccgcatcacaaatgataaggtcataggacatatttacctgttcttggactgactggagacccagcatggcgtat

SEQ ID NO: 444835 - DNA, 140 bp, Artificial Sequence
  Synthetic
atacgccatgctgggtctccaaaaatgtaacacccctaaaatggataccgacaagattgtatttaaagtcaaaaatcaggttgtttccttaaagcctgaaatcatcgtagatcaatatgacgtacttgggagtcggccat

SEQ ID NO: 444836 - DNA, 140 bp, Artificial Sequence
  Synthetic
atggccgactcccaagtacgtcatattgatctacgatgatttcaggctttaaggaaacaacctgatttttgactttaaatacaatcttgtcggtatccattttaggggtgttacatttttggagacccagcatggcgtat

SEQ ID NO: 444837 - DNA, 140 bp, Artificial Sequence
  Synthetic
atacgccatgctgggtctccaatgcagctaagctagacccagatgatgtgtgttcctatttggcagctgccatgcaattctttgaaggaacatgtccggaggactggactagctatgaaacgtacttgggagtcggccat

SEQ ID NO: 444838 - DNA, 140 bp, Artificial Sequence
  Synthetic
atggccgactcccaagtacgtttcatagctagtccagtcctccggacatgttccttcaaagaattgcatggcagctgccaaataggaacacacatcatctgggtctagcttagctgcattggagacccagcatggcgtat

SEQ ID NO: 444839 - DNA, 140 bp, Artificial Sequence
  Synthetic
atacgccatgctgggtctccattgactagggatcccaccatctcagaacatgcatctttggttggtcttcttctgagtctatatagactgagcaagatatctggactaaacaccggcaatcgtacttgggagtcggccat

SEQ ID NO: 444840 - DNA, 140 bp, Artificial Sequence
  Synthetic
atggccgactcccaagtacgattgccggtgtttagtccagatatcttgctcagtctatatagactcagaagaagaccaaccaaagatgcatgttctgagatggtgggatccctagtcaatggagacccagcatggcgtat

SEQ ID NO: 444841 - DNA, 140 bp, Artificial Sequence
  Synthetic
aggccctggctgctgatatgttatggtgccatcaaaccgctgcattttatcaaaatctgattgattacctttgcattttcagcctcttggatgtgaaaaaaacttttaacacccctcaaagaccttttgggacagcggtg

SEQ ID NO: 444842 - DNA, 140 bp, Artificial Sequence
  Synthetic
caccgctgtcccaaaaggtctttgaggggtgttaaaagtttttttcacatccaagaggctgaaaatgcaaaggtaatcaatcagattttgataaaatgcagcggtttgatggcaccataacatatcagcagccagggcct

SEQ ID NO: 444843 - DNA, 140 bp, Artificial Sequence
  Synthetic
atacgccatgctgggtctccgcgcaaactggagcaccataccgaacttcagattcttagctggaacttatgacatgtttttctcccggattgaacatctatactcagcaataagagtgggcgtacttgggagtcggccat

SEQ ID NO: 444844 - DNA, 140 bp, Artificial Sequence
  Synthetic
atggccgactcccaagtacgcccactcttattgctgagtatagatgttcaatccgggagaaaaacatgtcataagttccagctaagaatctgaagttcggtatggtgctccagtttgcgcggagacccagcatggcgtat

SEQ ID NO: 444845 - DNA, 140 bp, Artificial Sequence
  Synthetic
atacgccatgctgggtctccaaaaatgtaacacccctacaatggatgccgacaagattgtatttaaagtcaagaatcaggtggtctccttgaagcctgagatcatcgtggaccaatatgacgtacttgggagtcggccat

SEQ ID NO: 444846 - DNA, 140 bp, Artificial Sequence
  Synthetic
atggccgactcccaagtacgtcatattggtccacgatgatctcaggcttcaaggagaccacctgattcttgactttaaatacaatcttgtcggcatccattgtaggggtgttacatttttggagacccagcatggcgtat

SEQ ID NO: 444847 - DNA, 140 bp, Artificial Sequence
  Synthetic
atacgccatgctgggtctccttccacaagaattttgaagaggaaataaggagaatgtttgagccaggacaggaaactgcagttcctcactcctacttcatccattttcgatctttgggcccgtacttgggagtcggccat

SEQ ID NO: 444848 - DNA, 140 bp, Artificial Sequence
  Synthetic
atggccgactcccaagtacgggcccaaagatcgaaaatggatgaagtaggagtgaggaactgcagtttcctgtcctggctcaaacattctccttatttcctcttcaaaattcttgtggaaggagacccagcatggcgtat

SEQ ID NO: 444849 - DNA, 140 bp, Artificial Sequence
  Synthetic
aggccctggctgctgatatgatggaactcaaagtagggtacatttcagccataaaagtgaacgggttcacttgcacgggtgttgtgacagaagcagagacctacacaaactttgtcggctgaccttttgggacagcggtg

SEQ ID NO: 444850 - DNA, 140 bp, Artificial Sequence
  Synthetic
caccgctgtcccaaaaggtcagccgacaaagtttgtgtaggtctctgcttctgtcacaacacccgtgcaagtgaacccgttcacttttatggctgaaatgtaccctactttgagttccatcatatcagcagccagggcct

SEQ ID NO: 444851 - DNA, 140 bp, Artificial Sequence
  Synthetic
atacgccatgctgggtctccttgcacgggtgttgtgacagaagcagagacctacacaaactttgtcggctacgtcaccaccacgttcaagagaaagcacttccgcccgacaccagatgcccgtacttgggagtcggccat

SEQ ID NO: 444852 - DNA, 140 bp, Artificial Sequence
  Synthetic
atggccgactcccaagtacgggcatctggtgtcgggcggaagtgctttctcttgaacgtggtggtgacgtagccgacaaagtttgtgtaggtctctgcttctgtcacaacacccgtgcaaggagacccagcatggcgtat

SEQ ID NO: 444853 - DNA, 140 bp, Artificial Sequence
  Synthetic
atacgccatgctgggtctccaacggtaatagccacctgtgctccgcatgagatgtctgttctcggaggttatttgggggaggagttctttggtaagggaacttttgagagaagattcttccgtacttgggagtcggccat

SEQ ID NO: 444854 - DNA, 140 bp, Artificial Sequence
  Synthetic
atggccgactcccaagtacggaagaatcttctctcaaaagttcccttaccaaagaactcctcccccaaataacctccgagaacagacatctcatgcggagcacaggtggctattaccgttggagacccagcatggcgtat

SEQ ID NO: 444855 - DNA, 140 bp, Artificial Sequence
  Synthetic
aggccctggctgctgatatgtcaaaagacttaaggaaagatggttcctcaggttcttttgtttgtaccccttctggttttctcaatgtgtttcgggaaattccctatctatacgataccagaccttttgggacagcggtg

SEQ ID NO: 444856 - DNA, 140 bp, Artificial Sequence
  Synthetic
caccgctgtcccaaaaggtctggtatcgtatagatagggaatttcccgaaacacattgagaaaaccagaaggggtacaaacaaaagaacctgaggaaccatctttccttaagtcttttgacatatcagcagccagggcct

SEQ ID NO: 444857 - DNA, 140 bp, Artificial Sequence
  Synthetic
atacgccatgctgggtctccatttttccggtgaaaccaggagtccagaggcagtctacactcgcattatgatgaatggaggccgactcaaaagatcacacataaggagatatgtctcagtcgtacttgggagtcggccat

SEQ ID NO: 444858 - DNA, 140 bp, Artificial Sequence
  Synthetic
atggccgactcccaagtacgactgagacatatctccttatgtgtgatcttttgagtcggcctccattcatcataatgcgagtgtagactgcctctggactcctggtttcaccggaaaaatggagacccagcatggcgtat

SEQ ID NO: 444859 - DNA, 140 bp, Artificial Sequence
  Synthetic
aggccctggctgctgatatgaatagcagagggaagagggcatccaaaggaagcaaaacctgtggatttgtggacgaaagaggcttgtacaagtctctaaaaggagcatgcaaattgaagcgaccttttgggacagcggtg

SEQ ID NO: 444860 - DNA, 140 bp, Artificial Sequence
  Synthetic
caccgctgtcccaaaaggtcgcttcaatttgcatgctccttttagagacttgtacaagcctctttcgtccacaaatccacaggttttgcttcctttggatgccctcttccctctgctattcatatcagcagccagggcct

SEQ ID NO: 444861 - DNA, 140 bp, Artificial Sequence
  Synthetic
aggccctggctgctgatatgcggttatgtcaccaccacgttcaaaagaaagcatttccgcccaacaccagatgcatgtcgagctgcttacaactggaagatggccggtgaccccagatatgaccttttgggacagcggtg

SEQ ID NO: 444862 - DNA, 140 bp, Artificial Sequence
  Synthetic
caccgctgtcccaaaaggtcatatctggggtcaccggccatcttccagttgtaagcagctcgacatgcatctggtgttgggcggaaatgctttcttttgaacgtggtggtgacataaccgcatatcagcagccagggcct

SEQ ID NO: 444863 - DNA, 140 bp, Artificial Sequence
  Synthetic
atacgccatgctgggtctcctaataaatcatgcaatttcttcacgaaaaaaactaacacccctccttaagaaccatctcaaacatgagcaagatctttgttaacccaagtgcaatcagggcgtacttgggagtcggccat

SEQ ID NO: 444864 - DNA, 140 bp, Artificial Sequence
  Synthetic
atggccgactcccaagtacgccctgattgcacttgggttaacaaagatcttgctcatgtttgagatggttcttaaggaggggtgttagtttttttcgtgaagaaattgcatgatttattaggagacccagcatggcgtat

SEQ ID NO: 444865 - DNA, 140 bp, Artificial Sequence
  Synthetic
aggccctggctgctgatatgtgctcgggaataacaatatcatctacttactgctctactaaccatgattacacaatctggatgcccgagaatccgagactggggacatcttgtgacatctgaccttttgggacagcggtg

SEQ ID NO: 444866 - DNA, 140 bp, Artificial Sequence
  Synthetic
caccgctgtcccaaaaggtcagatgtcacaagatgtccccagtctcggattctcgggcatccagattgtgtaatcatggttagtagagcagtaagtagatgatattgttattcccgagcacatatcagcagccagggcct

SEQ ID NO: 444867 - DNA, 140 bp, Artificial Sequence
  Synthetic
atacgccatgctgggtctccggatagtcttcctgaagacatgaggaggctccagttgaataatgaaaaacaatatggccttgccgaggtggacaaagaaggagagaacaagagccatgagcgtacttgggagtcggccat

SEQ ID NO: 444868 - DNA, 140 bp, Artificial Sequence
  Synthetic
atggccgactcccaagtacgctcatggctcttgttctctccttctttgtccacctcggcaaggccatattgtttttcattattcaactggagcctcctcatgtcttcaggaagactatccggagacccagcatggcgtat

SEQ ID NO: 444869 - DNA, 140 bp, Artificial Sequence
  Synthetic
aggccctggctgctgatatgttaccaacagtagagggaagagagcatccaaagggggcaaaacttgcggatttgttgatgaaagaggcttgtacaagtctttgaaaggggcatgcaagctgaccttttgggacagcggtg

SEQ ID NO: 444870 - DNA, 140 bp, Artificial Sequence
  Synthetic
caccgctgtcccaaaaggtcagcttgcatgcccctttcaaagacttgtacaagcctctttcatcaacaaatccgcaagttttgccccctttggatgctctcttccctctactgttggtaacatatcagcagccagggcct

SEQ ID NO: 444871 - DNA, 140 bp, Artificial Sequence
  Synthetic
aggccctggctgctgatatgtgcttaagagttggggggagatgtcacccccatgttaacggggtgtttttcaacggtatcatcctgggtcctgatggacatgttctaatcccagaaatgcgaccttttgggacagcggtg

SEQ ID NO: 444872 - DNA, 140 bp, Artificial Sequence
  Synthetic
caccgctgtcccaaaaggtcgcatttctgggattagaacatgtccatcaggacccaggatgataccgttgaaaaacaccccgttaacatgggggtgacatctccccccaactcttaagcacatatcagcagccagggcct

SEQ ID NO: 444873 - DNA, 140 bp, Artificial Sequence
  Synthetic
atacgccatgctgggtctccgattcctcaagatatggtctcgtactgtagaggaaattatatcctatgtaatgattaatttctccagttctctggggaggccttccgaagacaaatctaccgtacttgggagtcggccat

SEQ ID NO: 444874 - DNA, 140 bp, Artificial Sequence
  Synthetic
atggccgactcccaagtacggtagatttgtcttcggaaggcctccccagagaactggagaaattaatcattacataggatataatttcctctacagtacgagaccatatcttgaggaatcggagacccagcatggcgtat

SEQ ID NO: 444875 - DNA, 140 bp, Artificial Sequence
  Synthetic
atacgccatgctgggtctcccgaggcggaagattttgttgaggttcaccttccggatgtgcacaagcaggtctcgggagttgatctcggtctcccaagctgggggaagtatgtgctgatgcgtacttgggagtcggccat

SEQ ID NO: 444876 - DNA, 140 bp, Artificial Sequence
  Synthetic
atggccgactcccaagtacgcatcagcacatacttcccccagcttgggagaccgagatcaactcccgagacctgcttgtgcacatccggaaggtgaacctcaacaaaatcttccgcctcgggagacccagcatggcgtat

SEQ ID NO: 444877 - DNA, 140 bp, Artificial Sequence
  Synthetic
atacgccatgctgggtctccggccctcctgccctggattggtccgccaccaacgaggaggatgatctatctgtggaggctgagattgcccaccaaattgcagagagcttctctaagaagtcgtacttgggagtcggccat

SEQ ID NO: 444878 - DNA, 140 bp, Artificial Sequence
  Synthetic
atggccgactcccaagtacgacttcttagagaagctctctgcaatttggtgggcaatctcagcctccacagatagatcatcctcctcgttggtggcggaccaatccagggcaggagggccggagacccagcatggcgtat

SEQ ID NO: 444879 - DNA, 140 bp, Artificial Sequence
  Synthetic
atacgccatgctgggtctcctttataactcaggtgacttcatctttttcatccgagttgtacctcagattctccaaacgggggaagttcttccgagatgcagaatatttgacctcctctgcgtacttgggagtcggccat

SEQ ID NO: 444880 - DNA, 140 bp, Artificial Sequence
  Synthetic
atggccgactcccaagtacgcagaggaggtcaaatattctgcatctcggaagaacttcccccgtttggagaatctgaggtacaactcggatgaaaaagatgaagtcacctgagttataaaggagacccagcatggcgtat

SEQ ID NO: 444881 - DNA, 140 bp, Artificial Sequence
  Synthetic
aggccctggctgctgatatgcgggaaggaaagtgtcagtcacctcccagaacgggagggtcatatcttcctgggagtcgtataaaagcgggggtgagaccaagctgtaaagaaagaccatgaccttttgggacagcggtg

SEQ ID NO: 444882 - DNA, 140 bp, Artificial Sequence
  Synthetic
caccgctgtcccaaaaggtcatggtctttctttacagcttggtctcacccccgcttttatacgactcccaggaagatatgaccctcccgttctgggaggtgactgacactttccttcccgcatatcagcagccagggcct

SEQ ID NO: 444883 - DNA, 140 bp, Artificial Sequence
  Synthetic
atacgccatgctgggtctcctgttacccgcctggctcgtgacgggtccaagctccctctgagatgtgtgcttgggtgggttgctctagccagctccagaaagttccagctgctagttgagcgtacttgggagtcggccat

SEQ ID NO: 444884 - DNA, 140 bp, Artificial Sequence
  Synthetic
atggccgactcccaagtacgctcaactagcagctggaactttctggagctggctagagcaacccacccaagcacacatctcagagggagcttggacccgtcacgagccaggcgggtaacaggagacccagcatggcgtat

SEQ ID NO: 444885 - DNA, 140 bp, Artificial Sequence
  Synthetic
atacgccatgctgggtctccggacagtcttcccgaggatataagacggcttcaattggatgatacgaaaccatctggactaggtgagattgctgcaatgggggaaagcaagtgtcaggaacgtacttgggagtcggccat

SEQ ID NO: 444886 - DNA, 140 bp, Artificial Sequence
  Synthetic
atggccgactcccaagtacgttcctgacacttgctttcccccattgcagcaatctcacctagtccagatggtttcgtatcatccaattgaagccgtcttatatcctcgggaagactgtccggagacccagcatggcgtat

SEQ ID NO: 444887 - DNA, 140 bp, Artificial Sequence
  Synthetic
atacgccatgctgggtctcctcaagagtcacaagatttccattaatcatctcaatcgatcagatatggtgatgtagattctcataatacaagagatcttctagcagttccagtgaccaaccgtacttgggagtcggccat

SEQ ID NO: 444888 - DNA, 140 bp, Artificial Sequence
  Synthetic
atggccgactcccaagtacggttggtcactggaactgctagaagatctcttgtattatgagaatctacatcaccatatctgatcgattgagatgattaatggaaatcttgtgactcttgaggagacccagcatggcgtat

SEQ ID NO: 444889 - DNA, 140 bp, Artificial Sequence
  Synthetic
atacgccatgctgggtctcctaatccaaatttgacgtgaaaaaaacagacaacaccactgatacaatgaatttcctacgcaagatagtgaagaactgcagagatgaggacaatcagaagccgtacttgggagtcggccat

SEQ ID NO: 444890 - DNA, 140 bp, Artificial Sequence
  Synthetic
atggccgactcccaagtacggcttctgattgtcctcatctctgcagttcttcactatcttgcgtaggaaattcattgtatcagtggtgttgtctgtttttttcacgtcaaatttggattaggagacccagcatggcgtat

SEQ ID NO: 444891 - DNA, 140 bp, Artificial Sequence
  Synthetic
aggccctggctgctgatatgacggtcaacttctccagtccgccagggaagtctacagaagacaaagccacccaaactgctggccgtgaacccaagaaagagactgtgtctgctccctctcgaccttttgggacagcggtg

SEQ ID NO: 444892 - DNA, 140 bp, Artificial Sequence
  Synthetic
caccgctgtcccaaaaggtcgagagggagcagacacagtctctttcttgggttcacggccagcagtttgggtggctttgtcttctgtagacttccctggcggactggagaagttgaccgtcatatcagcagccagggcct

SEQ ID NO: 444893 - DNA, 140 bp, Artificial Sequence
  Synthetic
atacgccatgctgggtctcctttttgcatcaatggggaagtcagggtatgtagtccaaatggatattcttttaggattttacgtcacatattaaaatcatttgatgagatatattctgggcgtacttgggagtcggccat

SEQ ID NO: 444894 - DNA, 140 bp, Artificial Sequence
  Synthetic
atggccgactcccaagtacgcccagaatatatctcatcaaatgattttaatatgtgacgtaaaatcctaaaagaatatccatttggactacataccctgacttccccattgatgcaaaaaggagacccagcatggcgtat

SEQ ID NO: 444895 - DNA, 140 bp, Artificial Sequence
  Synthetic
aggccctggctgctgatatgcgctggggatcaagtcctgtccatgtgtgggaactccggctatgaagtcatcaagatcttggagccgtatgttgtgaacagtctagtccatagagcagaagaccttttgggacagcggtg

SEQ ID NO: 444896 - DNA, 140 bp, Artificial Sequence
  Synthetic
caccgctgtcccaaaaggtcttctgctctatggactagactgttcacaacatacggctccaagatcttgatgacttcatagccggagttcccacacatggacaggacttgatccccagcgcatatcagcagccagggcct

SEQ ID NO: 444897 - DNA, 140 bp, Artificial Sequence
  Synthetic
atacgccatgctgggtctccctcttatcttccagtgggccgattctaggggccccttggagggggaggaattagagtactcccaggagatcacatgggatgatgataccgaatttgtcggcgtacttgggagtcggccat

SEQ ID NO: 444898 - DNA, 140 bp, Artificial Sequence
  Synthetic
atggccgactcccaagtacgccgacaaattcggtatcatcatcccatgtgatctcctgggagtactctaattcctccccctccaaggggcccctagaatcggcccactggaagataagagggagacccagcatggcgtat

SEQ ID NO: 444899 - DNA, 140 bp, Artificial Sequence
  Synthetic
atacgccatgctgggtctcccgtgacccgtttggctcatgatggatccaagctccctctgagatgtgtgttggggtgggttgccctagccaaatccaagaagttccagctgttagttgagcgtacttgggagtcggccat

SEQ ID NO: 444900 - DNA, 140 bp, Artificial Sequence
  Synthetic
atggccgactcccaagtacgctcaactaacagctggaacttcttggatttggctagggcaacccaccccaacacacatctcagagggagcttggatccatcatgagccaaacgggtcacgggagacccagcatggcgtat

SEQ ID NO: 444901 - DNA, 140 bp, Artificial Sequence
  Synthetic
aggccctggctgctgatatgctaacagacaactgctctaggtcttacaaggtctttaaggattacttcaagaagtttgatttgggatctgttaaagtaggtgggactgcggcccagtcgagaccttttgggacagcggtg

SEQ ID NO: 444902 - DNA, 140 bp, Artificial Sequence
  Synthetic
caccgctgtcccaaaaggtctcgactgggccgcagtcccacctactttaacagatcccaaatcaaacttcttgaagtaatccttaaagaccttgtaagacctagagcagttgtctgttagcatatcagcagccagggcct

SEQ ID NO: 444903 - DNA, 140 bp, Artificial Sequence
  Synthetic
atacgccatgctgggtctccctcaaaacacagagatctgaggaggacaaagactcttctgtccttctcgaatagttgagttatatcctgtaagtccctcaattgtttacctctggaggagcgtacttgggagtcggccat

SEQ ID NO: 444904 - DNA, 140 bp, Artificial Sequence
  Synthetic
atggccgactcccaagtacgctcctccagaggtaaacaattgagggacttacaggatataactcaactattcgagaaggacagaagagtctttgtcctcctcagatctctgtgttttgagggagacccagcatggcgtat

SEQ ID NO: 444905 - DNA, 140 bp, Artificial Sequence
  Synthetic
aggccctggctgctgatatgatcttgaggaactctgattacaatctcaattctcctttgatagaagaccctgccagactaatgttagagtggctgacaacaggaaatagaccttaccggagaccttttgggacagcggtg

SEQ ID NO: 444906 - DNA, 140 bp, Artificial Sequence
  Synthetic
caccgctgtcccaaaaggtctccggtaaggtctatttcctgttgtcagccactctaacattagtctggcagggtcttctatcaaaggagaattgagattgtaatcagagttcctcaagatcatatcagcagccagggcct

SEQ ID NO: 444907 - DNA, 140 bp, Artificial Sequence
  Synthetic
aggccctggctgctgatatggaagttgttaaattgcacacttgggaatagaggactaagaattcccccagaaggggtgttgagttgccttgaaagaattgactatgataaggcattcggggaccttttgggacagcggtg

SEQ ID NO: 444908 - DNA, 140 bp, Artificial Sequence
  Synthetic
caccgctgtcccaaaaggtccccgaatgccttatcatagtcaattctttcaaggcaactcaacaccccttctgggggaattcttagtcctctattcccaagtgtgcaatttaacaacttccatatcagcagccagggcct

SEQ ID NO: 444909 - DNA, 140 bp, Artificial Sequence
  Synthetic
atacgccatgctgggtctcctttgcattttaagcctcttggatgtgaaaaaaactattaacatccctcgaaagacctaaggaaagatggttcttcaggcccttctgttcgcaccttttctcgtacttgggagtcggccat

SEQ ID NO: 444910 - DNA, 140 bp, Artificial Sequence
  Synthetic
atggccgactcccaagtacgagaaaaggtgcgaacagaagggcctgaagaaccatctttccttaggtctttcgagggatgttaatagtttttttcacatccaagaggcttaaaatgcaaaggagacccagcatggcgtat

SEQ ID NO: 444911 - DNA, 140 bp, Artificial Sequence
  Synthetic
aggccctggctgctgatatgttcaagaaagtggatttgggctctctcaaagtgggtggaactgctgcacagtcaatgatttccctctggttatatggtgcccactccgaatcaaacagaagaccttttgggacagcggtg

SEQ ID NO: 444912 - DNA, 140 bp, Artificial Sequence
  Synthetic
caccgctgtcccaaaaggtcttctgtttgattcggagtgggcaccatataaccagagggaaatcattgactgtgcagcagttccacccactttgagagagcccaaatccactttcttgaacatatcagcagccagggcct

SEQ ID NO: 444913 - DNA, 140 bp, Artificial Sequence
  Synthetic
atacgccatgctgggtctccaatctagttgtagaagacgaggggtgcaacagtctatcaggaatttcttacatggaactgaaagtgggatatatctccgccataaaggtgaacgggttcacgtacttgggagtcggccat

SEQ ID NO: 444914 - DNA, 140 bp, Artificial Sequence
  Synthetic
atggccgactcccaagtacgtgaacccgttcacctttatggcggagatatatcccactttcagttccatgtaagaaattcctgatagactgttgcacccctcgtcttctacaactagattggagacccagcatggcgtat

SEQ ID NO: 444915 - DNA, 140 bp, Artificial Sequence
  Synthetic
aggccctggctgctgatatgacctttttttgtctcgcttcaactctttgatgattctgctttctccccctgaaccccgatattccgatgacctgatatctcagctatgccagctgtacatgaccttttgggacagcggtg

SEQ ID NO: 444916 - DNA, 140 bp, Artificial Sequence
  Synthetic
caccgctgtcccaaaaggtcatgtacagctggcatagctgagatatcaggtcatcggaatatcggggttcagggggagaaagcagaatcatcaaagagttgaagcgagacaaaaaaaggtcatatcagcagccagggcct

SEQ ID NO: 444917 - DNA, 140 bp, Artificial Sequence
  Synthetic
atacgccatgctgggtctccattggagatacgagtgagtgctagacaatgtcatatccagggaaggatttggtgtatcaacatgaactctcgggcatgtcaattttggtccgacatgtctcgtacttgggagtcggccat

SEQ ID NO: 444918 - DNA, 140 bp, Artificial Sequence
  Synthetic
atggccgactcccaagtacgagacatgtcggaccaaaattgacatgcccgagagttcatgttgatacaccaaatccttccctggatatgacattgtctagcactcactcgtatctccaatggagacccagcatggcgtat

SEQ ID NO: 444919 - DNA, 140 bp, Artificial Sequence
  Synthetic
atacgccatgctgggtctccgtgtagatctgcatacaactggaaactggcaggcgatcctcgttatgaagagtcccttcacaacccatatcccgattaccactggctgcggaccgtaaaacgtacttgggagtcggccat

SEQ ID NO: 444920 - DNA, 140 bp, Artificial Sequence
  Synthetic
atggccgactcccaagtacgttttacggtccgcagccagtggtaatcgggatatgggttgtgaagggactcttcataacgaggatcgcctgccagtttccagttgtatgcagatctacacggagacccagcatggcgtat

SEQ ID NO: 444921 - DNA, 140 bp, Artificial Sequence
  Synthetic
atacgccatgctgggtctcccagctccaatcatcaagctcgacccaattcatttgctgagttcttaaacaagacatattcgaatgactcataaaagattaaacaacaggattgtgaacaccgtacttgggagtcggccat

SEQ ID NO: 444922 - DNA, 140 bp, Artificial Sequence
  Synthetic
atggccgactcccaagtacggtgttcacaatcctgttgtttaatcttttatgagtcattcgaatatgtcttgtttaagaactcagcaaatgaattgggtcgagcttgatgattggagctgggagacccagcatggcgtat

SEQ ID NO: 444923 - DNA, 140 bp, Artificial Sequence
  Synthetic
atacgccatgctgggtctcctcctatgaaggacataagcaatagatcacaatcatcttacatcctgataaggtgtgcataactgcgaagggctgggccatccaagcttttcagtcgagaacgtacttgggagtcggccat

SEQ ID NO: 444924 - DNA, 140 bp, Artificial Sequence
  Synthetic
atggccgactcccaagtacgttctcgactgaaaagcttggatggcccagcccttcgcagttatgcacaccttatcaggatgtaagatgattgtgatctattgcttatgtccttcataggaggagacccagcatggcgtat

SEQ ID NO: 444925 - DNA, 140 bp, Artificial Sequence
  Synthetic
atacgccatgctgggtctcccagggatgaccatttcttctacctactgctcaactaaccatgaatacactatatggatgcccgaaaaggcaggtctcgggacgtcttgtgacatatttaccgtacttgggagtcggccat

SEQ ID NO: 444926 - DNA, 140 bp, Artificial Sequence
  Synthetic
atggccgactcccaagtacggtaaatatgtcacaagacgtcccgagacctgccttttcgggcatccatatagtgtattcatggttagttgagcagtaggtagaagaaatggtcatccctgggagacccagcatggcgtat

SEQ ID NO: 444927 - DNA, 140 bp, Artificial Sequence
  Synthetic
atacgccatgctgggtctcccaatctggttgcagaaaacgacgggtgcaccagtctgtcagggttttcctatatggaactgaaggtgggatacatctctgccataaaggtgaacgggttccgtacttgggagtcggccat

SEQ ID NO: 444928 - DNA, 140 bp, Artificial Sequence
  Synthetic
atggccgactcccaagtacggaacccgttcacctttatggcagagatgtatcccaccttcagttccatataggaaaaccctgacagactggtgcacccgtcgttttctgcaaccagattgggagacccagcatggcgtat

SEQ ID NO: 444929 - DNA, 140 bp, Artificial Sequence
  Synthetic
atacgccatgctgggtctccctatgtggggtctccgggctcagactaatggatgggacttgggttgcaatccagacatcagaagagaccaagtggtgtcctcctgatcagttggtgaatccgtacttgggagtcggccat

SEQ ID NO: 444930 - DNA, 140 bp, Artificial Sequence
  Synthetic
atggccgactcccaagtacggattcaccaactgatcaggaggacaccacttggtctcttctgatgtctggattgcaacccaagtcccatccattagtctgagcccggagaccccacatagggagacccagcatggcgtat

SEQ ID NO: 444931 - DNA, 140 bp, Artificial Sequence
  Synthetic
atacgccatgctgggtctcctaaatcagtaagtttcagacgtctcagccacttgagaaaacttgttccaggctttgggaaagcatataccatattcaacaaaaccttaatggaagcggaccgtacttgggagtcggccat

SEQ ID NO: 444932 - DNA, 140 bp, Artificial Sequence
  Synthetic
atggccgactcccaagtacggtccgcttccattaaggttttgttgaatatggtatatgctttcccaaagcctggaacaagttttctcaagtggctgagacgtctgaaacttactgatttaggagacccagcatggcgtat

SEQ ID NO: 444933 - DNA, 140 bp, Artificial Sequence
  Synthetic
aggccctggctgctgatatgggtgggggtttgacaagtactctaaatggtatcttgattcgcgacttctcacccgagaccaccccttgaccccttatatcaagactcagacgtggccaccgaccttttgggacagcggtg

SEQ ID NO: 444934 - DNA, 140 bp, Artificial Sequence
  Synthetic
caccgctgtcccaaaaggtcggtggccacgtctgagtcttgatataaggggtcaaggggtggtctcgggtgagaagtcgcgaatcaagataccatttagagtacttgtcaaacccccacccatatcagcagccagggcct

SEQ ID NO: 444935 - DNA, 140 bp, Artificial Sequence
  Synthetic
atacgccatgctgggtctcctcaacggcataatactgggtccggacgggcatgtcctgatcccagagatgcagtcgtctcttctccaacagcatatggaactgttggagtcttctgtgatcgtacttgggagtcggccat

SEQ ID NO: 444936 - DNA, 140 bp, Artificial Sequence
  Synthetic
atggccgactcccaagtacgatcacagaagactccaacagttccatatgctgttggagaagagacgactgcatctctgggatcaggacatgcccgtccggacccagtattatgccgttgaggagacccagcatggcgtat

SEQ ID NO: 444937 - DNA, 140 bp, Artificial Sequence
  Synthetic
aggccctggctgctgatatggaacagaggggggcctgctcccagcgagaaggtcattatcacggccttgtctaagccgcccgtcaaccccagagaatttctaaagaccatcgatctcggagaccttttgggacagcggtg

SEQ ID NO: 444938 - DNA, 140 bp, Artificial Sequence
  Synthetic
caccgctgtcccaaaaggtctccgagatcgatggtctttagaaattctctggggttgacgggcggcttagacaaggccgtgataatgaccttctcgctgggagcaggcccccctctgttccatatcagcagccagggcct

SEQ ID NO: 444939 - DNA, 140 bp, Artificial Sequence
  Synthetic
atacgccatgctgggtctccatctcaggggtggatcttggcctcccgagctggggaaagtatgtgctaatgagtgcaggtgccttggcaatcctaatgttggtgatctctttaatgaaatcgtacttgggagtcggccat

SEQ ID NO: 444940 - DNA, 140 bp, Artificial Sequence
  Synthetic
atggccgactcccaagtacgatttcattaaagagatcaccaacattaggattgccaaggcacctgcactcattagcacatactttccccagctcgggaggccaagatccacccctgagatggagacccagcatggcgtat

SEQ ID NO: 444941 - DNA, 140 bp, Artificial Sequence
  Synthetic
aggccctggctgctgatatgcatgcacgggcgttgtgacagaggcagaaacctacactaactttgttggttatgtcaccaccacatttaaaagaaagcatttccgcccaataccagatgcgaccttttgggacagcggtg

SEQ ID NO: 444942 - DNA, 140 bp, Artificial Sequence
  Synthetic
caccgctgtcccaaaaggtcgcatctggtattgggcggaaatgctttcttttaaatgtggtggtgacataaccaacaaagttagtgtaggtttctgcctctgtcacaacgcccgtgcatgcatatcagcagccagggcct

SEQ ID NO: 444943 - DNA, 140 bp, Artificial Sequence
  Synthetic
aggccctggctgctgatatgtttctaggactcatgagttttttcagaagtcctggatctattattcagatagatcagacctcatcggtctatgggaggaccaaatatactgcttagacatgaccttttgggacagcggtg

SEQ ID NO: 444944 - DNA, 140 bp, Artificial Sequence
  Synthetic
caccgctgtcccaaaaggtcatgtctaagcagtatatttggtcctcccatagaccgatgaggtctgatctatctgaataatagatccaggacttctgaaaaaactcatgagtcctagaaacatatcagcagccagggcct

SEQ ID NO: 444945 - DNA, 140 bp, Artificial Sequence
  Synthetic
atacgccatgctgggtctccagatcagacctcatcggtctatgggaggaccaaatatactgcttagacatgtccaatggcccgacctgttggaacggtcaagacggagggctggaaggctcgtacttgggagtcggccat

SEQ ID NO: 444946 - DNA, 140 bp, Artificial Sequence
  Synthetic
atggccgactcccaagtacgagccttccagccctccgtcttgaccgttccaacaggtcgggccattggacatgtctaagcagtatatttggtcctcccatagaccgatgaggtctgatctggagacccagcatggcgtat

SEQ ID NO: 444947 - DNA, 140 bp, Artificial Sequence
  Synthetic
atacgccatgctgggtctccttgggagtcttataagaatggaggggagactgaactgtaaagataggccgtccccatcatacctcacatgcaaaagattgctcccctctgagacattgggcgtacttgggagtcggccat

SEQ ID NO: 444948 - DNA, 140 bp, Artificial Sequence
  Synthetic
atggccgactcccaagtacgcccaatgtctcagaggggagcaatcttttgcatgtgaggtatgatggggacggcctatctttacagttcagtctcccctccattcttataagactcccaaggagacccagcatggcgtat

SEQ ID NO: 444949 - DNA, 140 bp, Artificial Sequence
  Synthetic
aggccctggctgctgatatggacttgtttttctcgcggattgaacatctatattcggcaatcagagtgggcacagtagtcactgcttatgaagactgttcaggactggtatcatttacaggaccttttgggacagcggtg

SEQ ID NO: 444950 - DNA, 140 bp, Artificial Sequence
  Synthetic
caccgctgtcccaaaaggtcctgtaaatgataccagtcctgaacagtcttcataagcagtgactactgtgcccactctgattgccgaatatagatgttcaatccgcgagaaaaacaagtccatatcagcagccagggcct

SEQ ID NO: 444951 - DNA, 140 bp, Artificial Sequence
  Synthetic
atacgccatgctgggtctccacgtagattttgataatgtatggagtatcataataatatcagcgaccgatggtgctctcaccttctaaggaccgataccaaaggttgtagacaggccgaacgtacttgggagtcggccat

SEQ ID NO: 444952 - DNA, 140 bp, Artificial Sequence
  Synthetic
atggccgactcccaagtacgttcggcctgtctacaacctttggtatcggtccttagaaggtgagagcaccatcggtcgctgatattattatgatactccatacattatcaaaatctacgtggagacccagcatggcgtat

SEQ ID NO: 444953 - DNA, 140 bp, Artificial Sequence
  Synthetic
atacgccatgctgggtctcctgttgtaggagggttaataagacaggatccacacagagaggtcatagggaatcaggagggaaaatgtctgtagtacctcaaaacgggaagatcatatcctcgtacttgggagtcggccat

SEQ ID NO: 444954 - DNA, 140 bp, Artificial Sequence
  Synthetic
atggccgactcccaagtacgaggatatgatcttcccgttttgaggtactacagacattttccctcctgattccctatgacctctctgtgtggatcctgtcttattaaccctcctacaacaggagacccagcatggcgtat

SEQ ID NO: 444955 - DNA, 140 bp, Artificial Sequence
  Synthetic
atacgccatgctgggtctcccctatgaaggacaaaaataacagatctcagtcatcttacatttcgataggacgtgcacaactgcaaagggcttggtcatctaatcttttcagtcaggaaacgtacttgggagtcggccat

SEQ ID NO: 444956 - DNA, 140 bp, Artificial Sequence
  Synthetic
atggccgactcccaagtacgtttcctgactgaaaagattagatgaccaagccctttgcagttgtgcacgtcctatcgaaatgtaagatgactgagatctgttatttttgtccttcataggggagacccagcatggcgtat

SEQ ID NO: 444957 - DNA, 140 bp, Artificial Sequence
  Synthetic
aggccctggctgctgatatggaagagaccatgtgtagttacgacttcctcatctacgggaagactcctttgtttcgaggtaacatcttagtgcctgaatctaaaagatgggcccgggtctgaccttttgggacagcggtg

SEQ ID NO: 444958 - DNA, 140 bp, Artificial Sequence
  Synthetic
caccgctgtcccaaaaggtcagacccgggcccatcttttagattcaggcactaagatgttacctcgaaacaaaggagtcttcccgtagatgaggaagtcgtaactacacatggtctcttccatatcagcagccagggcct

SEQ ID NO: 444959 - DNA, 140 bp, Artificial Sequence
  Synthetic
atacgccatgctgggtctccgttgattcagaggctgagccgcgagggaattccactattcctaacatcttgcggaactctgactataatctcaactcccctctgatcgaggacccagctacgtacttgggagtcggccat

SEQ ID NO: 444960 - DNA, 140 bp, Artificial Sequence
  Synthetic
atggccgactcccaagtacgtagctgggtcctcgatcagaggggagttgagattatagtcagagttccgcaagatgttaggaatagtggaattccctcgcggctcagcctctgaatcaacggagacccagcatggcgtat

SEQ ID NO: 444961 - DNA, 140 bp, Artificial Sequence
  Synthetic
atacgccatgctgggtctccgaaagtggatctcgggtctatcaaaattggcggggcagcagcacaatctatgatctctctttggttatacggtgctcattccgaatcgaaccggagccgacgtacttgggagtcggccat

SEQ ID NO: 444962 - DNA, 140 bp, Artificial Sequence
  Synthetic
atggccgactcccaagtacgtcggctccggttcgattcggaatgagcaccgtataaccaaagagagatcatagattgtgctgctgccccgccaattttgatagacccgagatccactttcggagacccagcatggcgtat

SEQ ID NO: 444963 - DNA, 140 bp, Artificial Sequence
  Synthetic
atacgccatgctgggtctccctattgagtcagaagccgagccgagggggaatcccaccattcccaacatcttaagaaactctgattacaacctcaattctcctctaatagaggatccagccgtacttgggagtcggccat

SEQ ID NO: 444964 - DNA, 140 bp, Artificial Sequence
  Synthetic
atggccgactcccaagtacggctggatcctctattagaggagaattgaggttgtaatcagagtttcttaagatgttgggaatggtgggattccccctcggctcggcttctgactcaatagggagacccagcatggcgtat

SEQ ID NO: 444965 - DNA, 140 bp, Artificial Sequence
  Synthetic
atacgccatgctgggtctccagggggtcttaaagtgtctagagagagtggattatgacaaagcatttgggaggtatctggccaatatatattcctcttatttgttcttccacgtgatcaccgtacttgggagtcggccat

SEQ ID NO: 444966 - DNA, 140 bp, Artificial Sequence
  Synthetic
atggccgactcccaagtacggtgatcacgtggaagaacaaataagaggaatatatattggccagatacctcccaaatgctttgtcataatccactctctctagacactttaagaccccctggagacccagcatggcgtat

SEQ ID NO: 444967 - DNA, 140 bp, Artificial Sequence
  Synthetic
atacgccatgctgggtctccaaggaccagatatggggacatttaattgtgaccaaagactttatatattcacagagctctcactgtctcttcgatcggaactatacactcatgttaaaggcgtacttgggagtcggccat

SEQ ID NO: 444968 - DNA, 140 bp, Artificial Sequence
  Synthetic
atggccgactcccaagtacgcctttaacatgagtgtatagttccgatcgaagagacagtgagagctctgtgaatatataaagtctttggtcacaattaaatgtccccatatctggtccttggagacccagcatggcgtat

SEQ ID NO: 444969 - DNA, 140 bp, Artificial Sequence
  Synthetic
aggccctggctgctgatatggatacaaaactctcggacaataagaaggcagtttagaaggagtctatcaagaactttagaagagtctttttacaactcagagatccatgggatcaatcgggaccttttgggacagcggtg

SEQ ID NO: 444970 - DNA, 140 bp, Artificial Sequence
  Synthetic
caccgctgtcccaaaaggtcccgattgatcccatggatctctgagttgtaaaaagactcttctaaagttcttgatagactccttctaaactgccttcttattgtccgagagttttgtatccatatcagcagccagggcct

SEQ ID NO: 444971 - DNA, 140 bp, Artificial Sequence
  Synthetic
atacgccatgctgggtctcctcaacggtgtcatattagggccggacggccatgttctgatccccgagatgcaatcatccctcctccagcaacatatggagttgttggaatcctcagttatcgtacttgggagtcggccat

SEQ ID NO: 444972 - DNA, 140 bp, Artificial Sequence
  Synthetic
atggccgactcccaagtacgataactgaggattccaacaactccatatgttgctggaggagggatgattgcatctcggggatcagaacatggccgtccggccctaatatgacaccgttgaggagacccagcatggcgtat

SEQ ID NO: 444973 - DNA, 140 bp, Artificial Sequence
  Synthetic
atacgccatgctgggtctcctgcaggggatcatgtcttgtccttgtgcgggaactctggttatgaagttataaaaatcttggaaccatatgtagtgaatagcttagtctttagagccgaacgtacttgggagtcggccat

SEQ ID NO: 444974 - DNA, 140 bp, Artificial Sequence
  Synthetic
atggccgactcccaagtacgttcggctctaaagactaagctattcactacatatggttccaagatttttataacttcataaccagagttcccgcacaaggacaagacatgatcccctgcaggagacccagcatggcgtat

SEQ ID NO: 444975 - DNA, 140 bp, Artificial Sequence
  Synthetic
atacgccatgctgggtctccgagggcagacctcttaagggagatctcttggggaagaaaagtagtaggtacgacagttcctcacccttctgagatgttggggttacttcccaaatcttcccgtacttgggagtcggccat

SEQ ID NO: 444976 - DNA, 140 bp, Artificial Sequence
  Synthetic
atggccgactcccaagtacgggaagatttgggaagtaaccccaacatctcagaagggtgaggaactgtcgtacctactacttttcttccccaagagatctcccttaagaggtctgccctcggagacccagcatggcgtat

SEQ ID NO: 444977 - DNA, 140 bp, Artificial Sequence
  Synthetic
aggccctggctgctgatatgttaaggatcagatatggggattgctgattgtgaccaaagattttgtgtactcccaaagctctggctgcctctttgatagaaactatacacttatgctgaagaccttttgggacagcggtg

SEQ ID NO: 444978 - DNA, 140 bp, Artificial Sequence
  Synthetic
caccgctgtcccaaaaggtcttcagcataagtgtatagtttctatcaaagaggcagccagagctttgggagtacacaaaatctttggtcacaatcagcaatccccatatctgatccttaacatatcagcagccagggcct

SEQ ID NO: 444979 - DNA, 140 bp, Artificial Sequence
  Synthetic
atacgccatgctgggtctcctctttaaagctttagatcagttcgacaatatacacgacttagtctttgtatatggttgttacaggcattgggggcatccttacatagattatagaaagggcgtacttgggagtcggccat

SEQ ID NO: 444980 - DNA, 140 bp, Artificial Sequence
  Synthetic
atggccgactcccaagtacgccctttctataatctatgtaaggatgcccccaatgcctgtaacaaccatatacaaagactaagtcgtgtatattgtcgaactgatctaaagctttaaagaggagacccagcatggcgtat

SEQ ID NO: 444981 - DNA, 140 bp, Artificial Sequence
  Synthetic
aggccctggctgctgatatgaagggtacttgggctcgtccacctccatgtcgacccagctattccatgcctgggaaaaagtcactaacgttcatgtggtcaaaagggccttatcattaaagaccttttgggacagcggtg

SEQ ID NO: 444982 - DNA, 140 bp, Artificial Sequence
  Synthetic
caccgctgtcccaaaaggtctttaatgataaggcccttttgaccacatgaacgttagtgactttttcccaggcatggaatagctgggtcgacatggaggtggacgagcccaagtacccttcatatcagcagccagggcct

SEQ ID NO: 444983 - DNA, 140 bp, Artificial Sequence
  Synthetic
atacgccatgctgggtctccgggttcgacaaatactctaaatggtatcttgatccacgactccttgcaagggatcaccccctaactccctatattaagacccagacatggccccccaaaccgtacttgggagtcggccat

SEQ ID NO: 444984 - DNA, 140 bp, Artificial Sequence
  Synthetic
atggccgactcccaagtacggtttggggggccatgtctgggtcttaatatagggagttagggggtgatcccttgcaaggagtcgtggatcaagataccatttagagtatttgtcgaacccggagacccagcatggcgtat

SEQ ID NO: 444985 - DNA, 140 bp, Artificial Sequence
  Synthetic
aggccctggctgctgatatggctcctgtcttcaagagaacggggtcagcgttgcataggttcaagtctgcaagatacagcgagggagggtattcctctgtctgccccaatctcctctcacgaccttttgggacagcggtg

SEQ ID NO: 444986 - DNA, 140 bp, Artificial Sequence
  Synthetic
caccgctgtcccaaaaggtcgtgagaggagattggggcagacagaggaataccctccctcgctgtatcttgcagacttgaacctatgcaacgctgaccccgttctcttgaagacaggagccatatcagcagccagggcct

SEQ ID NO: 444987 - DNA, 140 bp, Artificial Sequence
  Synthetic
aggccctggctgctgatatgaactatgatttcatgtttcagcccttgatgctttatgcgcaaacatggacatcagagctggtacaaaaagacacaaggctgagagactccacgtttcattgaccttttgggacagcggtg

SEQ ID NO: 444988 - DNA, 140 bp, Artificial Sequence
  Synthetic
caccgctgtcccaaaaggtcaatgaaacgtggagtctctcagccttgtgtctttttgtaccagctctgatgtccatgtttgcgcataaagcatcaagggctgaaacatgaaatcatagttcatatcagcagccagggcct

SEQ ID NO: 444989 - DNA, 140 bp, Artificial Sequence
  Synthetic
atacgccatgctgggtctccaaatagaaggtcggttcttcgccttgatgtcttggaatctaaggttatattttgttatcacagagaaactcctggctaattatgttctgccactctttgacgtacttgggagtcggccat

SEQ ID NO: 444990 - DNA, 140 bp, Artificial Sequence
  Synthetic
atggccgactcccaagtacgtcaaagagtggcagaacataattagccaggagtttctctgtgataacaaaatataaccttagattccaagacatcaaggcgaagaaccgaccttctatttggagacccagcatggcgtat

SEQ ID NO: 444991 - DNA, 140 bp, Artificial Sequence
  Synthetic
atacgccatgctgggtctcctttcacttggactacgagaagtggaacaaccatcagagactagaatcaactgaggatgtattttctgttcttgatcaagtgtttggattgaagagggtgtcgtacttgggagtcggccat

SEQ ID NO: 444992 - DNA, 140 bp, Artificial Sequence
  Synthetic
atggccgactcccaagtacgacaccctcttcaatccaaacacttgatcaagaacagaaaatacatcctcagttgattctagtctctgatggttgttccacttctcgtagtccaagtgaaaggagacccagcatggcgtat

SEQ ID NO: 444993 - DNA, 140 bp, Artificial Sequence
  Synthetic
atacgccatgctgggtctcctagatgaaagaggcttgtataagtctctaaaaggagcatgcaaactcaagctatgtggagttcttggacttagacttatggatggaacgtgggtcgcgatcgtacttgggagtcggccat

SEQ ID NO: 444994 - DNA, 140 bp, Artificial Sequence
  Synthetic
atggccgactcccaagtacgatcgcgacccacgttccatccataagtctaagtccaagaactccacatagcttgagtttgcatgctccttttagagacttatacaagcctctttcatctaggagacccagcatggcgtat

SEQ ID NO: 444995 - DNA, 140 bp, Artificial Sequence
  Synthetic
atacgccatgctgggtctccgtcgaatggcccgacttgctggaacggccaagacggcgggctagagggtctccgacagaaaggctggagcctagtcagcttactgatgatagatcgggagcgtacttgggagtcggccat

SEQ ID NO: 444996 - DNA, 140 bp, Artificial Sequence
  Synthetic
atggccgactcccaagtacgctcccgatctatcatcagtaagctgactaggctccagcctttctgtcggagaccctctagcccgccgtcttggccgttccagcaagtcgggccattcgacggagacccagcatggcgtat

SEQ ID NO: 444997 - DNA, 140 bp, Artificial Sequence
  Synthetic
aggccctggctgctgatatgagcgcgaggtgatcacggcatctccggagaatgactggttgtggatcttctcagactttagaagtgccaaaatgacatacctgactctcattacttaccagaccttttgggacagcggtg

SEQ ID NO: 444998 - DNA, 140 bp, Artificial Sequence
  Synthetic
caccgctgtcccaaaaggtctggtaagtaatgagagtcaggtatgtcattttggcacttctaaagtctgagaagatccacaaccagtcattctccggagatgccgtgatcacctcgcgctcatatcagcagccagggcct

SEQ ID NO: 444999 - DNA, 140 bp, Artificial Sequence
  Synthetic
atacgccatgctgggtctcctcctctatgagctagagagtatatccaggaatgcactctcaatatatcgcgccattgaggagggggcatctaaactggggcttattattaagaaggaagacgtacttgggagtcggccat

SEQ ID NO: 445000 - DNA, 140 bp, Artificial Sequence
  Synthetic
atggccgactcccaagtacgtcttccttcttaataataagccccagtttagatgccccctcctcaatggcgcgatatattgagagtgcattcctggatatactctctagctcatagaggaggagacccagcatggcgtat

SEQ ID NO: 445001 - DNA, 140 bp, Artificial Sequence
  Synthetic
aggccctggctgctgatatgaaaaatgtaacacctctacaatggatgctgacaggattgtattcagagctaataatcaggtggtctctttgaggcctgagattatcgcggatcaatatgagaccttttgggacagcggtg

SEQ ID NO: 445002 - DNA, 140 bp, Artificial Sequence
  Synthetic
caccgctgtcccaaaaggtctcatattgatccgcgataatctcaggcctcaaagagaccacctgattattagctctgaatacaatcctgtcagcatccattgtagaggtgttacatttttcatatcagcagccagggcct

SEQ ID NO: 445003 - DNA, 140 bp, Artificial Sequence
  Synthetic
atacgccatgctgggtctccatctccaacgaccaaatagtcaacctggcgaatataatgtcaacagtatctaccaatgccttgactgttgcgcagcattcccagtctttaattaagccgacgtacttgggagtcggccat

SEQ ID NO: 445004 - DNA, 140 bp, Artificial Sequence
  Synthetic
atggccgactcccaagtacgtcggcttaattaaagactgggaatgctgcgcaacagtcaaggcattggtagatactgttgacattatattcgccaggttgactatttggtcgttggagatggagacccagcatggcgtat

SEQ ID NO: 445005 - DNA, 140 bp, Artificial Sequence
  Synthetic
aggccctggctgctgatatgccctgtgtctagtggtaggagatggatcgggggggatatcgagagcagtactcaacatgtttccggatgccaagcttgtattcaacagcttgttggaggtgaccttttgggacagcggtg

SEQ ID NO: 445006 - DNA, 140 bp, Artificial Sequence
  Synthetic
caccgctgtcccaaaaggtcacctccaacaagctgttgaatacaagcttggcatccggaaacatgttgagtactgctctcgatatcccccccgatccatctcctaccactagacacagggcatatcagcagccagggcct

SEQ ID NO: 445007 - DNA, 140 bp, Artificial Sequence
  Synthetic
atacgccatgctgggtctccggacaattttcttttagcgatgtctagaataatttatctagatccttcattggggggggtatctggaatgtctctaggaaggttccacatacgtcaattccgtacttgggagtcggccat

SEQ ID NO: 445008 - DNA, 140 bp, Artificial Sequence
  Synthetic
atggccgactcccaagtacggaattgacgtatgtggaaccttcctagagacattccagataccccccccaatgaaggatctagataaattattctagacatcgctaaaagaaaattgtccggagacccagcatggcgtat

SEQ ID NO: 445009 - DNA, 140 bp, Artificial Sequence
  Synthetic
atacgccatgctgggtctccgtcagtccaaaaacaggtgaacatgtcttatgacctaatcatttgtgacgcagaagtcactgacattgcatcaatcaatcggataacactgttgatgtcgcgtacttgggagtcggccat

SEQ ID NO: 445010 - DNA, 140 bp, Artificial Sequence
  Synthetic
atggccgactcccaagtacgcgacatcaacagtgttatccgattgattgatgcaatgtcagtgacttctgcgtcacaaatgattaggtcataagacatgttcacctgtttttggactgacggagacccagcatggcgtat

SEQ ID NO: 445011 - DNA, 140 bp, Artificial Sequence
  Synthetic
atacgccatgctgggtctccatctaggagagagaacactagaaagtttcactcgccttcttgaagaccccaccacccttaatataaaaggaggggccagtcccaccattcttctcaaagacgtacttgggagtcggccat

SEQ ID NO: 445012 - DNA, 140 bp, Artificial Sequence
  Synthetic
atggccgactcccaagtacgtctttgagaagaatggtgggactggcccctccttttatattaagggtggtggggtcttcaagaaggcgagtgaaactttctagtgttctctctcctagatggagacccagcatggcgtat

SEQ ID NO: 445013 - DNA, 140 bp, Artificial Sequence
  Synthetic
aggccctggctgctgatatgaaagagaggaaagtatcggtcacttctcaaagcgggaaggtcatatcttcatgggagtcatataaaagtgggggtgagaccagactgtgaaagctagtcagaccttttgggacagcggtg

SEQ ID NO: 445014 - DNA, 140 bp, Artificial Sequence
  Synthetic
caccgctgtcccaaaaggtctgactagctttcacagtctggtctcacccccacttttatatgactcccatgaagatatgaccttcccgctttgagaagtgaccgatactttcctctctttcatatcagcagccagggcct

SEQ ID NO: 445015 - DNA, 140 bp, Artificial Sequence
  Synthetic
atacgccatgctgggtctccgatgcaattaggaaagctctatatgatgaggtagacaaagtggagaactcagagttcagagaagcgatcctattgtctaagactcatagggataactttgcgtacttgggagtcggccat

SEQ ID NO: 445016 - DNA, 140 bp, Artificial Sequence
  Synthetic
atggccgactcccaagtacgcaaagttatccctatgagtcttagacaataggatcgcttctctgaactctgagttctccactttgtctacctcatcatatagagctttcctaattgcatcggagacccagcatggcgtat

SEQ ID NO: 445017 - DNA, 140 bp, Artificial Sequence
  Synthetic
atacgccatgctgggtctcccttttcttgaaatctgtggaacccctctttcctcggtttcttagtgagctcttcagctcttccttcttgggaattcctgagtccatcattgggctgataccgtacttgggagtcggccat

SEQ ID NO: 445018 - DNA, 140 bp, Artificial Sequence
  Synthetic
atggccgactcccaagtacggtatcagcccaatgatggactcaggaattcccaagaaggaagagctgaagagctcactaagaaaccgaggaaagaggggttccacagatttcaagaaaagggagacccagcatggcgtat

SEQ ID NO: 445019 - DNA, 140 bp, Artificial Sequence
  Synthetic
atacgccatgctgggtctccacagactcctcaaagaatagggagggtttgggcatgctcttctgagagggcagatctcctgagagaaatatcttggggaagaaaggtggtaggcacgactcgtacttgggagtcggccat

SEQ ID NO: 445020 - DNA, 140 bp, Artificial Sequence
  Synthetic
atggccgactcccaagtacgagtcgtgcctaccacctttcttccccaagatatttctctcaggagatctgccctctcagaagagcatgcccaaaccctccctattctttgaggagtctgtggagacccagcatggcgtat

SEQ ID NO: 445021 - DNA, 140 bp, Artificial Sequence
  Synthetic
atacgccatgctgggtctcccagtccctcacccctctgagatgttggggttgatcccaaagtcttctatttcctgcacttgcggggcatcgggagggggaaatcctcgaatatcagtgtccgtacttgggagtcggccat

SEQ ID NO: 445022 - DNA, 140 bp, Artificial Sequence
  Synthetic
atggccgactcccaagtacggacactgatattcgaggatttccccctcccgatgccccgcaagtgcaggaaatagaagactttgggatcaaccccaacatctcagaggggtgagggactgggagacccagcatggcgtat

SEQ ID NO: 445023 - DNA, 140 bp, Artificial Sequence
  Synthetic
atacgccatgctgggtctcctgcttccgtcttttgatcagtctttcttttctagaggccctctaaagggatatctaggctcatctacatctatgtcaacccagttgttccacgcttgggacgtacttgggagtcggccat

SEQ ID NO: 445024 - DNA, 140 bp, Artificial Sequence
  Synthetic
atggccgactcccaagtacgtcccaagcgtggaacaactgggttgacatagatgtagatgagcctagatatccctttagagggcctctagaaaagaaagactgatcaaaagacggaagcaggagacccagcatggcgtat

SEQ ID NO: 445025 - DNA, 140 bp, Artificial Sequence
  Synthetic
aggccctggctgctgatatgtcctaagatcctgaggcacttcaacatatgttgcagtactatgatgtatctatctaccgctctaggcgatgtccccagttttgcgagacttcatgacctggaccttttgggacagcggtg

SEQ ID NO: 445026 - DNA, 140 bp, Artificial Sequence
  Synthetic
caccgctgtcccaaaaggtccaggtcatgaagtctcgcaaaactggggacatcgcctagagcggtagatagatacatcatagtactgcaacatatgttgaagtgcctcaggatcttaggacatatcagcagccagggcct

SEQ ID NO: 445027 - DNA, 140 bp, Artificial Sequence
  Synthetic
atacgccatgctgggtctccaaaaacataatgtccctaacaggcccggactttcctctagaagaagccccagtcttcaagaggacagggtctgccctgcacaggttcaaatcagccagatcgtacttgggagtcggccat

SEQ ID NO: 445028 - DNA, 140 bp, Artificial Sequence
  Synthetic
atggccgactcccaagtacgatctggctgatttgaacctgtgcagggcagaccctgtcctcttgaagactggggcttcttctagaggaaagtccgggcctgttagggacattatgtttttggagacccagcatggcgtat

SEQ ID NO: 445029 - DNA, 140 bp, Artificial Sequence
  Synthetic
aggccctggctgctgatatgtaaaggaggggctagtccgaccatcttacttaaagatgcaatcagaaaagccctgtatgacgaagtggacaaagtagagaactcggagtttagagaggcagaccttttgggacagcggtg

SEQ ID NO: 445030 - DNA, 140 bp, Artificial Sequence
  Synthetic
caccgctgtcccaaaaggtctgcctctctaaactccgagttctctactttgtccacttcgtcatacagggcttttctgattgcatctttaagtaagatggtcggactagcccctcctttacatatcagcagccagggcct

SEQ ID NO: 445031 - DNA, 140 bp, Artificial Sequence
  Synthetic
atacgccatgctgggtctcctgacttcatgttccagccacttatgctttatgcacaaacatggacatctgagctggtgcaaaaggacactcggttaaaggactccacctttcattggcatcgtacttgggagtcggccat

SEQ ID NO: 445032 - DNA, 140 bp, Artificial Sequence
  Synthetic
atggccgactcccaagtacgatgccaatgaaaggtggagtcctttaaccgagtgtccttttgcaccagctcagatgtccatgtttgtgcataaagcataagtggctggaacatgaagtcaggagacccagcatggcgtat

SEQ ID NO: 445033 - DNA, 140 bp, Artificial Sequence
  Synthetic
aggccctggctgctgatatgggacaccctcagaggcttgtacaagctaatactcttgtacgatataccttgaaaaaaacaagatcttgactctgagcctctggttgtttgattgttttttgaccttttgggacagcggtg

SEQ ID NO: 445034 - DNA, 140 bp, Artificial Sequence
  Synthetic
caccgctgtcccaaaaggtcaaaaaacaatcaaacaaccagaggctcagagtcaagatcttgtttttttcaaggtatatcgtacaagagtattagcttgtacaagcctctgagggtgtcccatatcagcagccagggcct

SEQ ID NO: 445035 - DNA, 140 bp, Artificial Sequence
  Synthetic
atacgccatgctgggtctcctttctggagctgttccccattttcaaaaacttcccgacatccgcttaaggcctggtgactttgagtctctaagtgaccgagagaagtcgcgccacataggcgtacttgggagtcggccat

SEQ ID NO: 445036 - DNA, 140 bp, Artificial Sequence
  Synthetic
atggccgactcccaagtacgcctatgtggcgcgacttctctcggtcacttagagactcaaagtcaccaggccttaagcggatgtcgggaagtttttgaaaatggggaacagctccagaaaggagacccagcatggcgtat

SEQ ID NO: 445037 - DNA, 140 bp, Artificial Sequence
  Synthetic
aggccctggctgctgatatgacgcttaacaacaaaatcagagaagaagtagacagtgtcgtccacaaagcaaaaatgtaacacccctacaatggatgccgacaagattgtatttaaggtcgaccttttgggacagcggtg

SEQ ID NO: 445038 - DNA, 140 bp, Artificial Sequence
  Synthetic
caccgctgtcccaaaaggtcgaccttaaatacaatcttgtcggcatccattgtaggggtgttacatttttgctttgtggacgacactgtctacttcttctctgattttgttgttaagcgtcatatcagcagccagggcct

SEQ ID NO: 445039 - DNA, 140 bp, Artificial Sequence
  Synthetic
atacgccatgctgggtctcccctcgagactatttgaggggactcgccagaggagtcttgataggatcttcaatctgctttttaacaagaatgacaaacattaacataaatagacctctagcgtacttgggagtcggccat

SEQ ID NO: 445040 - DNA, 140 bp, Artificial Sequence
  Synthetic
atggccgactcccaagtacgctagaggtctatttatgttaatgtttgtcattcttgttaaaaagcagattgaagatcctatcaagactcctctggcgagtcccctcaaatagtctcgaggggagacccagcatggcgtat

SEQ ID NO: 445041 - DNA, 140 bp, Artificial Sequence
  Synthetic
atacgccatgctgggtctccgaaaagcccctgacttgaacaaagcatacaagtcaattttatccggcatgaatgcagccaagcttgaccctgatgatgtatgctcttatctggcggctgccgtacttgggagtcggccat

SEQ ID NO: 445042 - DNA, 140 bp, Artificial Sequence
  Synthetic
atggccgactcccaagtacggcagccgccagataagagcatacatcatcagggtcaagcttggctgcattcatgccggataaaattgacttgtatgctttgttcaagtcaggggcttttcggagacccagcatggcgtat

SEQ ID NO: 445043 - DNA, 140 bp, Artificial Sequence
  Synthetic
atacgccatgctgggtctccttctatcccacaaaagatacccgctgcatacccgaccacaatgaaagagggcaacagatccatcctgtgttacctccaacatgtgctgcgctatgaacagcgtacttgggagtcggccat

SEQ ID NO: 445044 - DNA, 140 bp, Artificial Sequence
  Synthetic
atggccgactcccaagtacgctgttcatagcgcagcacatgttggaggtaacacaggatggatctgttgccctctttcattgtggtcgggtatgcagcgggtatcttttgtgggatagaaggagacccagcatggcgtat

SEQ ID NO: 445045 - DNA, 140 bp, Artificial Sequence
  Synthetic
atacgccatgctgggtctccatcttttacttcagagagttgaaaggaacctctccaaaagtatgagagtcaacctgcgacagatgagctctttgatgaggcaggtgttaggggggcatggcgtacttgggagtcggccat

SEQ ID NO: 445046 - DNA, 140 bp, Artificial Sequence
  Synthetic
atggccgactcccaagtacgccatgcccccctaacacctgcctcatcaaagagctcatctgtcgcaggttgactctcatacttttggagaggttcctttcaactctctgaagtaaaagatggagacccagcatggcgtat

SEQ ID NO: 445047 - DNA, 140 bp, Artificial Sequence
  Synthetic
atacgccatgctgggtctccttccttgcgcaggacgaggtgggtggatcaagaggtgcgccatgctgctagaactatgacagggagttacagccccaataggagggtatcacgcaaagcacgtacttgggagtcggccat

SEQ ID NO: 445048 - DNA, 140 bp, Artificial Sequence
  Synthetic
atggccgactcccaagtacgtgctttgcgtgataccctcctattggggctgtaactccctgtcatagttctagcagcatggcgcacctcttgatccacccacctcgtcctgcgcaaggaaggagacccagcatggcgtat

SEQ ID NO: 445049 - DNA, 140 bp, Artificial Sequence
  Synthetic
atacgccatgctgggtctccctttgttatcaccgaaaagctcttagctaattatatcttgccactctttgatgcactgactatgacagacaatctgaacaaggtgttcaagaagttgattcgtacttgggagtcggccat

SEQ ID NO: 445050 - DNA, 140 bp, Artificial Sequence
  Synthetic
atggccgactcccaagtacgaatcaacttcttgaacaccttgttcagattgtctgtcatagtcagtgcatcaaagagtggcaagatataattagctaagagcttttcggtgataacaaagggagacccagcatggcgtat

SEQ ID NO: 445051 - DNA, 140 bp, Artificial Sequence
  Synthetic
atacgccatgctgggtctccgccatgacagggggatacagccccaacaagaaggtgtcccgcaaggtgggatgctcagagtggatctgctcagcccaacaagttgctgtttcaacctcatcgtacttgggagtcggccat

SEQ ID NO: 445052 - DNA, 140 bp, Artificial Sequence
  Synthetic
atggccgactcccaagtacgatgaggttgaaacagcaacttgttgggctgagcagatccactctgagcatcccaccttgcgggacaccttcttgttggggctgtatccccctgtcatggcggagacccagcatggcgtat

SEQ ID NO: 445053 - DNA, 140 bp, Artificial Sequence
  Synthetic
aggccctggctgctgatatgggggcccattacaagctcaaacctattctggatgatctcaatgtattcccatccctatgtcttgtagtcggagatggatcagggggaatatcgagagcgggaccttttgggacagcggtg

SEQ ID NO: 445054 - DNA, 140 bp, Artificial Sequence
  Synthetic
caccgctgtcccaaaaggtcccgctctcgatattccccctgatccatctccgactacaagacatagggatgggaatacattgagatcatccagaataggtttgagcttgtaatgggcccccatatcagcagccagggcct

SEQ ID NO: 445055 - DNA, 140 bp, Artificial Sequence
  Synthetic
atacgccatgctgggtctccttccacaagaactttgaggaagagataagaagaatgtttgagcctgggcaggaaaccgcagttcctcattcctatttcatccatttccgttcattgggcccgtacttgggagtcggccat

SEQ ID NO: 445056 - DNA, 140 bp, Artificial Sequence
  Synthetic
atggccgactcccaagtacgggcccaatgaacggaaatggatgaaataggaatgaggaactgcggtttcctgcccaggctcaaacattcttcttatctcttcctcaaagttcttgtggaaggagacccagcatggcgtat

SEQ ID NO: 445057 - DNA, 140 bp, Artificial Sequence
  Synthetic
atacgccatgctgggtctccggcccattacaagctcaaacccattttggatgatctcaatgtattcccatcattatgtctcgtagtcggggacggatcaggagggatttcaagagctgtacgtacttgggagtcggccat

SEQ ID NO: 445058 - DNA, 140 bp, Artificial Sequence
  Synthetic
atggccgactcccaagtacgtacagctcttgaaatccctcctgatccgtccccgactacgagacataatgatgggaatacattgagatcatccaaaatgggtttgagcttgtaatgggccggagacccagcatggcgtat

SEQ ID NO: 445059 - DNA, 140 bp, Artificial Sequence
  Synthetic
atacgccatgctgggtctcctgagtgggggagatgatattgtgtctagggtgattgactttgactctatctgggaaaaaccttctgacctgaggaacctgacgacatggaggtacttccacgtacttgggagtcggccat

SEQ ID NO: 445060 - DNA, 140 bp, Artificial Sequence
  Synthetic
atggccgactcccaagtacgtggaagtacctccatgtcgtcaggttcctcaggtcagaaggtttttcccagatagagtcaaagtcaatcaccctagacacaatatcatctcccccactcaggagacccagcatggcgtat

SEQ ID NO: 445061 - DNA, 140 bp, Artificial Sequence
  Synthetic
atacgccatgctgggtctccagggacgagaaagaacttcaagaatatgaagcagctgaatcaacgaaaactgaggtagccttggcagatgacggaacagtcaattctgatgatgaggactcgtacttgggagtcggccat

SEQ ID NO: 445062 - DNA, 140 bp, Artificial Sequence
  Synthetic
atggccgactcccaagtacgagtcctcatcatcagaattgactgttccgtcatctgccaaggctacctcagttttcgttgattcagctgcttcatattcttgaagttctttctcgtccctggagacccagcatggcgtat

SEQ ID NO: 445063 - DNA, 140 bp, Artificial Sequence
  Synthetic
atacgccatgctgggtctccgattttgcattgtcaatagatggtccgctttgtctggttttcaaaacttatggaaccatgcttgtaaacccggattacagggcggttcaacacctgtccacgtacttgggagtcggccat

SEQ ID NO: 445064 - DNA, 140 bp, Artificial Sequence
  Synthetic
atggccgactcccaagtacgtggacaggtgttgaaccgccctgtaatccgggtttacaagcatggttccataagttttgaaaaccagacaaagcggaccatctattgacaatgcaaaatcggagacccagcatggcgtat

SEQ ID NO: 445065 - DNA, 140 bp, Artificial Sequence
  Synthetic
atacgccatgctgggtctcctgcagaatatttgacttcttctactattcgagaaatgagtcttgtactgtttaattgtagcagccccaaaagtgagatgcagagagctcgctctctaaatcgtacttgggagtcggccat

SEQ ID NO: 445066 - DNA, 140 bp, Artificial Sequence
  Synthetic
atggccgactcccaagtacgatttagagagcgagctctctgcatctcacttttggggctgctacaattaaacagtacaagactcatttctcgaatagtagaagaagtcaaatattctgcaggagacccagcatggcgtat

SEQ ID NO: 445067 - DNA, 140 bp, Artificial Sequence
  Synthetic
aggccctggctgctgatatgcaggtttggctgatctagagatggcagaggaaactgtagatctgatcgctaggaacatcgaggataatcaggctcatctccaaggagaacccatagaggtgaccttttgggacagcggtg

SEQ ID NO: 445068 - DNA, 140 bp, Artificial Sequence
  Synthetic
caccgctgtcccaaaaggtcacctctatgggttctccttggagatgagcctgattatcctcgatgttcctagcgatcagatctacagtttcctctgccatctctagatcagccaaacctgcatatcagcagccagggcct

SEQ ID NO: 445069 - DNA, 140 bp, Artificial Sequence
  Synthetic
atacgccatgctgggtctccttcacaagatggtagatgatcttgagctacagaggggaaccttgtctaaggtctctatcatcatagccattgtaatagttttttccaatagggtattcaacgtacttgggagtcggccat

SEQ ID NO: 445070 - DNA, 140 bp, Artificial Sequence
  Synthetic
atggccgactcccaagtacgttgaataccctattggaaaaaactattacaatggctatgatgatagagaccttagacaaggttcccctctgtagctcaagatcatctaccatcttgtgaaggagacccagcatggcgtat

SEQ ID NO: 445071 - DNA, 140 bp, Artificial Sequence
  Synthetic
atacgccatgctgggtctccgattttcagatggatgagggggaggaccccgtcttcttgttccagtcgtacctagacaatgttggagttcaaatagtcagacaaatgaggtcaggtgagacgtacttgggagtcggccat

SEQ ID NO: 445072 - DNA, 140 bp, Artificial Sequence
  Synthetic
atggccgactcccaagtacgtctcacctgacctcatttgtctgactatttgaactccaacattgtctaggtacgactggaacaagaagacggggtcctccccctcatccatctgaaaatcggagacccagcatggcgtat

SEQ ID NO: 445073 - DNA, 140 bp, Artificial Sequence
  Synthetic
aggccctggctgctgatatgcctagacaatgttggagttcaaatagtcagacaaatgaggtcaggtgagagattcctcaagatatggtctcagaccgtcgaggagataatatcctatgttgaccttttgggacagcggtg

SEQ ID NO: 445074 - DNA, 140 bp, Artificial Sequence
  Synthetic
caccgctgtcccaaaaggtcaacataggatattatctcctcgacggtctgagaccatatcttgaggaatctctcacctgacctcatttgtctgactatttgaactccaacattgtctaggcatatcagcagccagggcct

SEQ ID NO: 445075 - DNA, 140 bp, Artificial Sequence
  Synthetic
atacgccatgctgggtctccaccgccttgggggatgtgcccaactttgcgaggctacacgacctgtacaacagaccaataacttactattttaagaagcaagtcatccgggggaacatttcgtacttgggagtcggccat

SEQ ID NO: 445076 - DNA, 140 bp, Artificial Sequence
  Synthetic
atggccgactcccaagtacgaaatgttcccccggatgacttgcttcttaaaatagtaagttattggtctgttgtacaggtcgtgtagcctcgcaaagttgggcacatcccccaaggcggtggagacccagcatggcgtat

SEQ ID NO: 445077 - DNA, 140 bp, Artificial Sequence
  Synthetic
aggccctggctgctgatatggaaagtagatttgggttctctcaaggtgggcggaactgctgcacaatcaatgatttctctctggttatatggtgcccactctgaatcaaacaggagccgggaccttttgggacagcggtg

SEQ ID NO: 445078 - DNA, 140 bp, Artificial Sequence
  Synthetic
caccgctgtcccaaaaggtcccggctcctgtttgattcagagtgggcaccatataaccagagagaaatcattgattgtgcagcagttccgcccaccttgagagaacccaaatctactttccatatcagcagccagggcct

SEQ ID NO: 445079 - DNA, 140 bp, Artificial Sequence
  Synthetic
atacgccatgctgggtctccagcgagaaagtcaatcatctaaaaccaaaatggcggcccaaaccgcctccggtcctcctgctctagagtggtccgccgccaacgaagaggatgacctatccgtacttgggagtcggccat

SEQ ID NO: 445080 - DNA, 140 bp, Artificial Sequence
  Synthetic
atggccgactcccaagtacggataggtcatcctcttcgttggcggcggaccactctagagcaggaggaccggaggcggtttgggccgccattttggttttagatgattgactttctcgctggagacccagcatggcgtat

SEQ ID NO: 445081 - DNA, 140 bp, Artificial Sequence
  Synthetic
atacgccatgctgggtctccgcgaacccggcccctgcctccgagctggacatcaggaccctctctagaaggctccaaaatccattgatctcgggcctgagggtggttcagtgggcgacagcgtacttgggagtcggccat

SEQ ID NO: 445082 - DNA, 140 bp, Artificial Sequence
  Synthetic
atggccgactcccaagtacgctgtcgcccactgaaccaccctcaggcccgagatcaatggattttggagccttctagagagggtcctgatgtccagctcggaggcaggggccgggttcgcggagacccagcatggcgtat

SEQ ID NO: 445083 - DNA, 140 bp, Artificial Sequence
  Synthetic
atacgccatgctgggtctccaatcgtgaagactaccagacttgtaggaaatacggaagacttgtccagggaagtaaaaaagcacctccgagggtacaacaggtggatcaccctggatgaccgtacttgggagtcggccat

SEQ ID NO: 445084 - DNA, 140 bp, Artificial Sequence
  Synthetic
atggccgactcccaagtacggtcatccagggtgatccacctgttgtaccctcggaggtgcttttttacttccctggacaagtcttccgtatttcctacaagtctggtagtcttcacgattggagacccagcatggcgtat

SEQ ID NO: 445085 - DNA, 140 bp, Artificial Sequence
  Synthetic
atacgccatgctgggtctccctaaaaaggccacacagagactgacattcttggacaatgtaccctgaaaaaaacaaggtccttgttcataacctctgtttgtttgattgttttttttatccgtacttgggagtcggccat

SEQ ID NO: 445086 - DNA, 140 bp, Artificial Sequence
  Synthetic
atggccgactcccaagtacggataaaaaaaacaatcaaacaaacagaggttatgaacaaggaccttgtttttttcagggtacattgtccaagaatgtcagtctctgtgtggcctttttagggagacccagcatggcgtat

SEQ ID NO: 445087 - DNA, 140 bp, Artificial Sequence
  Synthetic
aggccctggctgctgatatgtggggtgggttgctctagccaattccaaaaggttccagcttttagttgagcccgacaagctaaataaaataatgcaagacgacctgaaccgttatgtgtcgaccttttgggacagcggtg

SEQ ID NO: 445088 - DNA, 140 bp, Artificial Sequence
  Synthetic
caccgctgtcccaaaaggtcgacacataacggttcaggtcgtcttgcattattttatttagcttgtcgggctcaactaaaagctggaaccttttggaattggctagagcaacccaccccacatatcagcagccagggcct

SEQ ID NO: 445089 - DNA, 140 bp, Artificial Sequence
  Synthetic
aggccctggctgctgatatgatacttgggatcatccacatccatgtcgacccagttgttccatgcctgggaaaaggtcaccaatgttcatgtggtgaaaagggccctatcactaaaggaggaccttttgggacagcggtg

SEQ ID NO: 445090 - DNA, 140 bp, Artificial Sequence
  Synthetic
caccgctgtcccaaaaggtcctcctttagtgatagggcccttttcaccacatgaacattggtgaccttttcccaggcatggaacaactgggtcgacatggatgtggatgatcccaagtatcatatcagcagccagggcct

SEQ ID NO: 445091 - DNA, 140 bp, Artificial Sequence
  Synthetic
atacgccatgctgggtctccctttctacgcaagatagtgaagaactgtagagatgaggacactcagaagtcctctcttgtatcggctcctccagatgatgatgatctgtggttaccccctcgtacttgggagtcggccat

SEQ ID NO: 445092 - DNA, 140 bp, Artificial Sequence
  Synthetic
atggccgactcccaagtacgagggggtaaccacagatcatcatcatctggaggagccgatacaagagaggacttctgagtgtcctcatctctacagttcttcactatcttgcgtagaaagggagacccagcatggcgtat

SEQ ID NO: 445093 - DNA, 140 bp, Artificial Sequence
  Synthetic
atacgccatgctgggtctccgggcccactataagctcaaacctattctagacgatctcaatgtattcccgtctctatgtcttgtagttggggatggatcaggggggatatcaagagcggtcgtacttgggagtcggccat

SEQ ID NO: 445094 - DNA, 140 bp, Artificial Sequence
  Synthetic
atggccgactcccaagtacgaccgctcttgatatcccccctgatccatccccaactacaagacatagagacgggaatacattgagatcgtctagaataggtttgagcttatagtgggcccggagacccagcatggcgtat

SEQ ID NO: 445095 - DNA, 140 bp, Artificial Sequence
  Synthetic
aggccctggctgctgatatggaacatctctggatttaacagtcctccttggacttcttgcaacagggtagattcaagagtcatgagacttccattaatcatctcaaccgatcagacatgggaccttttgggacagcggtg

SEQ ID NO: 445096 - DNA, 140 bp, Artificial Sequence
  Synthetic
caccgctgtcccaaaaggtcccatgtctgatcggttgagatgattaatggaagtctcatgactcttgaatctaccctgttgcaagaagtccaaggaggactgttaaatccagagatgttccatatcagcagccagggcct

SEQ ID NO: 445097 - DNA, 140 bp, Artificial Sequence
  Synthetic
atacgccatgctgggtctccttagaatactctcaggaaattacctgggatgatgacactgaatttgtcggactggaaatacgagtgagtgcaagacaatgccatatccagggcaggatttcgtacttgggagtcggccat

SEQ ID NO: 445098 - DNA, 140 bp, Artificial Sequence
  Synthetic
atggccgactcccaagtacgaaatcctgccctggatatggcattgtcttgcactcactcgtatttccagtccgacaaattcagtgtcatcatcccaggtaatttcctgagagtattctaaggagacccagcatggcgtat

SEQ ID NO: 445099 - DNA, 140 bp, Artificial Sequence
  Synthetic
aggccctggctgctgatatgactggaaatacgagtgagtgcaagacaatgccatatccagggcaggatttggtgtatcaatatgaactctcgggcatgtcagttgtggtctgacatgtctgaccttttgggacagcggtg

SEQ ID NO: 445100 - DNA, 140 bp, Artificial Sequence
  Synthetic
caccgctgtcccaaaaggtcagacatgtcagaccacaactgacatgcccgagagttcatattgatacaccaaatcctgccctggatatggcattgtcttgcactcactcgtatttccagtcatatcagcagccagggcct

SEQ ID NO: 445101 - DNA, 140 bp, Artificial Sequence
  Synthetic
atacgccatgctgggtctcctttacattttgagcctcttggatgtgaaaaaaactattaacatccctcaaaagatctaagaaaagatgatccctcaatctcttctgtttttgcctctcctcgtacttgggagtcggccat

SEQ ID NO: 445102 - DNA, 140 bp, Artificial Sequence
  Synthetic
atggccgactcccaagtacgaggagaggcaaaaacagaagagattgagggatcatcttttcttagatcttttgagggatgttaatagtttttttcacatccaagaggctcaaaatgtaaaggagacccagcatggcgtat

SEQ ID NO: 445103 - DNA, 140 bp, Artificial Sequence
  Synthetic
aggccctggctgctgatatgaaccgtctcagacatgagcaagatttttgtcaacccaagtgcgatcagggccggcttggctgatctagagatggctgaagagactgtagatctcatcgctgaccttttgggacagcggtg

SEQ ID NO: 445104 - DNA, 140 bp, Artificial Sequence
  Synthetic
caccgctgtcccaaaaggtcagcgatgagatctacagtctcttcagccatctctagatcagccaagccggccctgatcgcacttgggttgacaaaaatcttgctcatgtctgagacggttcatatcagcagccagggcct

SEQ ID NO: 445105 - DNA, 140 bp, Artificial Sequence
  Synthetic
atacgccatgctgggtctccaatttggttgtggaggacgagggatgcaacagtctgtcagggttttcttacatggaactgaaggtgggatacatctcttccataaaagtgaatgggttcacgtacttgggagtcggccat

SEQ ID NO: 445106 - DNA, 140 bp, Artificial Sequence
  Synthetic
atggccgactcccaagtacgtgaacccattcacttttatggaagagatgtatcccaccttcagttccatgtaagaaaaccctgacagactgttgcatccctcgtcctccacaaccaaattggagacccagcatggcgtat

SEQ ID NO: 445107 - DNA, 140 bp, Artificial Sequence
  Synthetic
atacgccatgctgggtctcctatgtcaccaccacattcaagagaaaacacttccgtccgatgccagatgcatgcagagctgcatacagttggaagatggccggagatcctagatacgaagcgtacttgggagtcggccat

SEQ ID NO: 445108 - DNA, 140 bp, Artificial Sequence
  Synthetic
atggccgactcccaagtacgcttcgtatctaggatctccggccatcttccaactgtatgcagctctgcatgcatctggcatcggacggaagtgttttctcttgaatgtggtggtgacataggagacccagcatggcgtat

SEQ ID NO: 445109 - DNA, 140 bp, Artificial Sequence
  Synthetic
aggccctggctgctgatatgcctgtataacagaccgataacttattacttcagaaaacaggtcattcgaaggaatgtttatctatcttggagctggtctggcgactcctcggtgttcaaggaccttttgggacagcggtg

SEQ ID NO: 445110 - DNA, 140 bp, Artificial Sequence
  Synthetic
caccgctgtcccaaaaggtccttgaacaccgaggagtcgccagaccagctccaagatagataaacattccttcgaatgacctgttttctgaagtaataagttatcggtctgttatacaggcatatcagcagccagggcct

SEQ ID NO: 445111 - DNA, 140 bp, Artificial Sequence
  Synthetic
atacgccatgctgggtctcctccatacgacaaatcccttcactcaagggtcttctctggtgggaagtgtctgggaataacaatctcttccacctactgctccactaaccatgattacactcgtacttgggagtcggccat

SEQ ID NO: 445112 - DNA, 140 bp, Artificial Sequence
  Synthetic
atggccgactcccaagtacgagtgtaatcatggttagtggagcagtaggtggaagagattgttattcccagacacttcccaccagagaagacccttgagtgaagggatttgtcgtatggaggagacccagcatggcgtat

SEQ ID NO: 445113 - DNA, 140 bp, Artificial Sequence
  Synthetic
atacgccatgctgggtctcctggatgaaaggggattatataagtctctaaaaggggcatgcaaacttaaactgtgcggagttcctggacttagacttatggatggaacttgggtctcaatcgtacttgggagtcggccat

SEQ ID NO: 445114 - DNA, 140 bp, Artificial Sequence
  Synthetic
atggccgactcccaagtacgattgagacccaagttccatccataagtctaagtccaggaactccgcacagtttaagtttgcatgccccttttagagacttatataatcccctttcatccaggagacccagcatggcgtat

SEQ ID NO: 445115 - DNA, 140 bp, Artificial Sequence
  Synthetic
aggccctggctgctgatatgctgaaccccgatattcagatggcctgatatcccaactctgccaactatacattgcaggagatcaagtattgtcaatgtgtggaaattcaggttatgaagtgaccttttgggacagcggtg

SEQ ID NO: 445116 - DNA, 140 bp, Artificial Sequence
  Synthetic
caccgctgtcccaaaaggtcacttcataacctgaatttccacacattgacaatacttgatctcctgcaatgtatagttggcagagttgggatatcaggccatctgaatatcggggttcagcatatcagcagccagggcct

SEQ ID NO: 445117 - DNA, 140 bp, Artificial Sequence
  Synthetic
aggccctggctgctgatatgcattaagatactggagccctatgtcgtgaacagcttagtccagagggcagaaaagtttaggcccctcatccactctttgggagactttcctgcttttatagaccttttgggacagcggtg

SEQ ID NO: 445118 - DNA, 140 bp, Artificial Sequence
  Synthetic
caccgctgtcccaaaaggtctataaaagcaggaaagtctcccaaagagtggatgaggggcctaaacttttctgccctctggactaagctgttcacgacatagggctccagtatcttaatgcatatcagcagccagggcct

SEQ ID NO: 445119 - DNA, 140 bp, Artificial Sequence
  Synthetic
atacgccatgctgggtctccgtcaagaagagggaagaatgcctggatgcactggagtccattatgaccaccaaatcagtaagcttcagacgtcttagccacttgagaaaacttgtccctgcgtacttgggagtcggccat

SEQ ID NO: 445120 - DNA, 140 bp, Artificial Sequence
  Synthetic
atggccgactcccaagtacgcagggacaagttttctcaagtggctaagacgtctgaagcttactgatttggtggtcataatggactccagtgcatccaggcattcttccctcttcttgacggagacccagcatggcgtat

SEQ ID NO: 445121 - DNA, 140 bp, Artificial Sequence
  Synthetic
atacgccatgctgggtctccggttcggaaaggcatatactatattcaacaaaaccttaatggaggctgacgctcactacaagtcagttcggacttggaatgaggtcatcccctcaaaaggcgtacttgggagtcggccat

SEQ ID NO: 445122 - DNA, 140 bp, Artificial Sequence
  Synthetic
atggccgactcccaagtacgccttttgaggggatgacctcattccaagtccgaactgacttgtagtgagcgtcagcctccattaaggttttgttgaatatagtatatgcctttccgaaccggagacccagcatggcgtat

SEQ ID NO: 445123 - DNA, 140 bp, Artificial Sequence
  Synthetic
atacgccatgctgggtctccgagtgcaggtgctctggctatcctaatgctggcaatattcttaatgacatgttgcagaagggccaatagaacaaaatcaatacaacaaggtcctagggagcgtacttgggagtcggccat

SEQ ID NO: 445124 - DNA, 140 bp, Artificial Sequence
  Synthetic
atggccgactcccaagtacgctccctaggaccttgttgtattgattttgttctattggcccttctgcaacatgtcattaagaatattgccagcattaggatagccagagcacctgcactcggagacccagcatggcgtat

SEQ ID NO: 445125 - DNA, 140 bp, Artificial Sequence
  Synthetic
atacgccatgctgggtctccaagtcctatcaagagtgtttggcaagcgacctggccagaaggatcctcaggtggggatttgataagtactccaaatggtatcttgattcacgacttctttcgtacttgggagtcggccat

SEQ ID NO: 445126 - DNA, 140 bp, Artificial Sequence
  Synthetic
atggccgactcccaagtacgaaagaagtcgtgaatcaagataccatttggagtacttatcaaatccccacctgaggatccttctggccaggtcgcttgccaaacactcttgataggacttggagacccagcatggcgtat

SEQ ID NO: 445127 - DNA, 140 bp, Artificial Sequence
  Synthetic
atacgccatgctgggtctcctctcctctgtaccttgtgttcagaagatcgcctctctttgagatcaggggggatctcttgacttaacagtccttcatggactccgcgcaacggggtaggtcgtacttgggagtcggccat

SEQ ID NO: 445128 - DNA, 140 bp, Artificial Sequence
  Synthetic
atggccgactcccaagtacgacctaccccgttgcgcggagtccatgaaggactgttaagtcaagagatcccccctgatctcaaagagaggcgatcttctgaacacaaggtacagaggagaggagacccagcatggcgtat

SEQ ID NO: 445129 - DNA, 140 bp, Artificial Sequence
  Synthetic
atacgccatgctgggtctccggtgctctcatctcccagggattgataccaaaggttgtggacaatccaactgatatctcagatgactctgtgcttgagctcgggcagaagctatagcattcgtacttgggagtcggccat

SEQ ID NO: 445130 - DNA, 140 bp, Artificial Sequence
  Synthetic
atggccgactcccaagtacgaatgctatagcttctgcccgagctcaagcacagagtcatctgagatatcagttggattgtccacaacctttggtatcaatccctgggagatgagagcaccggagacccagcatggcgtat

SEQ ID NO: 445131 - DNA, 140 bp, Artificial Sequence
  Synthetic
atacgccatgctgggtctccttcctctacaatagactgaataggggttaactgagagaagtgatttgcctcctatgaaggacacaagcaatagattataatcatcttgcatcccgataagcgtacttgggagtcggccat

SEQ ID NO: 445132 - DNA, 140 bp, Artificial Sequence
  Synthetic
atggccgactcccaagtacgcttatcgggatgcaagatgattataatctattgcttgtgtccttcataggaggcaaatcacttctctcagttaacccctattcagtctattgtagaggaaggagacccagcatggcgtat

SEQ ID NO: 445133 - DNA, 140 bp, Artificial Sequence
  Synthetic
atacgccatgctgggtctccgcaccatgatgatcgatccaggggaggtttatgatgaccccattgatccaattgagccagatgctgagccaagaggaaaccccaccattcctaacatcttcgtacttgggagtcggccat

SEQ ID NO: 445134 - DNA, 140 bp, Artificial Sequence
  Synthetic
atggccgactcccaagtacgaagatgttaggaatggtggggtttcctcttggctcagcatctggctcaattggatcaatggggtcatcataaacctcccctggatcgatcatcatggtgcggagacccagcatggcgtat

SEQ ID NO: 445135 - DNA, 140 bp, Artificial Sequence
  Synthetic
atacgccatgctgggtctccaagaaactccgactacaatctcaactctcccctgatagaggatccagccaagttaatgttagaatggttaaaaacaggaaataggcctctccggatgactcgtacttgggagtcggccat

SEQ ID NO: 445136 - DNA, 140 bp, Artificial Sequence
  Synthetic
atggccgactcccaagtacgagtcatccggagaggcctatttcctgtttttaaccattctaacattaacttggctggatcctctatcaggggagagttgagattgtagtcggagtttcttggagacccagcatggcgtat

SEQ ID NO: 445137 - DNA, 140 bp, Artificial Sequence
  Synthetic
aggccctggctgctgatatgaggtatctggctaacatatattcctcttatttgttctttcacgtgatcaccctttacatgaacgccttggactgggatgaggagaagaccatcctggcacgaccttttgggacagcggtg

SEQ ID NO: 445138 - DNA, 140 bp, Artificial Sequence
  Synthetic
caccgctgtcccaaaaggtcgtgccaggatggtcttctcctcatcccagtccaaggcgttcatgtaaagggtgatcacgtgaaagaacaaataagaggaatatatgttagccagatacctcatatcagcagccagggcct

SEQ ID NO: 445139 - DNA, 140 bp, Artificial Sequence
  Synthetic
atacgccatgctgggtctccttgcgacagaaaggttggagtctggtcagtttattaatgatagatcgtgaatcccaaaccaggaacacaagaaccaagatactagcccaaggggacaacccgtacttgggagtcggccat

SEQ ID NO: 445140 - DNA, 140 bp, Artificial Sequence
  Synthetic
atggccgactcccaagtacgggttgtccccttgggctagtatcttggttcttgtgttcctggtttgggattcacgatctatcattaataaactgaccagactccaacctttctgtcgcaaggagacccagcatggcgtat

SEQ ID NO: 445141 - DNA, 140 bp, Artificial Sequence
  Synthetic
atacgccatgctgggtctccccagagttctaactgtctctttgatagaaactatacacttatgctgaaagacctttttttgtctcggtttaactctctaatgattctcctttcccctccacgtacttgggagtcggccat

SEQ ID NO: 445142 - DNA, 140 bp, Artificial Sequence
  Synthetic
atggccgactcccaagtacgtggaggggaaaggagaatcattagagagttaaaccgagacaaaaaaaggtctttcagcataagtgtatagtttctatcaaagagacagttagaactctggggagacccagcatggcgtat

SEQ ID NO: 445143 - DNA, 140 bp, Artificial Sequence
  Synthetic
atacgccatgctgggtctcctatatcgccggagatcaagttttgtccatgtgtggaaactccggttacgaagtcatcaaaatattagagccatacgttgtgaacagcttggttcagagggcgtacttgggagtcggccat

SEQ ID NO: 445144 - DNA, 140 bp, Artificial Sequence
  Synthetic
atggccgactcccaagtacgccctctgaaccaagctgttcacaacgtatggctctaatattttgatgacttcgtaaccggagtttccacacatggacaaaacttgatctccggcgatataggagacccagcatggcgtat

SEQ ID NO: 445145 - DNA, 140 bp, Artificial Sequence
  Synthetic
atacgccatgctgggtctccaaatttaggcctctcattcattccctaggagacttccctatatttataagagataaggtgggtcaacttgaaggaacatttggtcctagtgcaaagaggtcgtacttgggagtcggccat

SEQ ID NO: 445146 - DNA, 140 bp, Artificial Sequence
  Synthetic
atggccgactcccaagtacgacctctttgcactaggaccaaatgttccttcaagttgacccaccttatctcttataaatatagggaagtctcctagggaatgaatgagaggcctaaatttggagacccagcatggcgtat

SEQ ID NO: 445147 - DNA, 140 bp, Artificial Sequence
  Synthetic
atacgccatgctgggtctccacatggaacttaaagttggacgcatctcagccataaaggtgaacgggttcacttgcacaggtgttgtgacagaggcagaaacctacaccaactttgtcggcgtacttgggagtcggccat

SEQ ID NO: 445148 - DNA, 140 bp, Artificial Sequence
  Synthetic
atggccgactcccaagtacgccgacaaagttggtgtaggtttctgcctctgtcacaacacctgtgcaagtgaacccgttcacctttatggctgagatgcgtccaactttaagttccatgtggagacccagcatggcgtat

SEQ ID NO: 445149 - DNA, 140 bp, Artificial Sequence
  Synthetic
atacgccatgctgggtctcccttgtcgaagctatacgatcaagtccacatcaagaaggtgatagataagtcctatcaggagtgtttggcaagcgaccttgccagaaggatactcaggtggcgtacttgggagtcggccat

SEQ ID NO: 445150 - DNA, 140 bp, Artificial Sequence
  Synthetic
atggccgactcccaagtacgccacctgagtatccttctggcaaggtcgcttgccaaacactcctgataggacttatctatcaccttcttgatgtggacttgatcgtatagcttcgacaagggagacccagcatggcgtat

SEQ ID NO: 445151 - DNA, 140 bp, Artificial Sequence
  Synthetic
atacgccatgctgggtctccgggtttgataagtactccaagtggtatcttgatttgagactccttgcgagagaccaccccttgactccttatatcaaaacccagacatggcctccaaaaccgtacttgggagtcggccat

SEQ ID NO: 445152 - DNA, 140 bp, Artificial Sequence
  Synthetic
atggccgactcccaagtacggttttggaggccatgtctgggttttgatataaggagtcaaggggtggtctctcgcaaggagtctcaaatcaagataccacttggagtacttatcaaacccggagacccagcatggcgtat

SEQ ID NO: 445153 - DNA, 140 bp, Artificial Sequence
  Synthetic
atacgccatgctgggtctccatcacactcctttactagaacaagactggcgtcatggctatcagagaacagaggagggccggtccccagcgaaaaggtcattatcacggctctttccaggcgtacttgggagtcggccat

SEQ ID NO: 445154 - DNA, 140 bp, Artificial Sequence
  Synthetic
atggccgactcccaagtacgcctggaaagagccgtgataatgaccttttcgctggggaccggccctcctctgttctctgatagccatgacgccagtcttgttctagtaaaggagtgtgatggagacccagcatggcgtat

SEQ ID NO: 445155 - DNA, 140 bp, Artificial Sequence
  Synthetic
atacgccatgctgggtctccgtcaaacggtccgacatgctggaatggccaggatggcgggctagagggtctgcgacagaaaggctggagtttggttagcttgttaatgatagatcgtgaacgtacttgggagtcggccat

SEQ ID NO: 445156 - DNA, 140 bp, Artificial Sequence
  Synthetic
atggccgactcccaagtacgttcacgatctatcattaacaagctaaccaaactccagcctttctgtcgcagaccctctagcccgccatcctggccattccagcatgtcggaccgtttgacggagacccagcatggcgtat

SEQ ID NO: 445157 - DNA, 140 bp, Artificial Sequence
  Synthetic
aggccctggctgctgatatgaaactatgtgcagttatgactttctcatctatggaaagacccccttgtttcgaggtaacattttagttcctgagtccaagagatgggctcgagtctcctggaccttttgggacagcggtg

SEQ ID NO: 445158 - DNA, 140 bp, Artificial Sequence
  Synthetic
caccgctgtcccaaaaggtccaggagactcgagcccatctcttggactcaggaactaaaatgttacctcgaaacaagggggtctttccatagatgagaaagtcataactgcacatagtttcatatcagcagccagggcct

SEQ ID NO: 445159 - DNA, 140 bp, Artificial Sequence
  Synthetic
atacgccatgctgggtctccttctctacgagttggagagcatatcaaggaatgcgctctcaatatatcgtgccattgaggagggggcgtctaaactggggcttatcataaaaaaggaagacgtacttgggagtcggccat

SEQ ID NO: 445160 - DNA, 140 bp, Artificial Sequence
  Synthetic
atggccgactcccaagtacgtcttccttttttatgataagccccagtttagacgccccctcctcaatggcacgatatattgagagcgcattccttgatatgctctccaactcgtagagaaggagacccagcatggcgtat

SEQ ID NO: 445161 - DNA, 140 bp, Artificial Sequence
  Synthetic
atacgccatgctgggtctccgaggtaacattttggtgcctgagtcaaaaagatgggctagagtctcctgtatctccaatgaccaaattgtcaacctggccaatataatgtcaacggtatccgtacttgggagtcggccat

SEQ ID NO: 445162 - DNA, 140 bp, Artificial Sequence
  Synthetic
atggccgactcccaagtacggataccgttgacattatattggccaggttgacaatttggtcattggagatacaggagactctagcccatctttttgactcaggcaccaaaatgttacctcggagacccagcatggcgtat

SEQ ID NO: 445163 - DNA, 140 bp, Artificial Sequence
  Synthetic
atacgccatgctgggtctcctttagccccatcttgaaaggtagagtttacaagatcctgggtgccgagggggacaattttcttctagctatgtctagaataatctatttagacccctcctcgtacttgggagtcggccat

SEQ ID NO: 445164 - DNA, 140 bp, Artificial Sequence
  Synthetic
atggccgactcccaagtacgaggaggggtctaaatagattattctagacatagctagaagaaaattgtccccctcggcacccaggatcttgtaaactctacctttcaagatggggctaaaggagacccagcatggcgtat

SEQ ID NO: 445165 - DNA, 140 bp, Artificial Sequence
  Synthetic
aggccctggctgctgatatgggacaattttcttctagctatgtctagaataatctatttagacccctccttagggggagtatctgggatgtctcttggaaggttccacatacgtcagttcgaccttttgggacagcggtg

SEQ ID NO: 445166 - DNA, 140 bp, Artificial Sequence
  Synthetic
caccgctgtcccaaaaggtcgaactgacgtatgtggaaccttccaagagacatcccagatactccccctaaggaggggtctaaatagattattctagacatagctagaagaaaattgtcccatatcagcagccagggcct

SEQ ID NO: 445167 - DNA, 140 bp, Artificial Sequence
  Synthetic
atacgccatgctgggtctccatctgggagagagaacactagagagcttcactcgcttgcttgaggatcccactaccctaaatattaagggaggggccagtcctaccattcttctcaaagacgtacttgggagtcggccat

SEQ ID NO: 445168 - DNA, 140 bp, Artificial Sequence
  Synthetic
atggccgactcccaagtacgtctttgagaagaatggtaggactggcccctcccttaatatttagggtagtgggatcctcaagcaagcgagtgaagctctctagtgttctctctcccagatggagacccagcatggcgtat

SEQ ID NO: 445169 - DNA, 140 bp, Artificial Sequence
  Synthetic
atacgccatgctgggtctcctccagatctgggagagagaacattggagagcttcactcgcctgctagaggaccccactaccctgaatatcaagggaggggccagtcctaccattcttctccgtacttgggagtcggccat

SEQ ID NO: 445170 - DNA, 140 bp, Artificial Sequence
  Synthetic
atggccgactcccaagtacggagaagaatggtaggactggcccctcccttgatattcagggtagtggggtcctctagcaggcgagtgaagctctccaatgttctctctcccagatctggaggagacccagcatggcgtat

SEQ ID NO: 445171 - DNA, 140 bp, Artificial Sequence
  Synthetic
atacgccatgctgggtctccctttttttgaagtctgtggagcctttgtttccccgatttctcagtgaactcttcagttcatctttcttggggattcctgagtcaatcattgggttgataccgtacttgggagtcggccat

SEQ ID NO: 445172 - DNA, 140 bp, Artificial Sequence
  Synthetic
atggccgactcccaagtacggtatcaacccaatgattgactcaggaatccccaagaaagatgaactgaagagttcactgagaaatcggggaaacaaaggctccacagacttcaaaaaaagggagacccagcatggcgtat

SEQ ID NO: 445173 - DNA, 140 bp, Artificial Sequence
  Synthetic
atacgccatgctgggtctccaaaattcccgaactataagaagacagtttaggaggagtctctcgagaaccttggaagagtccttttataactcagagatccatgggatcaatcggatgaccgtacttgggagtcggccat

SEQ ID NO: 445174 - DNA, 140 bp, Artificial Sequence
  Synthetic
atggccgactcccaagtacggtcatccgattgatcccatggatctctgagttataaaaggactcttccaaggttctcgagagactcctcctaaactgtcttcttatagttcgggaattttggagacccagcatggcgtat

SEQ ID NO: 445175 - DNA, 140 bp, Artificial Sequence
  Synthetic
aggccctggctgctgatatggaagctattaaattgtacgttggggaatagagggctgagaatccccccagagggggtgttaagttgccttgagagggtcgattacgataaggcatttggggaccttttgggacagcggtg

SEQ ID NO: 445176 - DNA, 140 bp, Artificial Sequence
  Synthetic
caccgctgtcccaaaaggtccccaaatgccttatcgtaatcgaccctctcaaggcaacttaacaccccctctggggggattctcagccctctattccccaacgtacaatttaatagcttccatatcagcagccagggcct

SEQ ID NO: 445177 - DNA, 140 bp, Artificial Sequence
  Synthetic
atacgccatgctgggtctcccaacagtccctcacccctctgagatgttggggttgatcccaaagtcctctatttcctgcacttgtggagcatcgggagggggaaatcctcggatatcagtcgtacttgggagtcggccat

SEQ ID NO: 445178 - DNA, 140 bp, Artificial Sequence
  Synthetic
atggccgactcccaagtacgactgatatccgaggatttccccctcccgatgctccacaagtgcaggaaatagaggactttgggatcaaccccaacatctcagaggggtgagggactgttgggagacccagcatggcgtat

SEQ ID NO: 445179 - DNA, 140 bp, Artificial Sequence
  Synthetic
atacgccatgctgggtctcctgcgatcaggaaagccctgtatgacgaagtagataaggtagagaactctgagttcagagaggcaatcctcttgtccaaaacccatagggataattttatacgtacttgggagtcggccat

SEQ ID NO: 445180 - DNA, 140 bp, Artificial Sequence
  Synthetic
atggccgactcccaagtacgtataaaattatccctatgggttttggacaagaggattgcctctctgaactcagagttctctaccttatctacttcgtcatacagggctttcctgatcgcaggagacccagcatggcgtat

SEQ ID NO: 445181 - DNA, 140 bp, Artificial Sequence
  Synthetic
atacgccatgctgggtctccctataaactggttcatcacaagaaactcaaatctggcccaaactttgattagaaacataatgtctctgacaggtccagactttcctttggaagaggcccccgtacttgggagtcggccat

SEQ ID NO: 445182 - DNA, 140 bp, Artificial Sequence
  Synthetic
atggccgactcccaagtacgggggcctcttccaaaggaaagtctggacctgtcagagacattatgtttctaatcaaagtttgggccagatttgagtttcttgtgatgaaccagtttatagggagacccagcatggcgtat

SEQ ID NO: 445183 - DNA, 140 bp, Artificial Sequence
  Synthetic
aggccctggctgctgatatgtagtcagattatatcccacagacttaccacttgtttacctctggaggagggagcacacgggcttaactccagcctttgggagcaatagaacaaaatatatgaccttttgggacagcggtg

SEQ ID NO: 445184 - DNA, 140 bp, Artificial Sequence
  Synthetic
caccgctgtcccaaaaggtcatatattttgttctattgctcccaaaggctggagttaagcccgtgtgctccctcctccagaggtaaacaagtggtaagtctgtgggatataatctgactacatatcagcagccagggcct

SEQ ID NO: 445185 - DNA, 140 bp, Artificial Sequence
  Synthetic
aggccctggctgctgatatgtctgtcagcacagacacgatgtctgacttgactcatgatgggagaaactatgactttatgttccaaccattgatgctttatgcacaaacatggacatcaggaccttttgggacagcggtg

SEQ ID NO: 445186 - DNA, 140 bp, Artificial Sequence
  Synthetic
caccgctgtcccaaaaggtcctgatgtccatgtttgtgcataaagcatcaatggttggaacataaagtcatagtttctcccatcatgagtcaagtcagacatcgtgtctgtgctgacagacatatcagcagccagggcct

SEQ ID NO: 445187 - DNA, 140 bp, Artificial Sequence
  Synthetic
atacgccatgctgggtctccttctcaggtcttcgagttccctgatgtctcaagaaggatatccaggatggtttctggagctgtgcctcattttcgaaaacttcctgatattcgtttaaaacgtacttgggagtcggccat

SEQ ID NO: 445188 - DNA, 140 bp, Artificial Sequence
  Synthetic
atggccgactcccaagtacgttttaaacgaatatcaggaagttttcgaaaatgaggcacagctccagaaaccatcctggatatccttcttgagacatcagggaactcgaagacctgagaaggagacccagcatggcgtat

SEQ ID NO: 445189 - DNA, 140 bp, Artificial Sequence
  Synthetic
aggccctggctgctgatatgtttctggagctgtgcctcattttcgaaaacttcctgatattcgtttaaaaccgggtgacttcgaatctctaagtggtagggagaagtcgcgccatatcgggaccttttgggacagcggtg

SEQ ID NO: 445190 - DNA, 140 bp, Artificial Sequence
  Synthetic
caccgctgtcccaaaaggtcccgatatggcgcgacttctccctaccacttagagattcgaagtcacccggttttaaacgaatatcaggaagttttcgaaaatgaggcacagctccagaaacatatcagcagccagggcct

SEQ ID NO: 445191 - DNA, 140 bp, Artificial Sequence
  Synthetic
atacgccatgctgggtctcctgagttttttcaaaagtcttggatctattactcagacagatccgacctcattgggttatgggaggatcaaatatactgtctggacatgtcaaacggccctcgtacttgggagtcggccat

SEQ ID NO: 445192 - DNA, 140 bp, Artificial Sequence
  Synthetic
atggccgactcccaagtacgagggccgtttgacatgtccagacagtatatttgatcctcccataacccaatgaggtcggatctgtctgagtaatagatccaagacttttgaaaaaactcaggagacccagcatggcgtat

SEQ ID NO: 445193 - DNA, 140 bp, Artificial Sequence
  Synthetic
atacgccatgctgggtctccatagggtcagcccaaggactcttgtattcaatcttggttgcgattcatgactctggatataatgatgggaccattttccccgtcaatatatatggcaaggcgtacttgggagtcggccat

SEQ ID NO: 445194 - DNA, 140 bp, Artificial Sequence
  Synthetic
atggccgactcccaagtacgccttgccatatatattgacggggaaaatggtcccatcattatatccagagtcatgaatcgcaaccaagattgaatacaagagtccttgggctgaccctatggagacccagcatggcgtat

SEQ ID NO: 445195 - DNA, 140 bp, Artificial Sequence
  Synthetic
aggccctggctgctgatatgccctttacatgaacgccttggactgggatgaggagaagaccatcctggcactgtggagggatttgacatcggtagatactggaaaggacttggtcaagttgaccttttgggacagcggtg

SEQ ID NO: 445196 - DNA, 140 bp, Artificial Sequence
  Synthetic
caccgctgtcccaaaaggtcaacttgaccaagtcctttccagtatctaccgatgtcaaatccctccacagtgccaggatggtcttctcctcatcccagtccaaggcgttcatgtaaagggcatatcagcagccagggcct

SEQ ID NO: 445197 - DNA, 140 bp, Artificial Sequence
  Synthetic
atacgccatgctgggtctccaactgatctcgggagtgatttcatacatcctcttgagactggacaatcacccatctttatacataatgctcagagagccatctctgaggggagagatattcgtacttgggagtcggccat

SEQ ID NO: 445198 - DNA, 140 bp, Artificial Sequence
  Synthetic
atggccgactcccaagtacgaatatctctcccctcagagatggctctctgagcattatgtataaagatgggtgattgtccagtctcaagaggatgtatgaaatcactcccgagatcagttggagacccagcatggcgtat

SEQ ID NO: 445199 - DNA, 140 bp, Artificial Sequence
  Synthetic
atacgccatgctgggtctcctcgggaataacagtgtcttctacctattgtcccactagccatgattataccatctggatgcctgaaaatccgagactagggacttcttgtgacattttcacgtacttgggagtcggccat

SEQ ID NO: 445200 - DNA, 140 bp, Artificial Sequence
  Synthetic
atggccgactcccaagtacgtgaaaatgtcacaagaagtccctagtctcggattttcaggcatccagatggtataatcatggctagtgggacaataggtagaagacactgttattcccgaggagacccagcatggcgtat

SEQ ID NO: 445201 - DNA, 140 bp, Artificial Sequence
  Synthetic
atacgccatgctgggtctccgccgacaagctaagtaaaatcatgcaggatgatttgaatcgctatgcatcctgctaactgaacttttaaatgtggcccttctagataataaaatctgagacgtacttgggagtcggccat

SEQ ID NO: 445202 - DNA, 140 bp, Artificial Sequence
  Synthetic
atggccgactcccaagtacgtctcagattttattatctagaagggccacatttaaaagttcagttagcaggatgcatagcgattcaaatcatcctgcatgattttacttagcttgtcggcggagacccagcatggcgtat

SEQ ID NO: 445203 - DNA, 140 bp, Artificial Sequence
  Synthetic
atacgccatgctgggtctccactatgacagggagttacagccccaacaagaagatgtcacgcaaagcagggtgttcggaatgggtctgctctgctcaacaggttgcggtttcaacctcagcgtacttgggagtcggccat

SEQ ID NO: 445204 - DNA, 140 bp, Artificial Sequence
  Synthetic
atggccgactcccaagtacgctgaggttgaaaccgcaacctgttgagcagagcagacccattccgaacaccctgctttgcgtgacatcttcttgttggggctgtaactccctgtcatagtggagacccagcatggcgtat

SEQ ID NO: 445205 - DNA, 140 bp, Artificial Sequence
  Synthetic
atacgccatgctgggtctccagctcattataagctcaaacctattttggatgatctcaatgtcttcccatccctatgtctggtggtaggggatggatcaggagggatatcaagagcggtacgtacttgggagtcggccat

SEQ ID NO: 445206 - DNA, 140 bp, Artificial Sequence
  Synthetic
atggccgactcccaagtacgtaccgctcttgatatccctcctgatccatcccctaccaccagacatagggatgggaagacattgagatcatccaaaataggtttgagcttataatgagctggagacccagcatggcgtat

SEQ ID NO: 445207 - DNA, 140 bp, Artificial Sequence
  Synthetic
atacgccatgctgggtctccgtccccctacactagactaaataatggttagctgagggaagcgatttgcctcctatgaaggacataagcaatagatcacaatcatcttacatcccgataacgtacttgggagtcggccat

SEQ ID NO: 445208 - DNA, 140 bp, Artificial Sequence
  Synthetic
atggccgactcccaagtacgttatcgggatgtaagatgattgtgatctattgcttatgtccttcataggaggcaaatcgcttccctcagctaaccattatttagtctagtgtagggggacggagacccagcatggcgtat

SEQ ID NO: 445209 - DNA, 140 bp, Artificial Sequence
  Synthetic
atacgccatgctgggtctccactctcaagggaatatacagaccaaaactcctggacagtacaccttgaaaaaaacaaggtccaaattcagaacctctgtctgattgactgtttttccatccgtacttgggagtcggccat

SEQ ID NO: 445210 - DNA, 140 bp, Artificial Sequence
  Synthetic
atggccgactcccaagtacggatggaaaaacagtcaatcagacagaggttctgaatttggaccttgtttttttcaaggtgtactgtccaggagttttggtctgtatattcccttgagagtggagacccagcatggcgtat

SEQ ID NO: 445211 - DNA, 140 bp, Artificial Sequence
  Synthetic
atacgccatgctgggtctccgattttgcattgtctatagatggccccctttatctggttttcaaaacttacggtactatgcttgtaaatccagaatacagagcaattcaacacctatctacgtacttgggagtcggccat

SEQ ID NO: 445212 - DNA, 140 bp, Artificial Sequence
  Synthetic
atggccgactcccaagtacgtagataggtgttgaattgctctgtattctggatttacaagcatagtaccgtaagttttgaaaaccagataaagggggccatctatagacaatgcaaaatcggagacccagcatggcgtat

SEQ ID NO: 445213 - DNA, 140 bp, Artificial Sequence
  Synthetic
atacgccatgctgggtctcctgcagaatacttgacctcctctactcttcgagaaatgagcctggtattgttcaactgtagcagccccaagagtgagatgcagagagcccgctctctaaaccgtacttgggagtcggccat

SEQ ID NO: 445214 - DNA, 140 bp, Artificial Sequence
  Synthetic
atggccgactcccaagtacggtttagagagcgggctctctgcatctcactcttggggctgctacagttgaacaataccaggctcatttctcgaagagtagaggaggtcaagtattctgcaggagacccagcatggcgtat

SEQ ID NO: 445215 - DNA, 140 bp, Artificial Sequence
  Synthetic
atacgccatgctgggtctccagctctcacgaatcttggattcacgccttgtgtcaggaggcagggaaccctgatctcggagagagaactctcgaaagcttcactcggcttctcgaggatccgtacttgggagtcggccat

SEQ ID NO: 445216 - DNA, 140 bp, Artificial Sequence
  Synthetic
atggccgactcccaagtacggatcctcgagaagccgagtgaagctttcgagagttctctctccgagatcagggttccctgcctcctgacacaaggcgtgaatccaagattcgtgagagctggagacccagcatggcgtat

SEQ ID NO: 445217 - DNA, 140 bp, Artificial Sequence
  Synthetic
aggccctggctgctgatatgcaatgaaatgatcataactctgattgatagtgatgtagaatctttcctagttcacaagatggtagatgatctggagttacagagaggaactctgtccaaagaccttttgggacagcggtg

SEQ ID NO: 445218 - DNA, 140 bp, Artificial Sequence
  Synthetic
caccgctgtcccaaaaggtctttggacagagttcctctctgtaactccagatcatctaccatcttgtgaactaggaaagattctacatcactatcaatcagagttatgatcatttcattgcatatcagcagccagggcct

SEQ ID NO: 445219 - DNA, 140 bp, Artificial Sequence
  Synthetic
aggccctggctgctgatatgtgagtttagagaggcaatcctattgtccaaaacccatagagacaattttatacttttcttgaaatctgttgaacctctgtttccacgattccttagtgaggaccttttgggacagcggtg

SEQ ID NO: 445220 - DNA, 140 bp, Artificial Sequence
  Synthetic
caccgctgtcccaaaaggtcctcactaaggaatcgtggaaacagaggttcaacagatttcaagaaaagtataaaattgtctctatgggttttggacaataggattgcctctctaaactcacatatcagcagccagggcct

SEQ ID NO: 445221 - DNA, 140 bp, Artificial Sequence
  Synthetic
aggccctggctgctgatatggttatggtgccattaaaccgctgcattttatcaaagtcaagttaattacctttacatttttgagcctctaagatgtgaaaaaaactattaacatccctcagaccttttgggacagcggtg

SEQ ID NO: 445222 - DNA, 140 bp, Artificial Sequence
  Synthetic
caccgctgtcccaaaaggtctgagggatgttaatagtttttttcacatcttagaggctcaaaaatgtaaaggtaattaacttgactttgataaaatgcagcggtttaatggcaccataaccatatcagcagccagggcct

SEQ ID NO: 445223 - DNA, 140 bp, Artificial Sequence
  Synthetic
atacgccatgctgggtctccaaacttggtccctggagcccgatcgacatacaccatctcagctgtccaaataacttggttgtggaggacgagggatgtaataacctgtcagggttctcctcgtacttgggagtcggccat

SEQ ID NO: 445224 - DNA, 140 bp, Artificial Sequence
  Synthetic
atggccgactcccaagtacgaggagaaccctgacaggttattacatccctcgtcctccacaaccaagttatttggacagctgagatggtgtatgtcgatcgggctccagggaccaagtttggagacccagcatggcgtat

SEQ ID NO: 445225 - DNA, 140 bp, Artificial Sequence
  Synthetic
aggccctggctgctgatatgacttttcttgaagtctgttgagcctttgtttccccgatttctcagtgaactcttcagttcgtccttcttgggaattcctgagtcaattattgggttgatagaccttttgggacagcggtg

SEQ ID NO: 445226 - DNA, 140 bp, Artificial Sequence
  Synthetic
caccgctgtcccaaaaggtctatcaacccaataattgactcaggaattcccaagaaggacgaactgaagagttcactgagaaatcggggaaacaaaggctcaacagacttcaagaaaagtcatatcagcagccagggcct

SEQ ID NO: 445227 - DNA, 140 bp, Artificial Sequence
  Synthetic
atacgccatgctgggtctccctctcgaaggaatgtatggaccaagactcttggacagtgtaccctgaaaaaaacgagatcctgattcatgacctctttttgcttgattgtttttcccatccgtacttgggagtcggccat

SEQ ID NO: 445228 - DNA, 140 bp, Artificial Sequence
  Synthetic
atggccgactcccaagtacggatgggaaaaacaatcaagcaaaaagaggtcatgaatcaggatctcgtttttttcagggtacactgtccaagagtcttggtccatacattccttcgagagggagacccagcatggcgtat

SEQ ID NO: 445229 - DNA, 140 bp, Artificial Sequence
  Synthetic
atacgccatgctgggtctccgggcactctagagagaatgtataaactggtaatcttgaacggtacactgtgaaaaaaactggatcccaatccttaacctctatttgcttgattatttttccgtacttgggagtcggccat

SEQ ID NO: 445230 - DNA, 140 bp, Artificial Sequence
  Synthetic
atggccgactcccaagtacggaaaaataatcaagcaaatagaggttaaggattgggatccagtttttttcacagtgtaccgttcaagattaccagtttatacattctctctagagtgcccggagacccagcatggcgtat

SEQ ID NO: 445231 - DNA, 140 bp, Artificial Sequence
  Synthetic
atacgccatgctgggtctccgtgaatgacctgatggcatccggaacacatccattgcctccctcagcaatcatgagtggaggagatgaaattgtctcgagagtaatagacttcgactcgacgtacttgggagtcggccat

SEQ ID NO: 445232 - DNA, 140 bp, Artificial Sequence
  Synthetic
atggccgactcccaagtacgtcgagtcgaagtctattactctcgagacaatttcatctcctccactcatgattgctgagggaggcaatggatgtgttccggatgccatcaggtcattcacggagacccagcatggcgtat

SEQ ID NO: 445233 - DNA, 140 bp, Artificial Sequence
  Synthetic
aggccctggctgctgatatgctttgtaaagattgtggaacatcatactttaatgacaacccataaaatgtgcgccaactggagtaccatacctaacttcagatttctggctgggacctatgaccttttgggacagcggtg

SEQ ID NO: 445234 - DNA, 140 bp, Artificial Sequence
  Synthetic
caccgctgtcccaaaaggtcataggtcccagccagaaatctgaagttaggtatggtactccagttggcgcacattttatgggttgtcattaaagtatgatgttccacaatctttacaaagcatatcagcagccagggcct

SEQ ID NO: 445235 - DNA, 140 bp, Artificial Sequence
  Synthetic
aggccctggctgctgatatgaaccggacattccagaaaatctgcacgtgctaggactcttgtgtgatgtgtctcgaaaaaaacaagaacttgaatccggacctctggctgtttgattgttgaccttttgggacagcggtg

SEQ ID NO: 445236 - DNA, 140 bp, Artificial Sequence
  Synthetic
caccgctgtcccaaaaggtcaacaatcaaacagccagaggtccggattcaagttcttgtttttttcgagacacatcacacaagagtcctagcacgtgcagattttctggaatgtccggttcatatcagcagccagggcct

SEQ ID NO: 445237 - DNA, 140 bp, Artificial Sequence
  Synthetic
aggccctggctgctgatatgggtttataaagcaaataaatcttactgcgagagaagctctgctatatttcttccataagaactttgaggaagagataagaagaatgtttgaaccggggcagaccttttgggacagcggtg

SEQ ID NO: 445238 - DNA, 140 bp, Artificial Sequence
  Synthetic
caccgctgtcccaaaaggtctgccccggttcaaacattcttcttatctcttcctcaaagttcttatggaagaaatatagcagagcttctctcgcagtaagatttatttgctttataaacccatatcagcagccagggcct

SEQ ID NO: 445239 - DNA, 140 bp, Artificial Sequence
  Synthetic
aggccctggctgctgatatgctcattcactttgtcgggtgctacatgggtcaggtgagatctttgaatgccacggttattgccacatgtgccccgcatgagatgtctgttcttgggggatgaccttttgggacagcggtg

SEQ ID NO: 445240 - DNA, 140 bp, Artificial Sequence
  Synthetic
caccgctgtcccaaaaggtcatcccccaagaacagacatctcatgcggggcacatgtggcaataaccgtggcattcaaagatctcacctgacccatgtagcacccgacaaagtgaatgagcatatcagcagccagggcct

SEQ ID NO: 445241 - DNA, 140 bp, Artificial Sequence
  Synthetic
atacgccatgctgggtctcctgttgccgaagagtcagtcgaccagaatctatgcaacgcagtcttggaggaacagggagaaaggtgtcggccgcttcccagagcgggaaggtcatatcttcgtacttgggagtcggccat

SEQ ID NO: 445242 - DNA, 140 bp, Artificial Sequence
  Synthetic
atggccgactcccaagtacgaagatatgaccttcccgctctgggaagcggccgacacctttctccctgttcctccaagactgcgttgcatagattctggtcgactgactcttcggcaacaggagacccagcatggcgtat

SEQ ID NO: 445243 - DNA, 140 bp, Artificial Sequence
  Synthetic
aggccctggctgctgatatgacttgggggaggagttttttggaaaagggacttttgagagaagattcttcagagacgagagagaacttcaggaatatgaagcggctgagttgatgaggacgaccttttgggacagcggtg

SEQ ID NO: 445244 - DNA, 140 bp, Artificial Sequence
  Synthetic
caccgctgtcccaaaaggtcgtcctcatcaactcagccgcttcatattcctgaagttctctctcgtctctgaagaatcttctctcaaaagtcccttttccaaaaaactcctcccccaagtcatatcagcagccagggcct

SEQ ID NO: 445245 - DNA, 140 bp, Artificial Sequence
  Synthetic
aggccctggctgctgatatgaatggagttctttgaggggacgtgtcccgaagactggaccagctatggaatgctgattgcacgaaatagagacaagatcaccccatattctctcgtggaggaccttttgggacagcggtg

SEQ ID NO: 445246 - DNA, 140 bp, Artificial Sequence
  Synthetic
caccgctgtcccaaaaggtcctccacgagagaatatggggtgatcttgtctctatttcgtgcaatcagcattccatagctggtccagtcttcgggacacgtcccctcaaagaactccattcatatcagcagccagggcct

SEQ ID NO: 445247 - DNA, 140 bp, Artificial Sequence
  Synthetic
aggccctggctgctgatatgggaatccctgggtccaatggtcctccttgaactccatccaacagggtaaattcaagagtcgtgagactttcattaatcatctcagtcgatcagacaaggtgaccttttgggacagcggtg

SEQ ID NO: 445248 - DNA, 140 bp, Artificial Sequence
  Synthetic
caccgctgtcccaaaaggtcaccttgtctgatcgactgagatgattaatgaaagtctcacgactcttgaatttaccctgttggatggagttcaaggaggaccattggacccagggattcccatatcagcagccagggcct

SEQ ID NO: 445249 - DNA, 140 bp, Artificial Sequence
  Synthetic
aggccctggctgctgatatgtcgtaagtctgtataggttgagcaaaatatcagggcaaaacactggtaactataaaacaaacattgcagacaggattgagcagatttttgaaacagccccgaccttttgggacagcggtg

SEQ ID NO: 445250 - DNA, 140 bp, Artificial Sequence
  Synthetic
caccgctgtcccaaaaggtcggggctgtttcaaaaatctgctcaatcctgtctgcaatgtttgttttatagttaccagtgttttgccctgatattttgctcaacctatacagacttacgacatatcagcagccagggcct

SEQ ID NO: 445251 - DNA, 140 bp, Artificial Sequence
  Synthetic
atacgccatgctgggtctccgggaggattttttcttaaatgactcagtgcttgggcacagaaagaggtcgtagtgtatcccctgatcgaggactcaacatgggctgattgagaaaggcaacgtacttgggagtcggccat

SEQ ID NO: 445252 - DNA, 140 bp, Artificial Sequence
  Synthetic
atggccgactcccaagtacgttgcctttctcaatcagcccatgttgagtcctcgatcaggggatacactacgacctctttctgtgcccaagcactgagtcatttaagaaaaaatcctcccggagacccagcatggcgtat

SEQ ID NO: 445253 - DNA, 140 bp, Artificial Sequence
  Synthetic
aggccctggctgctgatatgtagtgtatcccctgatcgaggactcaacatgggctgattgagaaaggcaatccgcctccaatgaaggacacaagcagtagctcataatcatattgcgtctgaccttttgggacagcggtg

SEQ ID NO: 445254 - DNA, 140 bp, Artificial Sequence
  Synthetic
caccgctgtcccaaaaggtcagacgcaatatgattatgagctactgcttgtgtccttcattggaggcggattgcctttctcaatcagcccatgttgagtcctcgatcaggggatacactacatatcagcagccagggcct

SEQ ID NO: 445255 - DNA, 140 bp, Artificial Sequence
  Synthetic
atacgccatgctgggtctccggaacatcgaagataatcaggctcatctccaaggagatcccatagaggtggacaatctccccgaagacatgagacggcttcaattagacgatgaaaaacccgtacttgggagtcggccat

SEQ ID NO: 445256 - DNA, 140 bp, Artificial Sequence
  Synthetic
atggccgactcccaagtacgggtttttcatcgtctaattgaagccgtctcatgtcttcggggagattgtccacctctatgggatctccttggagatgagcctgattatcttcgatgttccggagacccagcatggcgtat

SEQ ID NO: 445257 - DNA, 140 bp, Artificial Sequence
  Synthetic
aggccctggctgctgatatggactttcagatggatgaggcagaggaccctgctctcttgttccagtcttacctggacaatgttggaattcagatggtcagacaaatgaagtcaggagagagaccttttgggacagcggtg

SEQ ID NO: 445258 - DNA, 140 bp, Artificial Sequence
  Synthetic
caccgctgtcccaaaaggtctctctcctgacttcatttgtctgaccatctgaattccaacattgtccaggtaagactggaacaagagagcagggtcctctgcctcatccatctgaaagtccatatcagcagccagggcct

SEQ ID NO: 445259 - DNA, 140 bp, Artificial Sequence
  Synthetic
aggccctggctgctgatatggattcctcaagatatggtctcagaccgtcgaagagatcatatcctatgtcacggtcaactttatcattcttccgggaaagtcttcagaagacaaagcaacgaccttttgggacagcggtg

SEQ ID NO: 445260 - DNA, 140 bp, Artificial Sequence
  Synthetic
caccgctgtcccaaaaggtcgttgctttgtcttctgaagactttcccggaagaatgataaagttgaccgtgacataggatatgatctcttcgacggtctgagaccatatcttgaggaatccatatcagcagccagggcct

SEQ ID NO: 445261 - DNA, 140 bp, Artificial Sequence
  Synthetic
aggccctggctgctgatatgggtcctcctgctatagagtggtcctccgccaacgaagatgatgacccatctgtggaggctgaaattgctcaccaaattgccgaaagcttctccaagaagtgaccttttgggacagcggtg

SEQ ID NO: 445262 - DNA, 140 bp, Artificial Sequence
  Synthetic
caccgctgtcccaaaaggtcacttcttggagaagctttcggcaatttggtgagcaatttcagcctccacagatgggtcatcatcttcgttggcggaggaccactctatagcaggaggacccatatcagcagccagggcct

SEQ ID NO: 445263 - DNA, 140 bp, Artificial Sequence
  Synthetic
atacgccatgctgggtctcctgtggaggctgaaattgctcaccaaattgccgaaagcttctccaagaagtacaaatttccttcccggtcatcagggatattcttgtataactttgagcagcgtacttgggagtcggccat

SEQ ID NO: 445264 - DNA, 140 bp, Artificial Sequence
  Synthetic
atggccgactcccaagtacgctgctcaaagttatacaagaatatccctgatgaccgggaaggaaatttgtacttcttggagaagctttcggcaatttggtgagcaatttcagcctccacaggagacccagcatggcgtat

SEQ ID NO: 445265 - DNA, 140 bp, Artificial Sequence
  Synthetic
atacgccatgctgggtctcctggggtgggtcgctctagccaactccaaaaagttccagctgttagttgagcctgacaaactaaacaagataatgcaagacgacctgaatcgttatgccttcgtacttgggagtcggccat

SEQ ID NO: 445266 - DNA, 140 bp, Artificial Sequence
  Synthetic
atggccgactcccaagtacgaaggcataacgattcaggtcgtcttgcattatcttgtttagtttgtcaggctcaactaacagctggaactttttggagttggctagagcgacccaccccaggagacccagcatggcgtat

SEQ ID NO: 445267 - DNA, 140 bp, Artificial Sequence
  Synthetic
atacgccatgctgggtctccgtttactctcagagttctaactgtcttttcgacagaaactacacactcatgctaaaggatcttttcttgtctcgcttcaactccttaatgattttgctttcgtacttgggagtcggccat

SEQ ID NO: 445268 - DNA, 140 bp, Artificial Sequence
  Synthetic
atggccgactcccaagtacgaaagcaaaatcattaaggagttgaagcgagacaagaaaagatcctttagcatgagtgtgtagtttctgtcgaaaagacagttagaactctgagagtaaacggagacccagcatggcgtat

SEQ ID NO: 445269 - DNA, 140 bp, Artificial Sequence
  Synthetic
aggccctggctgctgatatgctttctgcgcaagatagtaaagaactgtagagatgaggacactcagaagccctctctcgtgtcagctcctcctgatgatgatgatttgtggttaccccctgaccttttgggacagcggtg

SEQ ID NO: 445270 - DNA, 140 bp, Artificial Sequence
  Synthetic
caccgctgtcccaaaaggtcagggggtaaccacaaatcatcatcatcaggaggagctgacacgagagagggcttctgagtgtcctcatctctacagttctttactatcttgcgcagaaagcatatcagcagccagggcct

SEQ ID NO: 445271 - DNA, 140 bp, Artificial Sequence
  Synthetic
atacgccatgctgggtctccgaaccccgatattcagacgatttgatatctcagctgtgccagttgtacattgcaggggatcaggtcttgtccatgtgcggaaactcgggttatgaggtcacgtacttgggagtcggccat

SEQ ID NO: 445272 - DNA, 140 bp, Artificial Sequence
  Synthetic
atggccgactcccaagtacgtgacctcataacccgagtttccgcacatggacaagacctgatcccctgcaatgtacaactggcacagctgagatatcaaatcgtctgaatatcggggttcggagacccagcatggcgtat

SEQ ID NO: 445273 - DNA, 140 bp, Artificial Sequence
  Synthetic
aggccctggctgctgatatgttagaatcctaagacacattttgaaatcattcgatgagatctattccgggaatcaaagaatgattgggctggtcaaggttgtcattggattggcgttgtcgaccttttgggacagcggtg

SEQ ID NO: 445274 - DNA, 140 bp, Artificial Sequence
  Synthetic
caccgctgtcccaaaaggtcgacaacgccaatccaatgacaaccttgaccagcccaatcattctttgattcccggaatagatctcatcgaatgatttcaaaatgtgtcttaggattctaacatatcagcagccagggcct

SEQ ID NO: 445275 - DNA, 140 bp, Artificial Sequence
  Synthetic
aggccctggctgctgatatgaggagccccagtccctgaaggcatgaactgggtgtacaaactgaggagaactcttatcttccagtgggctgaatctagaggccctcttgagggggaggaggaccttttgggacagcggtg

SEQ ID NO: 445276 - DNA, 140 bp, Artificial Sequence
  Synthetic
caccgctgtcccaaaaggtcctcctccccctcaagagggcctctagattcagcccactggaagataagagttctcctcagtttgtacacccagttcatgccttcagggactggggctcctcatatcagcagccagggcct

SEQ ID NO: 445277 - DNA, 140 bp, Artificial Sequence
  Synthetic
aggccctggctgctgatatgggtgtatcaacatgaactctagggcatgtcagttgtggtctgacatgtccctaaaaacacaaaggtctgaagaggataaagattcttcaatgcttctagagaccttttgggacagcggtg

SEQ ID NO: 445278 - DNA, 140 bp, Artificial Sequence
  Synthetic
caccgctgtcccaaaaggtctctagaagcattgaagaatctttatcctcttcagacctttgtgtttttagggacatgtcagaccacaactgacatgccctagagttcatgttgatacacccatatcagcagccagggcct

SEQ ID NO: 445279 - DNA, 140 bp, Artificial Sequence
  Synthetic
aggccctggctgctgatatgcaagctaggcccttggagtcctatcgacatacatcatctcagctgtcctaataacttggtggtagaggacgaggggtgcaccagtctgtcagggttttctgaccttttgggacagcggtg

SEQ ID NO: 445280 - DNA, 140 bp, Artificial Sequence
  Synthetic
caccgctgtcccaaaaggtcagaaaaccctgacagactggtgcacccctcgtcctctaccaccaagttattaggacagctgagatgatgtatgtcgataggactccaagggcctagcttgcatatcagcagccagggcct

SEQ ID NO: 445281 - DNA, 140 bp, Artificial Sequence
  Synthetic
aggccctggctgctgatatgcacctgtaccggtgtagtgacagaggccgagacctacaccaacttcgttggttatgttaccacaacattcaagagaaaacactttcgcccgatgcccgatgaccttttgggacagcggtg

SEQ ID NO: 445282 - DNA, 140 bp, Artificial Sequence
  Synthetic
caccgctgtcccaaaaggtcatcgggcatcgggcgaaagtgttttctcttgaatgttgtggtaacataaccaacgaagttggtgtaggtctcggcctctgtcactacaccggtacaggtgcatatcagcagccagggcct

SEQ ID NO: 445283 - DNA, 140 bp, Artificial Sequence
  Synthetic
aggccctggctgctgatatgccatatggatgccagaggaagcgagacttgggacatcttgtgacatttttacaaacagcaaagggaagaaagcttctaaggggggcaaggtttgcggattgaccttttgggacagcggtg

SEQ ID NO: 445284 - DNA, 140 bp, Artificial Sequence
  Synthetic
caccgctgtcccaaaaggtcaatccgcaaaccttgccccccttagaagctttcttccctttgctgtttgtaaaaatgtcacaagatgtcccaagtctcgcttcctctggcatccatatggcatatcagcagccagggcct

SEQ ID NO: 445285 - DNA, 140 bp, Artificial Sequence
  Synthetic
atacgccatgctgggtctccacaaacagcaaagggaagaaagcttctaaggggggcaaggtttgcggattcgtggatgaaaggggcttatacaagtctctgaaaggagcatgtaaacttacgtacttgggagtcggccat

SEQ ID NO: 445286 - DNA, 140 bp, Artificial Sequence
  Synthetic
atggccgactcccaagtacgtaagtttacatgctcctttcagagacttgtataagcccctttcatccacgaatccgcaaaccttgccccccttagaagctttcttccctttgctgtttgtggagacccagcatggcgtat

SEQ ID NO: 445287 - DNA, 140 bp, Artificial Sequence
  Synthetic
aggccctggctgctgatatggggatttggaaaggcatatactatattcaacaagacattaatggaagccgatgctcactacaagtcagttcggacttggaatgaggtcatcccttccaaggaccttttgggacagcggtg

SEQ ID NO: 445288 - DNA, 140 bp, Artificial Sequence
  Synthetic
caccgctgtcccaaaaggtccttggaagggatgacctcattccaagtccgaactgacttgtagtgagcatcggcttccattaatgtcttgttgaatatagtatatgcctttccaaatccccatatcagcagccagggcct

SEQ ID NO: 445289 - DNA, 140 bp, Artificial Sequence
  Synthetic
atacgccatgctgggtctcctgcagtcgtccttgctccaacaacatatggagctgttggagtcctctgtgatccccctaatgcatcccttggcggacccatcaaaggtcttcaaggaaggcgtacttgggagtcggccat

SEQ ID NO: 445290 - DNA, 140 bp, Artificial Sequence
  Synthetic
atggccgactcccaagtacgccttccttgaagacctttgatgggtccgccaagggatgcattagggggatcacagaggactccaacagctccatatgttgttggagcaaggacgactgcaggagacccagcatggcgtat

SEQ ID NO: 445291 - DNA, 140 bp, Artificial Sequence
  Synthetic
aggccctggctgctgatatgatgagtgtgggtgctctggcaacactaatcctgattatcttcttaataacatgttgcagaaaggtcaagagaacagaatcaatacagcgaggccatggaggaccttttgggacagcggtg

SEQ ID NO: 445292 - DNA, 140 bp, Artificial Sequence
  Synthetic
caccgctgtcccaaaaggtcctccatggcctcgctgtattgattctgttctcttgacctttctgcaacatgttattaagaagataatcaggattagtgttgccagagcacccacactcatcatatcagcagccagggcct

SEQ ID NO: 445293 - DNA, 140 bp, Artificial Sequence
  Synthetic
aggccctggctgctgatatgcatcacctccatactcggtgttaagaagattacctctctttaagatctgagagaatctcacgtctcaacagtccttcatggactccgcacaacaggatgggaccttttgggacagcggtg

SEQ ID NO: 445294 - DNA, 140 bp, Artificial Sequence
  Synthetic
caccgctgtcccaaaaggtcccatcctgttgtgcggagtccatgaaggactgttgagacgtgagattctctcagatcttaaagagaggtaatcttcttaacaccgagtatggaggtgatgcatatcagcagccagggcct

SEQ ID NO: 445295 - DNA, 140 bp, Artificial Sequence
  Synthetic
aggccctggctgctgatatgttatgtagactttgataatgtgtgatgtcttctgacagtatctttgactaatggtgctctcatcccccaaggactgataccaaaggttgtggacaggctagaccttttgggacagcggtg

SEQ ID NO: 445296 - DNA, 140 bp, Artificial Sequence
  Synthetic
caccgctgtcccaaaaggtctagcctgtccacaacctttggtatcagtccttgggggatgagagcaccattagtcaaagatactgtcagaagacatcacacattatcaaagtctacataacatatcagcagccagggcct

SEQ ID NO: 445297 - DNA, 140 bp, Artificial Sequence
  Synthetic
atacgccatgctgggtctccggcagatctacttagggagatctcttggggaagaaaagtggtaggcacgacagttcctcacccttctgagatgttggggttacttcccaagtcctctattcgtacttgggagtcggccat

SEQ ID NO: 445298 - DNA, 140 bp, Artificial Sequence
  Synthetic
atggccgactcccaagtacgaatagaggacttgggaagtaaccccaacatctcagaagggtgaggaactgtcgtgcctaccacttttcttccccaagagatctccctaagtagatctgccggagacccagcatggcgtat

SEQ ID NO: 445299 - DNA, 140 bp, Artificial Sequence
  Synthetic
atacgccatgctgggtctcctccaccatgatgatagatccaggggaagtttatgatgaccccattgatccggttgagccagaggctgaacagagggggaatcccacaattcccaacatctcgtacttgggagtcggccat

SEQ ID NO: 445300 - DNA, 140 bp, Artificial Sequence
  Synthetic
atggccgactcccaagtacgagatgttgggaattgtgggattccccctctgttcagcctctggctcaaccggatcaatggggtcatcataaacttcccctggatctatcatcatggtggaggagacccagcatggcgtat

SEQ ID NO: 445301 - DNA, 140 bp, Artificial Sequence
  Synthetic
aggccctggctgctgatatggcttcagaatccattgatctcgggcctgagagttgttcaatgggcgacaggggcccattacaagctcaaacctattctggatgatctcaatgtattcccagaccttttgggacagcggtg

SEQ ID NO: 445302 - DNA, 140 bp, Artificial Sequence
  Synthetic
caccgctgtcccaaaaggtctgggaatacattgagatcatccagaataggtttgagcttgtaatgggcccctgtcgcccattgaacaactctcaggcccgagatcaatggattctgaagccatatcagcagccagggcct

SEQ ID NO: 445303 - DNA, 140 bp, Artificial Sequence
  Synthetic
atacgccatgctgggtctcccttctcaggtcttcgaattcccggatgtttcaagaagaatatctagaatggtttctggagctgtgcctcactttcgaaaacttcccgatattcgtttgagcgtacttgggagtcggccat

SEQ ID NO: 445304 - DNA, 140 bp, Artificial Sequence
  Synthetic
atggccgactcccaagtacgctcaaacgaatatcgggaagttttcgaaagtgaggcacagctccagaaaccattctagatattcttcttgaaacatccgggaattcgaagacctgagaagggagacccagcatggcgtat

SEQ ID NO: 445305 - DNA, 140 bp, Artificial Sequence
  Synthetic
aggccctggctgctgatatgtttgacagacaattgctctaggtcttataaggttttgaaagattacttcaagaaagtggatctaggatctctcaaggtgggcggagctgccgcccaatctgaccttttgggacagcggtg

SEQ ID NO: 445306 - DNA, 140 bp, Artificial Sequence
  Synthetic
caccgctgtcccaaaaggtcagattgggcggcagctccgcccaccttgagagatcctagatccactttcttgaagtaatctttcaaaaccttataagacctagagcaattgtctgtcaaacatatcagcagccagggcct

SEQ ID NO: 445307 - DNA, 140 bp, Artificial Sequence
  Synthetic
aggccctggctgctgatatgggtatctggctaacatatattcctcttatttgttctttcacgtgatcaccctttacatgaacgccttggactgggatgaggagaagaccatcctagcgctgaccttttgggacagcggtg

SEQ ID NO: 445308 - DNA, 140 bp, Artificial Sequence
  Synthetic
caccgctgtcccaaaaggtcagcgctaggatggtcttctcctcatcccagtccaaggcgttcatgtaaagggtgatcacgtgaaagaacaaataagaggaatatatgttagccagatacccatatcagcagccagggcct

SEQ ID NO: 445309 - DNA, 140 bp, Artificial Sequence
  Synthetic
aggccctggctgctgatatgcgactcaggatataacgatgggaccattttccctgtcaacatatacggcaaagtctctcctagagactacttgagagggctcgcaagaggggtcttgatagaccttttgggacagcggtg

SEQ ID NO: 445310 - DNA, 140 bp, Artificial Sequence
  Synthetic
caccgctgtcccaaaaggtctatcaagacccctcttgcgagccctctcaagtagtctctaggagagactttgccgtatatgttgacagggaaaatggtcccatcgttatatcctgagtcgcatatcagcagccagggcct

SEQ ID NO: 445311 - DNA, 140 bp, Artificial Sequence
  Synthetic
atacgccatgctgggtctccccctttacatgaacgccctggactgggaggaggagaagaccatcctagcactgtggagagatatggcatcaatagataccggaaaggacttggtcaagctcgtacttgggagtcggccat

SEQ ID NO: 445312 - DNA, 140 bp, Artificial Sequence
  Synthetic
atggccgactcccaagtacgagcttgaccaagtcctttccggtatctattgatgccatatctctccacagtgctaggatggtcttctcctcctcccagtccagggcgttcatgtaaagggggagacccagcatggcgtat

SEQ ID NO: 445313 - DNA, 140 bp, Artificial Sequence
  Synthetic
atacgccatgctgggtctccataatcatccctctttgtatataatgcttagagaaccatctcttagaggagagatattttctatcccccagaaaatccccgccgcttacccaactactatcgtacttgggagtcggccat

SEQ ID NO: 445314 - DNA, 140 bp, Artificial Sequence
  Synthetic
atggccgactcccaagtacgatagtagttgggtaagcggcggggattttctgggggatagaaaatatctctcctctaagagatggttctctaagcattatatacaaagagggatgattatggagacccagcatggcgtat

SEQ ID NO: 445315 - DNA, 140 bp, Artificial Sequence
  Synthetic
aggccctggctgctgatatggacctctttttgtctcggttcaattctctgctaattcttctgtcacctccggaacccagatattcagatgacttgatatctctcctgtgtcagctatatagaccttttgggacagcggtg

SEQ ID NO: 445316 - DNA, 140 bp, Artificial Sequence
  Synthetic
caccgctgtcccaaaaggtctatatagctgacacaggagagatatcaagtcatctgaatatctgggttccggaggtgacagaagaattagcagagaattgaaccgagacaaaaagaggtccatatcagcagccagggcct

SEQ ID NO: 445317 - DNA, 140 bp, Artificial Sequence
  Synthetic
aggccctggctgctgatatgaaaatttcggcctctcattcactccctgggggatttccctgcatttataagagataaggtgggtcaacttgaggggacctttggtcctagtgcaaaaagggaccttttgggacagcggtg

SEQ ID NO: 445318 - DNA, 140 bp, Artificial Sequence
  Synthetic
caccgctgtcccaaaaggtccctttttgcactaggaccaaaggtcccctcaagttgacccaccttatctcttataaatgcagggaaatcccccagggagtgaatgagaggccgaaattttcatatcagcagccagggcct

SEQ ID NO: 445319 - DNA, 140 bp, Artificial Sequence
  Synthetic
atacgccatgctgggtctcctgagagctactctgcgacaaatgagctctttaatgaggcaagtgctgggtgggcacggagaagataccttggagtcagacgacgacattcaacggttactcgtacttgggagtcggccat

SEQ ID NO: 445320 - DNA, 140 bp, Artificial Sequence
  Synthetic
atggccgactcccaagtacgagtaaccgttgaatgtcgtcgtctgactccaaggtatcttctccgtgcccacccagcacttgcctcattaaagagctcatttgtcgcagagtagctctcaggagacccagcatggcgtat

SEQ ID NO: 445321 - DNA, 140 bp, Artificial Sequence
  Synthetic
atacgccatgctgggtctccggtctgcccaagggctcttgtattcaatcttggttgctatccatgactctgggtacaatgatggaactattttccctgtcaacatatatagcaaggtttccgtacttgggagtcggccat

SEQ ID NO: 445322 - DNA, 140 bp, Artificial Sequence
  Synthetic
atggccgactcccaagtacggaaaccttgctatatatgttgacagggaaaatagttccatcattgtacccagagtcatggatagcaaccaagattgaatacaagagcccttgggcagaccggagacccagcatggcgtat

SEQ ID NO: 445323 - DNA, 140 bp, Artificial Sequence
  Synthetic
aggccctggctgctgatatggaccaccccctgactccttatattaaaacccagacatggcctcccaaacatatagtagatttggtgggcgacacctggcacaagctcccgatcacccagagaccttttgggacagcggtg

SEQ ID NO: 445324 - DNA, 140 bp, Artificial Sequence
  Synthetic
caccgctgtcccaaaaggtctctgggtgatcgggagcttgtgccaggtgtcgcccaccaaatctactatatgtttgggaggccatgtctgggttttaatataaggagtcagggggtggtccatatcagcagccagggcct

SEQ ID NO: 445325 - DNA, 140 bp, Artificial Sequence
  Synthetic
aggccctggctgctgatatggatcttcgagatccctgaatcaatggacccttcggagatactagatgacaaatcacactctttcactcgaacaagactagcatcatggctatcagagaacgaccttttgggacagcggtg

SEQ ID NO: 445326 - DNA, 140 bp, Artificial Sequence
  Synthetic
caccgctgtcccaaaaggtcgttctctgatagccatgatgctagtcttgttcgagtgaaagagtgtgatttgtcatctagtatctccgaagggtccattgattcagggatctcgaagatccatatcagcagccagggcct

SEQ ID NO: 445327 - DNA, 140 bp, Artificial Sequence
  Synthetic
aggccctggctgctgatatgtgccagatgaggatttgataatcggcctcaaacctaaagaaagggagctgaaaatcgaaggccggttttttgctttgatgtcttggaatctgaggttgtagaccttttgggacagcggtg

SEQ ID NO: 445328 - DNA, 140 bp, Artificial Sequence
  Synthetic
caccgctgtcccaaaaggtctacaacctcagattccaagacatcaaagcaaaaaaccggccttcgattttcagctccctttctttaggtttgaggccgattatcaaatcctcatctggcacatatcagcagccagggcct

SEQ ID NO: 445329 - DNA, 140 bp, Artificial Sequence
  Synthetic
atacgccatgctgggtctccgaggatgtattttctgtgcttgatcaagtgtttggattgaagagggtgttctccagaactcatgagttttttcagaagtcttggatctattattcagacacgtacttgggagtcggccat

SEQ ID NO: 445330 - DNA, 140 bp, Artificial Sequence
  Synthetic
atggccgactcccaagtacgtgtctgaataatagatccaagacttctgaaaaaactcatgagttctggagaacaccctcttcaatccaaacacttgatcaagcacagaaaatacatcctcggagacccagcatggcgtat

SEQ ID NO: 445331 - DNA, 140 bp, Artificial Sequence
  Synthetic
aggccctggctgctgatatggacagggttacaggacaggggcttttagactattcgagggttacatatgcttttcacctggactatgagaagtggaataatcatcagaggttggaatcgagaccttttgggacagcggtg

SEQ ID NO: 445332 - DNA, 140 bp, Artificial Sequence
  Synthetic
caccgctgtcccaaaaggtctcgattccaacctctgatgattattccacttctcatagtccaggtgaaaagcatatgtaaccctcgaatagtctaaaagcccctgtcctgtaaccctgtccatatcagcagccagggcct

SEQ ID NO: 445333 - DNA, 140 bp, Artificial Sequence
  Synthetic
aggccctggctgctgatatgcaggtcagacctcatcgggctgtgggaggaccagatatactgtttggacatgtcaaacggccctacatgctggaacggccaagatggcgggctggagggtgaccttttgggacagcggtg

SEQ ID NO: 445334 - DNA, 140 bp, Artificial Sequence
  Synthetic
caccgctgtcccaaaaggtcaccctccagcccgccatcttggccgttccagcatgtagggccgtttgacatgtccaaacagtatatctggtcctcccacagcccgatgaggtctgacctgcatatcagcagccagggcct

SEQ ID NO: 445335 - DNA, 140 bp, Artificial Sequence
  Synthetic
aggccctggctgctgatatgttgcgacagaagggctggagtctggttagtttgttaatgatagatcgtgaatctcagacccggaataccagaaccaagatactagcccaaggggacaaccgaccttttgggacagcggtg

SEQ ID NO: 445336 - DNA, 140 bp, Artificial Sequence
  Synthetic
caccgctgtcccaaaaggtcggttgtccccttgggctagtatcttggttctggtattccgggtctgagattcacgatctatcattaacaaactaaccagactccagcccttctgtcgcaacatatcagcagccagggcct

SEQ ID NO: 445337 - DNA, 140 bp, Artificial Sequence
  Synthetic
aggccctggctgctgatatgcacagtcaacttctctaccccgtcaggaaggccttcagaggataaatctactcagactgttggcaaagaactcaagaaggagacaccgtctgcttcttctgaccttttgggacagcggtg

SEQ ID NO: 445338 - DNA, 140 bp, Artificial Sequence
  Synthetic
caccgctgtcccaaaaggtcagaagaagcagacggtgtctccttcttgagttctttgccaacagtctgagtagatttatcctctgaaggccttcctgacggggtagagaagttgactgtgcatatcagcagccagggcct

SEQ ID NO: 445339 - DNA, 140 bp, Artificial Sequence
  Synthetic
atacgccatgctgggtctcctgctattgaggagggggcatccaaactggggctcatcataaagaaggaagagaccatgtgtagctacgactttctcatctacggaaagacccctctgttccgtacttgggagtcggccat

SEQ ID NO: 445340 - DNA, 140 bp, Artificial Sequence
  Synthetic
atggccgactcccaagtacggaacagaggggtctttccgtagatgagaaagtcgtagctacacatggtctcttccttctttatgatgagccccagtttggatgccccctcctcaatagcaggagacccagcatggcgtat

SEQ ID NO: 445341 - DNA, 140 bp, Artificial Sequence
  Synthetic
aggccctggctgctgatatgccaccaatgcattgactgtagcacaacactctcagtctttaatcaagccgatgagggattttttgctcatgtcagtgcaagctgtcttccattacttgctgaccttttgggacagcggtg

SEQ ID NO: 445342 - DNA, 140 bp, Artificial Sequence
  Synthetic
caccgctgtcccaaaaggtcagcaagtaatggaagacagcttgcactgacatgagcaaaaaatccctcatcggcttgattaaagactgagagtgttgtgctacagtcaatgcattggtggcatatcagcagccagggcct

SEQ ID NO: 445343 - DNA, 140 bp, Artificial Sequence
  Synthetic
aggccctggctgctgatatgcccctctttgtacataatgctcagagagccttctctcagaggagagatattttctattccccaaaaagttcctgctgcttacccaactacgatgaaagaagaccttttgggacagcggtg

SEQ ID NO: 445344 - DNA, 140 bp, Artificial Sequence
  Synthetic
caccgctgtcccaaaaggtcttctttcatcgtagttgggtaagcagcaggaactttttggggaatagaaaatatctctcctctgagagaaggctctctgagcattatgtacaaagaggggcatatcagcagccagggcct

SEQ ID NO: 445345 - DNA, 140 bp, Artificial Sequence
  Synthetic
atacgccatgctgggtctcccctttacattttgatcctcttggatgtgaaaaaaactattaacatccctcaaaagactcaaggaaagatggttcctcaggctctcctgtttgtaccccttcgtacttgggagtcggccat

SEQ ID NO: 445346 - DNA, 140 bp, Artificial Sequence
  Synthetic
atggccgactcccaagtacgaaggggtacaaacaggagagcctgaggaaccatctttccttgagtcttttgagggatgttaatagtttttttcacatccaagaggatcaaaatgtaaaggggagacccagcatggcgtat

SEQ ID NO: 445347 - DNA, 140 bp, Artificial Sequence
  Synthetic
atacgccatgctgggtctccgctggacactactggaagcctgtacatgctgagactcctgtatgatcatcttgaaaaaaacaagatcttgaatccgagtctctggttgtttgattgttttcgtacttgggagtcggccat

SEQ ID NO: 445348 - DNA, 140 bp, Artificial Sequence
  Synthetic
atggccgactcccaagtacgaaaacaatcaaacaaccagagactcggattcaagatcttgtttttttcaagatgatcatacaggagtctcagcatgtacaggcttccagtagtgtccagcggagacccagcatggcgtat

SEQ ID NO: 445349 - DNA, 140 bp, Artificial Sequence
  Synthetic
atacgccatgctgggtctccatgcaattagaagagctttatatgatgaggtggacaaagtggagaactcggagtttagggaagcgatcctcttgtccaagacccacagggataactttatcgtacttgggagtcggccat

SEQ ID NO: 445350 - DNA, 140 bp, Artificial Sequence
  Synthetic
atggccgactcccaagtacgataaagttatccctgtgggtcttggacaagaggatcgcttccctaaactccgagttctccactttgtccacctcatcatataaagctcttctaattgcatggagacccagcatggcgtat

SEQ ID NO: 445351 - DNA, 140 bp, Artificial Sequence
  Synthetic
atacgccatgctgggtctccaaactccagaaccataagaagacagtttaggaggagtctctcaagaacattggaagagtccttttataactcagagatccatgggatcaaccggatgacccgtacttgggagtcggccat

SEQ ID NO: 445352 - DNA, 140 bp, Artificial Sequence
  Synthetic
atggccgactcccaagtacgggtcatccggttgatcccatggatctctgagttataaaaggactcttccaatgttcttgagagactcctcctaaactgtcttcttatggttctggagtttggagacccagcatggcgtat

SEQ ID NO: 445353 - DNA, 140 bp, Artificial Sequence
  Synthetic
aggccctggctgctgatatgcaaaattccagaacaattagaagacagtttaggaggagtctctcaagaacattagaagagtctttttataactcagagattcatgggatcaaccggatgagaccttttgggacagcggtg

SEQ ID NO: 445354 - DNA, 140 bp, Artificial Sequence
  Synthetic
caccgctgtcccaaaaggtctcatccggttgatcccatgaatctctgagttataaaaagactcttctaatgttcttgagagactcctcctaaactgtcttctaattgttctggaattttgcatatcagcagccagggcct

SEQ ID NO: 445355 - DNA, 140 bp, Artificial Sequence
  Synthetic
aggccctggctgctgatatggaagtgtataacagacttagctcagttctactccaagtcttccccaatagaaaaactactaaactgcacacttggaaatagagggctgaggatccccccggaccttttgggacagcggtg

SEQ ID NO: 445356 - DNA, 140 bp, Artificial Sequence
  Synthetic
caccgctgtcccaaaaggtccggggggatcctcagccctctatttccaagtgtgcagtttagtagtttttctattggggaagacttggagtagaactgagctaagtctgttatacacttccatatcagcagccagggcct

SEQ ID NO: 445357 - DNA, 140 bp, Artificial Sequence
  Synthetic
aggccctggctgctgatatgaacttggtccatggagtcccattgatatacatcatctcagctgtccgaacaatctggttgtggaagatgaaggatgcaccaatctgtctggattttcctagaccttttgggacagcggtg

SEQ ID NO: 445358 - DNA, 140 bp, Artificial Sequence
  Synthetic
caccgctgtcccaaaaggtctaggaaaatccagacagattggtgcatccttcatcttccacaaccagattgttcggacagctgagatgatgtatatcaatgggactccatggaccaagttcatatcagcagccagggcct

SEQ ID NO: 445359 - DNA, 140 bp, Artificial Sequence
  Synthetic
aggccctggctgctgatatgcaggtttggctgatctagagatggcagaggaaacggtagatctgatcgctaggaacatcgaggacaatcaggctcatctccaaggagaacccattgaggtgaccttttgggacagcggtg

SEQ ID NO: 445360 - DNA, 140 bp, Artificial Sequence
  Synthetic
caccgctgtcccaaaaggtcacctcaatgggttctccttggagatgagcctgattgtcctcgatgttcctagcgatcagatctaccgtttcctctgccatctctagatcagccaaacctgcatatcagcagccagggcct

SEQ ID NO: 445361 - DNA, 140 bp, Artificial Sequence
  Synthetic
aggccctggctgctgatatggacatgtttttctcccggattgaacatctgtattcagcgattagagtaggcacagttgtcactgcttatgaggactgctcagggttggtgtcatttacaggaccttttgggacagcggtg

SEQ ID NO: 445362 - DNA, 140 bp, Artificial Sequence
  Synthetic
caccgctgtcccaaaaggtcctgtaaatgacaccaaccctgagcagtcctcataagcagtgacaactgtgcctactctaatcgctgaatacagatgttcaatccgggagaaaaacatgtccatatcagcagccagggcct

SEQ ID NO: 445363 - DNA, 140 bp, Artificial Sequence
  Synthetic
aggccctggctgctgatatggtcttcaagaggacagggtctgccctgcataggttcaagtcagccagatacagtgaaggggggtactcttctgtttgtccaaatctcctctctcacatctgaccttttgggacagcggtg

SEQ ID NO: 445364 - DNA, 140 bp, Artificial Sequence
  Synthetic
caccgctgtcccaaaaggtcagatgtgagagaggagatttggacaaacagaagagtaccccccttcactgtatctggctgacttgaacctatgcagggcagaccctgtcctcttgaagaccatatcagcagccagggcct

SEQ ID NO: 445365 - DNA, 140 bp, Artificial Sequence
  Synthetic
aggccctggctgctgatatgactttagaagctccaagatgacgtatctgactctcattacctaccagtcccatcttttgcttcagagggttgagaaaaacctctccaaaagtatgagagcgaccttttgggacagcggtg

SEQ ID NO: 445366 - DNA, 140 bp, Artificial Sequence
  Synthetic
caccgctgtcccaaaaggtcgctctcatacttttggagaggtttttctcaaccctctgaagcaaaagatgggactggtaggtaatgagagtcagatacgtcatcttggagcttctaaagtcatatcagcagccagggcct

SEQ ID NO: 445367 - DNA, 140 bp, Artificial Sequence
  Synthetic
atacgccatgctgggtctccatttgggagaggagttttttgggaaagggacttttgagagaagattcttcagggacgagaaagaacttcaggaatatgaagcagctgaattaacgaagaccgtacttgggagtcggccat

SEQ ID NO: 445368 - DNA, 140 bp, Artificial Sequence
  Synthetic
atggccgactcccaagtacggtcttcgttaattcagctgcttcatattcctgaagttctttctcgtccctgaagaatcttctctcaaaagtccctttcccaaaaaactcctctcccaaatggagacccagcatggcgtat

SEQ ID NO: 445369 - DNA, 140 bp, Artificial Sequence
  Synthetic
aggccctggctgctgatatgggtcagcccaagggctcttgtattcaatcttggttgcgattcatgactctgggtataatgacggaaccatcttccctgtcaacatatacggcaaggtatcgaccttttgggacagcggtg

SEQ ID NO: 445370 - DNA, 140 bp, Artificial Sequence
  Synthetic
caccgctgtcccaaaaggtcgataccttgccgtatatgttgacagggaagatggttccgtcattatacccagagtcatgaatcgcaaccaagattgaatacaagagcccttgggctgacccatatcagcagccagggcct

SEQ ID NO: 445371 - DNA, 140 bp, Artificial Sequence
  Synthetic
aggccctggctgctgatatgccctagagactatttaagagggcttgcgagaggagtcttgatagggtcttcgatttgcttcttgacgagaatgactaacatcaacatcaacagacctcttgaccttttgggacagcggtg

SEQ ID NO: 445372 - DNA, 140 bp, Artificial Sequence
  Synthetic
caccgctgtcccaaaaggtcaagaggtctgttgatgttgatgttagtcattctcgtcaagaagcaaatcgaagaccctatcaagactcctctcgcaagccctcttaaatagtctctagggcatatcagcagccagggcct

SEQ ID NO: 445373 - DNA, 140 bp, Artificial Sequence
  Synthetic
aggccctggctgctgatatgcaggtttggctgatctagagatggcagaggaaactgtagatctaatcgctaggaacatcgaagataatcaggctcatctccaaggagatcccatagaggtgaccttttgggacagcggtg

SEQ ID NO: 445374 - DNA, 140 bp, Artificial Sequence
  Synthetic
caccgctgtcccaaaaggtcacctctatgggatctccttggagatgagcctgattatcttcgatgttcctagcgattagatctacagtttcctctgccatctctagatcagccaaacctgcatatcagcagccagggcct

SEQ ID NO: 445375 - DNA, 140 bp, Artificial Sequence
  Synthetic
aggccctggctgctgatatgttctgtatcaatggggaggtcagggtgtgcagtccgactggctattcgttcaggatcttacggcatattctaagatcatttgatgagatatattcagggagaccttttgggacagcggtg

SEQ ID NO: 445376 - DNA, 140 bp, Artificial Sequence
  Synthetic
caccgctgtcccaaaaggtctccctgaatatatctcatcaaatgatcttagaatatgccgtaagatcctgaacgaatagccagtcggactgcacaccctgacctccccattgatacagaacatatcagcagccagggcct

SEQ ID NO: 445377 - DNA, 140 bp, Artificial Sequence
  Synthetic
atacgccatgctgggtctccgaacctagatattcagacgacctgatatctcagctttgtcagctatatatcgcaggagatcacgtcttgtccatgtgcggaaactctggatatgaagtcacgtacttgggagtcggccat

SEQ ID NO: 445378 - DNA, 140 bp, Artificial Sequence
  Synthetic
atggccgactcccaagtacgtgacttcatatccagagtttccgcacatggacaagacgtgatctcctgcgatatatagctgacaaagctgagatatcaggtcgtctgaatatctaggttcggagacccagcatggcgtat

SEQ ID NO: 445379 - DNA, 140 bp, Artificial Sequence
  Synthetic
atacgccatgctgggtctcccgtggcccgcttggcccacgacgggtccaaactccccctgagatgtatgctggggtgggttgctctagccaactccaaaaaattccagctgttagtggagcgtacttgggagtcggccat

SEQ ID NO: 445380 - DNA, 140 bp, Artificial Sequence
  Synthetic
atggccgactcccaagtacgctccactaacagctggaattttttggagttggctagagcaacccaccccagcatacatctcagggggagtttggacccgtcgtgggccaagcgggccacgggagacccagcatggcgtat

SEQ ID NO: 445381 - DNA, 140 bp, Artificial Sequence
  Synthetic
aggccctggctgctgatatggggcccattacaaactcaaacccattctggatgatctcaatgtattcccatccctatgtcttgtagtcggagatggatcaggggggatatcaagagcagtgaccttttgggacagcggtg

SEQ ID NO: 445382 - DNA, 140 bp, Artificial Sequence
  Synthetic
caccgctgtcccaaaaggtcactgctcttgatatcccccctgatccatctccgactacaagacatagggatgggaatacattgagatcatccagaatgggtttgagtttgtaatgggccccatatcagcagccagggcct

SEQ ID NO: 445383 - DNA, 140 bp, Artificial Sequence
  Synthetic
aggccctggctgctgatatgtagggtcagcccaaggactcttgtattcaatcttggttgcgattcatgactctggatataatgatgggaccattttccccgtcaacatatatagcaaggtgaccttttgggacagcggtg

SEQ ID NO: 445384 - DNA, 140 bp, Artificial Sequence
  Synthetic
caccgctgtcccaaaaggtcaccttgctatatatgttgacggggaaaatggtcccatcattatatccagagtcatgaatcgcaaccaagattgaatacaagagtccttgggctgaccctacatatcagcagccagggcct

SEQ ID NO: 445385 - DNA, 140 bp, Artificial Sequence
  Synthetic
atacgccatgctgggtctcccctctctcgtgtcagctcccccagatgatgatgatttgtggttaccccctccagaatatgttccgttgaaggagcttacaggcaagaaaaacatgagaaacgtacttgggagtcggccat

SEQ ID NO: 445386 - DNA, 140 bp, Artificial Sequence
  Synthetic
atggccgactcccaagtacgtttctcatgtttttcttgcctgtaagctccttcaacggaacatattctggagggggtaaccacaaatcatcatcatctgggggagctgacacgagagaggggagacccagcatggcgtat

SEQ ID NO: 445387 - DNA, 140 bp, Artificial Sequence
  Synthetic
atacgccatgctgggtctccaggagccccagtccctgagggcatgaactgggtatacaaattgaggagaactcttatcttccagtgggctgattctaggggccctctagaaggggaggagcgtacttgggagtcggccat

SEQ ID NO: 445388 - DNA, 140 bp, Artificial Sequence
  Synthetic
atggccgactcccaagtacgctcctccccttctagagggcccctagaatcagcccactggaagataagagttctcctcaatttgtatacccagttcatgccctcagggactggggctcctggagacccagcatggcgtat

SEQ ID NO: 445389 - DNA, 140 bp, Artificial Sequence
  Synthetic
aggccctggctgctgatatgctcatcagagctatacctcagattctctaaacgggggaagttctttcgggatgcagaatatttgacttcctctactcttcgggaaatgagcctcgtgttggaccttttgggacagcggtg

SEQ ID NO: 445390 - DNA, 140 bp, Artificial Sequence
  Synthetic
caccgctgtcccaaaaggtccaacacgaggctcatttcccgaagagtagaggaagtcaaatattctgcatcccgaaagaacttcccccgtttagagaatctgaggtatagctctgatgagcatatcagcagccagggcct

SEQ ID NO: 445391 - DNA, 140 bp, Artificial Sequence
  Synthetic
atacgccatgctgggtctccatgcagaatatttgacttcctctactcttcgggaaatgagcctcgtgttgttcaactgcagtagccccaagagtgagatgcagagagcccgctctctaaacgtacttgggagtcggccat

SEQ ID NO: 445392 - DNA, 140 bp, Artificial Sequence
  Synthetic
atggccgactcccaagtacgtttagagagcgggctctctgcatctcactcttggggctactgcagttgaacaacacgaggctcatttcccgaagagtagaggaagtcaaatattctgcatggagacccagcatggcgtat

SEQ ID NO: 445393 - DNA, 140 bp, Artificial Sequence
  Synthetic
aggccctggctgctgatatgtttacattttaagcttctcggatgtgaaaaaaactattaacatccctcaaaagacccaaggaaagatgatccctcaggctcttctctttgtgcctctcctgaccttttgggacagcggtg

SEQ ID NO: 445394 - DNA, 140 bp, Artificial Sequence
  Synthetic
caccgctgtcccaaaaggtcaggagaggcacaaagagaagagcctgagggatcatctttccttgggtcttttgagggatgttaatagtttttttcacatccgagaagcttaaaatgtaaacatatcagcagccagggcct

SEQ ID NO: 445395 - DNA, 140 bp, Artificial Sequence
  Synthetic
atacgccatgctgggtctccagcttggaccttggagtcccatcgacatacatcatctcagctgtcctaacaatttggtcgtggaagacgaggggtgcaccagtctgtcggggttttcttacgtacttgggagtcggccat

SEQ ID NO: 445396 - DNA, 140 bp, Artificial Sequence
  Synthetic
atggccgactcccaagtacgtaagaaaaccccgacagactggtgcacccctcgtcttccacgaccaaattgttaggacagctgagatgatgtatgtcgatgggactccaaggtccaagctggagacccagcatggcgtat

SEQ ID NO: 445397 - DNA, 140 bp, Artificial Sequence
  Synthetic
atacgccatgctgggtctcctatgtcaccaccacattcaagagaaaacactttcgcccgatgccggattcatgcagagctgcatacaactggaagacggccggtgatcctcgatatgaagcgtacttgggagtcggccat

SEQ ID NO: 445398 - DNA, 140 bp, Artificial Sequence
  Synthetic
atggccgactcccaagtacgcttcatatcgaggatcaccggccgtcttccagttgtatgcagctctgcatgaatccggcatcgggcgaaagtgttttctcttgaatgtggtggtgacataggagacccagcatggcgtat

SEQ ID NO: 445399 - DNA, 140 bp, Artificial Sequence
  Synthetic
aggccctggctgctgatatgcattaggtccagatcatctcttttagattatagttgcatgtaacctaagcactctcgaatgaacgtacagactctgacttttagacagtgcaccctgaaagaccttttgggacagcggtg

SEQ ID NO: 445400 - DNA, 140 bp, Artificial Sequence
  Synthetic
caccgctgtcccaaaaggtctttcagggtgcactgtctaaaagtcagagtctgtacgttcattcgagagtgcttaggttacatgcaactataatctaaaagagatgatctggacctaatgcatatcagcagccagggcct

SEQ ID NO: 445401 - DNA, 140 bp, Artificial Sequence
  Synthetic
atacgccatgctgggtctccactctcgaatgaacgtacagactctgacttttagacagtgcaccctgaaaaaaacaaggtcctgattcagaacctctgcttgcttgattgttttttttatcgtacttgggagtcggccat

SEQ ID NO: 445402 - DNA, 140 bp, Artificial Sequence
  Synthetic
atggccgactcccaagtacgataaaaaaaacaatcaagcaagcagaggttctgaatcaggaccttgtttttttcagggtgcactgtctaaaagtcagagtctgtacgttcattcgagagtggagacccagcatggcgtat

SEQ ID NO: 445403 - DNA, 140 bp, Artificial Sequence
  Synthetic
aggccctggctgctgatatgcgaggcaatatcttggtaccggagtcaaagagatgggccagagtctcttgtatctcgaacgaccagatagtcaaccttgccaatataatgtcaacagtgtgaccttttgggacagcggtg

SEQ ID NO: 445404 - DNA, 140 bp, Artificial Sequence
  Synthetic
caccgctgtcccaaaaggtcacactgttgacattatattggcaaggttgactatctggtcgttcgagatacaagagactctggcccatctctttgactccggtaccaagatattgcctcgcatatcagcagccagggcct

SEQ ID NO: 445405 - DNA, 140 bp, Artificial Sequence
  Synthetic
aggccctggctgctgatatgctcccggaagcctgtacatgctaagactcttgtgcgatgtatcttgaaaaaaacaagatcttgaatccgaacctctggctgtttgattgttttttttatcgaccttttgggacagcggtg

SEQ ID NO: 445406 - DNA, 140 bp, Artificial Sequence
  Synthetic
caccgctgtcccaaaaggtcgataaaaaaaacaatcaaacagccagaggttcggattcaagatcttgtttttttcaagatacatcgcacaagagtcttagcatgtacaggcttccgggagcatatcagcagccagggcct

SEQ ID NO: 445407 - DNA, 140 bp, Artificial Sequence
  Synthetic
atacgccatgctgggtctcccaacagcagagggaagagagcatccaaggggggcaggacttgcggattcgtggacgaaaggggtttgtataagtctctaaaaggggcatgtaaacttaagcgtacttgggagtcggccat

SEQ ID NO: 445408 - DNA, 140 bp, Artificial Sequence
  Synthetic
atggccgactcccaagtacgcttaagtttacatgccccttttagagacttatacaaacccctttcgtccacgaatccgcaagtcctgccccccttggatgctctcttccctctgctgttgggagacccagcatggcgtat

SEQ ID NO: 445409 - DNA, 140 bp, Artificial Sequence
  Synthetic
aggccctggctgctgatatgaggggccccagttcctgagggtatgaactgggtatacaaattgaggagaaccctaattttccaatgggctgattccagaggccctctagaaggggaggaagaccttttgggacagcggtg

SEQ ID NO: 445410 - DNA, 140 bp, Artificial Sequence
  Synthetic
caccgctgtcccaaaaggtcttcctccccttctagagggcctctggaatcagcccattggaaaattagggttctcctcaatttgtatacccagttcataccctcaggaactggggcccctcatatcagcagccagggcct

SEQ ID NO: 445411 - DNA, 140 bp, Artificial Sequence
  Synthetic
atacgccatgctgggtctccgagataaggtgggtcaacttgaggggacctttggtcctagtgcaaaaaggttcttcagggttttggatcaattcgacaacatacacgacttagtctttgtcgtacttgggagtcggccat

SEQ ID NO: 445412 - DNA, 140 bp, Artificial Sequence
  Synthetic
atggccgactcccaagtacgacaaagactaagtcgtgtatgttgtcgaattgatccaaaaccctgaagaacctttttgcactaggaccaaaggtcccctcaagttgacccaccttatctcggagacccagcatggcgtat

SEQ ID NO: 445413 - DNA, 140 bp, Artificial Sequence
  Synthetic
aggccctggctgctgatatgccctctgatgcatcccttggcagacccatcaacagtcttcaaggacggtgatgaagcggaggactttgttgaggttcaccttccagatgttcacaaacaagaccttttgggacagcggtg

SEQ ID NO: 445414 - DNA, 140 bp, Artificial Sequence
  Synthetic
caccgctgtcccaaaaggtcttgtttgtgaacatctggaaggtgaacctcaacaaagtcctccgcttcatcaccgtccttgaagactgttgatgggtctgccaagggatgcatcagagggcatatcagcagccagggcct

SEQ ID NO: 445415 - DNA, 140 bp, Artificial Sequence
  Synthetic
atacgccatgctgggtctccttaggaagggaagtatcggtaacttcccaaaacgggaaagtcatatcttcatgggagttgtacaagagtggaggcgagaccaggctgtgagggcaggacacgtacttgggagtcggccat

SEQ ID NO: 445416 - DNA, 140 bp, Artificial Sequence
  Synthetic
atggccgactcccaagtacgtgtcctgccctcacagcctggtctcgcctccactcttgtacaactcccatgaagatatgactttcccgttttgggaagttaccgatacttcccttcctaaggagacccagcatggcgtat

SEQ ID NO: 445417 - DNA, 140 bp, Artificial Sequence
  Synthetic
atacgccatgctgggtctcctccccttaatgcatcccttggcagatccatcaacggtttttaaagatggtgacgaggtggaggattttgttgaggttcaccttccagatgtgcataagcacgtacttgggagtcggccat

SEQ ID NO: 445418 - DNA, 140 bp, Artificial Sequence
  Synthetic
atggccgactcccaagtacgtgcttatgcacatctggaaggtgaacctcaacaaaatcctccacctcgtcaccatctttaaaaaccgttgatggatctgccaagggatgcattaaggggaggagacccagcatggcgtat

SEQ ID NO: 445419 - DNA, 140 bp, Artificial Sequence
  Synthetic
atacgccatgctgggtctccaggaacatcgaggataatcaggctcatctccaaggagaacctatagaggtggacagtctccccgaagacataagacggcttcaattggatgatacaaaaccgtacttgggagtcggccat

SEQ ID NO: 445420 - DNA, 140 bp, Artificial Sequence
  Synthetic
atggccgactcccaagtacggttttgtatcatccaattgaagccgtcttatgtcttcggggagactgtccacctctataggttctccttggagatgagcctgattatcctcgatgttcctggagacccagcatggcgtat

SEQ ID NO: 445421 - DNA, 140 bp, Artificial Sequence
  Synthetic
atacgccatgctgggtctccttcccctacattagaccaaataggagataggtgagagaagtgatttgcctcctatgaaggacataagcaataggtcacaatcatcttacatcccaataagcgtacttgggagtcggccat

SEQ ID NO: 445422 - DNA, 140 bp, Artificial Sequence
  Synthetic
atggccgactcccaagtacgcttattgggatgtaagatgattgtgacctattgcttatgtccttcataggaggcaaatcacttctctcacctatctcctatttggtctaatgtaggggaaggagacccagcatggcgtat

SEQ ID NO: 445423 - DNA, 140 bp, Artificial Sequence
  Synthetic
atacgccatgctgggtctccgattttcaaatggatgaaggggaggaccccgtcttcttgttccagtcatacctagacaatgttggagttcaaatggtcagacagatgaggtcaggagagacgtacttgggagtcggccat

SEQ ID NO: 445424 - DNA, 140 bp, Artificial Sequence
  Synthetic
atggccgactcccaagtacgtctctcctgacctcatctgtctgaccatttgaactccaacattgtctaggtatgactggaacaagaagacggggtcctccccttcatccatttgaaaatcggagacccagcatggcgtat

SEQ ID NO: 445425 - DNA, 140 bp, Artificial Sequence
  Synthetic
aggccctggctgctgatatgcctagacaatgttggagttcaaatggtcagacagatgaggtcaggagagagattcctcaagatatggtctcagactgtagaagagatcatatcctatgtcgaccttttgggacagcggtg

SEQ ID NO: 445426 - DNA, 140 bp, Artificial Sequence
  Synthetic
caccgctgtcccaaaaggtcgacataggatatgatctcttctacagtctgagaccatatcttgaggaatctctctcctgacctcatctgtctgaccatttgaactccaacattgtctaggcatatcagcagccagggcct

SEQ ID NO: 445427 - DNA, 140 bp, Artificial Sequence
  Synthetic
atacgccatgctgggtctccttaaaaatgaaccttgatgacatagtcaaagagtcaaaaaatgtacctggtgtgacccgcttagcccatgatgggtccaaactccctctgagatgtgtgccgtacttgggagtcggccat

SEQ ID NO: 445428 - DNA, 140 bp, Artificial Sequence
  Synthetic
atggccgactcccaagtacggcacacatctcagagggagtttggacccatcatgggctaagcgggtcacaccaggtacattttttgactctttgactatgtcatcaaggttcatttttaaggagacccagcatggcgtat

SEQ ID NO: 445429 - DNA, 140 bp, Artificial Sequence
  Synthetic
aggccctggctgctgatatgcctttacatgaacgccttggactgggatgaggagaagaccatcctagcgctgtggagggatttatcatcagtagatactggaaaggacttggtcaagtttgaccttttgggacagcggtg

SEQ ID NO: 445430 - DNA, 140 bp, Artificial Sequence
  Synthetic
caccgctgtcccaaaaggtcaaacttgaccaagtcctttccagtatctactgatgataaatccctccacagcgctaggatggtcttctcctcatcccagtccaaggcgttcatgtaaaggcatatcagcagccagggcct

SEQ ID NO: 445431 - DNA, 140 bp, Artificial Sequence
  Synthetic
atacgccatgctgggtctcctggggtgggttgctctagccaattccaagaagttccagcttttagttgagcctgacaagctaaataaaataatgcaagacgatctgaaccgttatgtatccgtacttgggagtcggccat

SEQ ID NO: 445432 - DNA, 140 bp, Artificial Sequence
  Synthetic
atggccgactcccaagtacggatacataacggttcagatcgtcttgcattattttatttagcttgtcaggctcaactaaaagctggaacttcttggaattggctagagcaacccaccccaggagacccagcatggcgtat

SEQ ID NO: 445433 - DNA, 140 bp, Artificial Sequence
  Synthetic
atacgccatgctgggtctcctgcttcaaatacaacatgaaaaaaacaggcaacaccactgataagatgaactttctacgcaagatagtgaagaactgtagagatgaggacaatcaaaagtcgtacttgggagtcggccat

SEQ ID NO: 445434 - DNA, 140 bp, Artificial Sequence
  Synthetic
atggccgactcccaagtacgacttttgattgtcctcatctctacagttcttcactatcttgcgtagaaagttcatcttatcagtggtgttgcctgtttttttcatgttgtatttgaagcaggagacccagcatggcgtat

SEQ ID NO: 445435 - DNA, 140 bp, Artificial Sequence
  Synthetic
atacgccatgctgggtctcctgattttgcattgtccatagatggcccactttgcctggttttcaaatcttatggtaccatgcttgtaaatccggattacagagcaattcaacacctgtcccgtacttgggagtcggccat

SEQ ID NO: 445436 - DNA, 140 bp, Artificial Sequence
  Synthetic
atggccgactcccaagtacgggacaggtgttgaattgctctgtaatccggatttacaagcatggtaccataagatttgaaaaccaggcaaagtgggccatctatggacaatgcaaaatcaggagacccagcatggcgtat

SEQ ID NO: 445437 - DNA, 140 bp, Artificial Sequence
  Synthetic
atacgccatgctgggtctccgaacccagatattcagatgacctgatatctcagctgtgtcagctatatattgcaggagatcacgtcttgtccatgtgcggaaactctggttatgaagtcacgtacttgggagtcggccat

SEQ ID NO: 445438 - DNA, 140 bp, Artificial Sequence
  Synthetic
atggccgactcccaagtacgtgacttcataaccagagtttccgcacatggacaagacgtgatctcctgcaatatatagctgacacagctgagatatcaggtcatctgaatatctgggttcggagacccagcatggcgtat

SEQ ID NO: 445439 - DNA, 140 bp, Artificial Sequence
  Synthetic
aggccctggctgctgatatgaagtttaggcctctcattcattccctaggggatttccctgtatttataagagataaggtgggtcagcttgaaggaacatttggtcctagtgcaaaaaggtgaccttttgggacagcggtg

SEQ ID NO: 445440 - DNA, 140 bp, Artificial Sequence
  Synthetic
caccgctgtcccaaaaggtcacctttttgcactaggaccaaatgttccttcaagctgacccaccttatctcttataaatacagggaaatcccctagggaatgaatgagaggcctaaacttcatatcagcagccagggcct

SEQ ID NO: 445441 - DNA, 140 bp, Artificial Sequence
  Synthetic
atacgccatgctgggtctcctcaggatcctgcggcatattttgaaatcattcgacgagatttattctggaaatcaaagaatgatcgggttagtcaaagttgttgttggactagcattgtccgtacttgggagtcggccat

SEQ ID NO: 445442 - DNA, 140 bp, Artificial Sequence
  Synthetic
atggccgactcccaagtacggacaatgctagtccaacaacaactttgactaacccgatcattctttgatttccagaataaatctcgtcgaatgatttcaaaatatgccgcaggatcctgaggagacccagcatggcgtat

SEQ ID NO: 445443 - DNA, 140 bp, Artificial Sequence
  Synthetic
aggccctggctgctgatatgtctagagatggcagaggaaactgtagatctgatcgctcggaacatcgaggacaaccaggctcatctccaaggagaacccatagaggtggacagtctccctgaccttttgggacagcggtg

SEQ ID NO: 445444 - DNA, 140 bp, Artificial Sequence
  Synthetic
caccgctgtcccaaaaggtcagggagactgtccacctctatgggttctccttggagatgagcctggttgtcctcgatgttccgagcgatcagatctacagtttcctctgccatctctagacatatcagcagccagggcct

SEQ ID NO: 445445 - DNA, 140 bp, Artificial Sequence
  Synthetic
aggccctggctgctgatatgtcctgattgcaagaaaaggagacaagatcactccagactctctagtggagataaagcgcactgacgtagaagggaactgggctttgacaggaggcatggagaccttttgggacagcggtg

SEQ ID NO: 445446 - DNA, 140 bp, Artificial Sequence
  Synthetic
caccgctgtcccaaaaggtctccatgcctcctgtcaaagcccagttcccttctacgtcagtgcgctttatctccactagagagtctggagtgatcttgtctccttttcttgcaatcaggacatatcagcagccagggcct

SEQ ID NO: 445447 - DNA, 140 bp, Artificial Sequence
  Synthetic
aggccctggctgctgatatgactgacaagggaccccactgtctccgagcatgcatctttggttggtcttctcttgagtctatacaggctgagcaaaatatcaggacaaaacactggtaacgaccttttgggacagcggtg

SEQ ID NO: 445448 - DNA, 140 bp, Artificial Sequence
  Synthetic
caccgctgtcccaaaaggtcgttaccagtgttttgtcctgatattttgctcagcctgtatagactcaagagaagaccaaccaaagatgcatgctcggagacagtggggtcccttgtcagtcatatcagcagccagggcct

SEQ ID NO: 445449 - DNA, 140 bp, Artificial Sequence
  Synthetic
aggccctggctgctgatatggaggagggccggttcccagcgagaaggtcattattacagctctttccaaacctcctgtcaaccccagagaattcttaaaatctatagacctcggaggcttgaccttttgggacagcggtg

SEQ ID NO: 445450 - DNA, 140 bp, Artificial Sequence
  Synthetic
caccgctgtcccaaaaggtcaagcctccgaggtctatagattttaagaattctctggggttgacaggaggtttggaaagagctgtaataatgaccttctcgctgggaaccggccctcctccatatcagcagccagggcct

SEQ ID NO: 445451 - DNA, 140 bp, Artificial Sequence
  Synthetic
aggccctggctgctgatatgcacagttgtcactgcttatgaagactgctcagggttggtctcgtttacagggttcataaagcagatcaatctcaccgcaagagaagcaatactatacttcgaccttttgggacagcggtg

SEQ ID NO: 445452 - DNA, 140 bp, Artificial Sequence
  Synthetic
caccgctgtcccaaaaggtcgaagtatagtattgcttctcttgcggtgagattgatctgctttatgaaccctgtaaacgagaccaaccctgagcagtcttcataagcagtgacaactgtgcatatcagcagccagggcct

SEQ ID NO: 445453 - DNA, 140 bp, Artificial Sequence
  Synthetic
atacgccatgctgggtctccgatttcctcgctgtgtctcggagaattccccatttacacgataccagaaaaactcggcccttggagtcccatcgacatacatcacctcagttgccctaaccgtacttgggagtcggccat

SEQ ID NO: 445454 - DNA, 140 bp, Artificial Sequence
  Synthetic
atggccgactcccaagtacggttagggcaactgaggtgatgtatgtcgatgggactccaagggccgagtttttctggtatcgtgtaaatggggaattctccgagacacagcgaggaaatcggagacccagcatggcgtat

SEQ ID NO: 445455 - DNA, 140 bp, Artificial Sequence
  Synthetic
atacgccatgctgggtctcccatggaactgaaagtgggatacatctcttccataaaagtgaatgggttcacttgtacaggtgtcgtgacggaagctgagacctacaccaactttgttggtcgtacttgggagtcggccat

SEQ ID NO: 445456 - DNA, 140 bp, Artificial Sequence
  Synthetic
atggccgactcccaagtacgaccaacaaagttggtgtaggtctcagcttccgtcacgacacctgtacaagtgaacccattcacttttatggaagagatgtatcccactttcagttccatgggagacccagcatggcgtat

SEQ ID NO: 445457 - DNA, 140 bp, Artificial Sequence
  Synthetic
atacgccatgctgggtctccgatgaggcggaagactttgttgaggttcatcttccagatgtccacaaacaggtttcggatgttgaccttggtcttccgagttgggggaagtatctgttgacgtacttgggagtcggccat

SEQ ID NO: 445458 - DNA, 140 bp, Artificial Sequence
  Synthetic
atggccgactcccaagtacgtcaacagatacttcccccaactcggaagaccaaggtcaacatccgaaacctgtttgtggacatctggaagatgaacctcaacaaagtcttccgcctcatcggagacccagcatggcgtat

SEQ ID NO: 445459 - DNA, 140 bp, Artificial Sequence
  Synthetic
aggccctggctgctgatatggtcaaacggcccgacatgctggaacggtcaagatggcgggctagagggtttgcggcagaagggctggagtctggttagcttattaatgatagatcgtgaggaccttttgggacagcggtg

SEQ ID NO: 445460 - DNA, 140 bp, Artificial Sequence
  Synthetic
caccgctgtcccaaaaggtcctcacgatctatcattaataagctaaccagactccagcccttctgccgcaaaccctctagcccgccatcttgaccgttccagcatgtcgggccgtttgaccatatcagcagccagggcct

SEQ ID NO: 445461 - DNA, 140 bp, Artificial Sequence
  Synthetic
atacgccatgctgggtctcccatgggagttgtacaaaagtgaaagcgagaccggactgtgaaggtgagtcatccccttcacaccatgcatttagaagatcgaatctctttgagatctgagcgtacttgggagtcggccat

SEQ ID NO: 445462 - DNA, 140 bp, Artificial Sequence
  Synthetic
atggccgactcccaagtacgctcagatctcaaagagattcgatcttctaaatgcatggtgtgaaggggatgactcaccttcacagtccggtctcgctttcacttttgtacaactcccatgggagacccagcatggcgtat

SEQ ID NO: 445463 - DNA, 140 bp, Artificial Sequence
  Synthetic
aggccctggctgctgatatgttcaactgtagcagccccaagagcgagatgcagagagcccgttctctgaattatcaagatcttgtaagaggatttccagatgagatcatatccaacccttgaccttttgggacagcggtg

SEQ ID NO: 445464 - DNA, 140 bp, Artificial Sequence
  Synthetic
caccgctgtcccaaaaggtcaagggttggatatgatctcatctggaaatcctcttacaagatcttgataattcagagaacgggctctctgcatctcgctcttggggctgctacagttgaacatatcagcagccagggcct

SEQ ID NO: 445465 - DNA, 140 bp, Artificial Sequence
  Synthetic
atacgccatgctgggtctccaaccatcccaaatatgagcaagatctttgtcaatccgagtgcaatcagagccggtctggccgatcttgagatggctgaagagactgttgatctgatcaatcgtacttgggagtcggccat

SEQ ID NO: 445466 - DNA, 140 bp, Artificial Sequence
  Synthetic
atggccgactcccaagtacgattgatcagatcaacagtctcttcagccatctcaagatcggccagaccggctctgattgcactcggattgacaaagatcttgctcatatttgggatggttggagacccagcatggcgtat

SEQ ID NO: 445467 - DNA, 140 bp, Artificial Sequence
  Synthetic
aggccctggctgctgatatgggacaatctccctgaggacatgaggcgacttcacttggacgatgaaaaaccgtccagccttggagagatggctaatgtgggggaaggcaagtatcgagaggaccttttgggacagcggtg

SEQ ID NO: 445468 - DNA, 140 bp, Artificial Sequence
  Synthetic
caccgctgtcccaaaaggtcctctcgatacttgccttcccccacattagccatctctccaaggctggacggtttttcatcgtccaagtgaagtcgcctcatgtcctcagggagattgtcccatatcagcagccagggcct

SEQ ID NO: 445469 - DNA, 140 bp, Artificial Sequence
  Synthetic
atacgccatgctgggtctccggttcggaaaggcatatactatattcaacaaaacattaatggaggctgatgctcactacaagtcagttcggacttggaatgaaatcatcccctcaaaaggcgtacttgggagtcggccat

SEQ ID NO: 445470 - DNA, 140 bp, Artificial Sequence
  Synthetic
atggccgactcccaagtacgccttttgaggggatgatttcattccaagtccgaactgacttgtagtgagcatcagcctccattaatgttttgttgaatatagtatatgcctttccgaaccggagacccagcatggcgtat

SEQ ID NO: 445471 - DNA, 140 bp, Artificial Sequence
  Synthetic
aggccctggctgctgatatgggtcctccagcccttgaatggactgccaccaacgaagaggatgatctatcagtagaggctgagatcgctcatcagattgctgaaagcttttccaagaagtgaccttttgggacagcggtg

SEQ ID NO: 445472 - DNA, 140 bp, Artificial Sequence
  Synthetic
caccgctgtcccaaaaggtcacttcttggaaaagctttcagcaatctgatgagcgatctcagcctctactgatagatcatcctcttcgttggtggcagtccattcaagggctggaggacccatatcagcagccagggcct

SEQ ID NO: 445473 - DNA, 140 bp, Artificial Sequence
  Synthetic
atacgccatgctgggtctccgagtgcaggcgctctggctatcctactgctgacaatcttcttaatgacatgttgcataaggaccaatagaacaaaatcaatacaacaaggtcctggggagcgtacttgggagtcggccat

SEQ ID NO: 445474 - DNA, 140 bp, Artificial Sequence
  Synthetic
atggccgactcccaagtacgctccccaggaccttgttgtattgattttgttctattggtccttatgcaacatgtcattaagaagattgtcagcagtaggatagccagagcgcctgcactcggagacccagcatggcgtat

SEQ ID NO: 445475 - DNA, 140 bp, Artificial Sequence
  Synthetic
aggccctggctgctgatatgtgtgacccgtttggcccatgatggatccaaaatccccctaagatgtgtactgggatgggtcgctttggccaattctaagaagttccaattgctagtcgaggaccttttgggacagcggtg

SEQ ID NO: 445476 - DNA, 140 bp, Artificial Sequence
  Synthetic
caccgctgtcccaaaaggtcctcgactagcaattggaacttcttagaattggccaaagcgacccatcccagtacacatcttagggggattttggatccatcatgggccaaacgggtcacacatatcagcagccagggcct

SEQ ID NO: 445477 - DNA, 140 bp, Artificial Sequence
  Synthetic
atacgccatgctgggtctcctctcctctataccctgcattcagaagatagtctctcttcgaggtcaggggagatctcttgacttaacagtccttcatggactccatgtaacagggtagatcgtacttgggagtcggccat

SEQ ID NO: 445478 - DNA, 140 bp, Artificial Sequence
  Synthetic
atggccgactcccaagtacgatctaccctgttacatggagtccatgaaggactgttaagtcaagagatctcccctgacctcgaagagagactatcttctgaatgcagggtatagaggagaggagacccagcatggcgtat

SEQ ID NO: 445479 - DNA, 140 bp, Artificial Sequence
  Synthetic
atacgccatgctgggtctccatgggagtcttacaagagcggaggcgagaccaagctgtaaggagggctgccccctccacacactatgctcggaaaactgttcccctctgatacatggaagcgtacttgggagtcggccat

SEQ ID NO: 445480 - DNA, 140 bp, Artificial Sequence
  Synthetic
atggccgactcccaagtacgcttccatgtatcagaggggaacagttttccgagcatagtgtgtggagggggcagccctccttacagcttggtctcgcctccgctcttgtaagactcccatggagacccagcatggcgtat

SEQ ID NO: 445481 - DNA, 140 bp, Artificial Sequence
  Synthetic
atacgccatgctgggtctccggtgctctcatatcccagggactgataccaaaagttgtggacaatacaactgatatctcagatgactctgtgctcgagattgggcagaagccatagcaatcgtacttgggagtcggccat

SEQ ID NO: 445482 - DNA, 140 bp, Artificial Sequence
  Synthetic
atggccgactcccaagtacgattgctatggcttctgcccaatctcgagcacagagtcatctgagatatcagttgtattgtccacaacttttggtatcagtccctgggatatgagagcaccggagacccagcatggcgtat

SEQ ID NO: 445483 - DNA, 140 bp, Artificial Sequence
  Synthetic
aggccctggctgctgatatgtgcttccatcttttgatcagtcatttttctcgagaggccctctgaagggatacctgggctcatccacttccatgtcgacccagctattccacgcctgggagaccttttgggacagcggtg

SEQ ID NO: 445484 - DNA, 140 bp, Artificial Sequence
  Synthetic
caccgctgtcccaaaaggtctcccaggcgtggaatagctgggtcgacatggaagtggatgagcccaggtatcccttcagagggcctctcgagaaaaatgactgatcaaaagatggaagcacatatcagcagccagggcct

SEQ ID NO: 445485 - DNA, 140 bp, Artificial Sequence
  Synthetic
atacgccatgctgggtctccttcccttacaagagactaaataggggtcaattgagagaagtgatttgcctcctatgaaggacacaagcaatagatcataatcatcttacatcccgataaacgtacttgggagtcggccat

SEQ ID NO: 445486 - DNA, 140 bp, Artificial Sequence
  Synthetic
atggccgactcccaagtacgtttatcgggatgtaagatgattatgatctattgcttgtgtccttcataggaggcaaatcacttctctcaattgacccctatttagtctcttgtaagggaaggagacccagcatggcgtat

SEQ ID NO: 445487 - DNA, 140 bp, Artificial Sequence
  Synthetic
aggccctggctgctgatatgaatcataggatgattgggttagtcaaagttgttattggactggctttgtcaggagctccagtccctgagggcatgaactgggtatacaagttgagaagaagaccttttgggacagcggtg

SEQ ID NO: 445488 - DNA, 140 bp, Artificial Sequence
  Synthetic
caccgctgtcccaaaaggtcttcttctcaacttgtatacccagttcatgccctcagggactggagctcctgacaaagccagtccaataacaactttgactaacccaatcatcctatgattcatatcagcagccagggcct

SEQ ID NO: 445489 - DNA, 140 bp, Artificial Sequence
  Synthetic
atacgccatgctgggtctcctgtcttcaagaggacagggtctgccctgcataggttcaagtcagccagatacagtgaaggggggtactcttctgtttgtccaaatctcctctctcacatccgtacttgggagtcggccat

SEQ ID NO: 445490 - DNA, 140 bp, Artificial Sequence
  Synthetic
atggccgactcccaagtacggatgtgagagaggagatttggacaaacagaagagtaccccccttcactgtatctggctgacttgaacctatgcagggcagaccctgtcctcttgaagacaggagacccagcatggcgtat

SEQ ID NO: 445491 - DNA, 140 bp, Artificial Sequence
  Synthetic
atacgccatgctgggtctccattgcaaataagagtgagtgcaagacaatgtcatattcagggcaggatctggtgtatcaacatgaactcgagggcatgtcaactatggtctgacatgtctcgtacttgggagtcggccat

SEQ ID NO: 445492 - DNA, 140 bp, Artificial Sequence
  Synthetic
atggccgactcccaagtacgagacatgtcagaccatagttgacatgccctcgagttcatgttgatacaccagatcctgccctgaatatgacattgtcttgcactcactcttatttgcaatggagacccagcatggcgtat

SEQ ID NO: 445493 - DNA, 140 bp, Artificial Sequence
  Synthetic
atacgccatgctgggtctccaattgatgttagaatggttaaaaacaggaaataggcccctccggatgactctgacagacaactgctctagatcttacaaagtattgaaggattacttcaacgtacttgggagtcggccat

SEQ ID NO: 445494 - DNA, 140 bp, Artificial Sequence
  Synthetic
atggccgactcccaagtacgttgaagtaatccttcaatactttgtaagatctagagcagttgtctgtcagagtcatccggaggggcctatttcctgtttttaaccattctaacatcaattggagacccagcatggcgtat

SEQ ID NO: 445495 - DNA, 140 bp, Artificial Sequence
  Synthetic
atacgccatgctgggtctccctttacattttgagcctcttggatgtgaaaaaaactattaacatccctcaaaagactcaaggaaagatggttcctcaggctcttttgtttgtaccccttccgtacttgggagtcggccat

SEQ ID NO: 445496 - DNA, 140 bp, Artificial Sequence
  Synthetic
atggccgactcccaagtacggaaggggtacaaacaaaagagcctgaggaaccatctttccttgagtcttttgagggatgttaatagtttttttcacatccaagaggctcaaaatgtaaagggagacccagcatggcgtat

SEQ ID NO: 445497 - DNA, 140 bp, Artificial Sequence
  Synthetic
aggccctggctgctgatatggtcggcccaagggctcttgtattcaatcttggttgcaatccatgactctgggtataatgatggaaccattttccctgtcaacatatatagcaaggtctccgaccttttgggacagcggtg

SEQ ID NO: 445498 - DNA, 140 bp, Artificial Sequence
  Synthetic
caccgctgtcccaaaaggtcggagaccttgctatatatgttgacagggaaaatggttccatcattatacccagagtcatggattgcaaccaagattgaatacaagagcccttgggccgaccatatcagcagccagggcct

SEQ ID NO: 445499 - DNA, 140 bp, Artificial Sequence
  Synthetic
aggccctggctgctgatatgcaacttggttgtggaggatgaaggatgtaccaacctgtcggggttctcctacatggaacttaaagtgggatatatctcggccataaaagggaacgggttcgaccttttgggacagcggtg

SEQ ID NO: 445500 - DNA, 140 bp, Artificial Sequence
  Synthetic
caccgctgtcccaaaaggtcgaacccgttcccttttatggccgagatatatcccactttaagttccatgtaggagaaccccgacaggttggtacatccttcatcctccacaaccaagttgcatatcagcagccagggcct

SEQ ID NO: 445501 - DNA, 140 bp, Artificial Sequence
  Synthetic
atacgccatgctgggtctccacatggaacttaaagtgggatatatctcggccataaaagggaacgggttcacctgcacaggtgttgtaacagaggcagaaacctacaccaactttgttggcgtacttgggagtcggccat

SEQ ID NO: 445502 - DNA, 140 bp, Artificial Sequence
  Synthetic
atggccgactcccaagtacgccaacaaagttggtgtaggtttctgcctctgttacaacacctgtgcaggtgaacccgttcccttttatggccgagatatatcccactttaagttccatgtggagacccagcatggcgtat

SEQ ID NO: 445503 - DNA, 140 bp, Artificial Sequence
  Synthetic
atacgccatgctgggtctccgagtctctacacaatccttaccccgactaccattggcttcgaactgtaaaaactaccaaagagtctctcgtaatcatatccccaagtgtggcagacttggcgtacttgggagtcggccat

SEQ ID NO: 445504 - DNA, 140 bp, Artificial Sequence
  Synthetic
atggccgactcccaagtacgccaagtctgccacacttggggatatgattacgagagactctttggtagtttttacagttcgaagccaatggtagtcggggtaaggattgtgtagagactcggagacccagcatggcgtat

SEQ ID NO: 445505 - DNA, 140 bp, Artificial Sequence
  Synthetic
aggccctggctgctgatatgcatttggatgccagagaatccgagactagggacgtcttgtgacatttttatcaatagcagagggaagagagcatctaaagggagcaagacttgtggctttgaccttttgggacagcggtg

SEQ ID NO: 445506 - DNA, 140 bp, Artificial Sequence
  Synthetic
caccgctgtcccaaaaggtcaaagccacaagtcttgctccctttagatgctctcttccctctgctattgataaaaatgtcacaagacgtccctagtctcggattctctggcatccaaatgcatatcagcagccagggcct

SEQ ID NO: 445507 - DNA, 140 bp, Artificial Sequence
  Synthetic
aggccctggctgctgatatggtagatgaaagaggtctgtataagtctctaaagggagcatgtaaactcaagttatgcggagtccttggacttagactgatggatggaacatgggtcgcgagaccttttgggacagcggtg

SEQ ID NO: 445508 - DNA, 140 bp, Artificial Sequence
  Synthetic
caccgctgtcccaaaaggtctcgcgacccatgttccatccatcagtctaagtccaaggactccgcataacttgagtttacatgctccctttagagacttatacagacctctttcatctaccatatcagcagccagggcct

SEQ ID NO: 445509 - DNA, 140 bp, Artificial Sequence
  Synthetic
atacgccatgctgggtctccggggacagttttcttctagccatgtctaggatcatctatttagacccctcattggggggagtgtctgggatgtcccttggaaggttccacatacgtcagtcgtacttgggagtcggccat

SEQ ID NO: 445510 - DNA, 140 bp, Artificial Sequence
  Synthetic
atggccgactcccaagtacgactgacgtatgtggaaccttccaagggacatcccagacactccccccaatgaggggtctaaatagatgatcctagacatggctagaagaaaactgtccccggagacccagcatggcgtat

SEQ ID NO: 445511 - DNA, 140 bp, Artificial Sequence
  Synthetic
atacgccatgctgggtctccggtcaagaaaagagaggagtgtctggatgcactagagtccatcatgaccaccaagtcagtgagtttcagacgtctcagtcacttaagaaaacttgtccctcgtacttgggagtcggccat

SEQ ID NO: 445512 - DNA, 140 bp, Artificial Sequence
  Synthetic
atggccgactcccaagtacgagggacaagttttcttaagtgactgagacgtctgaaactcactgacttggtggtcatgatggactctagtgcatccagacactcctctcttttcttgaccggagacccagcatggcgtat

SEQ ID NO: 445513 - DNA, 140 bp, Artificial Sequence
  Synthetic
atacgccatgctgggtctccagagtttagagaagcgatcctcttgtctaagactcatagagataactttatacttttcttaaagtctgtcgagcctctgttcccccgatttctcagtgaacgtacttgggagtcggccat

SEQ ID NO: 445514 - DNA, 140 bp, Artificial Sequence
  Synthetic
atggccgactcccaagtacgttcactgagaaatcgggggaacagaggctcgacagactttaagaaaagtataaagttatctctatgagtcttagacaagaggatcgcttctctaaactctggagacccagcatggcgtat

SEQ ID NO: 445515 - DNA, 140 bp, Artificial Sequence
  Synthetic
atacgccatgctgggtctccttcaatggtataatattgggacctgacggccatgttctaatcccagaaatgcagtcatctctcctccaacaacatatggaattattggagtcctcagttacgtacttgggagtcggccat

SEQ ID NO: 445516 - DNA, 140 bp, Artificial Sequence
  Synthetic
atggccgactcccaagtacgtaactgaggactccaataattccatatgttgttggaggagagatgactgcatttctgggattagaacatggccgtcaggtcccaatattataccattgaaggagacccagcatggcgtat

SEQ ID NO: 445517 - DNA, 140 bp, Artificial Sequence
  Synthetic
atacgccatgctgggtctccgagcgcaggcgtcttgatcgtactagtgttgatgattttcttgatgatgtgttgtaaaaagcctaatagagcggagccaattcatcacagtcctagggagcgtacttgggagtcggccat

SEQ ID NO: 445518 - DNA, 140 bp, Artificial Sequence
  Synthetic
atggccgactcccaagtacgctccctaggactgtgatgaattggctccgctctattaggctttttacaacacatcatcaagaaaatcatcaacactagtacgatcaagacgcctgcgctcggagacccagcatggcgtat

SEQ ID NO: 445519 - DNA, 140 bp, Artificial Sequence
  Synthetic
aggccctggctgctgatatgggtctcaggagttgatctgggtctccccaactgggggaagtatgtattgatgagtgcaggggtcctgattgccctgatgttgataattttcctaatgacagaccttttgggacagcggtg

SEQ ID NO: 445520 - DNA, 140 bp, Artificial Sequence
  Synthetic
caccgctgtcccaaaaggtctgtcattaggaaaattatcaacatcagggcaatcaggacccctgcactcatcaatacatacttcccccagttggggagacccagatcaactcctgagacccatatcagcagccagggcct

SEQ ID NO: 445521 - DNA, 140 bp, Artificial Sequence
  Synthetic
atacgccatgctgggtctcctggcaccatgcttgtaaatccggactacagagcaattcaacacctatccagagcgtttcctgcggtcactggatttataactcagatgacttcttcctttcgtacttgggagtcggccat

SEQ ID NO: 445522 - DNA, 140 bp, Artificial Sequence
  Synthetic
atggccgactcccaagtacgaaaggaagaagtcatctgagttataaatccagtgaccgcaggaaacgctctggataggtgttgaattgctctgtagtccggatttacaagcatggtgccaggagacccagcatggcgtat

SEQ ID NO: 445523 - DNA, 140 bp, Artificial Sequence
  Synthetic
aggccctggctgctgatatggacagggaggaaggtgtcggtcacttcccaaagcgggaaggttatatcttcatgggagtcatataaaagtgggggtgagaccagactgtgagggccgatcgaccttttgggacagcggtg

SEQ ID NO: 445524 - DNA, 140 bp, Artificial Sequence
  Synthetic
caccgctgtcccaaaaggtcgatcggccctcacagtctggtctcacccccacttttatatgactcccatgaagatataaccttcccgctttgggaagtgaccgacaccttcctccctgtccatatcagcagccagggcct

SEQ ID NO: 445525 - DNA, 140 bp, Artificial Sequence
  Synthetic
atacgccatgctgggtctcctctccagaacccatgagttttttcagaagtcttggatctattattcagacagatccgacctcatcgggctgtgggaggatcaaatatattgtttagacatcgtacttgggagtcggccat

SEQ ID NO: 445526 - DNA, 140 bp, Artificial Sequence
  Synthetic
atggccgactcccaagtacgatgtctaaacaatatatttgatcctcccacagcccgatgaggtcggatctgtctgaataatagatccaagacttctgaaaaaactcatgggttctggagaggagacccagcatggcgtat

SEQ ID NO: 445527 - DNA, 140 bp, Artificial Sequence
  Synthetic
atacgccatgctgggtctccttcaagagtcatgagactttcattaatcatctcagttgatcagacatggtcgtatagattctcataatacgggagatcttctagcagtttcagtgaccaacgtacttgggagtcggccat

SEQ ID NO: 445528 - DNA, 140 bp, Artificial Sequence
  Synthetic
atggccgactcccaagtacgttggtcactgaaactgctagaagatctcccgtattatgagaatctatacgaccatgtctgatcaactgagatgattaatgaaagtctcatgactcttgaaggagacccagcatggcgtat

SEQ ID NO: 445529 - DNA, 140 bp, Artificial Sequence
  Synthetic
atacgccatgctgggtctcctctcagaccagaaacacaagaactaagatattagctcaaggggacaatcaggttctgtgtccgacgtacatgttgtctccagggctttctcgagaggggccgtacttgggagtcggccat

SEQ ID NO: 445530 - DNA, 140 bp, Artificial Sequence
  Synthetic
atggccgactcccaagtacggcccctctcgagaaagccctggagacaacatgtacgtcggacacagaacctgattgtccccttgagctaatatcttagttcttgtgtttctggtctgagaggagacccagcatggcgtat

SEQ ID NO: 445531 - DNA, 140 bp, Artificial Sequence
  Synthetic
aggccctggctgctgatatggccccctgatagtagactctacatgagttgattgagaaaggcaatctgcctcccatgaaggacataagcaatagctcataatcattttgcatctcagtaagaccttttgggacagcggtg

SEQ ID NO: 445532 - DNA, 140 bp, Artificial Sequence
  Synthetic
caccgctgtcccaaaaggtcttactgagatgcaaaatgattatgagctattgcttatgtccttcatgggaggcagattgcctttctcaatcaactcatgtagagtctactatcagggggccatatcagcagccagggcct

SEQ ID NO: 445533 - DNA, 140 bp, Artificial Sequence
  Synthetic
atacgccatgctgggtctcctcccatgaaggacataagcaatagctcataatcattttgcatctcagtaaagtgtacataattataaagggctgggtcatctaagcatttcagtcgagaacgtacttgggagtcggccat

SEQ ID NO: 445534 - DNA, 140 bp, Artificial Sequence
  Synthetic
atggccgactcccaagtacgttctcgactgaaatgcttagatgacccagccctttataattatgtacactttactgagatgcaaaatgattatgagctattgcttatgtccttcatgggaggagacccagcatggcgtat

SEQ ID NO: 445535 - DNA, 140 bp, Artificial Sequence
  Synthetic
atacgccatgctgggtctccgaccatgtgcagttatgactttctcatctacgggaaaactcctttatttcggggtaacattttggtgcctgagtcaaaaagatgggctagagtctcctgccgtacttgggagtcggccat

SEQ ID NO: 445536 - DNA, 140 bp, Artificial Sequence
  Synthetic
atggccgactcccaagtacggcaggagactctagcccatctttttgactcaggcaccaaaatgttaccccgaaataaaggagttttcccgtagatgagaaagtcataactgcacatggtcggagacccagcatggcgtat

SEQ ID NO: 445537 - DNA, 140 bp, Artificial Sequence
  Synthetic
aggccctggctgctgatatgggggtaacattttggtgcctgagtcaaaaagatgggctagagtctcctgcatctctaacgaccaaattgtcaaccttgccaatataatgtccacggtatcgaccttttgggacagcggtg

SEQ ID NO: 445538 - DNA, 140 bp, Artificial Sequence
  Synthetic
caccgctgtcccaaaaggtcgataccgtggacattatattggcaaggttgacaatttggtcgttagagatgcaggagactctagcccatctttttgactcaggcaccaaaatgttacccccatatcagcagccagggcct

SEQ ID NO: 445539 - DNA, 140 bp, Artificial Sequence
  Synthetic
atacgccatgctgggtctccagaaagtagatttgggttctctcaaagtaggtggaactgctgcacaatcaatgatttctctctggttgtatggtgcccactctgaatcaaacaggagccgcgtacttgggagtcggccat

SEQ ID NO: 445540 - DNA, 140 bp, Artificial Sequence
  Synthetic
atggccgactcccaagtacgcggctcctgtttgattcagagtgggcaccatacaaccagagagaaatcattgattgtgcagcagttccacctactttgagagaacccaaatctactttctggagacccagcatggcgtat

SEQ ID NO: 445541 - DNA, 140 bp, Artificial Sequence
  Synthetic
aggccctggctgctgatatggagggggtgttaagttgcctagaaagggtcgattacgataaagcatttgggaggtatctagccaacacgtattcttcttatttgtttttccatgtaatcagaccttttgggacagcggtg

SEQ ID NO: 445542 - DNA, 140 bp, Artificial Sequence
  Synthetic
caccgctgtcccaaaaggtctgattacatggaaaaacaaataagaagaatacgtgttggctagatacctcccaaatgctttatcgtaatcgaccctttctaggcaacttaacaccccctccatatcagcagccagggcct

SEQ ID NO: 445543 - DNA, 140 bp, Artificial Sequence
  Synthetic
aggccctggctgctgatatgcaaagatcaaatatggggactgctgattgtaactaaggacttcgtttactctcagagttctaattgtctttttgacaggaactatacactcatgctaaaagaccttttgggacagcggtg

SEQ ID NO: 445544 - DNA, 140 bp, Artificial Sequence
  Synthetic
caccgctgtcccaaaaggtcttttagcatgagtgtatagttcctgtcaaaaagacaattagaactctgagagtaaacgaagtccttagttacaatcagcagtccccatatttgatctttgcatatcagcagccagggcct

SEQ ID NO: 445545 - DNA, 140 bp, Artificial Sequence
  Synthetic
aggccctggctgctgatatgactgacaagggaccctactgtctccgagcatgcgtctttagttggtcttcttttaagcctatataggctgagcaaaatatcaggacaaaacaccggtaacgaccttttgggacagcggtg

SEQ ID NO: 445546 - DNA, 140 bp, Artificial Sequence
  Synthetic
caccgctgtcccaaaaggtcgttaccggtgttttgtcctgatattttgctcagcctatataggcttaaaagaagaccaactaaagacgcatgctcggagacagtagggtcccttgtcagtcatatcagcagccagggcct

SEQ ID NO: 445547 - DNA, 140 bp, Artificial Sequence
  Synthetic
atacgccatgctgggtctccttttaagcctatataggctgagcaaaatatcaggacaaaacaccggtaactataagacaaacattgcagataggatagagcagattttcgagacagcccccgtacttgggagtcggccat

SEQ ID NO: 445548 - DNA, 140 bp, Artificial Sequence
  Synthetic
atggccgactcccaagtacgggggctgtctcgaaaatctgctctatcctatctgcaatgtttgtcttatagttaccggtgttttgtcctgatattttgctcagcctatataggcttaaaaggagacccagcatggcgtat

SEQ ID NO: 445549 - DNA, 140 bp, Artificial Sequence
  Synthetic
aggccctggctgctgatatgtcgctggagatcaagtcttgtctatgtgtggaaactccggctatgaagtcatcaagatacttgagccatatgttgtaaacagtctagtccagagggcagagaccttttgggacagcggtg

SEQ ID NO: 445550 - DNA, 140 bp, Artificial Sequence
  Synthetic
caccgctgtcccaaaaggtctctgccctctggactagactgtttacaacatatggctcaagtatcttgatgacttcatagccggagtttccacacatagacaagacttgatctccagcgacatatcagcagccagggcct

SEQ ID NO: 445551 - DNA, 140 bp, Artificial Sequence
  Synthetic
aggccctggctgctgatatggaagttcaggcctctcatccactctttaggagactttcctgtattcataagagacaaggtgaatcaactcgaggggactttcggtcccagtgcaaaaagggaccttttgggacagcggtg

SEQ ID NO: 445552 - DNA, 140 bp, Artificial Sequence
  Synthetic
caccgctgtcccaaaaggtccctttttgcactgggaccgaaagtcccctcgagttgattcaccttgtctcttatgaatacaggaaagtctcctaaagagtggatgagaggcctgaacttccatatcagcagccagggcct

SEQ ID NO: 445553 - DNA, 140 bp, Artificial Sequence
  Synthetic
atacgccatgctgggtctccgacatgtttttctcccggattgagcatctatattcagcaatcagggtaggcacagttgtcactgcttatgaagactgctcagggctggtatcgtttacagcgtacttgggagtcggccat

SEQ ID NO: 445554 - DNA, 140 bp, Artificial Sequence
  Synthetic
atggccgactcccaagtacgctgtaaacgataccagccctgagcagtcttcataagcagtgacaactgtgcctaccctgattgctgaatatagatgctcaatccgggagaaaaacatgtcggagacccagcatggcgtat

SEQ ID NO: 445555 - DNA, 140 bp, Artificial Sequence
  Synthetic
aggccctggctgctgatatgtgccggacgaagatctgataatcggcctcaaacctaaggagagggagctaaagattgagggtagatttttcgctttgatgtcctggaatctgaggttgtagaccttttgggacagcggtg

SEQ ID NO: 445556 - DNA, 140 bp, Artificial Sequence
  Synthetic
caccgctgtcccaaaaggtctacaacctcagattccaggacatcaaagcgaaaaatctaccctcaatctttagctccctctccttaggtttgaggccgattatcagatcttcgtccggcacatatcagcagccagggcct

SEQ ID NO: 445557 - DNA, 140 bp, Artificial Sequence
  Synthetic
atacgccatgctgggtctccgaagttgttttatatttttagggagattgtttatttttatgggttttttttggagatgagtttgattgtttttgatatttttattgattagattaatagtcgtacttgggagtcggccat

SEQ ID NO: 445558 - DNA, 140 bp, Artificial Sequence
  Synthetic
atggccgactcccaagtacgactattaatctaatcaataaaaatatcaaaaacaatcaaactcatctccaaaaaaaacccataaaaataaacaatctccctaaaaatataaaacaacttcggagacccagcatggcgtat

SEQ ID NO: 445559 - DNA, 140 bp, Artificial Sequence
  Synthetic
aggccctggctgctgatatgggagacagctgttcctcactcttatttcatccacttccgttcactaggcttgagtggaaagtctccttattcatcaaatgccgttggtcatgtgttcaatgaccttttgggacagcggtg

SEQ ID NO: 445560 - DNA, 140 bp, Artificial Sequence
  Synthetic
caccgctgtcccaaaaggtcattgaacacatgaccaacggcatttgatgaataaggagactttccactcaagcctagtgaacggaagtggatgaaataagagtgaggaacagctgtctcccatatcagcagccagggcct

SEQ ID NO: 445561 - DNA, 140 bp, Artificial Sequence
  Synthetic
aggccctggctgctgatatgaacagttattgccgcctgtgctcctcatgagatgtctgttctagggggctatcttggagaggaattctttgggaaagggacgtttgaaagaagattctttgaccttttgggacagcggtg

SEQ ID NO: 445562 - DNA, 140 bp, Artificial Sequence
  Synthetic
caccgctgtcccaaaaggtcaaagaatcttctttcaaacgtccctttcccaaagaattcctctccaagatagccccctagaacagacatctcatgaggagcacaggcggcaataactgttcatatcagcagccagggcct

SEQ ID NO: 445563 - DNA, 140 bp, Artificial Sequence
  Synthetic
atacgccatgctgggtctccttctcaggtcttcgagttcccggatgtttcaagaaggatatccaggatggtttctggagctgtgcctcacttccgaaaacttcctgatattcgtttaaaacgtacttgggagtcggccat

SEQ ID NO: 445564 - DNA, 140 bp, Artificial Sequence
  Synthetic
atggccgactcccaagtacgttttaaacgaatatcaggaagttttcggaagtgaggcacagctccagaaaccatcctggatatccttcttgaaacatccgggaactcgaagacctgagaaggagacccagcatggcgtat

SEQ ID NO: 445565 - DNA, 140 bp, Artificial Sequence
  Synthetic
aggccctggctgctgatatgtttctggagctgtgcctcacttccgaaaacttcctgatattcgtttaaaacctggtgacttcgaatctctaagtgggagggagaagtcgcgccatatagggaccttttgggacagcggtg

SEQ ID NO: 445566 - DNA, 140 bp, Artificial Sequence
  Synthetic
caccgctgtcccaaaaggtccctatatggcgcgacttctccctcccacttagagattcgaagtcaccaggttttaaacgaatatcaggaagttttcggaagtgaggcacagctccagaaacatatcagcagccagggcct

SEQ ID NO: 445567 - DNA, 140 bp, Artificial Sequence
  Synthetic
aggccctggctgctgatatgaagattgagggtcgattcttcgctctaatgtcatggaatctaagactgtattttgtcatcaccgagaagcttttggccaactacatcttgccactttttggaccttttgggacagcggtg

SEQ ID NO: 445568 - DNA, 140 bp, Artificial Sequence
  Synthetic
caccgctgtcccaaaaggtccaaaaagtggcaagatgtagttggccaaaagcttctcggtgatgacaaaatacagtcttagattccatgacattagagcgaagaatcgaccctcaatcttcatatcagcagccagggcct

SEQ ID NO: 445569 - DNA, 140 bp, Artificial Sequence
  Synthetic
aggccctggctgctgatatgctatagattgtgtatatccaccatgaaaaaaactaacacccctcctttcgaaccatcccaaaaatgagcaagatctttgtcaatcctagtgcaatcagaggaccttttgggacagcggtg

SEQ ID NO: 445570 - DNA, 140 bp, Artificial Sequence
  Synthetic
caccgctgtcccaaaaggtcctctgattgcactaggattgacaaagatcttgctcatttttgggatggttcgaaaggaggggtgttagtttttttcatggtggatatacacaatctatagcatatcagcagccagggcct

SEQ ID NO: 445571 - DNA, 140 bp, Artificial Sequence
  Synthetic
aggccctggctgctgatatggatttgcttcttgacaagaatgacaaacattaacatcaatagacctcttgaactgatctcaggagtgatttcatacatcctcttgagactggacaatcacgaccttttgggacagcggtg

SEQ ID NO: 445572 - DNA, 140 bp, Artificial Sequence
  Synthetic
caccgctgtcccaaaaggtcgtgattgtccagtctcaagaggatgtatgaaatcactcctgagatcagttcaagaggtctattgatgttaatgtttgtcattcttgtcaagaagcaaatccatatcagcagccagggcct

SEQ ID NO: 445573 - DNA, 140 bp, Artificial Sequence
  Synthetic
atacgccatgctgggtctcctcagaaaagaaggtaacggcaaccccccaaactaggaaagtcatatcttcatgggagttgtacaagagtgaaggcgatgccaggttgtgagggcgggccacgtacttgggagtcggccat

SEQ ID NO: 445574 - DNA, 140 bp, Artificial Sequence
  Synthetic
atggccgactcccaagtacgtggcccgccctcacaacctggcatcgccttcactcttgtacaactcccatgaagatatgactttcctagtttggggggttgccgttaccttcttttctgaggagacccagcatggcgtat

SEQ ID NO: 445575 - DNA, 140 bp, Artificial Sequence
  Synthetic
aggccctggctgctgatatggactttcagatggatgaggaagaggatcctagccttctgttccagtcatacttggacaatgttggagtccaaatagtcagacaaatgaggtccggagaacgaccttttgggacagcggtg

SEQ ID NO: 445576 - DNA, 140 bp, Artificial Sequence
  Synthetic
caccgctgtcccaaaaggtcgttctccggacctcatttgtctgactatttggactccaacattgtccaagtatgactggaacagaaggctaggatcctcttcctcatccatctgaaagtccatatcagcagccagggcct

SEQ ID NO: 445577 - DNA, 140 bp, Artificial Sequence
  Synthetic
atacgccatgctgggtctccatctcttacttcagagggttgagaaaaatctctccaaaagtatgagagccaacctacgacaaatgagctctctaatgaggcaggtgctgggtgggcatggcgtacttgggagtcggccat

SEQ ID NO: 445578 - DNA, 140 bp, Artificial Sequence
  Synthetic
atggccgactcccaagtacgccatgcccacccagcacctgcctcattagagagctcatttgtcgtaggttggctctcatacttttggagagatttttctcaaccctctgaagtaagagatggagacccagcatggcgtat

SEQ ID NO: 445579 - DNA, 140 bp, Artificial Sequence
  Synthetic
aggccctggctgctgatatgccagactactggccgagagcccaagaaggagacaacatcagctccttctcaaagagaaggtcaatcctcgaaagccaggatggcggctcaagctgcctctgaccttttgggacagcggtg

SEQ ID NO: 445580 - DNA, 140 bp, Artificial Sequence
  Synthetic
caccgctgtcccaaaaggtcagaggcagcttgagccgccatcctggctttcgaggattgaccttctctttgagaaggagctgatgttgtctccttcttgggctctcggccagtagtctggcatatcagcagccagggcct

SEQ ID NO: 445581 - DNA, 140 bp, Artificial Sequence
  Synthetic
aggccctggctgctgatatgggtctcgggagttgatctcggtctcccgaactgggggaagtatgtgctggtgagtgtaggcgctctgattgcactgatgttgatgattttcttgatgacggaccttttgggacagcggtg

SEQ ID NO: 445582 - DNA, 140 bp, Artificial Sequence
  Synthetic
caccgctgtcccaaaaggtccgtcatcaagaaaatcatcaacatcagtgcaatcagagcgcctacactcaccagcacatacttcccccagttcgggagaccgagatcaactcccgagacccatatcagcagccagggcct

SEQ ID NO: 445583 - DNA, 140 bp, Artificial Sequence
  Synthetic
aggccctggctgctgatatgtgggatgggttgctttggccaattcaaagaaattccaattgttagtcgagcctgataaactgaataaaatcatgcaagatgatttgaatcgctatgcatcgaccttttgggacagcggtg

SEQ ID NO: 445584 - DNA, 140 bp, Artificial Sequence
  Synthetic
caccgctgtcccaaaaggtcgatgcatagcgattcaaatcatcttgcatgattttattcagtttatcaggctcgactaacaattggaatttctttgaattggccaaagcaacccatcccacatatcagcagccagggcct

SEQ ID NO: 445585 - DNA, 140 bp, Artificial Sequence
  Synthetic
atacgccatgctgggtctcccctgataaactgaataaaatcatgcaagatgatttgaatcgctatgcatcctgctaactgagcctccgagctcagcccctctggacactcaaatctgggacgtacttgggagtcggccat

SEQ ID NO: 445586 - DNA, 140 bp, Artificial Sequence
  Synthetic
atggccgactcccaagtacgtcccagatttgagtgtccagaggggctgagctcggaggctcagttagcaggatgcatagcgattcaaatcatcttgcatgattttattcagtttatcaggggagacccagcatggcgtat

SEQ ID NO: 445587 - DNA, 140 bp, Artificial Sequence
  Synthetic
atacgccatgctgggtctcctcaaaggtcaaatatggggactgcttattgtgacaaaggattttgtttactctcagagttctaactgtcttttcgacagaaactatacactcatgctgaacgtacttgggagtcggccat

SEQ ID NO: 445588 - DNA, 140 bp, Artificial Sequence
  Synthetic
atggccgactcccaagtacgttcagcatgagtgtatagtttctgtcgaaaagacagttagaactctgagagtaaacaaaatcctttgtcacaataagcagtccccatatttgacctttgaggagacccagcatggcgtat

SEQ ID NO: 445589 - DNA, 140 bp, Artificial Sequence
  Synthetic
atacgccatgctgggtctccaaatgacctgatggcttcaggaacacatccattgcccccctcagcaatcatgagtggaggagatgacatcacatccagggtgattgactttgactccatccgtacttgggagtcggccat

SEQ ID NO: 445590 - DNA, 140 bp, Artificial Sequence
  Synthetic
atggccgactcccaagtacggatggagtcaaagtcaatcaccctggatgtgatgtcatctcctccactcatgattgctgaggggggcaatggatgtgttcctgaagccatcaggtcatttggagacccagcatggcgtat

SEQ ID NO: 445591 - DNA, 140 bp, Artificial Sequence
  Synthetic
aggccctggctgctgatatgcctctcccatgtcagcccctccggatgatgacgacctgtggcttccgccccctgaatacgtcccgctgaaagaactcactagcaagaagaacatgagaaagaccttttgggacagcggtg

SEQ ID NO: 445592 - DNA, 140 bp, Artificial Sequence
  Synthetic
caccgctgtcccaaaaggtctttctcatgttcttcttgctagtgagttctttcagcgggacgtattcagggggcggaagccacaggtcgtcatcatccggaggggctgacatgggagaggcatatcagcagccagggcct

SEQ ID NO: 445593 - DNA, 140 bp, Artificial Sequence
  Synthetic
atacgccatgctgggtctcccctgaatacgtcccgctgaaagaactcactagcaagaagaacatgagaaacttctgtatcaacggagaggttaaggtgtgtagcccgaatggttactcgtcgtacttgggagtcggccat

SEQ ID NO: 445594 - DNA, 140 bp, Artificial Sequence
  Synthetic
atggccgactcccaagtacgacgagtaaccattcgggctacacaccttaacctctccgttgatacagaagtttctcatgttcttcttgctagtgagttctttcagcgggacgtattcaggggagacccagcatggcgtat

SEQ ID NO: 445595 - DNA, 140 bp, Artificial Sequence
  Synthetic
aggccctggctgctgatatggagtttcgagaggcaatcttgttatctaagacccatagagacaactttatactcttcttaaaatctgttgaacctttgttccctcgatttctcagtgagcgaccttttgggacagcggtg

SEQ ID NO: 445596 - DNA, 140 bp, Artificial Sequence
  Synthetic
caccgctgtcccaaaaggtcgctcactgagaaatcgagggaacaaaggttcaacagattttaagaagagtataaagttgtctctatgggtcttagataacaagattgcctctcgaaactccatatcagcagccagggcct

SEQ ID NO: 445597 - DNA, 140 bp, Artificial Sequence
  Synthetic
aggccctggctgctgatatgaggagctccagtccctgagggcatgaactgggtatataaattgaggagaacccttatcttccagtgggctgattccaggggccctctagaaggggaggaggaccttttgggacagcggtg

SEQ ID NO: 445598 - DNA, 140 bp, Artificial Sequence
  Synthetic
caccgctgtcccaaaaggtcctcctccccttctagagggcccctggaatcagcccactggaagataagggttctcctcaatttatatacccagttcatgccctcagggactggagctcctcatatcagcagccagggcct

SEQ ID NO: 445599 - DNA, 140 bp, Artificial Sequence
  Synthetic
aggccctggctgctgatatgcaaaactctcggacgataagacggcagtttaggaggagtctctcaagaactttagaagagtccttctacaactcggagatccacgggatcaatcggatgagaccttttgggacagcggtg

SEQ ID NO: 445600 - DNA, 140 bp, Artificial Sequence
  Synthetic
caccgctgtcccaaaaggtctcatccgattgatcccgtggatctccgagttgtagaaggactcttctaaagttcttgagagactcctcctaaactgccgtcttatcgtccgagagttttgcatatcagcagccagggcct

SEQ ID NO: 445601 - DNA, 140 bp, Artificial Sequence
  Synthetic
aggccctggctgctgatatgagaagatactttagagtcagacgacgacattcaacgattgctaaaagactctttgcgaaggacaaggtgggtggatcaagaagtgcgtcatgcagccagggaccttttgggacagcggtg

SEQ ID NO: 445602 - DNA, 140 bp, Artificial Sequence
  Synthetic
caccgctgtcccaaaaggtccctggctgcatgacgcacttcttgatccacccaccttgtccttcgcaaagagtcttttagcaatcgttgaatgtcgtcgtctgactctaaagtatcttctcatatcagcagccagggcct

SEQ ID NO: 445603 - DNA, 140 bp, Artificial Sequence
  Synthetic
aggccctggctgctgatatgattacaaataagagtgagtgcaagacagtgtcatatccagggcaggatctggtgtatcaacatgaactcgagagcatgtcagctatggtctgacatgtctgaccttttgggacagcggtg

SEQ ID NO: 445604 - DNA, 140 bp, Artificial Sequence
  Synthetic
caccgctgtcccaaaaggtcagacatgtcagaccatagctgacatgctctcgagttcatgttgatacaccagatcctgccctggatatgacactgtcttgcactcactcttatttgtaatcatatcagcagccagggcct

SEQ ID NO: 445605 - DNA, 140 bp, Artificial Sequence
  Synthetic
atacgccatgctgggtctccagttcctcacccttctgagatgttggggttacttcccaaatcttccatttcctgcacttgtggagcaacaggaggaggcaatcctagagtttctgtgtcacgtacttgggagtcggccat

SEQ ID NO: 445606 - DNA, 140 bp, Artificial Sequence
  Synthetic
atggccgactcccaagtacgtgacacagaaactctaggattgcctcctcctgttgctccacaagtgcaggaaatggaagatttgggaagtaaccccaacatctcagaagggtgaggaactggagacccagcatggcgtat

SEQ ID NO: 445607 - DNA, 140 bp, Artificial Sequence
  Synthetic
atacgccatgctgggtctccgtttctattattatagccatcatgatagtcttctccaacagggtgttcaatgtctcaaaaccgctgactgaccctttattctatccgccatctgatcccacgtacttgggagtcggccat

SEQ ID NO: 445608 - DNA, 140 bp, Artificial Sequence
  Synthetic
atggccgactcccaagtacgtgggatcagatggcggatagaataaagggtcagtcagcggttttgagacattgaacaccctgttggagaagactatcatgatggctataataatagaaacggagacccagcatggcgtat

SEQ ID NO: 445609 - DNA, 140 bp, Artificial Sequence
  Synthetic
atacgccatgctgggtctccccggtctggctgacctcgagatggctgaagagactgttgatctgatcaacaaaaacatagaagacaatcaggctcatctccagggagaacccatagaggtcgtacttgggagtcggccat

SEQ ID NO: 445610 - DNA, 140 bp, Artificial Sequence
  Synthetic
atggccgactcccaagtacgacctctatgggttctccctggagatgagcctgattgtcttctatgtttttgttgatcagatcaacagtctcttcagccatctcgaggtcagccagaccggggagacccagcatggcgtat

SEQ ID NO: 445611 - DNA, 140 bp, Artificial Sequence
  Synthetic
atacgccatgctgggtctccggtgacgagggaccccaccgttccggagcatgcatctttggttggtcttctcttgagtctgtatcggttgagcaaaatatctggacaaaacaccggcaatcgtacttgggagtcggccat

SEQ ID NO: 445612 - DNA, 140 bp, Artificial Sequence
  Synthetic
atggccgactcccaagtacgattgccggtgttttgtccagatattttgctcaaccgatacagactcaagagaagaccaaccaaagatgcatgctccggaacggtggggtccctcgtcaccggagacccagcatggcgtat

SEQ ID NO: 445613 - DNA, 140 bp, Artificial Sequence
  Synthetic
atacgccatgctgggtctcccagatccataacttattatttcaggaaacaagtcgtccgggggaatgtttatctgtcctggagttggtccgatgacacttcagtatttaagagggtggctcgtacttgggagtcggccat

SEQ ID NO: 445614 - DNA, 140 bp, Artificial Sequence
  Synthetic
atggccgactcccaagtacgagccaccctcttaaatactgaagtgtcatcggaccaactccaggacagataaacattcccccggacgacttgtttcctgaaataataagttatggatctgggagacccagcatggcgtat

SEQ ID NO: 445615 - DNA, 140 bp, Artificial Sequence
  Synthetic
aggccctggctgctgatatgtacagtgaaggagggtattcttcggtctgccccaaccttctctctcatatttctgtgagcacagacactatgtctgatttgacccaggacgggaagaactgaccttttgggacagcggtg

SEQ ID NO: 445616 - DNA, 140 bp, Artificial Sequence
  Synthetic
caccgctgtcccaaaaggtcagttcttcccgtcctgggtcaaatcagacatagtgtctgtgctcacagaaatatgagagagaaggttggggcagaccgaagaataccctccttcactgtacatatcagcagccagggcct

SEQ ID NO: 445617 - DNA, 140 bp, Artificial Sequence
  Synthetic
atacgccatgctgggtctccttctgtgagcacagacactatgtctgatttgacccaggacgggaagaactatgatttcatgttccaaccattgatgctttatgctcaaacatggacgtcacgtacttgggagtcggccat

SEQ ID NO: 445618 - DNA, 140 bp, Artificial Sequence
  Synthetic
atggccgactcccaagtacgtgacgtccatgtttgagcataaagcatcaatggttggaacatgaaatcatagttcttcccgtcctgggtcaaatcagacatagtgtctgtgctcacagaaggagacccagcatggcgtat

SEQ ID NO: 445619 - DNA, 140 bp, Artificial Sequence
  Synthetic
atacgccatgctgggtctccaggtggagaggcaccttcgagggtacaacaggtggattaccctcgatgacattcgatccagatcatctcttctagattacagctgcttgtaaactaggctcgtacttgggagtcggccat

SEQ ID NO: 445620 - DNA, 140 bp, Artificial Sequence
  Synthetic
atggccgactcccaagtacgagcctagtttacaagcagctgtaatctagaagagatgatctggatcgaatgtcatcgagggtaatccacctgttgtaccctcgaaggtgcctctccacctggagacccagcatggcgtat

SEQ ID NO: 445621 - DNA, 140 bp, Artificial Sequence
  Synthetic
atacgccatgctgggtctccctctctaaggaatgtgcggaccaagactcttggacggtgtatcctgaaaaaaacaggatcctaattcataacctctttttacttgattgtttttccatctcgtacttgggagtcggccat

SEQ ID NO: 445622 - DNA, 140 bp, Artificial Sequence
  Synthetic
atggccgactcccaagtacgagatggaaaaacaatcaagtaaaaagaggttatgaattaggatcctgtttttttcaggatacaccgtccaagagtcttggtccgcacattccttagagagggagacccagcatggcgtat

SEQ ID NO: 445623 - DNA, 140 bp, Artificial Sequence
  Synthetic
aggccctggctgctgatatggaccaccaaagaatctctcgttatcatatcccctagtgtggcagatttggacccatacgacaaatcccttcactccagggtcttccccagcgggaagtgcgaccttttgggacagcggtg

SEQ ID NO: 445624 - DNA, 140 bp, Artificial Sequence
  Synthetic
caccgctgtcccaaaaggtcgcacttcccgctggggaagaccctggagtgaagggatttgtcgtatgggtccaaatctgccacactaggggatatgataacgagagattctttggtggtccatatcagcagccagggcct

SEQ ID NO: 445625 - DNA, 140 bp, Artificial Sequence
  Synthetic
aggccctggctgctgatatgccaatagtagagggaagagagcatccaaagggagcaagacctgcggctttgttgatgaaagaggcctgtataagtccctaaagggagcatgcaaactcaagaccttttgggacagcggtg

SEQ ID NO: 445626 - DNA, 140 bp, Artificial Sequence
  Synthetic
caccgctgtcccaaaaggtcttgagtttgcatgctccctttagggacttatacaggcctctttcatcaacaaagccgcaggtcttgctccctttggatgctctcttccctctactattggcatatcagcagccagggcct

SEQ ID NO: 445627 - DNA, 140 bp, Artificial Sequence
  Synthetic
atacgccatgctgggtctccgttgatgaaagaggcctgtataagtccctaaagggagcatgcaaactcaaattatgtggagttcttggacttagacttatggatggaacatgggtagcgacgtacttgggagtcggccat

SEQ ID NO: 445628 - DNA, 140 bp, Artificial Sequence
  Synthetic
atggccgactcccaagtacgtcgctacccatgttccatccataagtctaagtccaagaactccacataatttgagtttgcatgctccctttagggacttatacaggcctctttcatcaacggagacccagcatggcgtat

SEQ ID NO: 445629 - DNA, 140 bp, Artificial Sequence
  Synthetic
atacgccatgctgggtctcctctctatccctcagaaaatacccgctgcttacccaaccactatgaaagaaggcaatagatcgatcttgtgttacctacaacacgtgctacgctatgagcgcgtacttgggagtcggccat

SEQ ID NO: 445630 - DNA, 140 bp, Artificial Sequence
  Synthetic
atggccgactcccaagtacgcgctcatagcgtagcacgtgttgtaggtaacacaagatcgatctattgccttctttcatagtggttgggtaagcagcgggtattttctgagggatagagaggagacccagcatggcgtat

SEQ ID NO: 445631 - DNA, 140 bp, Artificial Sequence
  Synthetic
aggccctggctgctgatatgggtcaagaaaagagaggagtgtctggatgcattagagtccatcatgaccaccaagtcagtgagtttcagacgtctcagtcatttaagaaaactcgtccccgaccttttgggacagcggtg

SEQ ID NO: 445632 - DNA, 140 bp, Artificial Sequence
  Synthetic
caccgctgtcccaaaaggtcggggacgagttttcttaaatgactgagacgtctgaaactcactgacttggtggtcatgatggactctaatgcatccagacactcctctcttttcttgacccatatcagcagccagggcct

SEQ ID NO: 445633 - DNA, 140 bp, Artificial Sequence
  Synthetic
aggccctggctgctgatatgggtgtctaagagtgggagggaggtgtcatcctcatgtgaacggggtgttcttcaatggtataatactggggcctgatggccatgttctaatcccagagatgaccttttgggacagcggtg

SEQ ID NO: 445634 - DNA, 140 bp, Artificial Sequence
  Synthetic
caccgctgtcccaaaaggtcatctctgggattagaacatggccatcaggccccagtattataccattgaagaacaccccgttcacatgaggatgacacctccctcccactcttagacacccatatcagcagccagggcct

SEQ ID NO: 445635 - DNA, 140 bp, Artificial Sequence
  Synthetic
aggccctggctgctgatatgggttcataaagcagataaatctcactgcaagggaagcaatactatatttcttccacaaaaacttcgaggaagagataagaagaatgtttgagccggggcagaccttttgggacagcggtg

SEQ ID NO: 445636 - DNA, 140 bp, Artificial Sequence
  Synthetic
caccgctgtcccaaaaggtctgccccggctcaaacattcttcttatctcttcctcgaagtttttgtggaagaaatatagtattgcttcccttgcagtgagatttatctgctttatgaacccatatcagcagccagggcct

SEQ ID NO: 445637 - DNA, 140 bp, Artificial Sequence
  Synthetic
aggccctggctgctgatatgtcaaaagacttaaggaaagatggttcctcaggctcttttgtttgtaccccttctggttgtctcaatgtgtttcgggaaattccctatctatacggtaccggaccttttgggacagcggtg

SEQ ID NO: 445638 - DNA, 140 bp, Artificial Sequence
  Synthetic
caccgctgtcccaaaaggtccggtaccgtatagatagggaatttcccgaaacacattgagacaaccagaaggggtacaaacaaaagagcctgaggaaccatctttccttaagtcttttgacatatcagcagccagggcct

SEQ ID NO: 445639 - DNA, 140 bp, Artificial Sequence
  Synthetic
aggccctggctgctgatatgagagacagctgttcctcactcctatttcattcacttccgttctctgggcttgagtgggaagtccccttattcatcaaatgcagttggtcatgtgttcaatgaccttttgggacagcggtg

SEQ ID NO: 445640 - DNA, 140 bp, Artificial Sequence
  Synthetic
caccgctgtcccaaaaggtcattgaacacatgaccaactgcatttgatgaataaggggacttcccactcaagcccagagaacggaagtgaatgaaataggagtgaggaacagctgtctctcatatcagcagccagggcct

SEQ ID NO: 445641 - DNA, 140 bp, Artificial Sequence
  Synthetic
aggccctggctgctgatatggacagggaggaaggtgtcggttacctcccaaagcgggaaggtcatatcttcatgggagtcatataaaagtggaggcgagactaggctgtgaggtccggttgaccttttgggacagcggtg

SEQ ID NO: 445642 - DNA, 140 bp, Artificial Sequence
  Synthetic
caccgctgtcccaaaaggtcaaccggacctcacagcctagtctcgcctccacttttatatgactcccatgaagatatgaccttcccgctttgggaggtaaccgacaccttcctccctgtccatatcagcagccagggcct

SEQ ID NO: 445643 - DNA, 140 bp, Artificial Sequence
  Synthetic
aggccctggctgctgatatggttcaagagtcgtgagactttcattaatcatctcagtcgaccagacatggtcatgtagattctcataatacgggaaatctcctagcagtttcagtgacaagaccttttgggacagcggtg

SEQ ID NO: 445644 - DNA, 140 bp, Artificial Sequence
  Synthetic
caccgctgtcccaaaaggtcttgtcactgaaactgctaggagatttcccgtattatgagaatctacatgaccatgtctggtcgactgagatgattaatgaaagtctcacgactcttgaaccatatcagcagccagggcct

SEQ ID NO: 445645 - DNA, 140 bp, Artificial Sequence
  Synthetic
aggccctggctgctgatatgaaccatcccaaatatgagcaagatcttcgtcaatccgagtgcaattagggccggtctggctgaccttgagatggctgaagagactgttgatctgatcaacgaccttttgggacagcggtg

SEQ ID NO: 445646 - DNA, 140 bp, Artificial Sequence
  Synthetic
caccgctgtcccaaaaggtcgttgatcagatcaacagtctcttcagccatctcaaggtcagccagaccggccctaattgcactcggattgacgaagatcttgctcatatttgggatggttcatatcagcagccagggcct

SEQ ID NO: 445647 - DNA, 140 bp, Artificial Sequence
  Synthetic
aggccctggctgctgatatgtgtctcctgatagcggactttacatgagtgagttgagaagtgcaatttgcctctcatgaaggacataagcaatagctcataatcattttgcatctcagcagaccttttgggacagcggtg

SEQ ID NO: 445648 - DNA, 140 bp, Artificial Sequence
  Synthetic
caccgctgtcccaaaaggtctgctgagatgcaaaatgattatgagctattgcttatgtccttcatgagaggcaaattgcacttctcaactcactcatgtaaagtccgctatcaggagacacatatcagcagccagggcct

SEQ ID NO: 445649 - DNA, 140 bp, Artificial Sequence
  Synthetic
aggccctggctgctgatatgctgcatcaaaatgctagatccaggagaggtctatgatgatcccattgatccaattgagtcagaggccgaacctagaggagcccccactgtccccaacatcgaccttttgggacagcggtg

SEQ ID NO: 445650 - DNA, 140 bp, Artificial Sequence
  Synthetic
caccgctgtcccaaaaggtcgatgttggggacagtgggggctcctctaggttcggcctctgactcaattggatcaatgggatcatcatagacctctcctggatctagcattttgatgcagcatatcagcagccagggcct

SEQ ID NO: 445651 - DNA, 140 bp, Artificial Sequence
  Synthetic
aggccctggctgctgatatgatgtttctaaacccttgactgaccccttgttctatcccccatctgatcccaaaattctgaggcacttcaacatatgttgcagtactatgatgtatctgtcgaccttttgggacagcggtg

SEQ ID NO: 445652 - DNA, 140 bp, Artificial Sequence
  Synthetic
caccgctgtcccaaaaggtcgacagatacatcatagtactgcaacatatgttgaagtgcctcagaattttgggatcagatgggggatagaacaaggggtcagtcaagggtttagaaacatcatatcagcagccagggcct

SEQ ID NO: 445653 - DNA, 140 bp, Artificial Sequence
  Synthetic
aggccctggctgctgatatgaatgatctctctctggttatatggagcccactctgaatcaaacaggagcaggagatgtataaccgacttagcccatttctattctaaatcgtcccccatagaccttttgggacagcggtg

SEQ ID NO: 445654 - DNA, 140 bp, Artificial Sequence
  Synthetic
caccgctgtcccaaaaggtctatgggggacgatttagaatagaaatgggctaagtcggttatacatctcctgctcctgtttgattcagagtgggctccatataaccagagagagatcattcatatcagcagccagggcct

SEQ ID NO: 445655 - DNA, 140 bp, Artificial Sequence
  Synthetic
aggccctggctgctgatatgtatctatcttggagctggtccgacgacacctcggtgttcaagagggtagcctgtaactctagcttgagtctgtcatctcactggatcaggctgatttacagaccttttgggacagcggtg

SEQ ID NO: 445656 - DNA, 140 bp, Artificial Sequence
  Synthetic
caccgctgtcccaaaaggtctgtaaatcagcctgatccagtgagatgacagactcaagctagagttacaggctaccctcttgaacaccgaggtgtcgtcggaccagctccaagatagatacatatcagcagccagggcct

SEQ ID NO: 445657 - DNA, 140 bp, Artificial Sequence
  Synthetic
aggccctggctgctgatatgggaggtatctagccaacacatattcctcttatctgtttttccatgtaatcaccctatacatgaacgccttagactgggacgaagagaaaaccatcttagcgaccttttgggacagcggtg

SEQ ID NO: 445658 - DNA, 140 bp, Artificial Sequence
  Synthetic
caccgctgtcccaaaaggtcgctaagatggttttctcttcgtcccagtctaaggcgttcatgtatagggtgattacatggaaaaacagataagaggaatatgtgttggctagatacctcccatatcagcagccagggcct

SEQ ID NO: 445659 - DNA, 140 bp, Artificial Sequence
  Synthetic
aggccctggctgctgatatgtgggatgggttggtctggccaactctaaaaagttccagttgttagtcgagcccgacaagctaaataaaatcatgcaagacgatctgaatcgctatacatcgaccttttgggacagcggtg

SEQ ID NO: 445660 - DNA, 140 bp, Artificial Sequence
  Synthetic
caccgctgtcccaaaaggtcgatgtatagcgattcagatcgtcttgcatgattttatttagcttgtcgggctcgactaacaactggaactttttagagttggccagaccaacccatcccacatatcagcagccagggcct

SEQ ID NO: 445661 - DNA, 140 bp, Artificial Sequence
  Synthetic
aggccctggctgctgatatgtatcagatctagatcatccctactagactacagttgcttgtaaaccggatcttaccgaaagcctgcacatgctaagactcttgtatgatgcatcttgaaagaccttttgggacagcggtg

SEQ ID NO: 445662 - DNA, 140 bp, Artificial Sequence
  Synthetic
caccgctgtcccaaaaggtctttcaagatgcatcatacaagagtcttagcatgtgcaggctttcggtaagatccggtttacaagcaactgtagtctagtagggatgatctagatctgatacatatcagcagccagggcct

SEQ ID NO: 445663 - DNA, 140 bp, Artificial Sequence
  Synthetic
aggccctggctgctgatatgtcccagagttctaactgtctttttgacagaaactacacactcatgctaaaagatcttttcttgtctcgcttcaattccttaatgattttgctttccccccgaccttttgggacagcggtg

SEQ ID NO: 445664 - DNA, 140 bp, Artificial Sequence
  Synthetic
caccgctgtcccaaaaggtcggggggaaagcaaaatcattaaggaattgaagcgagacaagaaaagatcttttagcatgagtgtgtagtttctgtcaaaaagacagttagaactctgggacatatcagcagccagggcct

SEQ ID NO: 445665 - DNA, 140 bp, Artificial Sequence
  Synthetic
atacgccatgctgggtctcccatcaaaatgttagagccatatgtagtgaatagcttagtccagagagcagaaaagtttaggcctctcattcattccttgggagacttccctgtattcatacgtacttgggagtcggccat

SEQ ID NO: 445666 - DNA, 140 bp, Artificial Sequence
  Synthetic
atggccgactcccaagtacgtatgaatacagggaagtctcccaaggaatgaatgagaggcctaaacttttctgctctctggactaagctattcactacatatggctctaacattttgatgggagacccagcatggcgtat

SEQ ID NO: 445667 - DNA, 140 bp, Artificial Sequence
  Synthetic
aggccctggctgctgatatgacttattgttcaaccaaccatggttataccatctggatgcctgaagaggctagacttgggacatcctgtgacattttcgtccacagcaaaggaaaaagaggaccttttgggacagcggtg

SEQ ID NO: 445668 - DNA, 140 bp, Artificial Sequence
  Synthetic
caccgctgtcccaaaaggtcctctttttcctttgctgtggacgaaaatgtcacaggatgtcccaagtctagcctcttcaggcatccagatggtataaccatggttggttgaacaataagtcatatcagcagccagggcct

SEQ ID NO: 445669 - DNA, 140 bp, Artificial Sequence
  Synthetic
aggccctggctgctgatatgcccttatcttccaatgggctgattctaggggcccccttgagggggaggaattggaatactctcaagagatcacttgggacgatgataccgaattcgttgggaccttttgggacagcggtg

SEQ ID NO: 445670 - DNA, 140 bp, Artificial Sequence
  Synthetic
caccgctgtcccaaaaggtcccaacgaattcggtatcatcgtcccaagtgatctcttgagagtattccaattcctccccctcaagggggcccctagaatcagcccattggaagataagggcatatcagcagccagggcct

SEQ ID NO: 445671 - DNA, 140 bp, Artificial Sequence
  Synthetic
aggccctggctgctgatatgtgtacggctgttacaggcactgggggcatccctatatagattatcgaaagggtctgtcgaaactctatgatcaagttcatatcaagaaagtgatagataagaccttttgggacagcggtg

SEQ ID NO: 445672 - DNA, 140 bp, Artificial Sequence
  Synthetic
caccgctgtcccaaaaggtcttatctatcactttcttgatatgaacttgatcatagagtttcgacagaccctttcgataatctatatagggatgcccccagtgcctgtaacagccgtacacatatcagcagccagggcct

SEQ ID NO: 445673 - DNA, 140 bp, Artificial Sequence
  Synthetic
aggccctggctgctgatatggtttctggagctgtgcctcatttccgaaaacttcctgatattcgtttaaaaccgggtgacttcgaatctctgagcggtaaggagaagtctcgccatataggaccttttgggacagcggtg

SEQ ID NO: 445674 - DNA, 140 bp, Artificial Sequence
  Synthetic
caccgctgtcccaaaaggtcctatatggcgagacttctccttaccgctcagagattcgaagtcacccggttttaaacgaatatcaggaagttttcggaaatgaggcacagctccagaaaccatatcagcagccagggcct

SEQ ID NO: 445675 - DNA, 140 bp, Artificial Sequence
  Synthetic
atacgccatgctgggtctccacacatagtagacttggtgggggatacctggcacaagctcccgatcacgcagatcttcgagattcccgaatcaatggacccatcagagatactggatgatcgtacttgggagtcggccat

SEQ ID NO: 445676 - DNA, 140 bp, Artificial Sequence
  Synthetic
atggccgactcccaagtacgatcatccagtatctctgatgggtccattgattcgggaatctcgaagatctgcgtgatcgggagcttgtgccaggtatcccccaccaagtctactatgtgtggagacccagcatggcgtat

SEQ ID NO: 445677 - DNA, 140 bp, Artificial Sequence
  Synthetic
atacgccatgctgggtctcctcttggggattcctgagtcaataatcggattgatacaaaactctcggacgataagaagacagtttagaaaaagcctctcaagaactttagaggagtcattcgtacttgggagtcggccat

SEQ ID NO: 445678 - DNA, 140 bp, Artificial Sequence
  Synthetic
atggccgactcccaagtacgaatgactcctctaaagttcttgagaggctttttctaaactgtcttcttatcgtccgagagttttgtatcaatccgattattgactcaggaatccccaagaggagacccagcatggcgtat

SEQ ID NO: 445679 - DNA, 140 bp, Artificial Sequence
  Synthetic
aggccctggctgctgatatgcccagactgctggaagagaacttaagaaggaaaccccatcagcttcttctcaaagagagagccaatcctcgaaagcccgaatggcagctcaaactgcctcgaccttttgggacagcggtg

SEQ ID NO: 445680 - DNA, 140 bp, Artificial Sequence
  Synthetic
caccgctgtcccaaaaggtcgaggcagtttgagctgccattcgggctttcgaggattggctctctctttgagaagaagctgatggggtttccttcttaagttctcttccagcagtctgggcatatcagcagccagggcct

SEQ ID NO: 445681 - DNA, 140 bp, Artificial Sequence
  Synthetic
aggccctggctgctgatatgagccgcctgtcaatccccgggagtttttgaagtctatagacctcggaggactaccggatgaagacttgataatcggcctcaaaccaaaagagcgagagttgaccttttgggacagcggtg

SEQ ID NO: 445682 - DNA, 140 bp, Artificial Sequence
  Synthetic
caccgctgtcccaaaaggtcaactctcgctcttttggtttgaggccgattatcaagtcttcatccggtagtcctccgaggtctatagacttcaaaaactcccggggattgacaggcggctcatatcagcagccagggcct

SEQ ID NO: 445683 - DNA, 140 bp, Artificial Sequence
  Synthetic
aggccctggctgctgatatggacgcgctgaccatgacagacaacttgaacaaggtgtttaaaaagttgatcgacagagtcactgggcaagggcttttgaactattcgagggttacatatggaccttttgggacagcggtg

SEQ ID NO: 445684 - DNA, 140 bp, Artificial Sequence
  Synthetic
caccgctgtcccaaaaggtccatatgtaaccctcgaatagttcaaaagcccttgcccagtgactctgtcgatcaactttttaaacaccttgttcaagttgtctgtcatggtcagcgcgtccatatcagcagccagggcct

SEQ ID NO: 445685 - DNA, 140 bp, Artificial Sequence
  Synthetic
atacgccatgctgggtctcccgacagagtcactgggcaagggcttttgaactattcgagggttacatatgcatttcatctggactatgagaagtggaacaatcaccaaagattggagtcacgtacttgggagtcggccat

SEQ ID NO: 445686 - DNA, 140 bp, Artificial Sequence
  Synthetic
atggccgactcccaagtacgtgactccaatctttggtgattgttccacttctcatagtccagatgaaatgcatatgtaaccctcgaatagttcaaaagcccttgcccagtgactctgtcgggagacccagcatggcgtat

SEQ ID NO: 445687 - DNA, 140 bp, Artificial Sequence
  Synthetic
atacgccatgctgggtctccacagatcagacctcattgggttatgggaggatcaaatatactgcttggatatgtccaacggcccaacatgctggaatggccaagacggcgggctagagggcgtacttgggagtcggccat

SEQ ID NO: 445688 - DNA, 140 bp, Artificial Sequence
  Synthetic
atggccgactcccaagtacgccctctagcccgccgtcttggccattccagcatgttgggccgttggacatatccaagcagtatatttgatcctcccataacccaatgaggtctgatctgtggagacccagcatggcgtat

SEQ ID NO: 445689 - DNA, 140 bp, Artificial Sequence
  Synthetic
aggccctggctgctgatatgaatctacacgactttcgctcggacgagatcgaacatcttgttgtggaggagttggtcaagaaaagagaggagtgtctggatgcactagagtccatcatgagaccttttgggacagcggtg

SEQ ID NO: 445690 - DNA, 140 bp, Artificial Sequence
  Synthetic
caccgctgtcccaaaaggtctcatgatggactctagtgcatccagacactcctctcttttcttgaccaactcctccacaacaagatgttcgatctcgtccgagcgaaagtcgtgtagattcatatcagcagccagggcct

SEQ ID NO: 445691 - DNA, 140 bp, Artificial Sequence
  Synthetic
atacgccatgctgggtctccttatccccctgatgcaccctttagcagacccgtctacagttttcaaggacggtgatgaagcagaggattttgttgaggttcaccttcccgacgtgcacaacgtacttgggagtcggccat

SEQ ID NO: 445692 - DNA, 140 bp, Artificial Sequence
  Synthetic
atggccgactcccaagtacgttgtgcacgtcgggaaggtgaacctcaacaaaatcctctgcttcatcaccgtccttgaaaactgtagacgggtctgctaaagggtgcatcagggggataaggagacccagcatggcgtat

SEQ ID NO: 445693 - DNA, 140 bp, Artificial Sequence
  Synthetic
aggccctggctgctgatatgtcgaggtaacatattagtgcctgaatccaaaagatgggccagagtctcttgcatctctaacgaccaaatagtcaaccttgccaatataatgtcgacagtagaccttttgggacagcggtg

SEQ ID NO: 445694 - DNA, 140 bp, Artificial Sequence
  Synthetic
caccgctgtcccaaaaggtctactgtcgacattatattggcaaggttgactatttggtcgttagagatgcaagagactctggcccatcttttggattcaggcactaatatgttacctcgacatatcagcagccagggcct

SEQ ID NO: 445695 - DNA, 140 bp, Artificial Sequence
  Synthetic
aggccctggctgctgatatgtctcggaccctgtctctgaagggttatccttttggagagagatctggttaagctcccacgaaccctggattcatgcgttgtgtcaagaggctgggaatccgaccttttgggacagcggtg

SEQ ID NO: 445696 - DNA, 140 bp, Artificial Sequence
  Synthetic
caccgctgtcccaaaaggtcggattcccagcctcttgacacaacgcatgaatccagggttcgtgggagcttaaccagatctctctccaaaaggataacccttcagagacagggtccgagacatatcagcagccagggcct

SEQ ID NO: 445697 - DNA, 140 bp, Artificial Sequence
  Synthetic
aggccctggctgctgatatgccaacggtgctttcatcctccaggggtcgataccaaaggttgtggacaggtcgagggttacctcagatgactccgtgctcgggcacggacagaggttatagaccttttgggacagcggtg

SEQ ID NO: 445698 - DNA, 140 bp, Artificial Sequence
  Synthetic
caccgctgtcccaaaaggtctataacctctgtccgtgcccgagcacggagtcatctgaggtaaccctcgacctgtccacaacctttggtatcgacccctggaggatgaaagcaccgttggcatatcagcagccagggcct

SEQ ID NO: 445699 - DNA, 140 bp, Artificial Sequence
  Synthetic
aggccctggctgctgatatggatgcaatcagaaaggctctgtatgacgaggtggacaaggtggaaaattcagagtttcgagaggcaattctattgtccaagacccatagagataacttcagaccttttgggacagcggtg

SEQ ID NO: 445700 - DNA, 140 bp, Artificial Sequence
  Synthetic
caccgctgtcccaaaaggtctgaagttatctctatgggtcttggacaatagaattgcctctcgaaactctgaattttccaccttgtccacctcgtcatacagagcctttctgattgcatccatatcagcagccagggcct

SEQ ID NO: 445701 - DNA, 140 bp, Artificial Sequence
  Synthetic
aggccctggctgctgatatgaaggatgcaatcaggaaggctctgtacgacgaggtggacaaggtggaaaattccgagtttagagaggcaatcctgctgtccaagacccatagggataactgaccttttgggacagcggtg

SEQ ID NO: 445702 - DNA, 140 bp, Artificial Sequence
  Synthetic
caccgctgtcccaaaaggtcagttatccctatgggtcttggacagcaggattgcctctctaaactcggaattttccaccttgtccacctcgtcgtacagagccttcctgattgcatccttcatatcagcagccagggcct

SEQ ID NO: 445703 - DNA, 140 bp, Artificial Sequence
  Synthetic
aggccctggctgctgatatggacctagatcaagatgcttgatccgggagaggtctatgatgaccccgttgatccaattgaatcggaagctgagcctagagggccccccactgttcccaacgaccttttgggacagcggtg

SEQ ID NO: 445704 - DNA, 140 bp, Artificial Sequence
  Synthetic
caccgctgtcccaaaaggtcgttgggaacagtggggggccctctaggctcagcttccgattcaattggatcaacggggtcatcatagacctctcccggatcaagcatcttgatctaggtccatatcagcagccagggcct

SEQ ID NO: 445705 - DNA, 140 bp, Artificial Sequence
  Synthetic
atacgccatgctgggtctccgcgctaactggagcaccataccgaatttcagatttctagccggaacctacgacatgtttttctcccggatcgaacatctgtattcagcaattagagtgggcgtacttgggagtcggccat

SEQ ID NO: 445706 - DNA, 140 bp, Artificial Sequence
  Synthetic
atggccgactcccaagtacgcccactctaattgctgaatacagatgttcgatccgggagaaaaacatgtcgtaggttccggctagaaatctgaaattcggtatggtgctccagttagcgcggagacccagcatggcgtat

SEQ ID NO: 445707 - DNA, 140 bp, Artificial Sequence
  Synthetic
atacgccatgctgggtctccgatacttgggttcgtccacctccatgtcaacccagctattccatgcatgggaaaaagtcaccaatgttcatgtggtgaaaagggctctctcattaaaagacgtacttgggagtcggccat

SEQ ID NO: 445708 - DNA, 140 bp, Artificial Sequence
  Synthetic
atggccgactcccaagtacgtcttttaatgagagagcccttttcaccacatgaacattggtgactttttcccatgcatggaatagctgggttgacatggaggtggacgaacccaagtatcggagacccagcatggcgtat

SEQ ID NO: 445709 - DNA, 140 bp, Artificial Sequence
  Synthetic
aggccctggctgctgatatgcccagagggggtattaagttgccttgagagggttgactatgataaggcatttgggagatatctggctaacacgtattcctcttatctgtttttccacgttgaccttttgggacagcggtg

SEQ ID NO: 445710 - DNA, 140 bp, Artificial Sequence
  Synthetic
caccgctgtcccaaaaggtcaacgtggaaaaacagataagaggaatacgtgttagccagatatctcccaaatgccttatcatagtcaaccctctcaaggcaacttaataccccctctgggcatatcagcagccagggcct

SEQ ID NO: 445711 - DNA, 140 bp, Artificial Sequence
  Synthetic
aggccctggctgctgatatgagagctggtacagagagacataaggctgagagattctacgtttcattggcaccttcggtgcaacaggtgtgtaaggcccattgatgatataacactggaggaccttttgggacagcggtg

SEQ ID NO: 445712 - DNA, 140 bp, Artificial Sequence
  Synthetic
caccgctgtcccaaaaggtcctccagtgttatatcatcaatgggccttacacacctgttgcaccgaaggtgccaatgaaacgtagaatctctcagccttatgtctctctgtaccagctctcatatcagcagccagggcct

SEQ ID NO: 445713 - DNA, 140 bp, Artificial Sequence
  Synthetic
aggccctggctgctgatatgcaccagaaccccgatattcagatgacttgatatcccagctgtgccaactatacatagccggggatcaagtcctgtccatgtgcggaaactccggttatgagaccttttgggacagcggtg

SEQ ID NO: 445714 - DNA, 140 bp, Artificial Sequence
  Synthetic
caccgctgtcccaaaaggtctcataaccggagtttccgcacatggacaggacttgatccccggctatgtatagttggcacagctgggatatcaagtcatctgaatatcggggttctggtgcatatcagcagccagggcct

SEQ ID NO: 445715 - DNA, 140 bp, Artificial Sequence
  Synthetic
aggccctggctgctgatatgggtttctggggcagtgcctcattttcagaagcttcccgacatccgtctcaaaccaggtgattttgaatctctaagtggcagagagaagtctcgccatatcgaccttttgggacagcggtg

SEQ ID NO: 445716 - DNA, 140 bp, Artificial Sequence
  Synthetic
caccgctgtcccaaaaggtcgatatggcgagacttctctctgccacttagagattcaaaatcacctggtttgagacggatgtcgggaagcttctgaaaatgaggcactgccccagaaacccatatcagcagccagggcct

SEQ ID NO: 445717 - DNA, 140 bp, Artificial Sequence
  Synthetic
aggccctggctgctgatatgcccctagagactacttgagagggctcgcaagaggagtattgatagggtcctcaatttgcttcttgacaagaatgacaaatatcaacatcaatagacctctgaccttttgggacagcggtg

SEQ ID NO: 445718 - DNA, 140 bp, Artificial Sequence
  Synthetic
caccgctgtcccaaaaggtcagaggtctattgatgttgatatttgtcattcttgtcaagaagcaaattgaggaccctatcaatactcctcttgcgagccctctcaagtagtctctaggggcatatcagcagccagggcct

SEQ ID NO: 445719 - DNA, 140 bp, Artificial Sequence
  Synthetic
atacgccatgctgggtctccaagggtctgtcaaaactatatgaccaagttcacattaagaaagtgatagataagtcttaccaagagtgtttagctagcgacctggccaggagaatcctcacgtacttgggagtcggccat

SEQ ID NO: 445720 - DNA, 140 bp, Artificial Sequence
  Synthetic
atggccgactcccaagtacgtgaggattctcctggccaggtcgctagctaaacactcttggtaagacttatctatcactttcttaatgtgaacttggtcatatagttttgacagacccttggagacccagcatggcgtat

SEQ ID NO: 445721 - DNA, 140 bp, Artificial Sequence
  Synthetic
aggccctggctgctgatatgttttctatccctcagaaaatccccgccgcttacccgactactatgaaagaaggtaacagatcgatcttgtgttatctccaacatgtgctacgctatgagcgaccttttgggacagcggtg

SEQ ID NO: 445722 - DNA, 140 bp, Artificial Sequence
  Synthetic
caccgctgtcccaaaaggtcgctcatagcgtagcacatgttggagataacacaagatcgatctgttaccttctttcatagtagtcgggtaagcggcggggattttctgagggatagaaaacatatcagcagccagggcct

SEQ ID NO: 445723 - DNA, 140 bp, Artificial Sequence
  Synthetic
aggccctggctgctgatatgcccatctttatacataatgctcagagagccgtctcttagaggagagatattttcaataccccaaaaaattccagcagcttacccgaccacgatgaaagaggaccttttgggacagcggtg

SEQ ID NO: 445724 - DNA, 140 bp, Artificial Sequence
  Synthetic
caccgctgtcccaaaaggtcctctttcatcgtggtcgggtaagctgctggaattttttggggtattgaaaatatctctcctctaagagacggctctctgagcattatgtataaagatgggcatatcagcagccagggcct

SEQ ID NO: 445725 - DNA, 140 bp, Artificial Sequence
  Synthetic
aggccctggctgctgatatgttccagtcagtccaaaaacaggtaaacatgtcttatgacctcattatttgtgacgcggaagttactgacattgcatctatcaatagaataaccttgttgagaccttttgggacagcggtg

SEQ ID NO: 445726 - DNA, 140 bp, Artificial Sequence
  Synthetic
caccgctgtcccaaaaggtctcaacaaggttattctattgatagatgcaatgtcagtaacttccgcgtcacaaataatgaggtcataagacatgtttacctgtttttggactgactggaacatatcagcagccagggcct

SEQ ID NO: 445727 - DNA, 140 bp, Artificial Sequence
  Synthetic
aggccctggctgctgatatgacttacgggactatgctagtaaacccagactataacgcgattcaacagctgtcaagagcgttcccttcggtcacaggatttataactcaagtaacttcgtgaccttttgggacagcggtg

SEQ ID NO: 445728 - DNA, 140 bp, Artificial Sequence
  Synthetic
caccgctgtcccaaaaggtcacgaagttacttgagttataaatcctgtgaccgaagggaacgctcttgacagctgttgaatcgcgttatagtctgggtttactagcatagtcccgtaagtcatatcagcagccagggcct

SEQ ID NO: 445729 - DNA, 140 bp, Artificial Sequence
  Synthetic
aggccctggctgctgatatgggcgcccattataagcttaagcctattctagatgatctcaatgttttcccatctctctgtcttgtagttggggacggatcaggggggatatcaagggcaggaccttttgggacagcggtg

SEQ ID NO: 445730 - DNA, 140 bp, Artificial Sequence
  Synthetic
caccgctgtcccaaaaggtcctgcccttgatatcccccctgatccgtccccaactacaagacagagagatgggaaaacattgagatcatctagaataggcttaagcttataatgggcgcccatatcagcagccagggcct

SEQ ID NO: 445731 - DNA, 140 bp, Artificial Sequence
  Synthetic
aggccctggctgctgatatgccttataatgaaatgatcataactctaattgacagtgacgtggaatctttcctggtccacaagatggtggatgatcttgagttacagaggggaactctgtgaccttttgggacagcggtg

SEQ ID NO: 445732 - DNA, 140 bp, Artificial Sequence
  Synthetic
caccgctgtcccaaaaggtcacagagttcccctctgtaactcaagatcatccaccatcttgtggaccaggaaagattccacgtcactgtcaattagagttatgatcatttcattataaggcatatcagcagccagggcct

SEQ ID NO: 445733 - DNA, 140 bp, Artificial Sequence
  Synthetic
aggccctggctgctgatatggtgaatgatctgatggcttccggaacacatccattgcctccttcggcaatcatgagtggaggggatgacatcgtttccagggtgatagactttgactcaagaccttttgggacagcggtg

SEQ ID NO: 445734 - DNA, 140 bp, Artificial Sequence
  Synthetic
caccgctgtcccaaaaggtcttgagtcaaagtctatcaccctggaaacgatgtcatcccctccactcatgattgccgaaggaggcaatggatgtgttccggaagccatcagatcattcaccatatcagcagccagggcct

SEQ ID NO: 445735 - DNA, 140 bp, Artificial Sequence
  Synthetic
aggccctggctgctgatatgtgccggggatcaagtattgtccatgtgtgggaactccggttatgaagtcattaagatattggaaccatatgtcgtgaacagcttagtccagagggcagaagaccttttgggacagcggtg

SEQ ID NO: 445736 - DNA, 140 bp, Artificial Sequence
  Synthetic
caccgctgtcccaaaaggtcttctgccctctggactaagctgttcacgacatatggttccaatatcttaatgacttcataaccggagttcccacacatggacaatacttgatccccggcacatatcagcagccagggcct

SEQ ID NO: 445737 - DNA, 140 bp, Artificial Sequence
  Synthetic
aggccctggctgctgatatgtgcagaagttactgacattgcgtctatcaaccggatcaccctgttgatgtccgatttcgcgttgtctatagatggaccactttgtctggttttcaaaactgaccttttgggacagcggtg

SEQ ID NO: 445738 - DNA, 140 bp, Artificial Sequence
  Synthetic
caccgctgtcccaaaaggtcagttttgaaaaccagacaaagtggtccatctatagacaacgcgaaatcggacatcaacagggtgatccggttgatagacgcaatgtcagtaacttctgcacatatcagcagccagggcct

SEQ ID NO: 445739 - DNA, 140 bp, Artificial Sequence
  Synthetic
aggccctggctgctgatatgttaagctcccatgagtcctggatacacgcgttatgtcaagaggccgggaacccagatctgggagagaggacactcgagagcttcactcgccttctggagggaccttttgggacagcggtg

SEQ ID NO: 445740 - DNA, 140 bp, Artificial Sequence
  Synthetic
caccgctgtcccaaaaggtccctccagaaggcgagtgaagctctcgagtgtcctctctcccagatctgggttcccggcctcttgacataacgcgtgtatccaggactcatgggagcttaacatatcagcagccagggcct

SEQ ID NO: 445741 - DNA, 140 bp, Artificial Sequence
  Synthetic
aggccctggctgctgatatgactatcaagatcttgtaaggggatttcctgaggaaatcatatcgaatccttacaatgagatgatcataaccctaattgacagcgatgtagagtccttcctgaccttttgggacagcggtg

SEQ ID NO: 445742 - DNA, 140 bp, Artificial Sequence
  Synthetic
caccgctgtcccaaaaggtcaggaaggactctacatcgctgtcaattagggttatgatcatctcattgtaaggattcgatatgatttcctcaggaaatccccttacaagatcttgatagtcatatcagcagccagggcct

SEQ ID NO: 445743 - DNA, 140 bp, Artificial Sequence
  Synthetic
atacgccatgctgggtctcctacaatgagatgatcataaccctaattgacagcgatgtagagtccttcctagtccacaaaatggtggatgatctcgagttacagaggggaactctgtttacgtacttgggagtcggccat

SEQ ID NO: 445744 - DNA, 140 bp, Artificial Sequence
  Synthetic
atggccgactcccaagtacgtaaacagagttcccctctgtaactcgagatcatccaccattttgtggactaggaaggactctacatcgctgtcaattagggttatgatcatctcattgtaggagacccagcatggcgtat

SEQ ID NO: 445745 - DNA, 140 bp, Artificial Sequence
  Synthetic
aggccctggctgctgatatgaaggatgcaatcaggaaggctctgtacgacgaggtggacaaggtggaaaattcggagttcagagaggcaatcctgttgtctaagacccatagggataactgaccttttgggacagcggtg

SEQ ID NO: 445746 - DNA, 140 bp, Artificial Sequence
  Synthetic
caccgctgtcccaaaaggtcagttatccctatgggtcttagacaacaggattgcctctctgaactccgaattttccaccttgtccacctcgtcgtacagagccttcctgattgcatccttcatatcagcagccagggcct

SEQ ID NO: 445747 - DNA, 140 bp, Artificial Sequence
  Synthetic
atacgccatgctgggtctccaggtctcaggagttgacttgggtctcccgaactgggggaagtatgtattactgagtgcaggggccctgactgccttgatgttgataattttcctgatgaccgtacttgggagtcggccat

SEQ ID NO: 445748 - DNA, 140 bp, Artificial Sequence
  Synthetic
atggccgactcccaagtacggtcatcaggaaaattatcaacatcaaggcagtcagggcccctgcactcagtaatacatacttcccccagttcgggagacccaagtcaactcctgagacctggagacccagcatggcgtat

SEQ ID NO: 445749 - DNA, 140 bp, Artificial Sequence
  Synthetic
aggccctggctgctgatatgaacgtttcaaaacctttgactgaccccttgttttatcctccatctgatcctaaaatcctgagacacttcaacatatgttgtagtactatgatgtatctgtgaccttttgggacagcggtg

SEQ ID NO: 445750 - DNA, 140 bp, Artificial Sequence
  Synthetic
caccgctgtcccaaaaggtcacagatacatcatagtactacaacatatgttgaagtgtctcaggattttaggatcagatggaggataaaacaaggggtcagtcaaaggttttgaaacgttcatatcagcagccagggcct

SEQ ID NO: 445751 - DNA, 140 bp, Artificial Sequence
  Synthetic
aggccctggctgctgatatgttatctatcttggagttggtccaacgacacctcagtgttcaagagggtagcctgtaattctagcttgagtctgtcatctcactggatcaggttaatttacgaccttttgggacagcggtg

SEQ ID NO: 445752 - DNA, 140 bp, Artificial Sequence
  Synthetic
caccgctgtcccaaaaggtcgtaaattaacctgatccagtgagatgacagactcaagctagaattacaggctaccctcttgaacactgaggtgtcgttggaccaactccaagatagataacatatcagcagccagggcct

SEQ ID NO: 445753 - DNA, 140 bp, Artificial Sequence
  Synthetic
aggccctggctgctgatatggagggcagacctcctgagggagatctcttggggaagaaaagtagtaggcacgacagttcctcacccttctgagatgttggggttacttcccaaatcttccgaccttttgggacagcggtg

SEQ ID NO: 445754 - DNA, 140 bp, Artificial Sequence
  Synthetic
caccgctgtcccaaaaggtcggaagatttgggaagtaaccccaacatctcagaagggtgaggaactgtcgtgcctactacttttcttccccaagagatctccctcaggaggtctgccctccatatcagcagccagggcct

SEQ ID NO: 445755 - DNA, 140 bp, Artificial Sequence
  Synthetic
atacgccatgctgggtctcccatgtagagccgcgtacaactggaagatggccggtgaccccagatatgaagagtctctacacaatccgtaccctgactaccactggcttcgaactgtaaacgtacttgggagtcggccat

SEQ ID NO: 445756 - DNA, 140 bp, Artificial Sequence
  Synthetic
atggccgactcccaagtacgtttacagttcgaagccagtggtagtcagggtacggattgtgtagagactcttcatatctggggtcaccggccatcttccagttgtacgcggctctacatgggagacccagcatggcgtat

SEQ ID NO: 445757 - DNA, 140 bp, Artificial Sequence
  Synthetic
aggccctggctgctgatatgatatcaaatctagatcatctctactagaatacagttgtttgtagaccggatactctcgggaacctgtacatactaaaattcgtgtatgatgtatcttgaagaccttttgggacagcggtg

SEQ ID NO: 445758 - DNA, 140 bp, Artificial Sequence
  Synthetic
caccgctgtcccaaaaggtcttcaagatacatcatacacgaattttagtatgtacaggttcccgagagtatccggtctacaaacaactgtattctagtagagatgatctagatttgatatcatatcagcagccagggcct

SEQ ID NO: 445759 - DNA, 140 bp, Artificial Sequence
  Synthetic
aggccctggctgctgatatgccgatgagggactttttgcttatgtcagtacaagccgttttccattacttgctgtttagccccatcttgaaaggcagagtttacaagatcctgagtgccggaccttttgggacagcggtg

SEQ ID NO: 445760 - DNA, 140 bp, Artificial Sequence
  Synthetic
caccgctgtcccaaaaggtccggcactcaggatcttgtaaactctgcctttcaagatggggctaaacagcaagtaatggaaaacggcttgtactgacataagcaaaaagtccctcatcggcatatcagcagccagggcct

SEQ ID NO: 445761 - DNA, 140 bp, Artificial Sequence
  Synthetic
aggccctggctgctgatatgaaccaggtgactttgaatctctaagtggtagagaaaagtctcgccacatagggtcggctcaggggctcttgtattcaattttggtggcaattcatgactcgaccttttgggacagcggtg

SEQ ID NO: 445762 - DNA, 140 bp, Artificial Sequence
  Synthetic
caccgctgtcccaaaaggtcgagtcatgaattgccaccaaaattgaatacaagagcccctgagccgaccctatgtggcgagacttttctctaccacttagagattcaaagtcacctggttcatatcagcagccagggcct

SEQ ID NO: 445763 - DNA, 140 bp, Artificial Sequence
  Synthetic
atacgccatgctgggtctccacttctctggtgaaaccaggagtccggaggcagtttatactcggatcatgataaatgggggtagattgaaaagatcacacataaggagatatgtctcagtcgtacttgggagtcggccat

SEQ ID NO: 445764 - DNA, 140 bp, Artificial Sequence
  Synthetic
atggccgactcccaagtacgactgagacatatctccttatgtgtgatcttttcaatctacccccatttatcatgatccgagtataaactgcctccggactcctggtttcaccagagaagtggagacccagcatggcgtat

SEQ ID NO: 445765 - DNA, 140 bp, Artificial Sequence
  Synthetic
atacgccatgctgggtctccccatagattgtgtatatccatcatgaaaaaaactaacactcctcctttcgaaccatcccaagtatgagcaagatctttgttaatccgagtgcaatcagagcgtacttgggagtcggccat

SEQ ID NO: 445766 - DNA, 140 bp, Artificial Sequence
  Synthetic
atggccgactcccaagtacgctctgattgcactcggattaacaaagatcttgctcatacttgggatggttcgaaaggaggagtgttagtttttttcatgatggatatacacaatctatggggagacccagcatggcgtat

SEQ ID NO: 445767 - DNA, 140 bp, Artificial Sequence
  Synthetic
atacgccatgctgggtctccaaagatcaaatatggggattgctgattgtgaccaaggatttcgtgtactcccaaagttctggctgtctctttgatagaaattatacacttatgctgaaagcgtacttgggagtcggccat

SEQ ID NO: 445768 - DNA, 140 bp, Artificial Sequence
  Synthetic
atggccgactcccaagtacgctttcagcataagtgtataatttctatcaaagagacagccagaactttgggagtacacgaaatccttggtcacaatcagcaatccccatatttgatctttggagacccagcatggcgtat

SEQ ID NO: 445769 - DNA, 140 bp, Artificial Sequence
  Synthetic
atacgccatgctgggtctcctaataaattgtgtacatccttcacgaaaaaaactaacacccctcctcttgaaccatctcagacatgagcaagatttttgtcaaccccagtgcgatccgggcgtacttgggagtcggccat

SEQ ID NO: 445770 - DNA, 140 bp, Artificial Sequence
  Synthetic
atggccgactcccaagtacgcccggatcgcactggggttgacaaaaatcttgctcatgtctgagatggttcaagaggaggggtgttagtttttttcgtgaaggatgtacacaatttattaggagacccagcatggcgtat

SEQ ID NO: 445771 - DNA, 140 bp, Artificial Sequence
  Synthetic
aggccctggctgctgatatgtaatgtgtgagaccttctggcggtgtcattgatcaacggtgctctcataccataacgaccgataccaaaggttatatgtgaaccggataatgtctcagatgaccttttgggacagcggtg

SEQ ID NO: 445772 - DNA, 140 bp, Artificial Sequence
  Synthetic
caccgctgtcccaaaaggtcatctgagacattatccggttcacatataacctttggtatcggtcgttatggtatgagagcaccgttgatcaatgacaccgccagaaggtctcacacattacatatcagcagccagggcct

SEQ ID NO: 445773 - DNA, 140 bp, Artificial Sequence
  Synthetic
atacgccatgctgggtctcctcagacaccaggtgaaaccaaatggtgctctcctgatcagctagtgaatctacatgattttcactcagatgagatagagcatctcgtcgcagaggagttgcgtacttgggagtcggccat

SEQ ID NO: 445774 - DNA, 140 bp, Artificial Sequence
  Synthetic
atggccgactcccaagtacgcaactcctctgcgacgagatgctctatctcatctgagtgaaaatcatgtagattcactagctgatcaggagagcaccatttggtttcacctggtgtctgaggagacccagcatggcgtat

SEQ ID NO: 445775 - DNA, 140 bp, Artificial Sequence
  Synthetic
atacgccatgctgggtctccaaaaatgtaatatttttataatggatgttgataagattgtatttaaagttaataattaggtggtttttttgaagtttgagattattgtggattaatatgacgtacttgggagtcggccat

SEQ ID NO: 445776 - DNA, 140 bp, Artificial Sequence
  Synthetic
atggccgactcccaagtacgtcatattaatccacaataatctcaaacttcaaaaaaaccacctaattattaactttaaatacaatcttatcaacatccattataaaaatattacatttttggagacccagcatggcgtat

SEQ ID NO: 445777 - DNA, 140 bp, Artificial Sequence
  Synthetic
atacgccatgctgggtctccagtgttgttaaatttgattttgatgatgtatgtttttatttggtggtggtaatgtagttttttgaggggatatgtttggaagattggattagttatggaacgtacttgggagtcggccat

SEQ ID NO: 445778 - DNA, 140 bp, Artificial Sequence
  Synthetic
atggccgactcccaagtacgttccataactaatccaatcttccaaacatatcccctcaaaaaactacattaccaccaccaaataaaaacatacatcatcaaaatcaaatttaacaacactggagacccagcatggcgtat

SEQ ID NO: 445779 - DNA, 140 bp, Artificial Sequence
  Synthetic
atacgccatgctgggtctccggtagcccgcttggctcacgacgggtccaaactccccctgagatgtatgctggggtgggttgctctagccaactccaaaaagttccagctattagttgagcgtacttgggagtcggccat

SEQ ID NO: 445780 - DNA, 140 bp, Artificial Sequence
  Synthetic
atggccgactcccaagtacgctcaactaatagctggaactttttggagttggctagagcaacccaccccagcatacatctcagggggagtttggacccgtcgtgagccaagcgggctaccggagacccagcatggcgtat

SEQ ID NO: 445781 - DNA, 140 bp, Artificial Sequence
  Synthetic
atacgccatgctgggtctccattgataagagattttattgtttttgagtatgtgtttttagttggtttttttttgagtttgtataggttgagtaaaatatttgggtaaagtattggtaatcgtacttgggagtcggccat

SEQ ID NO: 445782 - DNA, 140 bp, Artificial Sequence
  Synthetic
atggccgactcccaagtacgattaccaatactttacccaaatattttactcaacctatacaaactcaaaaaaaaaccaactaaaaacacatactcaaaaacaataaaatctcttatcaatggagacccagcatggcgtat

SEQ ID NO: 445783 - DNA, 140 bp, Artificial Sequence
  Synthetic
atacgccatgctgggtctccgtgttaattggagtattatattaaattttagatttttggttggaatttatgatatgttttttttttggattgagtatttatatttagtaattagagtgggcgtacttgggagtcggccat

SEQ ID NO: 445784 - DNA, 140 bp, Artificial Sequence
  Synthetic
atggccgactcccaagtacgcccactctaattactaaatataaatactcaatccaaaaaaaaaacatatcataaattccaaccaaaaatctaaaatttaatataatactccaattaacacggagacccagcatggcgtat

SEQ ID NO: 445785 - DNA, 140 bp, Artificial Sequence
  Synthetic
aggccctggctgctgatatgaggagagatagagagacaccttcgtgggtacaacaggtggattacccttgaagatatcagatgtagatcatctctacttgattacagctgcttgtgaactgaccttttgggacagcggtg

SEQ ID NO: 445786 - DNA, 140 bp, Artificial Sequence
  Synthetic
caccgctgtcccaaaaggtcagttcacaagcagctgtaatcaagtagagatgatctacatctgatatcttcaagggtaatccacctgttgtacccacgaaggtgtctctctatctctcctcatatcagcagccagggcct

SEQ ID NO: 445787 - DNA, 140 bp, Artificial Sequence
  Synthetic
aggccctggctgctgatatgggacactctcagaggcttgtacaagctaagactcttatacgatgtatcttgaaaaaaacaagatcttgactctgaacctctggttgtttgattgtttttcgaccttttgggacagcggtg

SEQ ID NO: 445788 - DNA, 140 bp, Artificial Sequence
  Synthetic
caccgctgtcccaaaaggtcgaaaaacaatcaaacaaccagaggttcagagtcaagatcttgtttttttcaagatacatcgtataagagtcttagcttgtacaagcctctgagagtgtcccatatcagcagccagggcct

SEQ ID NO: 445789 - DNA, 140 bp, Artificial Sequence
  Synthetic
atacgccatgctgggtctccttttataagaattttgaggaagagataagaagaatgtttgagttagggtaggagatagttgttttttatttttattttatttatttttgtttattaggttcgtacttgggagtcggccat

SEQ ID NO: 445790 - DNA, 140 bp, Artificial Sequence
  Synthetic
atggccgactcccaagtacgaacctaataaacaaaaataaataaaataaaaataaaaaacaactatctcctaccctaactcaaacattcttcttatctcttcctcaaaattcttataaaaggagacccagcatggcgtat

SEQ ID NO: 445791 - DNA, 140 bp, Artificial Sequence
  Synthetic
aggccctggctgctgatatgcaaacaagagatcacagtcatcttacatcctaataaggtgtccataactgcagagggctatgccatccaagctttccaatcgagaaaaaaactatagaacgaccttttgggacagcggtg

SEQ ID NO: 445792 - DNA, 140 bp, Artificial Sequence
  Synthetic
caccgctgtcccaaaaggtcgttctatagtttttttctcgattggaaagcttggatggcatagccctctgcagttatggacaccttattaggatgtaagatgactgtgatctcttgtttgcatatcagcagccagggcct

SEQ ID NO: 445793 - DNA, 140 bp, Artificial Sequence
  Synthetic
atacgccatgctgggtctccaatggttattgttgtatgtgttttttatgaaatgtttgttttagggggttatttgggagaggaattttttgggaaagggatatttgaaagaagattttttcgtacttgggagtcggccat

SEQ ID NO: 445794 - DNA, 140 bp, Artificial Sequence
  Synthetic
atggccgactcccaagtacgaaaaaatcttctttcaaatatccctttcccaaaaaattcctctcccaaataaccccctaaaacaaacatttcataaaaaacacatacaacaataaccattggagacccagcatggcgtat

SEQ ID NO: 445795 - DNA, 140 bp, Artificial Sequence
  Synthetic
atacgccatgctgggtctccgattcctcaagatatggtcacagaccgtagaggaaattatatcctatgtcacggtcaactttcctaaccctccaggaaggtcttcggaggataaatcaaccgtacttgggagtcggccat

SEQ ID NO: 445796 - DNA, 140 bp, Artificial Sequence
  Synthetic
atggccgactcccaagtacggttgatttatcctccgaagaccttcctggagggttaggaaagttgaccgtgacataggatataatttcctctacggtctgtgaccatatcttgaggaatcggagacccagcatggcgtat

SEQ ID NO: 445797 - DNA, 140 bp, Artificial Sequence
  Synthetic
aggccctggctgctgatatgaatgctgccaagcttgatcctgatgatgtatgttcctacttagcagctgcgatgcagttctttgaagggacatgtcctgaagactggaccagctacgggagaccttttgggacagcggtg

SEQ ID NO: 445798 - DNA, 140 bp, Artificial Sequence
  Synthetic
caccgctgtcccaaaaggtctcccgtagctggtccagtcttcaggacatgtcccttcaaagaactgcatcgcagctgctaagtaggaacatacatcatcaggatcaagcttggcagcattcatatcagcagccagggcct

SEQ ID NO: 445799 - DNA, 140 bp, Artificial Sequence
  Synthetic
aggccctggctgctgatatgtccagactccccagagggtcggaagggtttggccctgttcctctgagagggcagatctcttaagagaaatctcatggggaaggaaggtggttggcaccacgaccttttgggacagcggtg

SEQ ID NO: 445800 - DNA, 140 bp, Artificial Sequence
  Synthetic
caccgctgtcccaaaaggtcgtggtgccaaccaccttccttccccatgagatttctcttaagagatctgccctctcagaggaacagggccaaacccttccgaccctctggggagtctggacatatcagcagccagggcct

SEQ ID NO: 445801 - DNA, 140 bp, Artificial Sequence
  Synthetic
aggccctggctgctgatatgatgcagttctttgagggagcatgtcctgatgactggaccagctacggaatcctgatagcacggaggggagacaagatcaccccaaattctcttgtggacagaccttttgggacagcggtg

SEQ ID NO: 445802 - DNA, 140 bp, Artificial Sequence
  Synthetic
caccgctgtcccaaaaggtctgtccacaagagaatttggggtgatcttgtctcccctccgtgctatcaggattccgtagctggtccagtcatcaggacatgctccctcaaagaactgcatcatatcagcagccagggcct

SEQ ID NO: 445803 - DNA, 140 bp, Artificial Sequence
  Synthetic
aggccctggctgctgatatgatgaatggaggtcgactaaagagatcgcatatacggagatatgtctcagtcagttctaatcatcaagcccgtccaaactcattcgccgagtttctaaacagaccttttgggacagcggtg

SEQ ID NO: 445804 - DNA, 140 bp, Artificial Sequence
  Synthetic
caccgctgtcccaaaaggtctgtttagaaactcggcgaatgagtttggacgggcttgatgattagaactgactgagacatatctccgtatatgcgatctctttagtcgacctccattcatcatatcagcagccagggcct

SEQ ID NO: 445805 - DNA, 140 bp, Artificial Sequence
  Synthetic
atacgccatgctgggtctccttatggattgtgtatatttattatgaaaaaaattaatatttttttttttgaattattttaaatatgagtaagatttttgttaattttagtgttattagagcgtacttgggagtcggccat

SEQ ID NO: 445806 - DNA, 140 bp, Artificial Sequence
  Synthetic
atggccgactcccaagtacgctctaataacactaaaattaacaaaaatcttactcatatttaaaataattcaaaaaaaaaaatattaatttttttcataataaatatacacaatccataaggagacccagcatggcgtat

SEQ ID NO: 445807 - DNA, 140 bp, Artificial Sequence
  Synthetic
atacgccatgctgggtctccggataatttttttgaggatatggggtgattttatttggatgatggaaaattgtttaattttggtgagatggttaaggtgggagaaggtaagtattgagagcgtacttgggagtcggccat

SEQ ID NO: 445808 - DNA, 140 bp, Artificial Sequence
  Synthetic
atggccgactcccaagtacgctctcaatacttaccttctcccaccttaaccatctcaccaaaattaaacaattttccatcatccaaataaaatcaccccatatcctcaaaaaaattatccggagacccagcatggcgtat

SEQ ID NO: 445809 - DNA, 140 bp, Artificial Sequence
  Synthetic
atacgccatgctgggtctccgattttttaagatatggttatagattgtagaagagattatattttatgttgtggttaatttttttaattttttaggaaagtttttagaggataaattaatcgtacttgggagtcggccat

SEQ ID NO: 445810 - DNA, 140 bp, Artificial Sequence
  Synthetic
atggccgactcccaagtacgattaatttatcctctaaaaactttcctaaaaaattaaaaaaattaaccacaacataaaatataatctcttctacaatctataaccatatcttaaaaaatcggagacccagcatggcgtat

SEQ ID NO: 445811 - DNA, 140 bp, Artificial Sequence
  Synthetic
atacgccatgctgggtctccggttttttagtttttgaatggttggttattaatgaagaggatgatttattagtggaggttgagattgtttattagattgtagaaagtttttttaaaaaatcgtacttgggagtcggccat

SEQ ID NO: 445812 - DNA, 140 bp, Artificial Sequence
  Synthetic
atggccgactcccaagtacgattttttaaaaaaactttctacaatctaataaacaatctcaacctccactaataaatcatcctcttcattaataaccaaccattcaaaaactaaaaaaccggagacccagcatggcgtat

SEQ ID NO: 445813 - DNA, 140 bp, Artificial Sequence
  Synthetic
aggccctggctgctgatatgagtggaagctgagattgctcaccaaattgctgaaagcttttccaagaagtacaagtttccctctcgatcatctgggatatttttgtataactttgagcaggaccttttgggacagcggtg

SEQ ID NO: 445814 - DNA, 140 bp, Artificial Sequence
  Synthetic
caccgctgtcccaaaaggtcctgctcaaagttatacaaaaatatcccagatgatcgagagggaaacttgtacttcttggaaaagctttcagcaatttggtgagcaatctcagcttccactcatatcagcagccagggcct

SEQ ID NO: 445815 - DNA, 140 bp, Artificial Sequence
  Synthetic
aggccctggctgctgatatgctgagccgagagggaaccccaccatccctaacatattaaggaactctgactacaacctaaactctcccctaatagaggatccagccaagttgatgctggagaccttttgggacagcggtg

SEQ ID NO: 445816 - DNA, 140 bp, Artificial Sequence
  Synthetic
caccgctgtcccaaaaggtctccagcatcaacttggctggatcctctattaggggagagtttaggttgtagtcagagttccttaatatgttagggatggtggggttccctctcggctcagcatatcagcagccagggcct

SEQ ID NO: 445817 - DNA, 140 bp, Artificial Sequence
  Synthetic
atacgccatgctgggtctcctgtgatttgtttagtttgtgatgggtttaaattttttttaagatgtgtattgggatgggttgttttggttaattttaagaaattttagttgttagttgaacgtacttgggagtcggccat

SEQ ID NO: 445818 - DNA, 140 bp, Artificial Sequence
  Synthetic
atggccgactcccaagtacgttcaactaacaactaaaatttcttaaaattaaccaaaacaacccatcccaatacacatcttaaaaaaaatttaaacccatcacaaactaaacaaatcacaggagacccagcatggcgtat

SEQ ID NO: 445819 - DNA, 140 bp, Artificial Sequence
  Synthetic
atacgccatgctgggtctcctgttttaaagttaatatgaaaaaaataggtaatattattgataaaatgaattttttatgtaagatagtgaaaaattgtagggatgaggatatttaaaaatcgtacttgggagtcggccat

SEQ ID NO: 445820 - DNA, 140 bp, Artificial Sequence
  Synthetic
atggccgactcccaagtacgatttttaaatatcctcatccctacaatttttcactatcttacataaaaaattcattttatcaataatattacctatttttttcatattaactttaaaacaggagacccagcatggcgtat

SEQ ID NO: 445821 - DNA, 140 bp, Artificial Sequence
  Synthetic
atacgccatgctgggtctccctggacaatgttggaattcaaatggtcagacaaatgaggtcaggagagagattcctcaagatatggtctcagaccgtcgaagagatcatatcctatgtcacgtacttgggagtcggccat

SEQ ID NO: 445822 - DNA, 140 bp, Artificial Sequence
  Synthetic
atggccgactcccaagtacgtgacataggatatgatctcttcgacggtctgagaccatatcttgaggaatctctctcctgacctcatttgtctgaccatttgaattccaacattgtccagggagacccagcatggcgtat

SEQ ID NO: 445823 - DNA, 140 bp, Artificial Sequence
  Synthetic
atacgccatgctgggtctcctttttgtattaatggaggggttaaagtgtgtagtttgaatggttatttgtttgggattttgtggtatattttgagattatttgatgagatatattttgggcgtacttgggagtcggccat

SEQ ID NO: 445824 - DNA, 140 bp, Artificial Sequence
  Synthetic
atggccgactcccaagtacgcccaaaatatatctcatcaaataatctcaaaatataccacaaaatcccaaacaaataaccattcaaactacacactttaacccctccattaatacaaaaaggagacccagcatggcgtat

SEQ ID NO: 445825 - DNA, 140 bp, Artificial Sequence
  Synthetic
aggccctggctgctgatatgaatgacctgatggcgtcaggaacacatccgttgcccccctcggcaatcatgagcggaggagatgacatcatctccagggtgattgactttgactccatctgaccttttgggacagcggtg

SEQ ID NO: 445826 - DNA, 140 bp, Artificial Sequence
  Synthetic
caccgctgtcccaaaaggtcagatggagtcaaagtcaatcaccctggagatgatgtcatctcctccgctcatgattgccgaggggggcaacggatgtgttcctgacgccatcaggtcattcatatcagcagccagggcct

SEQ ID NO: 445827 - DNA, 140 bp, Artificial Sequence
  Synthetic
atacgccatgctgggtctcctttttattttttagtgggttgattttaggggtttttttgaaggggaggagttggaatatttttaggagattatttgggatgataatattgagtttgttggcgtacttgggagtcggccat

SEQ ID NO: 445828 - DNA, 140 bp, Artificial Sequence
  Synthetic
atggccgactcccaagtacgccaacaaactcaatattatcatcccaaataatctcctaaaaatattccaactcctccccttcaaaaaaacccctaaaatcaacccactaaaaaataaaaaggagacccagcatggcgtat

SEQ ID NO: 445829 - DNA, 140 bp, Artificial Sequence
  Synthetic
atacgccatgctgggtctccggggtgggttgctctagccaaatccaaaaagttccagctgttagttgagcccgacaagctaaataaaataatgcaggacgacctgaaccgttatgcattccgtacttgggagtcggccat

SEQ ID NO: 445830 - DNA, 140 bp, Artificial Sequence
  Synthetic
atggccgactcccaagtacggaatgcataacggttcaggtcgtcctgcattattttatttagcttgtcgggctcaactaacagctggaactttttggatttggctagagcaacccaccccggagacccagcatggcgtat

SEQ ID NO: 445831 - DNA, 140 bp, Artificial Sequence
  Synthetic
atacgccatgctgggtctccttttagatataaaggtttgaagaggataaagatttttttttgtttttagaataattagattatattttgtaaatttattatttgtttatttttggaggagcgtacttgggagtcggccat

SEQ ID NO: 445832 - DNA, 140 bp, Artificial Sequence
  Synthetic
atggccgactcccaagtacgctcctccaaaaataaacaaataataaatttacaaaatataatctaattattctaaaaacaaaaaaaaatctttatcctcttcaaacctttatatctaaaaggagacccagcatggcgtat

SEQ ID NO: 445833 - DNA, 140 bp, Artificial Sequence
  Synthetic
aggccctggctgctgatatgataatcaaattatatcccgcaagtttatcacttgtttacctctggaggagagaacatacgggcttgactccaacctttgggagcaatagaacaaaaaaacgaccttttgggacagcggtg

SEQ ID NO: 445834 - DNA, 140 bp, Artificial Sequence
  Synthetic
caccgctgtcccaaaaggtcgtttttttgttctattgctcccaaaggttggagtcaagcccgtatgttctctcctccagaggtaaacaagtgataaacttgcgggatataatttgattatcatatcagcagccagggcct

SEQ ID NO: 445835 - DNA, 140 bp, Artificial Sequence
  Synthetic
atacgccatgctgggtctcctttttatattttgatttttttggatgtgaaaaaaattattaatattttttaaaagatttaaggaaagatggttttttaggtttttttgtttgtattttttcgtacttgggagtcggccat

SEQ ID NO: 445836 - DNA, 140 bp, Artificial Sequence
  Synthetic
atggccgactcccaagtacgaaaaaatacaaacaaaaaaacctaaaaaaccatctttccttaaatcttttaaaaaatattaataatttttttcacatccaaaaaaatcaaaatataaaaaggagacccagcatggcgtat

SEQ ID NO: 445837 - DNA, 140 bp, Artificial Sequence
  Synthetic
aggccctggctgctgatatgaatgcagccaagcttgaccctgatgatgtatgctcttatctagcagccgcaatgcagttctttgaggggacatgtcctgatgactggaccagctatggaagaccttttgggacagcggtg

SEQ ID NO: 445838 - DNA, 140 bp, Artificial Sequence
  Synthetic
caccgctgtcccaaaaggtcttccatagctggtccagtcatcaggacatgtcccctcaaagaactgcattgcggctgctagataagagcatacatcatcagggtcaagcttggctgcattcatatcagcagccagggcct

SEQ ID NO: 445839 - DNA, 140 bp, Artificial Sequence
  Synthetic
atacgccatgctgggtctccttttgtgtcaatggagaagtcaaggtgtgtagtccaaacggctattcatttaggatcctgcggcatattttgaaatcattcgacgagatctattctggaacgtacttgggagtcggccat

SEQ ID NO: 445840 - DNA, 140 bp, Artificial Sequence
  Synthetic
atggccgactcccaagtacgttccagaatagatctcgtcgaatgatttcaaaatatgccgcaggatcctaaatgaatagccgtttggactacacaccttgacttctccattgacacaaaaggagacccagcatggcgtat

SEQ ID NO: 445841 - DNA, 140 bp, Artificial Sequence
  Synthetic
atacgccatgctgggtctccataatttggtagtggaggatgaaggatgtattaatttgttagggtttttttatatggaatttaaagttggatatattttagttataaaaatgaatgggttcgtacttgggagtcggccat

SEQ ID NO: 445842 - DNA, 140 bp, Artificial Sequence
  Synthetic
atggccgactcccaagtacgaacccattcatttttataactaaaatatatccaactttaaattccatataaaaaaaccctaacaaattaatacatccttcatcctccactaccaaattatggagacccagcatggcgtat

SEQ ID NO: 445843 - DNA, 140 bp, Artificial Sequence
  Synthetic
atacgccatgctgggtctccgttgacgagagaccccacagtttcggagcatgcatccctagttggtcttctcttgagtctttacaggttaagcaaaatatctggacaaaacaccggcaatcgtacttgggagtcggccat

SEQ ID NO: 445844 - DNA, 140 bp, Artificial Sequence
  Synthetic
atggccgactcccaagtacgattgccggtgttttgtccagatattttgcttaacctgtaaagactcaagagaagaccaactagggatgcatgctccgaaactgtggggtctctcgtcaacggagacccagcatggcgtat

SEQ ID NO: 445845 - DNA, 140 bp, Artificial Sequence
  Synthetic
aggccctggctgctgatatgtgtggaggctgaaatcgctcaccagattgctgaaagcttttccaagaagtataaatttccctctcgatcatcagggatattcttgtataattttgagcaggaccttttgggacagcggtg

SEQ ID NO: 445846 - DNA, 140 bp, Artificial Sequence
  Synthetic
caccgctgtcccaaaaggtcctgctcaaaattatacaagaatatccctgatgatcgagagggaaatttatacttcttggaaaagctttcagcaatctggtgagcgatttcagcctccacacatatcagcagccagggcct

SEQ ID NO: 445847 - DNA, 140 bp, Artificial Sequence
  Synthetic
atacgccatgctgggtctccgtatgtagagttgtgtataattggaagatggttggtgattttagatatgaagagtttttatataatttgtattttgattattattggttttgaattgtaacgtacttgggagtcggccat

SEQ ID NO: 445848 - DNA, 140 bp, Artificial Sequence
  Synthetic
atggccgactcccaagtacgttacaattcaaaaccaataataatcaaaatacaaattatataaaaactcttcatatctaaaatcaccaaccatcttccaattatacacaactctacatacggagacccagcatggcgtat

SEQ ID NO: 445849 - DNA, 140 bp, Artificial Sequence
  Synthetic
atacgccatgctgggtctccgtgctaactggagtactataccgaacttcagatttctggccggaacctacgatatgtttttctcgcgggttgaacatctgtattcagcaattagagtgggcgtacttgggagtcggccat

SEQ ID NO: 445850 - DNA, 140 bp, Artificial Sequence
  Synthetic
atggccgactcccaagtacgcccactctaattgctgaatacagatgttcaacccgcgagaaaaacatatcgtaggttccggccagaaatctgaagttcggtatagtactccagttagcacggagacccagcatggcgtat

SEQ ID NO: 445851 - DNA, 140 bp, Artificial Sequence
  Synthetic
atacgccatgctgggtctcctacagttgtaacagcctatgaggactgctcagggttggtgtcgtttacagggtttattaagcaaataaatctcactgcaaaagaagcaatactatatttccgtacttgggagtcggccat

SEQ ID NO: 445852 - DNA, 140 bp, Artificial Sequence
  Synthetic
atggccgactcccaagtacggaaatatagtattgcttcttttgcagtgagatttatttgcttaataaaccctgtaaacgacaccaaccctgagcagtcctcataggctgttacaactgtaggagacccagcatggcgtat

SEQ ID NO: 445853 - DNA, 140 bp, Artificial Sequence
  Synthetic
atacgccatgctgggtctcctttaggagtagtggtgttttttatttattgttttattaattatgattatattatttggatgtttgagaatttgagattagggatgttttgtgatatttttcgtacttgggagtcggccat

SEQ ID NO: 445854 - DNA, 140 bp, Artificial Sequence
  Synthetic
atggccgactcccaagtacgaaaaatatcacaaaacatccctaatctcaaattctcaaacatccaaataatataatcataattaataaaacaataaataaaaaacaccactactcctaaaggagacccagcatggcgtat

SEQ ID NO: 445855 - DNA, 140 bp, Artificial Sequence
  Synthetic
atacgccatgctgggtctcctgagtgggaaatctccgtattcatcaaatgcagttggtcacgtgttcaacctcattcactttgttggatgttatatgggtcaagtgagatctttgaacgccgtacttgggagtcggccat

SEQ ID NO: 445856 - DNA, 140 bp, Artificial Sequence
  Synthetic
atggccgactcccaagtacggcgttcaaagatctcacttgacccatataacatccaacaaagtgaatgaggttgaacacgtgaccaactgcatttgatgaatacggagatttcccactcaggagacccagcatggcgtat

SEQ ID NO: 445857 - DNA, 140 bp, Artificial Sequence
  Synthetic
atacgccatgctgggtctccagttatgtggagttttaggatttagatttatggatggaatatgggttgtgatgtaaatattaaatgaaattaaatggtgtttttttggttagttggtgaacgtacttgggagtcggccat

SEQ ID NO: 445858 - DNA, 140 bp, Artificial Sequence
  Synthetic
atggccgactcccaagtacgttcaccaactaaccaaaaaaacaccatttaatttcatttaatatttacatcacaacccatattccatccataaatctaaatcctaaaactccacataactggagacccagcatggcgtat

SEQ ID NO: 445859 - DNA, 140 bp, Artificial Sequence
  Synthetic
atacgccatgctgggtctccatgtcaccaccacattcaagagaaaacactttcgccctatgccagatgcatgcagagctgcatacaattggaagatggccggtgatcctagatatgaagacgtacttgggagtcggccat

SEQ ID NO: 445860 - DNA, 140 bp, Artificial Sequence
  Synthetic
atggccgactcccaagtacgtcttcatatctaggatcaccggccatcttccaattgtatgcagctctgcatgcatctggcatagggcgaaagtgttttctcttgaatgtggtggtgacatggagacccagcatggcgtat

SEQ ID NO: 445861 - DNA, 140 bp, Artificial Sequence
  Synthetic
aggccctggctgctgatatgcctgggttcggaaaagcatacaccatattcaacaaaaccttgatggaagcagatgctcattacaagtcagtccgaacctggaatgagatcatcccctccagaccttttgggacagcggtg

SEQ ID NO: 445862 - DNA, 140 bp, Artificial Sequence
  Synthetic
caccgctgtcccaaaaggtctggaggggatgatctcattccaggttcggactgacttgtaatgagcatctgcttccatcaaggttttgttgaatatggtgtatgcttttccgaacccaggcatatcagcagccagggcct

SEQ ID NO: 445863 - DNA, 140 bp, Artificial Sequence
  Synthetic
aggccctggctgctgatatgtgcttttcaccttgactatgagaaatggaacaatcatcaaagattggagtcgacagaagatgtgttttccgtcctagaccaggtgtttggactaaaaagggaccttttgggacagcggtg

SEQ ID NO: 445864 - DNA, 140 bp, Artificial Sequence
  Synthetic
caccgctgtcccaaaaggtccctttttagtccaaacacctggtctaggacggaaaacacatcttctgtcgactccaatctttgatgattgttccatttctcatagtcaaggtgaaaagcacatatcagcagccagggcct

SEQ ID NO: 445865 - DNA, 140 bp, Artificial Sequence
  Synthetic
atacgccatgctgggtctccattaagttagtgagttttagatgttttagttatttaagaaaatttgtttttgggtttggaaaagtatatattatatttaataagattttgatggaagttgcgtacttgggagtcggccat

SEQ ID NO: 445866 - DNA, 140 bp, Artificial Sequence
  Synthetic
atggccgactcccaagtacgcaacttccatcaaaatcttattaaatataatatatacttttccaaacccaaaaacaaattttcttaaataactaaaacatctaaaactcactaacttaatggagacccagcatggcgtat

SEQ ID NO: 445867 - DNA, 140 bp, Artificial Sequence
  Synthetic
atacgccatgctgggtctcccagttccaatcatcaagctcgccctaattcgttcgctgagtttctaagtaagacatactctagtgattcataaagaattgaacaacaggattgtaaacatcgtacttgggagtcggccat

SEQ ID NO: 445868 - DNA, 140 bp, Artificial Sequence
  Synthetic
atggccgactcccaagtacgatgtttacaatcctgttgttcaattctttatgaatcactagagtatgtcttacttagaaactcagcgaacgaattagggcgagcttgatgattggaactgggagacccagcatggcgtat

SEQ ID NO: 445869 - DNA, 140 bp, Artificial Sequence
  Synthetic
atacgccatgctgggtctccttttaatggtataatattaggatttgatggtaatgttttaattttagagatgtaattattttttttttagtaatatatggagttgttggtatttttggttcgtacttgggagtcggccat

SEQ ID NO: 445870 - DNA, 140 bp, Artificial Sequence
  Synthetic
atggccgactcccaagtacgaaccaaaaataccaacaactccatatattactaaaaaaaaaataattacatctctaaaattaaaacattaccatcaaatcctaatattataccattaaaaggagacccagcatggcgtat

SEQ ID NO: 445871 - DNA, 140 bp, Artificial Sequence
  Synthetic
aggccctggctgctgatatgttgtctcgagagggtcgattatgataaagcattcgggcgatatctggccaacacatattcctcttatctattcttccacgtgatcatcctttacatgaatgaccttttgggacagcggtg

SEQ ID NO: 445872 - DNA, 140 bp, Artificial Sequence
  Synthetic
caccgctgtcccaaaaggtcattcatgtaaaggatgatcacgtggaagaatagataagaggaatatgtgttggccagatatcgcccgaatgctttatcataatcgaccctctcgagacaacatatcagcagccagggcct

SEQ ID NO: 445873 - DNA, 140 bp, Artificial Sequence
  Synthetic
atacgccatgctgggtctccggattttaggagttgatttgggttttttgaattgggggaagtatgtattattgagtgtaggggttttgattgttttgatgttgataatttttttgatgatcgtacttgggagtcggccat

SEQ ID NO: 445874 - DNA, 140 bp, Artificial Sequence
  Synthetic
atggccgactcccaagtacgatcatcaaaaaaattatcaacatcaaaacaatcaaaacccctacactcaataatacatacttcccccaattcaaaaaacccaaatcaactcctaaaatccggagacccagcatggcgtat

SEQ ID NO: 445875 - DNA, 140 bp, Artificial Sequence
  Synthetic
aggccctggctgctgatatggtttggaaaggcatatactatattcaacaagaccttaatggaagctgatgctcattacaagtcaattcggacctggaacgagatcatcccctcaaaaggggaccttttgggacagcggtg

SEQ ID NO: 445876 - DNA, 140 bp, Artificial Sequence
  Synthetic
caccgctgtcccaaaaggtccccttttgaggggatgatctcgttccaggtccgaattgacttgtaatgagcatcagcttccattaaggtcttgttgaatatagtatatgcctttccaaaccatatcagcagccagggcct

SEQ ID NO: 445877 - DNA, 140 bp, Artificial Sequence
  Synthetic
atacgccatgctgggtctccgactttcagatggacgagggggaggaccccgccctcttgttccagtcgtacctagacaatattggagttcaaatggtcagacaaatgagatcaggagagacgtacttgggagtcggccat

SEQ ID NO: 445878 - DNA, 140 bp, Artificial Sequence
  Synthetic
atggccgactcccaagtacgtctctcctgatctcatttgtctgaccatttgaactccaatattgtctaggtacgactggaacaagagggcggggtcctccccctcgtccatctgaaagtcggagacccagcatggcgtat

SEQ ID NO: 445879 - DNA, 140 bp, Artificial Sequence
  Synthetic
atacgccatgctgggtctccttatgggaattatataagagtgggggtgagattggattgtgagagttggttgtttttttaatgatttaagttttgaagattatttttttttggggggtttcgtacttgggagtcggccat

SEQ ID NO: 445880 - DNA, 140 bp, Artificial Sequence
  Synthetic
atggccgactcccaagtacgaaaccccccaaaaaaaaataatcttcaaaacttaaatcattaaaaaaacaaccaactctcacaatccaatctcacccccactcttatataattcccataaggagacccagcatggcgtat

SEQ ID NO: 445881 - DNA, 140 bp, Artificial Sequence
  Synthetic
atacgccatgctgggtctccccagactgccaaccaggaactcaagaaaaagacaatgtctgtttcttctcagcgagaaagtaaatcatctaaagctaaaatggcggcccaaaccgcctcccgtacttgggagtcggccat

SEQ ID NO: 445882 - DNA, 140 bp, Artificial Sequence
  Synthetic
atggccgactcccaagtacgggaggcggtttgggccgccattttagctttagatgatttactttctcgctgagaagaaacagacattgtctttttcttgagttcctggttggcagtctggggagacccagcatggcgtat

SEQ ID NO: 445883 - DNA, 140 bp, Artificial Sequence
  Synthetic
atacgccatgctgggtctccagtaagattatgtagatttttataataggggagattttttagtagttttagtgattaatggtgtttttattttttaggaattgatattaatagttgtagacgtacttgggagtcggccat

SEQ ID NO: 445884 - DNA, 140 bp, Artificial Sequence
  Synthetic
atggccgactcccaagtacgtctacaactattaatatcaattcctaaaaaataaaaacaccattaatcactaaaactactaaaaaatctcccctattataaaaatctacataatcttactggagacccagcatggcgtat

SEQ ID NO: 445885 - DNA, 140 bp, Artificial Sequence
  Synthetic
atacgccatgctgggtctcctgtggaggctgaaattgctcaccagattgctgagagcttctctaagaagtacaaattcccctctcgatcatcagggatattcttgtataattttgagcagcgtacttgggagtcggccat

SEQ ID NO: 445886 - DNA, 140 bp, Artificial Sequence
  Synthetic
atggccgactcccaagtacgctgctcaaaattatacaagaatatccctgatgatcgagaggggaatttgtacttcttagagaagctctcagcaatctggtgagcaatttcagcctccacaggagacccagcatggcgtat

SEQ ID NO: 445887 - DNA, 140 bp, Artificial Sequence
  Synthetic
atacgccatgctgggtctccaattttttttttgtgaaggatataagtagtagtttataattattttgtgttttagtaaagtgtgtataattataaagtgttgggttatttaagttttttacgtacttgggagtcggccat

SEQ ID NO: 445888 - DNA, 140 bp, Artificial Sequence
  Synthetic
atggccgactcccaagtacgtaaaaaacttaaataacccaacactttataattatacacactttactaaaacacaaaataattataaactactacttatatccttcacaaaaaaaaaattggagacccagcatggcgtat

SEQ ID NO: 445889 - DNA, 140 bp, Artificial Sequence
  Synthetic
atacgccatgctgggtctcctggggtgggttgctctagccaactccaaaaagttccagctgttagttgagcctgacaagctaaacaaaataatgcaagacgacctgaatcgttatgtgttcgtacttgggagtcggccat

SEQ ID NO: 445890 - DNA, 140 bp, Artificial Sequence
  Synthetic
atggccgactcccaagtacgaacacataacgattcaggtcgtcttgcattattttgtttagcttgtcaggctcaactaacagctggaactttttggagttggctagagcaacccaccccaggagacccagcatggcgtat

SEQ ID NO: 445891 - DNA, 140 bp, Artificial Sequence
  Synthetic
atacgccatgctgggtctccattgatttaattgagttagaggttgaatttagaggaatttttattgtttttaatattttgaggaattttgattataattttaatttttttttgatagaagcgtacttgggagtcggccat

SEQ ID NO: 445892 - DNA, 140 bp, Artificial Sequence
  Synthetic
atggccgactcccaagtacgcttctatcaaaaaaaaattaaaattataatcaaaattcctcaaaatattaaaaacaataaaaattcctctaaattcaacctctaactcaattaaatcaatggagacccagcatggcgtat

SEQ ID NO: 445893 - DNA, 140 bp, Artificial Sequence
  Synthetic
atacgccatgctgggtctccctttctacgcaagatagtaaagaactgtagagatgaggacactcagaagccctctttcgtgtcggctcctccagatgatgatgacttgtggttaccccctcgtacttgggagtcggccat

SEQ ID NO: 445894 - DNA, 140 bp, Artificial Sequence
  Synthetic
atggccgactcccaagtacgagggggtaaccacaagtcatcatcatctggaggagccgacacgaaagagggcttctgagtgtcctcatctctacagttctttactatcttgcgtagaaagggagacccagcatggcgtat

SEQ ID NO: 445895 - DNA, 140 bp, Artificial Sequence
  Synthetic
atacgccatgctgggtctccttattttaagaaggtagatttgggtttttttaaggtgggtggaatggttgtatagttaatgatttttttttggttatatggtgtttattttgaatttaatcgtacttgggagtcggccat

SEQ ID NO: 445896 - DNA, 140 bp, Artificial Sequence
  Synthetic
atggccgactcccaagtacgattaaattcaaaataaacaccatataaccaaaaaaaaatcattaactatacaaccattccacccaccttaaaaaaacccaaatctaccttcttaaaataaggagacccagcatggcgtat

SEQ ID NO: 445897 - DNA, 140 bp, Artificial Sequence
  Synthetic
aggccctggctgctgatatgcaaacatatagtagatttggtaggagatacgtggcataagctcccgataacgcagatctttgaaattcctgaatcaatggatccatccgaaatactggatgaccttttgggacagcggtg

SEQ ID NO: 445898 - DNA, 140 bp, Artificial Sequence
  Synthetic
caccgctgtcccaaaaggtcatccagtatttcggatggatccattgattcaggaatttcaaagatctgcgttatcgggagcttatgccacgtatctcctaccaaatctactatatgtttgcatatcagcagccagggcct

SEQ ID NO: 445899 - DNA, 140 bp, Artificial Sequence
  Synthetic
aggccctggctgctgatatggggggtcgctgattgtgaccaaggatttcgtgtactctcagagttcgggctgtttctttgatagaaattacacactcatgctgaaggatctttttctgtcgaccttttgggacagcggtg

SEQ ID NO: 445900 - DNA, 140 bp, Artificial Sequence
  Synthetic
caccgctgtcccaaaaggtcgacagaaaaagatccttcagcatgagtgtgtaatttctatcaaagaaacagcccgaactctgagagtacacgaaatccttggtcacaatcagcgaccccccatatcagcagccagggcct

SEQ ID NO: 445901 - DNA, 140 bp, Artificial Sequence
  Synthetic
atacgccatgctgggtctcctttttttagagggagtgttaagttgttttgagagggttgattatgataatgtatttggaaggtattttgttaatatgtattttttttatttgtttttttacgtacttgggagtcggccat

SEQ ID NO: 445902 - DNA, 140 bp, Artificial Sequence
  Synthetic
atggccgactcccaagtacgtaaaaaaacaaataaaaaaaatacatattaacaaaataccttccaaatacattatcataatcaaccctctcaaaacaacttaacactccctctaaaaaaaggagacccagcatggcgtat

SEQ ID NO: 445903 - DNA, 140 bp, Artificial Sequence
  Synthetic
aggccctggctgctgatatgctcttatcttccagtgggctgattctaggggccctctagagggggaggagttagaatactctcaggaaattacctgggatgacgatgccgaatttgtcgggaccttttgggacagcggtg

SEQ ID NO: 445904 - DNA, 140 bp, Artificial Sequence
  Synthetic
caccgctgtcccaaaaggtcccgacaaattcggcatcgtcatcccaggtaatttcctgagagtattctaactcctccccctctagagggcccctagaatcagcccactggaagataagagcatatcagcagccagggcct

SEQ ID NO: 445905 - DNA, 140 bp, Artificial Sequence
  Synthetic
atacgccatgctgggtctcccttcctacgcaagatagtaaagaactgtagagatgaggacactcagaagccctctctcttgtcggcccctccagatgatgatgacttgtggttaccccctcgtacttgggagtcggccat

SEQ ID NO: 445906 - DNA, 140 bp, Artificial Sequence
  Synthetic
atggccgactcccaagtacgagggggtaaccacaagtcatcatcatctggaggggccgacaagagagagggcttctgagtgtcctcatctctacagttctttactatcttgcgtaggaagggagacccagcatggcgtat

SEQ ID NO: 445907 - DNA, 140 bp, Artificial Sequence
  Synthetic
atacgccatgctgggtctccgtaaagtttaaagattaaatatggggattgttgattgtgataaaggattttgtttatttttaaagttttaattgtttttttgatagaaattatatatttacgtacttgggagtcggccat

SEQ ID NO: 445908 - DNA, 140 bp, Artificial Sequence
  Synthetic
atggccgactcccaagtacgtaaatatataatttctatcaaaaaaacaattaaaactttaaaaataaacaaaatcctttatcacaatcaacaatccccatatttaatctttaaactttacggagacccagcatggcgtat

SEQ ID NO: 445909 - DNA, 140 bp, Artificial Sequence
  Synthetic
atacgccatgctgggtctcccttcaaacacaaaggtctgaggaggataaagactcttcaatgcttctggaatagtcaatttacatcctacaaattcctcaattgtttacctctggaggagcgtacttgggagtcggccat

SEQ ID NO: 445910 - DNA, 140 bp, Artificial Sequence
  Synthetic
atggccgactcccaagtacgctcctccagaggtaaacaattgaggaatttgtaggatgtaaattgactattccagaagcattgaagagtctttatcctcctcagacctttgtgtttgaagggagacccagcatggcgtat

SEQ ID NO: 445911 - DNA, 140 bp, Artificial Sequence
  Synthetic
atacgccatgctgggtctccgttgtatattgttggggattaagttttgtttatgtgtggaaattttggttatgaagttattaaaatattggagttatatgttgtgaatagtttagtttagcgtacttgggagtcggccat

SEQ ID NO: 445912 - DNA, 140 bp, Artificial Sequence
  Synthetic
atggccgactcccaagtacgctaaactaaactattcacaacatataactccaatattttaataacttcataaccaaaatttccacacataaacaaaacttaatccccaacaatatacaacggagacccagcatggcgtat

SEQ ID NO: 445913 - DNA, 140 bp, Artificial Sequence
  Synthetic
atacgccatgctgggtctcctttacattttaagcctctcggatgtgaaaaaaactatcaacatccctcaaaagacttaaggaaacatgatccctcaggctcttctgtttgtgccttttctcgtacttgggagtcggccat

SEQ ID NO: 445914 - DNA, 140 bp, Artificial Sequence
  Synthetic
atggccgactcccaagtacgagaaaaggcacaaacagaagagcctgagggatcatgtttccttaagtcttttgagggatgttgatagtttttttcacatccgagaggcttaaaatgtaaaggagacccagcatggcgtat

SEQ ID NO: 445915 - DNA, 140 bp, Artificial Sequence
  Synthetic
aggccctggctgctgatatgaagacttaaggaaacatgatccctcaggctcttctgtttgtgccttttctatttccctcgttgtgtctcgggaaattccccatctacaccataccggaaagaccttttgggacagcggtg

SEQ ID NO: 445916 - DNA, 140 bp, Artificial Sequence
  Synthetic
caccgctgtcccaaaaggtctttccggtatggtgtagatggggaatttcccgagacacaacgagggaaatagaaaaggcacaaacagaagagcctgagggatcatgtttccttaagtcttcatatcagcagccagggcct

SEQ ID NO: 445917 - DNA, 140 bp, Artificial Sequence
  Synthetic
atacgccatgctgggtctcctaagaaggttttttagggttttggattaatttgataatatatatgatttggtttttgtgtatggttgttataggtattgggggtatttatatatagattacgtacttgggagtcggccat

SEQ ID NO: 445918 - DNA, 140 bp, Artificial Sequence
  Synthetic
atggccgactcccaagtacgtaatctatatataaatacccccaatacctataacaaccatacacaaaaaccaaatcatatatattatcaaattaatccaaaaccctaaaaaaccttcttaggagacccagcatggcgtat

SEQ ID NO: 445919 - DNA, 140 bp, Artificial Sequence
  Synthetic
atacgccatgctgggtctcctttagatggggttttgataagtattttaagtggtatttggatttatgatttttagtttgagattattttttgattttttatattaaaatttaaatatggtcgtacttgggagtcggccat

SEQ ID NO: 445920 - DNA, 140 bp, Artificial Sequence
  Synthetic
atggccgactcccaagtacgaccatatttaaattttaatataaaaaatcaaaaaataatctcaaactaaaaatcataaatccaaataccacttaaaatacttatcaaaaccccatctaaaggagacccagcatggcgtat

SEQ ID NO: 445921 - DNA, 140 bp, Artificial Sequence
  Synthetic
atacgccatgctgggtctccggatgataaattatatttttttattagaatgagattagttttttggttgttagaaaattgaggggggtttgtttttagtgaaaaagttattattatggttcgtacttgggagtcggccat

SEQ ID NO: 445922 - DNA, 140 bp, Artificial Sequence
  Synthetic
atggccgactcccaagtacgaaccataataataactttttcactaaaaacaaacccccctcaattttctaacaaccaaaaaactaatctcattctaataaaaaaatataatttatcatccggagacccagcatggcgtat

SEQ ID NO: 445923 - DNA, 140 bp, Artificial Sequence
  Synthetic
aggccctggctgctgatatggaaggggaaagttttcttttagccatgtcgagaataatctacttagatccttctttgggaggagtgtctggaatgtctcttggaaggttccatatacgtcgaccttttgggacagcggtg

SEQ ID NO: 445924 - DNA, 140 bp, Artificial Sequence
  Synthetic
caccgctgtcccaaaaggtcgacgtatatggaaccttccaagagacattccagacactcctcccaaagaaggatctaagtagattattctcgacatggctaaaagaaaactttccccttccatatcagcagccagggcct

SEQ ID NO: 445925 - DNA, 140 bp, Artificial Sequence
  Synthetic
aggccctggctgctgatatggtcttgtctgtgtgcgggaactccggttatgaagttatcaaaatattggagccgtacgttgtgaacagcctagtccagagagcagaaaagttcaggcctcgaccttttgggacagcggtg

SEQ ID NO: 445926 - DNA, 140 bp, Artificial Sequence
  Synthetic
caccgctgtcccaaaaggtcgaggcctgaacttttctgctctctggactaggctgttcacaacgtacggctccaatattttgataacttcataaccggagttcccgcacacagacaagaccatatcagcagccagggcct

SEQ ID NO: 445927 - DNA, 140 bp, Artificial Sequence
  Synthetic
atacgccatgctgggtctcctggatgaaaggggcttatataagtctctaaaaggggcatgtaaacttaagctgtgcggagttcctggacttagacttatggatggaacgtgggtcgctatcgtacttgggagtcggccat

SEQ ID NO: 445928 - DNA, 140 bp, Artificial Sequence
  Synthetic
atggccgactcccaagtacgatagcgacccacgttccatccataagtctaagtccaggaactccgcacagcttaagtttacatgccccttttagagacttatataagcccctttcatccaggagacccagcatggcgtat

SEQ ID NO: 445929 - DNA, 140 bp, Artificial Sequence
  Synthetic
atacgccatgctgggtctccttagaatcctgcggcacattttgaagtcattcgacgagatctattctggaaatcaaagaatgatcgggttggttaaagttgttgttggacttgcactgtccgtacttgggagtcggccat

SEQ ID NO: 445930 - DNA, 140 bp, Artificial Sequence
  Synthetic
atggccgactcccaagtacggacagtgcaagtccaacaacaactttaaccaacccgatcattctttgatttccagaatagatctcgtcgaatgacttcaaaatgtgccgcaggattctaaggagacccagcatggcgtat

SEQ ID NO: 445931 - DNA, 140 bp, Artificial Sequence
  Synthetic
atacgccatgctgggtctccatatatgtattttatttggattatgaaaagtggaataattattaaagattagagttaatagaggatgtattttttgttttagattaagtgtttggattgacgtacttgggagtcggccat

SEQ ID NO: 445932 - DNA, 140 bp, Artificial Sequence
  Synthetic
atggccgactcccaagtacgtcaatccaaacacttaatctaaaacaaaaaatacatcctctattaactctaatctttaataattattccacttttcataatccaaataaaatacatatatggagacccagcatggcgtat

SEQ ID NO: 445933 - DNA, 140 bp, Artificial Sequence
  Synthetic
atacgccatgctgggtctcctttagatgtgtttaatggtttaatttgttggaatggttaggatggtgggttagaaggtttatggtagaagggttggagtttagttagtttattgatgatacgtacttgggagtcggccat

SEQ ID NO: 445934 - DNA, 140 bp, Artificial Sequence
  Synthetic
atggccgactcccaagtacgtatcatcaataaactaactaaactccaacccttctaccataaaccttctaacccaccatcctaaccattccaacaaattaaaccattaaacacatctaaaggagacccagcatggcgtat

SEQ ID NO: 445935 - DNA, 140 bp, Artificial Sequence
  Synthetic
atacgccatgctgggtctccaagaggggtttttttatgaattggagagtatattaaggaatgtatttttgatatatagagttgttgaggaaggggtatttaaattagggttgattattaacgtacttgggagtcggccat

SEQ ID NO: 445936 - DNA, 140 bp, Artificial Sequence
  Synthetic
atggccgactcccaagtacgttaataatcaaccctaatttaaataccccttcctcaacaactctatatatcaaaaatacattccttaatatactctccaattcataaaaaaacccctcttggagacccagcatggcgtat

SEQ ID NO: 445937 - DNA, 140 bp, Artificial Sequence
  Synthetic
aggccctggctgctgatatgtttcacctggactatgagaaatggaataatcatcagcggttggaatcgaccgaagatgtattttccgtacttgatcaagtgtttggactgaaaagggtgtgaccttttgggacagcggtg

SEQ ID NO: 445938 - DNA, 140 bp, Artificial Sequence
  Synthetic
caccgctgtcccaaaaggtcacacccttttcagtccaaacacttgatcaagtacggaaaatacatcttcggtcgattccaaccgctgatgattattccatttctcatagtccaggtgaaacatatcagcagccagggcct

SEQ ID NO: 445939 - DNA, 140 bp, Artificial Sequence
  Synthetic
atacgccatgctgggtctccgttttttgtgtttttaatgattaaatagttaattttgttaatataatgttgatagtgtttattaatgtgttaatagtggtataatatttttaatttttgacgtacttgggagtcggccat

SEQ ID NO: 445940 - DNA, 140 bp, Artificial Sequence
  Synthetic
atggccgactcccaagtacgtcaaaaattaaaaatattataccactattaacacattaataaacactatcaacattatattaacaaaattaactatttaatcattaaaaacacaaaaaacggagacccagcatggcgtat

SEQ ID NO: 445941 - DNA, 140 bp, Artificial Sequence
  Synthetic
atacgccatgctgggtctccaaagcatacaaatcagttttatcaggcatgaatgccgccaaacttgatccggatgatgtatgctcctacttggcagcagcaatgcagttctttgaggggacgtacttgggagtcggccat

SEQ ID NO: 445942 - DNA, 140 bp, Artificial Sequence
  Synthetic
atggccgactcccaagtacgtcccctcaaagaactgcattgctgctgccaagtaggagcatacatcatccggatcaagtttggcggcattcatgcctgataaaactgatttgtatgctttggagacccagcatggcgtat

SEQ ID NO: 445943 - DNA, 140 bp, Artificial Sequence
  Synthetic
atacgccatgctgggtctcctgttgaaggggagagtttttttttagttatgttaaggataatttatttagatttttttttgggaggggtatttggaatgttttttggaagattttatatacgtacttgggagtcggccat

SEQ ID NO: 445944 - DNA, 140 bp, Artificial Sequence
  Synthetic
atggccgactcccaagtacgtatataaaatcttccaaaaaacattccaaatacccctcccaaaaaaaaatctaaataaattatccttaacataactaaaaaaaaactctccccttcaacaggagacccagcatggcgtat

SEQ ID NO: 445945 - DNA, 140 bp, Artificial Sequence
  Synthetic
atacgccatgctgggtctccctcttatcttccagtgggctgactctaggggccctctagaaggggaggagttagaatactctcaggagattacctgggacgacgatgccgaatttgttggcgtacttgggagtcggccat

SEQ ID NO: 445946 - DNA, 140 bp, Artificial Sequence
  Synthetic
atggccgactcccaagtacgccaacaaattcggcatcgtcgtcccaggtaatctcctgagagtattctaactcctccccttctagagggcccctagagtcagcccactggaagataagagggagacccagcatggcgtat

SEQ ID NO: 445947 - DNA, 140 bp, Artificial Sequence
  Synthetic
aggccctggctgctgatatgagatcagtttgacaatatacatgacttggtctttgtgtacggctgttacaggcattggggccatccttacatagattacagaaaggggctttcgaaactagaccttttgggacagcggtg

SEQ ID NO: 445948 - DNA, 140 bp, Artificial Sequence
  Synthetic
caccgctgtcccaaaaggtctagtttcgaaagcccctttctgtaatctatgtaaggatggccccaatgcctgtaacagccgtacacaaagaccaagtcatgtatattgtcaaactgatctcatatcagcagccagggcct

SEQ ID NO: 445949 - DNA, 140 bp, Artificial Sequence
  Synthetic
atacgccatgctgggtctccgaaatttagattttggagagagaatatttgagagttttatttgttttttagaagattttattattttaaatattagaggaggggttagttttattattttcgtacttgggagtcggccat

SEQ ID NO: 445950 - DNA, 140 bp, Artificial Sequence
  Synthetic
atggccgactcccaagtacgaaaataataaaactaacccctcctctaatatttaaaataataaaatcttctaaaaaacaaataaaactctcaaatattctctctccaaaatctaaatttcggagacccagcatggcgtat

SEQ ID NO: 445951 - DNA, 140 bp, Artificial Sequence
  Synthetic
atacgccatgctgggtctccaattttatattttttttaatatttgttgagtttttgtttttttgattttttagtgagttatttagtttgttttttttgggaatttttgagttaattattgcgtacttgggagtcggccat

SEQ ID NO: 445952 - DNA, 140 bp, Artificial Sequence
  Synthetic
atggccgactcccaagtacgcaataattaactcaaaaattcccaaaaaaaacaaactaaataactcactaaaaaatcaaaaaaacaaaaactcaacaaatattaaaaaaaatataaaattggagacccagcatggcgtat

SEQ ID NO: 445953 - DNA, 140 bp, Artificial Sequence
  Synthetic
aggccctggctgctgatatgaaactaatgttagaatggttgaagacaggaaataggcctctccggataactttaacagacaattgctctaggtcttacaaaattttgaaggattatttcagaccttttgggacagcggtg

SEQ ID NO: 445954 - DNA, 140 bp, Artificial Sequence
  Synthetic
caccgctgtcccaaaaggtctgaaataatccttcaaaattttgtaagacctagagcaattgtctgttaaagttatccggagaggcctatttcctgtcttcaaccattctaacattagtttcatatcagcagccagggcct

SEQ ID NO: 445955 - DNA, 140 bp, Artificial Sequence
  Synthetic
atacgccatgctgggtctccttggatgatttagatattttagagggttgggggggtgtggttttgttttttagagagggtagatttatttagggagattttttggggaagaaaagtggtacgtacttgggagtcggccat

SEQ ID NO: 445956 - DNA, 140 bp, Artificial Sequence
  Synthetic
atggccgactcccaagtacgtaccacttttcttccccaaaaaatctccctaaataaatctaccctctctaaaaaacaaaaccacacccccccaaccctctaaaatatctaaatcatccaaggagacccagcatggcgtat

SEQ ID NO: 445957 - DNA, 140 bp, Artificial Sequence
  Synthetic
atacgccatgctgggtctccgaagtgtataaccgacttggctcagttctattccaagtcttcccccatagaaaagctgttaaattacacactcggaaatcgagggctgaggatccccccacgtacttgggagtcggccat

SEQ ID NO: 445958 - DNA, 140 bp, Artificial Sequence
  Synthetic
atggccgactcccaagtacgtggggggatcctcagccctcgatttccgagtgtgtaatttaacagcttttctatgggggaagacttggaatagaactgagccaagtcggttatacacttcggagacccagcatggcgtat

SEQ ID NO: 445959 - DNA, 140 bp, Artificial Sequence
  Synthetic
atacgccatgctgggtctccttgtattagtatttttgttttttgattagttatttttttgtatggggtttttaaaggggtatttgggtttgtttatttttatgttgatttagttattttacgtacttgggagtcggccat

SEQ ID NO: 445960 - DNA, 140 bp, Artificial Sequence
  Synthetic
atggccgactcccaagtacgtaaaataactaaatcaacataaaaataaacaaacccaaatacccctttaaaaaccccatacaaaaaaataactaatcaaaaaacaaaaatactaatacaaggagacccagcatggcgtat

SEQ ID NO: 445961 - DNA, 140 bp, Artificial Sequence
  Synthetic
atacgccatgctgggtctccccctttacatgaacgccttggactgggatgaggagaagaccattctagcactgtggagggatttaacctcaatagatataggaaaggacttggtcaagttcgtacttgggagtcggccat

SEQ ID NO: 445962 - DNA, 140 bp, Artificial Sequence
  Synthetic
atggccgactcccaagtacgaacttgaccaagtcctttcctatatctattgaggttaaatccctccacagtgctagaatggtcttctcctcatcccagtccaaggcgttcatgtaaagggggagacccagcatggcgtat

SEQ ID NO: 445963 - DNA, 140 bp, Artificial Sequence
  Synthetic
atacgccatgctgggtctccattttaattaggaatattgtgtttttgataggttttgatttttttttagaggaggtttttgtttttaaaaggatggggttagttttgtataggtttaagtcgtacttgggagtcggccat

SEQ ID NO: 445964 - DNA, 140 bp, Artificial Sequence
  Synthetic
atggccgactcccaagtacgacttaaacctatacaaaactaaccccatccttttaaaaacaaaaacctcctctaaaaaaaaatcaaaacctatcaaaaacacaatattcctaattaaaatggagacccagcatggcgtat

SEQ ID NO: 445965 - DNA, 140 bp, Artificial Sequence
  Synthetic
atacgccatgctgggtctccgacctttttttgtctcggttcaactctctaatgattctcctttctcctccggaacccagatattcagacgacctgatatcccagctgtgtcagctatatacgtacttgggagtcggccat

SEQ ID NO: 445966 - DNA, 140 bp, Artificial Sequence
  Synthetic
atggccgactcccaagtacgtatatagctgacacagctgggatatcaggtcgtctgaatatctgggttccggaggagaaaggagaatcattagagagttgaaccgagacaaaaaaaggtcggagacccagcatggcgtat

SEQ ID NO: 445967 - DNA, 140 bp, Artificial Sequence
  Synthetic
atacgccatgctgggtctccgaagaattatgattttatgttttagttattgatgttttatgtatagatatggatattagagttggtatagagagatataaggttaagagattttatgtttcgtacttgggagtcggccat

SEQ ID NO: 445968 - DNA, 140 bp, Artificial Sequence
  Synthetic
atggccgactcccaagtacgaaacataaaatctcttaaccttatatctctctataccaactctaatatccatatctatacataaaacatcaataactaaaacataaaatcataattcttcggagacccagcatggcgtat

SEQ ID NO: 445969 - DNA, 140 bp, Artificial Sequence
  Synthetic
atacgccatgctgggtctccattcatgagtcaagagactttcattaatcatctcaatcgatcagatgtggtcaggtagagtgtaatattctgggaaatcttctagcagtttctgtgaccacgtacttgggagtcggccat

SEQ ID NO: 445970 - DNA, 140 bp, Artificial Sequence
  Synthetic
atggccgactcccaagtacgtggtcacagaaactgctagaagatttcccagaatattacactctacctgaccacatctgatcgattgagatgattaatgaaagtctcttgactcatgaatggagacccagcatggcgtat

SEQ ID NO: 445971 - DNA, 140 bp, Artificial Sequence
  Synthetic
atacgccatgctgggtctcctcagtccaagaacaagtaaatatgtcctatgacctcatcatttgtgatgcagaggtcactgacattgcatcaatcaaccgaataaccctgctaatgtctgcgtacttgggagtcggccat

SEQ ID NO: 445972 - DNA, 140 bp, Artificial Sequence
  Synthetic
atggccgactcccaagtacgcagacattagcagggttattcggttgattgatgcaatgtcagtgacctctgcatcacaaatgatgaggtcataggacatatttacttgttcttggactgaggagacccagcatggcgtat

SEQ ID NO: 445973 - DNA, 140 bp, Artificial Sequence
  Synthetic
atacgccatgctgggtctccagaggatgtattttctgtacttgatcaagtgtttggattgaagaaggtgttctccaggacccatgagttttttcagaagtcttggatctattactcagaccgtacttgggagtcggccat

SEQ ID NO: 445974 - DNA, 140 bp, Artificial Sequence
  Synthetic
atggccgactcccaagtacggtctgagtaatagatccaagacttctgaaaaaactcatgggtcctggagaacaccttcttcaatccaaacacttgatcaagtacagaaaatacatcctctggagacccagcatggcgtat

SEQ ID NO: 445975 - DNA, 140 bp, Artificial Sequence
  Synthetic
atacgccatgctgggtctccaaggttttttttagagattatttgagagggtttgtaaggggagtattgataggatttttgatttgttttttgatgagaatgataaatattaatattaatacgtacttgggagtcggccat

SEQ ID NO: 445976 - DNA, 140 bp, Artificial Sequence
  Synthetic
atggccgactcccaagtacgtattaatattaatatttatcattctcatcaaaaaacaaatcaaaaatcctatcaatactccccttacaaaccctctcaaataatctctaaaaaaaaccttggagacccagcatggcgtat

SEQ ID NO: 445977 - DNA, 140 bp, Artificial Sequence
  Synthetic
atacgccatgctgggtctccagagatattttttattttttagaaaatttttgttgtttatttaattattatgaaagaaggtaatagattaattttgtgttatttttaatatgtgttatgtcgtacttgggagtcggccat

SEQ ID NO: 445978 - DNA, 140 bp, Artificial Sequence
  Synthetic
atggccgactcccaagtacgacataacacatattaaaaataacacaaaattaatctattaccttctttcataataattaaataaacaacaaaaattttctaaaaaataaaaaatatctctggagacccagcatggcgtat

SEQ ID NO: 445979 - DNA, 140 bp, Artificial Sequence
  Synthetic
atacgccatgctgggtctccagaggagggccggtccccagcgagaaggtcattatcactgctctttccaagcctcctgtcaaccccagggaatttctgaaatctatagacctgggaggatcgtacttgggagtcggccat

SEQ ID NO: 445980 - DNA, 140 bp, Artificial Sequence
  Synthetic
atggccgactcccaagtacgatcctcccaggtctatagatttcagaaattccctggggttgacaggaggcttggaaagagcagtgataatgaccttctcgctggggaccggccctcctctggagacccagcatggcgtat

SEQ ID NO: 445981 - DNA, 140 bp, Artificial Sequence
  Synthetic
atacgccatgctgggtctccattagttttattttttattttagagggttgagagaaatttatttaagagtatgagagataatttgtgataattgagttttttgatgaggtaggtgttgggcgtacttgggagtcggccat

SEQ ID NO: 445982 - DNA, 140 bp, Artificial Sequence
  Synthetic
atggccgactcccaagtacgcccaacacctacctcatcaaaaaactcaattatcacaaattatctctcatactcttaaataaatttctctcaaccctctaaaataaaaaataaaactaatggagacccagcatggcgtat

SEQ ID NO: 445983 - DNA, 140 bp, Artificial Sequence
  Synthetic
aggccctggctgctgatatgttttgtcatcacagaaaagctcctagccaattatatcttgccactttttgacgcactgactatgacagacaacttgaacaaagtgtttaaaaagctgatcgaccttttgggacagcggtg

SEQ ID NO: 445984 - DNA, 140 bp, Artificial Sequence
  Synthetic
caccgctgtcccaaaaggtcgatcagctttttaaacactttgttcaagttgtctgtcatagtcagtgcgtcaaaaagtggcaagatataattggctaggagcttttctgtgatgacaaaacatatcagcagccagggcct

SEQ ID NO: 445985 - DNA, 140 bp, Artificial Sequence
  Synthetic
atacgccatgctgggtctccgtagttagaattatgattggagattatagttttaataagaaggtgttttgtaaggtaggatgtttagaatgggtttgttttgtttaataggttgtagtttcgtacttgggagtcggccat

SEQ ID NO: 445986 - DNA, 140 bp, Artificial Sequence
  Synthetic
atggccgactcccaagtacgaaactacaacctattaaacaaaacaaacccattctaaacatcctaccttacaaaacaccttcttattaaaactataatctccaatcataattctaactacggagacccagcatggcgtat

SEQ ID NO: 445987 - DNA, 140 bp, Artificial Sequence
  Synthetic
atacgccatgctgggtctccggtaattggtgtttattataagtttaagtttattttagatgattttaatgtttttttatttttttgttttgtagttggggatgggttaggggggatattacgtacttgggagtcggccat

SEQ ID NO: 445988 - DNA, 140 bp, Artificial Sequence
  Synthetic
atggccgactcccaagtacgtaatatcccccctaacccatccccaactacaaaacaaaaaaataaaaaaacattaaaatcatctaaaataaacttaaacttataataaacaccaattaccggagacccagcatggcgtat

SEQ ID NO: 445989 - DNA, 140 bp, Artificial Sequence
  Synthetic
atacgccatgctgggtctccatctcaaaccaggaacacaagaactaaaatactagctcagggagacaaccaagttctgtgtccgacatatatgctgtcgccggggctctctcgagaggggcgtacttgggagtcggccat

SEQ ID NO: 445990 - DNA, 140 bp, Artificial Sequence
  Synthetic
atggccgactcccaagtacgcccctctcgagagagccccggcgacagcatatatgtcggacacagaacttggttgtctccctgagctagtattttagttcttgtgttcctggtttgagatggagacccagcatggcgtat

SEQ ID NO: 445991 - DNA, 140 bp, Artificial Sequence
  Synthetic
atacgccatgctgggtctcctagtaattatgaggggaggaaatgatattgtttttagagtgatagattttgatttaatttgggaaaaattgtttgatttgagaaatttggttatttggaacgtacttgggagtcggccat

SEQ ID NO: 445992 - DNA, 140 bp, Artificial Sequence
  Synthetic
atggccgactcccaagtacgttccaaataaccaaatttctcaaatcaaacaatttttcccaaattaaatcaaaatctatcactctaaaaacaatatcatttcctcccctcataattactaggagacccagcatggcgtat

SEQ ID NO: 445993 - DNA, 140 bp, Artificial Sequence
  Synthetic
aggccctggctgctgatatgagaccatgtgtagctatgactttctcatctatgggaaaactcctttatttcgaggtaacatcttggtgcctgagtccaaaagatgggctagggtctcctggaccttttgggacagcggtg

SEQ ID NO: 445994 - DNA, 140 bp, Artificial Sequence
  Synthetic
caccgctgtcccaaaaggtccaggagaccctagcccatcttttggactcaggcaccaagatgttacctcgaaataaaggagttttcccatagatgagaaagtcatagctacacatggtctcatatcagcagccagggcct

SEQ ID NO: 445995 - DNA, 140 bp, Artificial Sequence
  Synthetic
atacgccatgctgggtctccttaatgtttgattttgtattgtttatagatggattattttatttggtttttaaaatttatgggattatgttagtaaatttaaattataaggttatttaatcgtacttgggagtcggccat

SEQ ID NO: 445996 - DNA, 140 bp, Artificial Sequence
  Synthetic
atggccgactcccaagtacgattaaataaccttataatttaaatttactaacataatcccataaattttaaaaaccaaataaaataatccatctataaacaatacaaaatcaaacattaaggagacccagcatggcgtat

SEQ ID NO: 445997 - DNA, 140 bp, Artificial Sequence
  Synthetic
atacgccatgctgggtctccatgagggacttcctgcttatgtcagtacaagctgtcttccattacttgctgtttagccccatcttgaaaggcagagtttacaagatcctgggtgccgaggcgtacttgggagtcggccat

SEQ ID NO: 445998 - DNA, 140 bp, Artificial Sequence
  Synthetic
atggccgactcccaagtacgcctcggcacccaggatcttgtaaactctgcctttcaagatggggctaaacagcaagtaatggaagacagcttgtactgacataagcaggaagtccctcatggagacccagcatggcgtat

SEQ ID NO: 445999 - DNA, 140 bp, Artificial Sequence
  Synthetic
atacgccatgctgggtctccttttagagatgttgagtatttgattttttttattttttgagaaatgagttttgtgttatttaattgtagtagttttaagagtgagatgtagagagtttgtcgtacttgggagtcggccat

SEQ ID NO: 446000 - DNA, 140 bp, Artificial Sequence
  Synthetic
atggccgactcccaagtacgacaaactctctacatctcactcttaaaactactacaattaaataacacaaaactcatttctcaaaaaataaaaaaaatcaaatactcaacatctctaaaaggagacccagcatggcgtat

SEQ ID NO: 446001 - DNA, 140 bp, Artificial Sequence
  Synthetic
aggccctggctgctgatatgttggggggagtatctggaatgtctcttggaaggttccacatacgtcagttctcagatcctgtctcagaagggttgtccttctggagagagatatggctgagaccttttgggacagcggtg

SEQ ID NO: 446002 - DNA, 140 bp, Artificial Sequence
  Synthetic
caccgctgtcccaaaaggtctcagccatatctctctccagaaggacaacccttctgagacaggatctgagaactgacgtatgtggaaccttccaagagacattccagatactccccccaacatatcagcagccagggcct

SEQ ID NO: 446003 - DNA, 140 bp, Artificial Sequence
  Synthetic
atacgccatgctgggtctcctttttttagtttataagatggtggatgattttgagttatagaggggaattttgtttaaagtggttattattatagttattatgatagttttttttaatagcgtacttgggagtcggccat

SEQ ID NO: 446004 - DNA, 140 bp, Artificial Sequence
  Synthetic
atggccgactcccaagtacgctattaaaaaaaactatcataataactataataataaccactttaaacaaaattcccctctataactcaaaatcatccaccatcttataaactaaaaaaaggagacccagcatggcgtat

SEQ ID NO: 446005 - DNA, 140 bp, Artificial Sequence
  Synthetic
atacgccatgctgggtctcctactaccctaaacattaaaggaggggccagtcctaccattcttctcaaagatgcgatcagaaaagccttgtatgatgaggtagacaaggtggagaactcacgtacttgggagtcggccat

SEQ ID NO: 446006 - DNA, 140 bp, Artificial Sequence
  Synthetic
atggccgactcccaagtacgtgagttctccaccttgtctacctcatcatacaaggcttttctgatcgcatctttgagaagaatggtaggactggcccctcctttaatgtttagggtagtaggagacccagcatggcgtat

SEQ ID NO: 446007 - DNA, 140 bp, Artificial Sequence
  Synthetic
atacgccatgctgggtctcctatttatttattgttttaggtgatgtttttagttttgtaagattttatgatttgtataatagatttataatttattattttagaaagtaagttattttagcgtacttgggagtcggccat

SEQ ID NO: 446008 - DNA, 140 bp, Artificial Sequence
  Synthetic
atggccgactcccaagtacgctaaaataacttactttctaaaataataaattataaatctattatacaaatcataaaatcttacaaaactaaaaacatcacctaaaacaataaataaataggagacccagcatggcgtat

SEQ ID NO: 446009 - DNA, 140 bp, Artificial Sequence
  Synthetic
atacgccatgctgggtctccgatttataagatagtgaagattattagatttgttggtagtattaaggatttatttggagaagtggaaagatatttttataggtataataggtggattattcgtacttgggagtcggccat

SEQ ID NO: 446010 - DNA, 140 bp, Artificial Sequence
  Synthetic
atggccgactcccaagtacgaataatccacctattatacctataaaaatatctttccacttctccaaataaatccttaatactaccaacaaatctaataatcttcactatcttataaatcggagacccagcatggcgtat

SEQ ID NO: 446011 - DNA, 140 bp, Artificial Sequence
  Synthetic
atacgccatgctgggtctcctattggatatttttggaagtttgtttatgttaagatttttgtgtgatgtattttgaaaaaaataagattttaaatttgaatttttagttgtttgattgttcgtacttgggagtcggccat

SEQ ID NO: 446012 - DNA, 140 bp, Artificial Sequence
  Synthetic
atggccgactcccaagtacgaacaatcaaacaactaaaaattcaaatttaaaatcttatttttttcaaaatacatcacacaaaaatcttaacataaacaaacttccaaaaatatccaataggagacccagcatggcgtat

SEQ ID NO: 446013 - DNA, 140 bp, Artificial Sequence
  Synthetic
atacgccatgctgggtctccggtttagatttaagattttgttttttttaaaatatattatataagagttttagtatgggtaggtttttaggagtatttgatgtataggtaattgtagtttcgtacttgggagtcggccat

SEQ ID NO: 446014 - DNA, 140 bp, Artificial Sequence
  Synthetic
atggccgactcccaagtacgaaactacaattacctatacatcaaatactcctaaaaacctacccatactaaaactcttatataatatattttaaaaaaaacaaaatcttaaatctaaaccggagacccagcatggcgtat

SEQ ID NO: 446015 - DNA, 140 bp, Artificial Sequence
  Synthetic
atacgccatgctgggtctcccaaatccgtaagcttcagacgtctcagccacttgagaaaacttgttcctgggtttggaaaggcatatactatattcaacaagaccttgatggaagctgatcgtacttgggagtcggccat

SEQ ID NO: 446016 - DNA, 140 bp, Artificial Sequence
  Synthetic
atggccgactcccaagtacgatcagcttccatcaaggtcttgttgaatatagtatatgcctttccaaacccaggaacaagttttctcaagtggctgagacgtctgaagcttacggatttgggagacccagcatggcgtat

SEQ ID NO: 446017 - DNA, 140 bp, Artificial Sequence
  Synthetic
aggccctggctgctgatatgctatagattgtgtatgtccatcatggaaaaaactaacacccctcctttcgaaccatcccaaatatgagcaagatctttgtcaatccgagtgcaataagaggaccttttgggacagcggtg

SEQ ID NO: 446018 - DNA, 140 bp, Artificial Sequence
  Synthetic
caccgctgtcccaaaaggtcctcttattgcactcggattgacaaagatcttgctcatatttgggatggttcgaaaggaggggtgttagttttttccatgatggacatacacaatctatagcatatcagcagccagggcct

SEQ ID NO: 446019 - DNA, 140 bp, Artificial Sequence
  Synthetic
atacgccatgctgggtctcctgagtttggtagtttttattattttgtaaattaatttgatttagtgagatgatagatttaggttagaattataggttatttttttgaatattgaggtgttcgtacttgggagtcggccat

SEQ ID NO: 446020 - DNA, 140 bp, Artificial Sequence
  Synthetic
atggccgactcccaagtacgaacacctcaatattcaaaaaaataacctataattctaacctaaatctatcatctcactaaatcaaattaatttacaaaataataaaaactaccaaactcaggagacccagcatggcgtat

SEQ ID NO: 446021 - DNA, 140 bp, Artificial Sequence
  Synthetic
aggccctggctgctgatatgtacagtgaaggggggtactcttcagtttgtccaaatctcctctctcacatctctgtcagtacagacacgatgtctgatttgactcatgatgggataaattgaccttttgggacagcggtg

SEQ ID NO: 446022 - DNA, 140 bp, Artificial Sequence
  Synthetic
caccgctgtcccaaaaggtcaatttatcccatcatgagtcaaatcagacatcgtgtctgtactgacagagatgtgagagaggagatttggacaaactgaagagtaccccccttcactgtacatatcagcagccagggcct

SEQ ID NO: 446023 - DNA, 140 bp, Artificial Sequence
  Synthetic
atacgccatgctgggtctccttagggatgttatttaaagtagtagatagatatattatagtattgtaatatatgttgaagtgttttaggattttgggattagatggtggatagaataaggcgtacttgggagtcggccat

SEQ ID NO: 446024 - DNA, 140 bp, Artificial Sequence
  Synthetic
atggccgactcccaagtacgccttattctatccaccatctaatcccaaaatcctaaaacacttcaacatatattacaatactataatatatctatctactactttaaataacatccctaaggagacccagcatggcgtat

SEQ ID NO: 446025 - DNA, 140 bp, Artificial Sequence
  Synthetic
atacgccatgctgggtctcctcttcgatgtaacaagtgcataaggcccatcgatgatatcacccttgatacctctcagatcttcgagttcccagatgtctcaagaaggatatctaggatgcgtacttgggagtcggccat

SEQ ID NO: 446026 - DNA, 140 bp, Artificial Sequence
  Synthetic
atggccgactcccaagtacgcatcctagatatccttcttgagacatctgggaactcgaagatctgagaggtatcaagggtgatatcatcgatgggccttatgcacttgttacatcgaagaggagacccagcatggcgtat

SEQ ID NO: 446027 - DNA, 140 bp, Artificial Sequence
  Synthetic
aggccctggctgctgatatgcctctcagatcttcgagttcccagatgtctcaagaaggatatctaggatggtttctggagctgtgcctcatttcagaaagcttcctgatattcgtttgaggaccttttgggacagcggtg

SEQ ID NO: 446028 - DNA, 140 bp, Artificial Sequence
  Synthetic
caccgctgtcccaaaaggtcctcaaacgaatatcaggaagctttctgaaatgaggcacagctccagaaaccatcctagatatccttcttgagacatctgggaactcgaagatctgagaggcatatcagcagccagggcct

SEQ ID NO: 446029 - DNA, 140 bp, Artificial Sequence
  Synthetic
atacgccatgctgggtctccaagattatttattattttgtggattagaaaagattttatattattgttaattagagttatgattattttattgtaaggatttgatatgatttttttaggacgtacttgggagtcggccat

SEQ ID NO: 446030 - DNA, 140 bp, Artificial Sequence
  Synthetic
atggccgactcccaagtacgtcctaaaaaaatcatatcaaatccttacaataaaataatcataactctaattaacaataatataaaatcttttctaatccacaaaataataaataatcttggagacccagcatggcgtat

SEQ ID NO: 446031 - DNA, 140 bp, Artificial Sequence
  Synthetic
aggccctggctgctgatatggggtataatgatggaaccattttccctgtcaacatatatagcaaggtctcccctagagactatttgagagggcttgcgagaggagtcttgatagggtcctgaccttttgggacagcggtg

SEQ ID NO: 446032 - DNA, 140 bp, Artificial Sequence
  Synthetic
caccgctgtcccaaaaggtcaggaccctatcaagactcctctcgcaagccctctcaaatagtctctaggggagaccttgctatatatgttgacagggaaaatggttccatcattataccccatatcagcagccagggcct

SEQ ID NO: 446033 - DNA, 140 bp, Artificial Sequence
  Synthetic
atacgccatgctgggtctcctggaagaggttaagtatttagtatttttgaaaaattttttttgtttggagaattgaaggtagagtttagatgaaaaagatgaagttatttgggtgataaacgtacttgggagtcggccat

SEQ ID NO: 446034 - DNA, 140 bp, Artificial Sequence
  Synthetic
atggccgactcccaagtacgtttatcacccaaataacttcatctttttcatctaaactctaccttcaattctccaaacaaaaaaaatttttcaaaaatactaaatacttaacctcttccaggagacccagcatggcgtat

SEQ ID NO: 446035 - DNA, 140 bp, Artificial Sequence
  Synthetic
atacgccatgctgggtctccaacctacgacagatgagctctctcatgagacaagtgttgggcgggcatggcgaagacgccttggaatcagacgaggacattcagaggttgttgaaggactcgtacttgggagtcggccat

SEQ ID NO: 446036 - DNA, 140 bp, Artificial Sequence
  Synthetic
atggccgactcccaagtacgagtccttcaacaacctctgaatgtcctcgtctgattccaaggcgtcttcgccatgcccgcccaacacttgtctcatgagagagctcatctgtcgtaggttggagacccagcatggcgtat

SEQ ID NO: 446037 - DNA, 140 bp, Artificial Sequence
  Synthetic
atacgccatgctgggtctccttatttatagataatgtaaaattggatattaatagggttatttggttgatagatgtaatgttagtaatttttgtattgtaaataatgaggttataggatacgtacttgggagtcggccat

SEQ ID NO: 446038 - DNA, 140 bp, Artificial Sequence
  Synthetic
atggccgactcccaagtacgtatcctataacctcattatttacaatacaaaaattactaacattacatctatcaaccaaataaccctattaatatccaattttacattatctataaataaggagacccagcatggcgtat

SEQ ID NO: 446039 - DNA, 140 bp, Artificial Sequence
  Synthetic
atacgccatgctgggtctccagaggtgatcactgcatctccggagaatgactggttgtggatcttctcggactttagaagctctaagatgacatatctgactctcatcacctaccagtctcgtacttgggagtcggccat

SEQ ID NO: 446040 - DNA, 140 bp, Artificial Sequence
  Synthetic
atggccgactcccaagtacgagactggtaggtgatgagagtcagatatgtcatcttagagcttctaaagtccgagaagatccacaaccagtcattctccggagatgcagtgatcacctctggagacccagcatggcgtat

SEQ ID NO: 446041 - DNA, 140 bp, Artificial Sequence
  Synthetic
atacgccatgctgggtctccgatgatattattttttttttttatgattgttgaaggaggtagtggatgtgttttggaagttattaggttatttatttttaaaagattgttgaatataagtcgtacttgggagtcggccat

SEQ ID NO: 446042 - DNA, 140 bp, Artificial Sequence
  Synthetic
atggccgactcccaagtacgacttatattcaacaatcttttaaaaataaataacctaataacttccaaaacacatccactacctccttcaacaatcataaaaaaaaaaaataatatcatcggagacccagcatggcgtat

SEQ ID NO: 446043 - DNA, 140 bp, Artificial Sequence
  Synthetic
atacgccatgctgggtctccgtgaagacaccttagagtcagacgaagacatccagaggctgttaagagactctctgcgtaggacaaggtgggtagaccaggaagtgcgccatgcagcgagcgtacttgggagtcggccat

SEQ ID NO: 446044 - DNA, 140 bp, Artificial Sequence
  Synthetic
atggccgactcccaagtacgctcgctgcatggcgcacttcctggtctacccaccttgtcctacgcagagagtctcttaacagcctctggatgtcttcgtctgactctaaggtgtcttcacggagacccagcatggcgtat

SEQ ID NO: 446045 - DNA, 140 bp, Artificial Sequence
  Synthetic
atacgccatgctgggtctcctaggtttaagtttataatgagtattggttgtttattgaattatttttaagtttgagattaaagggttttggaattttttagagagggtttttatgttaagcgtacttgggagtcggccat

SEQ ID NO: 446046 - DNA, 140 bp, Artificial Sequence
  Synthetic
atggccgactcccaagtacgcttaacataaaaaccctctctaaaaaattccaaaaccctttaatctcaaacttaaaaataattcaataaacaaccaatactcattataaacttaaacctaggagacccagcatggcgtat

SEQ ID NO: 446047 - DNA, 140 bp, Artificial Sequence
  Synthetic
atacgccatgctgggtctcctcgaacccagcccctgtttcagagctggacgtcagagccctctccaaaaggcttcaaaacccgttgatctctggactgagagtggttcagtgggcgacagcgtacttgggagtcggccat

SEQ ID NO: 446048 - DNA, 140 bp, Artificial Sequence
  Synthetic
atggccgactcccaagtacgctgtcgcccactgaaccactctcagtccagagatcaacgggttttgaagccttttggagagggctctgacgtccagctctgaaacaggggctgggttcgaggagacccagcatggcgtat

SEQ ID NO: 446049 - DNA, 140 bp, Artificial Sequence
  Synthetic
atacgccatgctgggtctcctggtgcccactctgaatcaaacaggagccggagatgtataaccgacttggcccatttctattccaagtcatcccccatagagaagctattgaattgtacgcgtacttgggagtcggccat

SEQ ID NO: 446050 - DNA, 140 bp, Artificial Sequence
  Synthetic
atggccgactcccaagtacgcgtacaattcaatagcttctctatgggggatgacttggaatagaaatgggccaagtcggttatacatctccggctcctgtttgattcagagtgggcaccaggagacccagcatggcgtat

SEQ ID NO: 446051 - DNA, 140 bp, Artificial Sequence
  Synthetic
atacgccatgctgggtctccgggttgtaatttttagttatggttttagttgtatggtgtattttttgatttatttattttgttttttgtaaagagttttttagtagttgttgaatgttgtcgtacttgggagtcggccat

SEQ ID NO: 446052 - DNA, 140 bp, Artificial Sequence
  Synthetic
atggccgactcccaagtacgacaacattcaacaactactaaaaaactctttacaaaaaacaaaataaataaatcaaaaaatacaccatacaactaaaaccataactaaaaattacaacccggagacccagcatggcgtat

SEQ ID NO: 446053 - DNA, 140 bp, Artificial Sequence
  Synthetic
atacgccatgctgggtctccacttaacatgtttcctgatgccaaactcgtattcaacagcctgttagaagtaaatgacctgatggcatcaggaacacatccgttgcccccctcagcaatccgtacttgggagtcggccat

SEQ ID NO: 446054 - DNA, 140 bp, Artificial Sequence
  Synthetic
atggccgactcccaagtacggattgctgaggggggcaacggatgtgttcctgatgccatcaggtcatttacttctaacaggctgttgaatacgagtttggcatcaggaaacatgttaagtggagacccagcatggcgtat

SEQ ID NO: 446055 - DNA, 140 bp, Artificial Sequence
  Synthetic
atacgccatgctgggtctccattcctcttacttgtttttccatgtaatcaccttatacatgaatgccttagactgggaagaggaaaagaccatcctggcattatggaaagatataacctccgtacttgggagtcggccat

SEQ ID NO: 446056 - DNA, 140 bp, Artificial Sequence
  Synthetic
atggccgactcccaagtacggaggttatatctttccataatgccaggatggtcttttcctcttcccagtctaaggcattcatgtataaggtgattacatggaaaaacaagtaagaggaatggagacccagcatggcgtat

SEQ ID NO: 446057 - DNA, 140 bp, Artificial Sequence
  Synthetic
atacgccatgctgggtctcctttaattttttggagtagaagatgagattggtaagtaatgagggttaggtatgttattttggtatttttaaagtttgaaaagatttatagttagttatttcgtacttgggagtcggccat

SEQ ID NO: 446058 - DNA, 140 bp, Artificial Sequence
  Synthetic
atggccgactcccaagtacgaaataactaactataaatcttttcaaactttaaaaataccaaaataacatacctaaccctcattacttaccaatctcatcttctactccaaaaaattaaaggagacccagcatggcgtat

SEQ ID NO: 446059 - DNA, 140 bp, Artificial Sequence
  Synthetic
aggccctggctgctgatatggatttgcttcttgacaagaatgacaaacattaacatcaatagacctcttgaactgatctcaggggtgatttcttacatcctcttgaggctggacaatcacgaccttttgggacagcggtg

SEQ ID NO: 446060 - DNA, 140 bp, Artificial Sequence
  Synthetic
caccgctgtcccaaaaggtcgtgattgtccagcctcaagaggatgtaagaaatcacccctgagatcagttcaagaggtctattgatgttaatgtttgtcattcttgtcaagaagcaaatccatatcagcagccagggcct

SEQ ID NO: 446061 - DNA, 140 bp, Artificial Sequence
  Synthetic
atacgccatgctgggtctcccaactccttaatgattctgctttctccccctgagccccgatactcagatgacttaatatctcagctgtgccagctatacatcgctggggatcaagtcttgcgtacttgggagtcggccat

SEQ ID NO: 446062 - DNA, 140 bp, Artificial Sequence
  Synthetic
atggccgactcccaagtacgcaagacttgatccccagcgatgtatagctggcacagctgagatattaagtcatctgagtatcggggctcagggggagaaagcagaatcattaaggagttgggagacccagcatggcgtat

SEQ ID NO: 446063 - DNA, 140 bp, Artificial Sequence
  Synthetic
atacgccatgctgggtctcctggggattttttgagggatagaaaatattttttttttaaaagatggttttttgagtattatgtataaggagggatggttatttagttttaggagaatatacgtacttgggagtcggccat

SEQ ID NO: 446064 - DNA, 140 bp, Artificial Sequence
  Synthetic
atggccgactcccaagtacgtatattctcctaaaactaaataaccatccctccttatacataatactcaaaaaaccatcttttaaaaaaaaaatattttctatccctcaaaaaatccccaggagacccagcatggcgtat

SEQ ID NO: 446065 - DNA, 140 bp, Artificial Sequence
  Synthetic
atacgccatgctgggtctccagagcatttcctgcggtcactggattcataactcagatgacctcgtccttctcatccgagctatatctcagattctcaaagcgggggaagttcttccgggcgtacttgggagtcggccat

SEQ ID NO: 446066 - DNA, 140 bp, Artificial Sequence
  Synthetic
atggccgactcccaagtacgcccggaagaacttcccccgctttgagaatctgagatatagctcggatgagaaggacgaggtcatctgagttatgaatccagtgaccgcaggaaatgctctggagacccagcatggcgtat

SEQ ID NO: 446067 - DNA, 140 bp, Artificial Sequence
  Synthetic
aggccctggctgctgatatgtagatgagagaggcctgtataagtctctaaaaggagcatgcaaactcaagttatgtggagttcttggacttagacttatggatggaacatgggtcgcgatgaccttttgggacagcggtg

SEQ ID NO: 446068 - DNA, 140 bp, Artificial Sequence
  Synthetic
caccgctgtcccaaaaggtcatcgcgacccatgttccatccataagtctaagtccaagaactccacataacttgagtttgcatgctccttttagagacttatacaggcctctctcatctacatatcagcagccagggcct

SEQ ID NO: 446069 - DNA, 140 bp, Artificial Sequence
  Synthetic
atacgccatgctgggtctccagtttttttaaatagtttttaggggaaattttgttgtatatgttgatagggaagatggttttattattgtattttgagttgtgaattgttattaagattgcgtacttgggagtcggccat

SEQ ID NO: 446070 - DNA, 140 bp, Artificial Sequence
  Synthetic
atggccgactcccaagtacgcaatcttaataacaattcacaactcaaaatacaataataaaaccatcttccctatcaacatatacaacaaaatttcccctaaaaactatttaaaaaaactggagacccagcatggcgtat

SEQ ID NO: 446071 - DNA, 140 bp, Artificial Sequence
  Synthetic
aggccctggctgctgatatgattcgacaacatacatgacttagtatttgtgtatggctgttacagacattgggggcacccctatatagattatcggaagggtctgtcgaaactatatgatgaccttttgggacagcggtg

SEQ ID NO: 446072 - DNA, 140 bp, Artificial Sequence
  Synthetic
caccgctgtcccaaaaggtcatcatatagtttcgacagacccttccgataatctatataggggtgcccccaatgtctgtaacagccatacacaaatactaagtcatgtatgttgtcgaatcatatcagcagccagggcct

SEQ ID NO: 446073 - DNA, 140 bp, Artificial Sequence
  Synthetic
atacgccatgctgggtctccgggggcacccctatatagattatcggaagggtctgtcgaaactatatgatcaagttcacattaagaaagtaatagataagtcctaccaggagtgtttagccgtacttgggagtcggccat

SEQ ID NO: 446074 - DNA, 140 bp, Artificial Sequence
  Synthetic
atggccgactcccaagtacggctaaacactcctggtaggacttatctattactttcttaatgtgaacttgatcatatagtttcgacagacccttccgataatctatataggggtgcccccggagacccagcatggcgtat

SEQ ID NO: 446075 - DNA, 140 bp, Artificial Sequence
  Synthetic
atacgccatgctgggtctccgaagtgaggtatagttttagaaattattttggatattttttttgatatatttggaaatttgaagatttgagaggtttttagggttatgttgttaatgggtcgtacttgggagtcggccat

SEQ ID NO: 446076 - DNA, 140 bp, Artificial Sequence
  Synthetic
atggccgactcccaagtacgacccattaacaacataaccctaaaaacctctcaaatcttcaaatttccaaatatatcaaaaaaaatatccaaaataatttctaaaactatacctcacttcggagacccagcatggcgtat

SEQ ID NO: 446077 - DNA, 140 bp, Artificial Sequence
  Synthetic
aggccctggctgctgatatgatgtctcaaaaccactgactgaccctttattctatccgccatctgatcccaagatcttgagacacttcaacatatgctgcggcaccatgatgtacttgtcgaccttttgggacagcggtg

SEQ ID NO: 446078 - DNA, 140 bp, Artificial Sequence
  Synthetic
caccgctgtcccaaaaggtcgacaagtacatcatggtgccgcagcatatgttgaagtgtctcaagatcttgggatcagatggcggatagaataaagggtcagtcagtggttttgagacatcatatcagcagccagggcct

SEQ ID NO: 446079 - DNA, 140 bp, Artificial Sequence
  Synthetic
atacgccatgctgggtctcctatgtcaagacccaaacatggccacccaaacatatagtagacttggtgggggacacatggcataagctcccgatcacgcagatctttgagattcctgaatcgtacttgggagtcggccat

SEQ ID NO: 446080 - DNA, 140 bp, Artificial Sequence
  Synthetic
atggccgactcccaagtacgattcaggaatctcaaagatctgcgtgatcgggagcttatgccatgtgtcccccaccaagtctactatatgtttgggtggccatgtttgggtcttgacataggagacccagcatggcgtat

SEQ ID NO: 446081 - DNA, 140 bp, Artificial Sequence
  Synthetic
atacgccatgctgggtctccttaatggttggaatatgaaattgtagttttttttgttttgggttaaattagatatggtgtttgtattaatagaaatatgagagaggaggtttgggtatatcgtacttgggagtcggccat

SEQ ID NO: 446082 - DNA, 140 bp, Artificial Sequence
  Synthetic
atggccgactcccaagtacgatatacccaaacctcctctctcatatttctattaatacaaacaccatatctaatttaacccaaaacaaaaaaaactacaatttcatattccaaccattaaggagacccagcatggcgtat

SEQ ID NO: 446083 - DNA, 140 bp, Artificial Sequence
  Synthetic
atacgccatgctgggtctcctttgttagagatataatgtttttaattagagtttgagttaagttggaatttttagtaatgaattagtttatagatttttttaatgatagagttttttttacgtacttgggagtcggccat

SEQ ID NO: 446084 - DNA, 140 bp, Artificial Sequence
  Synthetic
atggccgactcccaagtacgtaaaaaaaactctatcattaaaaaaatctataaactaattcattactaaaaattccaacttaactcaaactctaattaaaaacattatatctctaacaaaggagacccagcatggcgtat

SEQ ID NO: 446085 - DNA, 140 bp, Artificial Sequence
  Synthetic
aggccctggctgctgatatgacacaaggactaagatcctagcgcaaggagacaaccaagttctgtgtccgacatacatgttgtcgccggggctctctagagaggggcttctttatgagttgaccttttgggacagcggtg

SEQ ID NO: 446086 - DNA, 140 bp, Artificial Sequence
  Synthetic
caccgctgtcccaaaaggtcaactcataaagaagcccctctctagagagccccggcgacaacatgtatgtcggacacagaacttggttgtctccttgcgctaggatcttagtccttgtgtcatatcagcagccagggcct

SEQ ID NO: 446087 - DNA, 140 bp, Artificial Sequence
  Synthetic
aggccctggctgctgatatgcactctcgagggaatgtacagactaagattatgggacggtgtaacctgaaaaaaacaagatcccgattcataacttctgtttacttgattgtttttccatgaccttttgggacagcggtg

SEQ ID NO: 446088 - DNA, 140 bp, Artificial Sequence
  Synthetic
caccgctgtcccaaaaggtcatggaaaaacaatcaagtaaacagaagttatgaatcgggatcttgtttttttcaggttacaccgtcccataatcttagtctgtacattccctcgagagtgcatatcagcagccagggcct

SEQ ID NO: 446089 - DNA, 140 bp, Artificial Sequence
  Synthetic
atacgccatgctgggtctcctgattgattaaaagatgggagtattgatatagaaattttaggattgtttttttttgttgttttataagtgtaagaaatagaggatttgggaagtaattttcgtacttgggagtcggccat

SEQ ID NO: 446090 - DNA, 140 bp, Artificial Sequence
  Synthetic
atggccgactcccaagtacgaaaattacttcccaaatcctctatttcttacacttataaaacaacaaaaaaaaacaatcctaaaatttctatatcaatactcccatcttttaatcaatcaggagacccagcatggcgtat

SEQ ID NO: 446091 - DNA, 140 bp, Artificial Sequence
  Synthetic
atacgccatgctgggtctccgttgcagaagagttgatagaacaagatcaatacaacgaggttccggggagtcaggaaggaaagtgtcggtgacttcccaaaacgggaaagtcatctcttccgtacttgggagtcggccat

SEQ ID NO: 446092 - DNA, 140 bp, Artificial Sequence
  Synthetic
atggccgactcccaagtacggaagagatgactttcccgttttgggaagtcaccgacactttccttcctgactccccggaacctcgttgtattgatcttgttctatcaactcttctgcaacggagacccagcatggcgtat

SEQ ID NO: 446093 - DNA, 140 bp, Artificial Sequence
  Synthetic
aggccctggctgctgatatgttttgttaagatcgtggaacaccatactctaatgacaactcacaaaatgtgtgctaattggagtactataccgaacttcagatttttggccggaacctacgaccttttgggacagcggtg

SEQ ID NO: 446094 - DNA, 140 bp, Artificial Sequence
  Synthetic
caccgctgtcccaaaaggtcgtaggttccggccaaaaatctgaagttcggtatagtactccaattagcacacattttgtgagttgtcattagagtatggtgttccacgatcttaacaaaacatatcagcagccagggcct

SEQ ID NO: 446095 - DNA, 140 bp, Artificial Sequence
  Synthetic
atacgccatgctgggtctccttttaattttttgaggtgtttgggttatttgattaattttgtggatttttgagttgtagaaggatttttttaaagtttttgagagattttttttaaattgcgtacttgggagtcggccat

SEQ ID NO: 446096 - DNA, 140 bp, Artificial Sequence
  Synthetic
atggccgactcccaagtacgcaatttaaaaaaaatctctcaaaaactttaaaaaaatccttctacaactcaaaaatccacaaaattaatcaaataacccaaacacctcaaaaaattaaaaggagacccagcatggcgtat

SEQ ID NO: 446097 - DNA, 140 bp, Artificial Sequence
  Synthetic
atacgccatgctgggtctccggtttaatagatgttaagaagagtataaaattatttttatgggttttggataataggattgttttttgaaattttgagttttttattttgtttattttgtcgtacttgggagtcggccat

SEQ ID NO: 446098 - DNA, 140 bp, Artificial Sequence
  Synthetic
atggccgactcccaagtacgacaaaataaacaaaataaaaaactcaaaatttcaaaaaacaatcctattatccaaaacccataaaaataattttatactcttcttaacatctattaaaccggagacccagcatggcgtat

SEQ ID NO: 446099 - DNA, 140 bp, Artificial Sequence
  Synthetic
atacgccatgctgggtctcctttgagtgttttttttttaagatttgggtttttagttttttgatataatgtgtgaatttaggatttgtgggagtttaattagatttttttttagaaggatcgtacttgggagtcggccat

SEQ ID NO: 446100 - DNA, 140 bp, Artificial Sequence
  Synthetic
atggccgactcccaagtacgatccttctaaaaaaaaatctaattaaactcccacaaatcctaaattcacacattatatcaaaaaactaaaaacccaaatcttaaaaaaaaaacactcaaaggagacccagcatggcgtat

SEQ ID NO: 446101 - DNA, 140 bp, Artificial Sequence
  Synthetic
atacgccatgctgggtctccatatggttaggagaaagtttttttttttagtgtttagaattttgtaaatttttttttttaagattgggttaaatagtaggtagtgaaagattgtttgtatcgtacttgggagtcggccat

SEQ ID NO: 446102 - DNA, 140 bp, Artificial Sequence
  Synthetic
atggccgactcccaagtacgatacaaacaatctttcactacctactatttaacccaatcttaaaaaaaaaaatttacaaaattctaaacactaaaaaaaaaaactttctcctaaccatatggagacccagcatggcgtat

SEQ ID NO: 446103 - DNA, 140 bp, Artificial Sequence
  Synthetic
atacgccatgctgggtctccttgattatttggttattagagatgtaagagattttggtttattttttggatttaggtattaatatgttatttttaaataaaggggtttttttatagatgacgtacttgggagtcggccat

SEQ ID NO: 446104 - DNA, 140 bp, Artificial Sequence
  Synthetic
atggccgactcccaagtacgtcatctataaaaaaacccctttatttaaaaataacatattaatacctaaatccaaaaaataaaccaaaatctcttacatctctaataaccaaataatcaaggagacccagcatggcgtat

SEQ ID NO: 446105 - DNA, 140 bp, Artificial Sequence
  Synthetic
aggccctggctgctgatatgtatgacttcctcatctatggaaaaacccctttgtttcggggtaatattctggtgcctgaatccaagagatgggctagagtctcttgtatctctaacgaccgaccttttgggacagcggtg

SEQ ID NO: 446106 - DNA, 140 bp, Artificial Sequence
  Synthetic
caccgctgtcccaaaaggtcggtcgttagagatacaagagactctagcccatctcttggattcaggcaccagaatattaccccgaaacaaaggggtttttccatagatgaggaagtcatacatatcagcagccagggcct

SEQ ID NO: 446107 - DNA, 140 bp, Artificial Sequence
  Synthetic
atacgccatgctgggtctcccctctcctgtgtcagcccctccggatgacgatgacctgtggcttccacctcctgaatatgtcccgctgaaagaactcacaagcaagaagaacatgaggaacgtacttgggagtcggccat

SEQ ID NO: 446108 - DNA, 140 bp, Artificial Sequence
  Synthetic
atggccgactcccaagtacgttcctcatgttcttcttgcttgtgagttctttcagcgggacatattcaggaggtggaagccacaggtcatcgtcatccggaggggctgacacaggagaggggagacccagcatggcgtat

SEQ ID NO: 446109 - DNA, 140 bp, Artificial Sequence
  Synthetic
atacgccatgctgggtctcctatgttttttaatttatagaggagttttttttgagatagttttggtgataatatatatgttggatataaaatttggttgtttttttgagttagtattttgcgtacttgggagtcggccat

SEQ ID NO: 446110 - DNA, 140 bp, Artificial Sequence
  Synthetic
atggccgactcccaagtacgcaaaatactaactcaaaaaaacaaccaaattttatatccaacatatatattatcaccaaaactatctcaaaaaaaactcctctataaattaaaaaacataggagacccagcatggcgtat

SEQ ID NO: 446111 - DNA, 140 bp, Artificial Sequence
  Synthetic
atacgccatgctgggtctccgaatctctctcttcaacggtccttcatggactccgtgcaacagagtgaaatcaagagtcgagaaactttcattaatcatctcaactgatcatacacagtccgtacttgggagtcggccat

SEQ ID NO: 446112 - DNA, 140 bp, Artificial Sequence
  Synthetic
atggccgactcccaagtacggactgtgtatgatcagttgagatgattaatgaaagtttctcgactcttgatttcactctgttgcacggagtccatgaaggaccgttgaagagagagattcggagacccagcatggcgtat

SEQ ID NO: 446113 - DNA, 140 bp, Artificial Sequence
  Synthetic
atacgccatgctgggtctcctgtcaaacggcccgacatgctggaacggtcaagatggcgggctagagggtttgcgacagaaaggttggagtctggttagcttattgatgatagatcgtgacgtacttgggagtcggccat

SEQ ID NO: 446114 - DNA, 140 bp, Artificial Sequence
  Synthetic
atggccgactcccaagtacgtcacgatctatcatcaataagctaaccagactccaacctttctgtcgcaaaccctctagcccgccatcttgaccgttccagcatgtcgggccgtttgacaggagacccagcatggcgtat

SEQ ID NO: 446115 - DNA, 140 bp, Artificial Sequence
  Synthetic
atacgccatgctgggtctcctttaataggttgggttgttggatgtatttaagtagtatatttgatttttttgtaatttgatgaggtttgatttgtttgaataatagatttaggatttttgcgtacttgggagtcggccat

SEQ ID NO: 446116 - DNA, 140 bp, Artificial Sequence
  Synthetic
atggccgactcccaagtacgcaaaaatcctaaatctattattcaaacaaatcaaacctcatcaaattacaaaaaaatcaaatatactacttaaatacatccaacaacccaacctattaaaggagacccagcatggcgtat

SEQ ID NO: 446117 - DNA, 140 bp, Artificial Sequence
  Synthetic
aggccctggctgctgatatgtctgggaaaaaccgtctgacctgagaaacttaaccacctggggatacttccagtcagtccagaagcaggtcaacatgtcttttgacctcattatttgtgagaccttttgggacagcggtg

SEQ ID NO: 446118 - DNA, 140 bp, Artificial Sequence
  Synthetic
caccgctgtcccaaaaggtctcacaaataatgaggtcaaaagacatgttgacctgcttctggactgactggaagtatccccaggtggttaagtttctcaggtcagacggtttttcccagacatatcagcagccagggcct

SEQ ID NO: 446119 - DNA, 140 bp, Artificial Sequence
  Synthetic
atacgccatgctgggtctcctattttttatagtttaggtgaaatgtatatgtgatttttgaatagtttagaagtttttgtttggtgattttgttgattagttttttaaatattttgtttacgtacttgggagtcggccat

SEQ ID NO: 446120 - DNA, 140 bp, Artificial Sequence
  Synthetic
atggccgactcccaagtacgtaaacaaaatatttaaaaaactaatcaacaaaatcaccaaacaaaaacttctaaactattcaaaaatcacatatacatttcacctaaactataaaaaataggagacccagcatggcgtat

SEQ ID NO: 446121 - DNA, 140 bp, Artificial Sequence
  Synthetic
aggccctggctgctgatatgccatgtcaacccagctattccatgcatgggaaaaagtcactaatgttcatgtggtgaaaagggctctatcgttaaaagaatctataaactggttcatcaagaccttttgggacagcggtg

SEQ ID NO: 446122 - DNA, 140 bp, Artificial Sequence
  Synthetic
caccgctgtcccaaaaggtcttgatgaaccagtttatagattcttttaacgatagagcccttttcaccacatgaacattagtgactttttcccatgcatggaatagctgggttgacatggcatatcagcagccagggcct

SEQ ID NO: 446123 - DNA, 140 bp, Artificial Sequence
  Synthetic
atacgccatgctgggtctcctttttcaatggtataatattagggcctgacggccatgtcctaatcccagagatgcaatcatccctcctccagcaacatatggagttgttggaatcttcagcgtacttgggagtcggccat

SEQ ID NO: 446124 - DNA, 140 bp, Artificial Sequence
  Synthetic
atggccgactcccaagtacgctgaagattccaacaactccatatgttgctggaggagggatgattgcatctctgggattaggacatggccgtcaggccctaatattataccattgaaaaaggagacccagcatggcgtat

SEQ ID NO: 446125 - DNA, 140 bp, Artificial Sequence
  Synthetic
atacgccatgctgggtctccagtaaagaattgatttttaatttttaatttttgtttttttggtttgaggttaattattaagtttttatttggtaattttttgaggtttatagattttagacgtacttgggagtcggccat

SEQ ID NO: 446126 - DNA, 140 bp, Artificial Sequence
  Synthetic
atggccgactcccaagtacgtctaaaatctataaacctcaaaaaattaccaaataaaaacttaataattaacctcaaaccaaaaaaacaaaaattaaaaattaaaaatcaattctttactggagacccagcatggcgtat

SEQ ID NO: 446127 - DNA, 140 bp, Artificial Sequence
  Synthetic
atacgccatgctgggtctcccaggccctgatttccctctagaagaggcccctgttttcaaacggacagggtcagccttgcataggttcaagtctgccagatacagtgaaggagggtattccgtacttgggagtcggccat

SEQ ID NO: 446128 - DNA, 140 bp, Artificial Sequence
  Synthetic
atggccgactcccaagtacggaataccctccttcactgtatctggcagacttgaacctatgcaaggctgaccctgtccgtttgaaaacaggggcctcttctagagggaaatcagggcctgggagacccagcatggcgtat

SEQ ID NO: 446129 - DNA, 140 bp, Artificial Sequence
  Synthetic
atacgccatgctgggtctccttgttttggtgaaagaatgtgatttgttatttaatatttttgatggatttattgatttaggaattttaaagatttgtgtgattgggagtttgtgttatgtcgtacttgggagtcggccat

SEQ ID NO: 446130 - DNA, 140 bp, Artificial Sequence
  Synthetic
atggccgactcccaagtacgacataacacaaactcccaatcacacaaatctttaaaattcctaaatcaataaatccatcaaaaatattaaataacaaatcacattctttcaccaaaacaaggagacccagcatggcgtat

SEQ ID NO: 446131 - DNA, 140 bp, Artificial Sequence
  Synthetic
atacgccatgctgggtctcctatttggagtatttattaaaattttatttaaggatttttttggttaggttgtttgttaagtatttttggtaggatttatttattatttttttaatgtgaacgtacttgggagtcggccat

SEQ ID NO: 446132 - DNA, 140 bp, Artificial Sequence
  Synthetic
atggccgactcccaagtacgttcacattaaaaaaataataaataaatcctaccaaaaatacttaacaaacaacctaaccaaaaaaatccttaaataaaattttaataaatactccaaataggagacccagcatggcgtat

SEQ ID NO: 446133 - DNA, 140 bp, Artificial Sequence
  Synthetic
atacgccatgctgggtctccgaattgatttagagttttaaagaatttttttgtataggaattgaatgtttttttgagttgatttattttgttttttataaatataggaaagttttttaagcgtacttgggagtcggccat

SEQ ID NO: 446134 - DNA, 140 bp, Artificial Sequence
  Synthetic
atggccgactcccaagtacgcttaaaaaactttcctatatttataaaaaacaaaataaatcaactcaaaaaaacattcaattcctatacaaaaaaattctttaaaactctaaatcaattcggagacccagcatggcgtat

SEQ ID NO: 446135 - DNA, 140 bp, Artificial Sequence
  Synthetic
atacgccatgctgggtctcctagataagatttgatttttagtaatgtatagttggtatagttgagatattaagttatttgagtattggggttttgggggagaaagtaagattattaaggacgtacttgggagtcggccat

SEQ ID NO: 446136 - DNA, 140 bp, Artificial Sequence
  Synthetic
atggccgactcccaagtacgtccttaataatcttactttctcccccaaaaccccaatactcaaataacttaatatctcaactataccaactatacattactaaaaatcaaatcttatctaggagacccagcatggcgtat

SEQ ID NO: 446137 - DNA, 140 bp, Artificial Sequence
  Synthetic
aggccctggctgctgatatgtgtagatgaaagaggcctgtacaagtctctaaaaggggcatgcaaactcaagttatgtggagttccaggacttaaacttatagatgggacatggatcgcggaccttttgggacagcggtg

SEQ ID NO: 446138 - DNA, 140 bp, Artificial Sequence
  Synthetic
caccgctgtcccaaaaggtccgcgatccatgtcccatctataagtttaagtcctggaactccacataacttgagtttgcatgccccttttagagacttgtacaggcctctttcatctacacatatcagcagccagggcct

SEQ ID NO: 446139 - DNA, 140 bp, Artificial Sequence
  Synthetic
atacgccatgctgggtctccttcaatggtataattttgggtccggatgggcatatcctgattccggagatgcaatcatccctcctccaacagcatatggagctgttagaatcctctgtaacgtacttgggagtcggccat

SEQ ID NO: 446140 - DNA, 140 bp, Artificial Sequence
  Synthetic
atggccgactcccaagtacgttacagaggattctaacagctccatatgctgttggaggagggatgattgcatctccggaatcaggatatgcccatccggacccaaaattataccattgaaggagacccagcatggcgtat

SEQ ID NO: 446141 - DNA, 140 bp, Artificial Sequence
  Synthetic
atacgccatgctgggtctccagtagtttttatatttggtttttgaattttattaagttttttttgatgtttattgaggttaaatttttttataatgttaggatggttttttttttattttcgtacttgggagtcggccat

SEQ ID NO: 446142 - DNA, 140 bp, Artificial Sequence
  Synthetic
atggccgactcccaagtacgaaaataaaaaaaaaaccatcctaacattataaaaaaatttaacctcaataaacatcaaaaaaaacttaataaaattcaaaaaccaaatataaaaactactggagacccagcatggcgtat

SEQ ID NO: 446143 - DNA, 140 bp, Artificial Sequence
  Synthetic
atacgccatgctgggtctcctttaaggtaatttaatattttttttggggggatttttagttttttattttttagtgtgagatttaatagtttttttatgggggatgatttggaatagaaacgtacttgggagtcggccat

SEQ ID NO: 446144 - DNA, 140 bp, Artificial Sequence
  Synthetic
atggccgactcccaagtacgtttctattccaaatcatcccccataaaaaaactattaaatctcacactaaaaaataaaaaactaaaaatccccccaaaaaaaatattaaattaccttaaaggagacccagcatggcgtat

SEQ ID NO: 446145 - DNA, 140 bp, Artificial Sequence
  Synthetic
atacgccatgctgggtctcctgagggaatttaaatttatttttttgaaataattttttaaaattttgaaagatttggagtaattgtttgttagagttatttgataaggtttattttttgtcgtacttgggagtcggccat

SEQ ID NO: 446146 - DNA, 140 bp, Artificial Sequence
  Synthetic
atggccgactcccaagtacgacaaaaaataaaccttatcaaataactctaacaaacaattactccaaatctttcaaaattttaaaaaattatttcaaaaaaataaatttaaattccctcaggagacccagcatggcgtat

SEQ ID NO: 446147 - DNA, 140 bp, Artificial Sequence
  Synthetic
atacgccatgctgggtctccctaagcttgtgttcaacagcctattggaggtgaatgatctgatggcttccggaacacatccactgcctccttcagcaatcatgagtggaggagatgacatcgtacttgggagtcggccat

SEQ ID NO: 446148 - DNA, 140 bp, Artificial Sequence
  Synthetic
atggccgactcccaagtacgatgtcatctcctccactcatgattgctgaaggaggcagtggatgtgttccggaagccatcagatcattcacctccaataggctgttgaacacaagcttagggagacccagcatggcgtat

SEQ ID NO: 446149 - DNA, 140 bp, Artificial Sequence
  Synthetic
atacgccatgctgggtctccttgggtttagtttttaatttgattgggttaatagggttattatagatttttttaggattgagtattttgaagtaggttttaggatgagaagtgttgttagcgtacttgggagtcggccat

SEQ ID NO: 446150 - DNA, 140 bp, Artificial Sequence
  Synthetic
atggccgactcccaagtacgctaacaacacttctcatcctaaaacctacttcaaaatactcaatcctaaaaaaatctataataaccctattaacccaatcaaattaaaaactaaacccaaggagacccagcatggcgtat

SEQ ID NO: 446151 - DNA, 140 bp, Artificial Sequence
  Synthetic
aggccctggctgctgatatgacgcttaacgacaaaatcagaaaagaagtagacagtatcgtctacaaagcaaaaatgtaacacccctacaatggatgccgacaagattgtatttaaagtcgaccttttgggacagcggtg

SEQ ID NO: 446152 - DNA, 140 bp, Artificial Sequence
  Synthetic
caccgctgtcccaaaaggtcgactttaaatacaatcttgtcggcatccattgtaggggtgttacatttttgctttgtagacgatactgtctacttcttttctgattttgtcgttaagcgtcatatcagcagccagggcct

SEQ ID NO: 446153 - DNA, 140 bp, Artificial Sequence
  Synthetic
atacgccatgctgggtctccttattgtttgtgttttttatgggaggaagattgttttttttaattaatttattttgagtttgttattatggaatatattatgatttttgtttgtgtttaacgtacttgggagtcggccat

SEQ ID NO: 446154 - DNA, 140 bp, Artificial Sequence
  Synthetic
atggccgactcccaagtacgttaaacacaaacaaaaatcataatatattccataataacaaactcaaaataaattaattaaaaaaaacaatcttcctcccataaaaaacacaaacaataaggagacccagcatggcgtat

SEQ ID NO: 446155 - DNA, 140 bp, Artificial Sequence
  Synthetic
atacgccatgctgggtctccatggaccactttatctggtcttcaaaacttacgggactatgctagtaaacccggactataaagctattcaacatctgtcaagagcgttcccttcggtcaccgtacttgggagtcggccat

SEQ ID NO: 446156 - DNA, 140 bp, Artificial Sequence
  Synthetic
atggccgactcccaagtacggtgaccgaagggaacgctcttgacagatgttgaatagctttatagtccgggtttactagcatagtcccgtaagttttgaagaccagataaagtggtccatggagacccagcatggcgtat

SEQ ID NO: 446157 - DNA, 140 bp, Artificial Sequence
  Synthetic
atacgccatgctgggtctccttttttattatgagaatttatatgattttgtttgattaattgagaggattaatgaaaattttatgatttttgaatttatttagttgtatggagtttaaggcgtacttgggagtcggccat

SEQ ID NO: 446158 - DNA, 140 bp, Artificial Sequence
  Synthetic
atggccgactcccaagtacgccttaaactccatacaactaaataaattcaaaaatcataaaattttcattaatcctctcaattaatcaaacaaaatcatataaattctcataataaaaaaggagacccagcatggcgtat

SEQ ID NO: 446159 - DNA, 140 bp, Artificial Sequence
  Synthetic
atacgccatgctgggtctccaataatcaggtggtctctttgaagcctgagattatcgtggatcaatatgagtacaagtaccctgccatcaaagatttgaaaaagccctgtataaccctagcgtacttgggagtcggccat

SEQ ID NO: 446160 - DNA, 140 bp, Artificial Sequence
  Synthetic
atggccgactcccaagtacgctagggttatacagggctttttcaaatctttgatggcagggtacttgtactcatattgatccacgataatctcaggcttcaaagagaccacctgattattggagacccagcatggcgtat

SEQ ID NO: 446161 - DNA, 140 bp, Artificial Sequence
  Synthetic
aggccctggctgctgatatgagcgccgccaaacttgatcctgacgatgtatgttcctatttggcagcggcaatgcagttttttgaggggacatgtccggaagactggaccagctatggaagaccttttgggacagcggtg

SEQ ID NO: 446162 - DNA, 140 bp, Artificial Sequence
  Synthetic
caccgctgtcccaaaaggtcttccatagctggtccagtcttccggacatgtcccctcaaaaaactgcattgccgctgccaaataggaacatacatcgtcaggatcaagtttggcggcgctcatatcagcagccagggcct

SEQ ID NO: 446163 - DNA, 140 bp, Artificial Sequence
  Synthetic
atacgccatgctgggtctcctacaaaacaaacatcgcggatagaatagagcagattttcgagacggccccctttgtaaagatcgtggaacatcatactttgatgacaacccacaagatgtcgtacttgggagtcggccat

SEQ ID NO: 446164 - DNA, 140 bp, Artificial Sequence
  Synthetic
atggccgactcccaagtacgacatcttgtgggttgtcatcaaagtatgatgttccacgatctttacaaagggggccgtctcgaaaatctgctctattctatccgcgatgtttgttttgtaggagacccagcatggcgtat

SEQ ID NO: 446165 - DNA, 140 bp, Artificial Sequence
  Synthetic
atacgccatgctgggtctccgtttgggagatttaagttaatttttgagatttgtttgtgtatattgggaaggtgaattttaataaaatttttagttttgttattgtttttgaaaatggtacgtacttgggagtcggccat

SEQ ID NO: 446166 - DNA, 140 bp, Artificial Sequence
  Synthetic
atggccgactcccaagtacgtaccattttcaaaaacaataacaaaactaaaaattttattaaaattcaccttcccaatatacacaaacaaatctcaaaaattaacttaaatctcccaaacggagacccagcatggcgtat

SEQ ID NO: 446167 - DNA, 140 bp, Artificial Sequence
  Synthetic
atacgccatgctgggtctcccacagttgtcactgcttacgaggactgctcagggctggtatcgtttacagggtttataaagcaaataaatctcactgcaagagaggcaatactgtatttccgtacttgggagtcggccat

SEQ ID NO: 446168 - DNA, 140 bp, Artificial Sequence
  Synthetic
atggccgactcccaagtacggaaatacagtattgcctctcttgcagtgagatttatttgctttataaaccctgtaaacgataccagccctgagcagtcctcgtaagcagtgacaactgtgggagacccagcatggcgtat

SEQ ID NO: 446169 - DNA, 140 bp, Artificial Sequence
  Synthetic
atacgccatgctgggtctcctgttgttaggttttaatattatattattgaaaaatattttgtttatatgaggatgatatttttttttaatttttaaatatttttttgaagggatgattttcgtacttgggagtcggccat

SEQ ID NO: 446170 - DNA, 140 bp, Artificial Sequence
  Synthetic
atggccgactcccaagtacgaaaatcatcccttcaaaaaaatatttaaaaattaaaaaaaaatatcatcctcatataaacaaaatatttttcaataatataatattaaaacctaacaacaggagacccagcatggcgtat

SEQ ID NO: 446171 - DNA, 140 bp, Artificial Sequence
  Synthetic
atacgccatgctgggtctccaacagtcattgccacatgtgccccgcatgagatgtctgttcttgggggttatctgggggaggagttttttggaaaagggacttttgaaagaagattcttccgtacttgggagtcggccat

SEQ ID NO: 446172 - DNA, 140 bp, Artificial Sequence
  Synthetic
atggccgactcccaagtacggaagaatcttctttcaaaagtcccttttccaaaaaactcctcccccagataacccccaagaacagacatctcatgcggggcacatgtggcaatgactgttggagacccagcatggcgtat

SEQ ID NO: 446173 - DNA, 140 bp, Artificial Sequence
  Synthetic
atacgccatgctgggtctcctgattgagatgtttgaaatttattgatttggtggttatgatggattttagtgtatttagatatttttttttttttttgattaatttttttataataaggtcgtacttgggagtcggccat

SEQ ID NO: 446174 - DNA, 140 bp, Artificial Sequence
  Synthetic
atggccgactcccaagtacgaccttattataaaaaaattaatcaaaaaaaaaaaaaaatatctaaatacactaaaatccatcataaccaccaaatcaataaatttcaaacatctcaatcaggagacccagcatggcgtat

SEQ ID NO: 446175 - DNA, 140 bp, Artificial Sequence
  Synthetic
atacgccatgctgggtctcctataagtttaagttttagaattttatataatttgagtttgtatgttttttttaaagatttatataggttttttttatttataaagttgtaagttttatttcgtacttgggagtcggccat

SEQ ID NO: 446176 - DNA, 140 bp, Artificial Sequence
  Synthetic
atggccgactcccaagtacgaaataaaacttacaactttataaataaaaaaaacctatataaatctttaaaaaaaacatacaaactcaaattatataaaattctaaaacttaaacttataggagacccagcatggcgtat

SEQ ID NO: 446177 - DNA, 140 bp, Artificial Sequence
  Synthetic
aggccctggctgctgatatgtagttccaatcatcaagctcgccctaattcattcgctgagtttctaaacaagacatactcgagtgattcgtgaatagttgaacaacagagttgtaaacacgaccttttgggacagcggtg

SEQ ID NO: 446178 - DNA, 140 bp, Artificial Sequence
  Synthetic
caccgctgtcccaaaaggtcgtgtttacaactctgttgttcaactattcacgaatcactcgagtatgtcttgtttagaaactcagcgaatgaattagggcgagcttgatgattggaactacatatcagcagccagggcct

SEQ ID NO: 446179 - DNA, 140 bp, Artificial Sequence
  Synthetic
atacgccatgctgggtctccagtagtaggtagaagatattgttatttttgagtaatttttgttagggaagatttttgagtgaagggatttgttatatgggtttaaatttgttatatttggcgtacttgggagtcggccat

SEQ ID NO: 446180 - DNA, 140 bp, Artificial Sequence
  Synthetic
atggccgactcccaagtacgccaaatataacaaatttaaacccatataacaaatcccttcactcaaaaatcttccctaacaaaaattactcaaaaataacaatatcttctacctactactggagacccagcatggcgtat

SEQ ID NO: 446181 - DNA, 140 bp, Artificial Sequence
  Synthetic
atacgccatgctgggtctccgttattttttagttgtatgtggttttatatgtatttggtgttgggtggaaatgtttttttttgaatgtggttgtgatataattaatgaagttagtgtaggcgtacttgggagtcggccat

SEQ ID NO: 446182 - DNA, 140 bp, Artificial Sequence
  Synthetic
atggccgactcccaagtacgcctacactaacttcattaattatatcacaaccacattcaaaaaaaaacatttccacccaacaccaaatacatataaaaccacatacaactaaaaaataacggagacccagcatggcgtat

SEQ ID NO: 446183 - DNA, 140 bp, Artificial Sequence
  Synthetic
aggccctggctgctgatatgaaccatcccaaacatgagcaagatctttgtcaatcctagtgctattagagccggtctggccgatcttgagatggctgaagaaactgttgatctgatcaatgaccttttgggacagcggtg

SEQ ID NO: 446184 - DNA, 140 bp, Artificial Sequence
  Synthetic
caccgctgtcccaaaaggtcattgatcagatcaacagtttcttcagccatctcaagatcggccagaccggctctaatagcactaggattgacaaagatcttgctcatgtttgggatggttcatatcagcagccagggcct

SEQ ID NO: 446185 - DNA, 140 bp, Artificial Sequence
  Synthetic
aggccctggctgctgatatgagaaatatcgaagacaatcaggctcatctccaaggggaacccatagaggtggacaatctccctgaggatatggggcgacttcacctggatgatggaaaatgaccttttgggacagcggtg

SEQ ID NO: 446186 - DNA, 140 bp, Artificial Sequence
  Synthetic
caccgctgtcccaaaaggtcattttccatcatccaggtgaagtcgccccatatcctcagggagattgtccacctctatgggttccccttggagatgagcctgattgtcttcgatatttctcatatcagcagccagggcct

SEQ ID NO: 446187 - DNA, 140 bp, Artificial Sequence
  Synthetic
atacgccatgctgggtctccggtgtattttttgttttttattattaaattgtttgggtagttgaggtgatgtatgttaattgggttttagggattaagtttgtttggtattgtgtaaatacgtacttgggagtcggccat

SEQ ID NO: 446188 - DNA, 140 bp, Artificial Sequence
  Synthetic
atggccgactcccaagtacgtatttacacaataccaaacaaacttaatccctaaaacccaattaacatacatcacctcaactacccaaacaatttaataataaaaaacaaaaaatacaccggagacccagcatggcgtat

SEQ ID NO: 446189 - DNA, 140 bp, Artificial Sequence
  Synthetic
atacgccatgctgggtctcctcagaccaccaaccgggaactcaagagggagacggtgtctacttcctctcagcgagaaagtcaatcatccaaagccaaaatggcggctcaaaccgcttctcgtacttgggagtcggccat

SEQ ID NO: 446190 - DNA, 140 bp, Artificial Sequence
  Synthetic
atggccgactcccaagtacgagaagcggtttgagccgccattttggctttggatgattgactttctcgctgagaggaagtagacaccgtctccctcttgagttcccggttggtggtctgaggagacccagcatggcgtat

SEQ ID NO: 446191 - DNA, 140 bp, Artificial Sequence
  Synthetic
atacgccatgctgggtctcctttttatatttaagaggattaaaatgtaaaggtaattaatttgattttgatgaaatgtagtggtttaatggtattataatatgtttttttgttatattgtcgtacttgggagtcggccat

SEQ ID NO: 446192 - DNA, 140 bp, Artificial Sequence
  Synthetic
atggccgactcccaagtacgacaatataacaaaaaaacatattataataccattaaaccactacatttcatcaaaatcaaattaattacctttacattttaatcctcttaaatataaaaaggagacccagcatggcgtat

SEQ ID NO: 446193 - DNA, 140 bp, Artificial Sequence
  Synthetic
atacgccatgctgggtctccacaagtttccatcccgatcttcggggatattcttgtataactttgagcaattaaaaatgaaccttgatgatatagttaaggagtcaaaaaatgtgccaagcgtacttgggagtcggccat

SEQ ID NO: 446194 - DNA, 140 bp, Artificial Sequence
  Synthetic
atggccgactcccaagtacgcttggcacattttttgactccttaactatatcatcaaggttcatttttaattgctcaaagttatacaagaatatccccgaagatcgggatggaaacttgtggagacccagcatggcgtat

SEQ ID NO: 446195 - DNA, 140 bp, Artificial Sequence
  Synthetic
aggccctggctgctgatatgagagagaaagccaatcatcgaaagccaggatggcggctcaaactgcttctggccctccagcccttgaatggtcggccaccaatgaagaggatgatctatcgaccttttgggacagcggtg

SEQ ID NO: 446196 - DNA, 140 bp, Artificial Sequence
  Synthetic
caccgctgtcccaaaaggtcgatagatcatcctcttcattggtggccgaccattcaagggctggagggccagaagcagtttgagccgccatcctggctttcgatgattggctttctctctcatatcagcagccagggcct

SEQ ID NO: 446197 - DNA, 140 bp, Artificial Sequence
  Synthetic
atacgccatgctgggtctcctttttgttttttttggatttttgtgtttgaagagatatgttagattatagttgatttgtttttgagtttatgttgatatattagattttgttttggatatcgtacttgggagtcggccat

SEQ ID NO: 446198 - DNA, 140 bp, Artificial Sequence
  Synthetic
atggccgactcccaagtacgatatccaaaacaaaatctaatatatcaacataaactcaaaaacaaatcaactataatctaacatatctcttcaaacacaaaaatccaaaaaaaacaaaaaggagacccagcatggcgtat

SEQ ID NO: 446199 - DNA, 140 bp, Artificial Sequence
  Synthetic
atacgccatgctgggtctcccctgataagctaaataaaataatgcaagacgacctgaaccgttatgtgtctcactgaccagaccctcaaactcagtcctactatgcaatcagatctgatccgtacttgggagtcggccat

SEQ ID NO: 446200 - DNA, 140 bp, Artificial Sequence
  Synthetic
atggccgactcccaagtacggatcagatctgattgcatagtaggactgagtttgagggtctggtcagtgagacacataacggttcaggtcgtcttgcattattttatttagcttatcaggggagacccagcatggcgtat

SEQ ID NO: 446201 - DNA, 140 bp, Artificial Sequence
  Synthetic
aggccctggctgctgatatgttgaaaatgaaccttgatgatatagttaaagaggcaaaaaatgtaccaggtgtgacccgtttagcccatgacgggtccaaactccccctaagatgtgtacgaccttttgggacagcggtg

SEQ ID NO: 446202 - DNA, 140 bp, Artificial Sequence
  Synthetic
caccgctgtcccaaaaggtcgtacacatcttagggggagtttggacccgtcatgggctaaacgggtcacacctggtacattttttgcctctttaactatatcatcaaggttcattttcaacatatcagcagccagggcct

SEQ ID NO: 446203 - DNA, 140 bp, Artificial Sequence
  Synthetic
atacgccatgctgggtctccgtttttggaattagtttattggaagataagggttttttttaatttgtatatttagtttatgtttttagggattggagtttttgataaagttagtttaatacgtacttgggagtcggccat

SEQ ID NO: 446204 - DNA, 140 bp, Artificial Sequence
  Synthetic
atggccgactcccaagtacgtattaaactaactttatcaaaaactccaatccctaaaaacataaactaaatatacaaattaaaaaaaacccttatcttccaataaactaattccaaaaacggagacccagcatggcgtat

SEQ ID NO: 446205 - DNA, 140 bp, Artificial Sequence
  Synthetic
atacgccatgctgggtctcccctctatcgtgtcggctcctccggatgacgatgatttgtggttaccccctccagaatacgttccgttgagggagctcaccggcagaaaaaacatgagaaacgtacttgggagtcggccat

SEQ ID NO: 446206 - DNA, 140 bp, Artificial Sequence
  Synthetic
atggccgactcccaagtacgtttctcatgttttttctgccggtgagctccctcaacggaacgtattctggagggggtaaccacaaatcatcgtcatccggaggagccgacacgatagaggggagacccagcatggcgtat

SEQ ID NO: 446207 - DNA, 140 bp, Artificial Sequence
  Synthetic
aggccctggctgctgatatgccagaatacgttccgttgagggagctcaccggcagaaaaaacatgagaaacttctgcgttaatggagaagtcaaggtgtgcagtccaaacggctattcatgaccttttgggacagcggtg

SEQ ID NO: 446208 - DNA, 140 bp, Artificial Sequence
  Synthetic
caccgctgtcccaaaaggtcatgaatagccgtttggactgcacaccttgacttctccattaacgcagaagtttctcatgttttttctgccggtgagctccctcaacggaacgtattctggcatatcagcagccagggcct

SEQ ID NO: 446209 - DNA, 140 bp, Artificial Sequence
  Synthetic
atacgccatgctgggtctcccccttatcttccagtgggctgattccaggggccctcttgaaggggaggagttggaatactctcaggagatcacttgggatgatgatactgagttcgtcggcgtacttgggagtcggccat

SEQ ID NO: 446210 - DNA, 140 bp, Artificial Sequence
  Synthetic
atggccgactcccaagtacgccgacgaactcagtatcatcatcccaagtgatctcctgagagtattccaactcctccccttcaagagggcccctggaatcagcccactggaagataagggggagacccagcatggcgtat

SEQ ID NO: 446211 - DNA, 140 bp, Artificial Sequence
  Synthetic
atacgccatgctgggtctcctatatattttaatttttttgttgatataaaagttttttttgttttttttgtttgtaagtttttttagtgggatgtatttagggggtggaagttataagttcgtacttgggagtcggccat

SEQ ID NO: 446212 - DNA, 140 bp, Artificial Sequence
  Synthetic
atggccgactcccaagtacgaacttataacttccaccccctaaatacatcccactaaaaaaacttacaaacaaaaaaaacaaaaaaaacttttatatcaacaaaaaaattaaaatatataggagacccagcatggcgtat

SEQ ID NO: 446213 - DNA, 140 bp, Artificial Sequence
  Synthetic
aggccctggctgctgatatgaacagacctataacttattacttcagaaaacaagtcattcgagggaatatttatttatcttggagctggtctggcgacaccccggtgttcaagagggtaggaccttttgggacagcggtg

SEQ ID NO: 446214 - DNA, 140 bp, Artificial Sequence
  Synthetic
caccgctgtcccaaaaggtcctaccctcttgaacaccggggtgtcgccagaccagctccaagataaataaatattccctcgaatgacttgttttctgaagtaataagttataggtctgttcatatcagcagccagggcct

SEQ ID NO: 446215 - DNA, 140 bp, Artificial Sequence
  Synthetic
atacgccatgctgggtctccttgtttgttttttttatgttgattttaggatattttggattttattgtttagagggattgagtggagaggtttggttagtaagatgtatagtgatttaagcgtacttgggagtcggccat

SEQ ID NO: 446216 - DNA, 140 bp, Artificial Sequence
  Synthetic
atggccgactcccaagtacgcttaaatcactatacatcttactaaccaaacctctccactcaatccctctaaacaataaaatccaaaatatcctaaaatcaacataaaaaaaacaaacaaggagacccagcatggcgtat

SEQ ID NO: 446217 - DNA, 140 bp, Artificial Sequence
  Synthetic
atacgccatgctgggtctccattggaaatacgagtgagtgcaagacaatgccatattcagggccggatttggtgtattaacatgaactctagggcatgtcaattgtggtctgacatgtcccgtacttgggagtcggccat

SEQ ID NO: 446218 - DNA, 140 bp, Artificial Sequence
  Synthetic
atggccgactcccaagtacgggacatgtcagaccacaattgacatgccctagagttcatgttaatacaccaaatccggccctgaatatggcattgtcttgcactcactcgtatttccaatggagacccagcatggcgtat

SEQ ID NO: 446219 - DNA, 140 bp, Artificial Sequence
  Synthetic
atacgccatgctgggtctccaatagtgaagactaccagacttgtaggaaatacggagaatctatccagggaggtcgaaaagcaccttcgagggtacaacaggtggatcaccctagacgaccgtacttgggagtcggccat

SEQ ID NO: 446220 - DNA, 140 bp, Artificial Sequence
  Synthetic
atggccgactcccaagtacggtcgtctagggtgatccacctgttgtaccctcgaaggtgcttttcgacctccctggatagattctccgtatttcctacaagtctggtagtcttcactattggagacccagcatggcgtat

SEQ ID NO: 446221 - DNA, 140 bp, Artificial Sequence
  Synthetic
atacgccatgctgggtctccgtttggatttgttatgggttaaatgggttatatttggtatattttttgtttttttaattatattattaaggtttatttttaattgtttaaaattatataacgtacttgggagtcggccat

SEQ ID NO: 446222 - DNA, 140 bp, Artificial Sequence
  Synthetic
atggccgactcccaagtacgttatataattttaaacaattaaaaataaaccttaataatataattaaaaaaacaaaaaatataccaaatataacccatttaacccataacaaatccaaacggagacccagcatggcgtat

SEQ ID NO: 446223 - DNA, 140 bp, Artificial Sequence
  Synthetic
atacgccatgctgggtctccagaacacatgggcttaactccaaccttcgggagcaatagaacaaaaacatgttatggtgccgttgaatcgctgcattttatcagagtcaaatcaattacccgtacttgggagtcggccat

SEQ ID NO: 446224 - DNA, 140 bp, Artificial Sequence
  Synthetic
atggccgactcccaagtacgggtaattgatttgactctgataaaatgcagcgattcaacggcaccataacatgtttttgttctattgctcccgaaggttggagttaagcccatgtgttctggagacccagcatggcgtat

SEQ ID NO: 446225 - DNA, 140 bp, Artificial Sequence
  Synthetic
aggccctggctgctgatatggttatggtgccgttgaatcgctgcattttatcagagtcaaatcaattacctttgcattttgagcctctcggatgtgaaaaaaactattaacatccctcgagaccttttgggacagcggtg

SEQ ID NO: 446226 - DNA, 140 bp, Artificial Sequence
  Synthetic
caccgctgtcccaaaaggtctcgagggatgttaatagtttttttcacatccgagaggctcaaaatgcaaaggtaattgatttgactctgataaaatgcagcgattcaacggcaccataaccatatcagcagccagggcct

SEQ ID NO: 446227 - DNA, 140 bp, Artificial Sequence
  Synthetic
aggccctggctgctgatatgggtgtatcaacatgaacccgagagcatgtcaactatggtctgacatgtctcttcagacacaaaggtccgaagaggacaaagattcctctctgcttctagagaccttttgggacagcggtg

SEQ ID NO: 446228 - DNA, 140 bp, Artificial Sequence
  Synthetic
caccgctgtcccaaaaggtctctagaagcagagaggaatctttgtcctcttcggacctttgtgtctgaagagacatgtcagaccatagttgacatgctctcgggttcatgttgatacacccatatcagcagccagggcct

SEQ ID NO: 446229 - DNA, 140 bp, Artificial Sequence
  Synthetic
aggccctggctgctgatatgtgtagatgaaagaggcctatataagtctttaaaaggagcatgcaaactcaagttatgtggagttctcggacttagacttatggatggaacatgggtcgcggaccttttgggacagcggtg

SEQ ID NO: 446230 - DNA, 140 bp, Artificial Sequence
  Synthetic
caccgctgtcccaaaaggtccgcgacccatgttccatccataagtctaagtccgagaactccacataacttgagtttgcatgctccttttaaagacttatataggcctctttcatctacacatatcagcagccagggcct

SEQ ID NO: 446231 - DNA, 140 bp, Artificial Sequence
  Synthetic
atacgccatgctgggtctccgatttcctcattgtgtttcggaaaatttccaatctatacgatacccgaaaaactcgggccttggagtcccattgacatacatcatctcagctgtcctaaccgtacttgggagtcggccat

SEQ ID NO: 446232 - DNA, 140 bp, Artificial Sequence
  Synthetic
atggccgactcccaagtacggttaggacagctgagatgatgtatgtcaatgggactccaaggcccgagtttttcgggtatcgtatagattggaaattttccgaaacacaatgaggaaatcggagacccagcatggcgtat

SEQ ID NO: 446233 - DNA, 140 bp, Artificial Sequence
  Synthetic
aggccctggctgctgatatgtggtcaagaagagagaggagtgtctggatgcactagagtccatcatgaccaccaagtcagtgagtttcagacgtctcagtcatttaagaaaacttgtcccgaccttttgggacagcggtg

SEQ ID NO: 446234 - DNA, 140 bp, Artificial Sequence
  Synthetic
caccgctgtcccaaaaggtcgggacaagttttcttaaatgactgagacgtctgaaactcactgacttggtggtcatgatggactctagtgcatccagacactcctctctcttcttgaccacatatcagcagccagggcct

SEQ ID NO: 446235 - DNA, 140 bp, Artificial Sequence
  Synthetic
atacgccatgctgggtctccagtctcttcacaatccttatcctgattaccattggctacggaccgtaaaaaccaccaaagagtctcttgttatcatatcgccaagtgtggctgatttggacgtacttgggagtcggccat

SEQ ID NO: 446236 - DNA, 140 bp, Artificial Sequence
  Synthetic
atggccgactcccaagtacgtccaaatcagccacacttggcgatatgataacaagagactctttggtggtttttacggtccgtagccaatggtaatcaggataaggattgtgaagagactggagacccagcatggcgtat

SEQ ID NO: 446237 - DNA, 140 bp, Artificial Sequence
  Synthetic
atacgccatgctgggtctccttttttttatgatggatatatataatttgtagatttttggtattttgttatttaattttttatgagttatttgaatatgttttgtttagaaatttggtgacgtacttgggagtcggccat

SEQ ID NO: 446238 - DNA, 140 bp, Artificial Sequence
  Synthetic
atggccgactcccaagtacgtcaccaaatttctaaacaaaacatattcaaataactcataaaaaattaaataacaaaataccaaaaatctacaaattatatatatccatcataaaaaaaaggagacccagcatggcgtat

SEQ ID NO: 446239 - DNA, 140 bp, Artificial Sequence
  Synthetic
aggccctggctgctgatatgggacagggagggaggtgtcagtcactccccaaagcgggaagatcatatcttcatgggaatcatacaagagcgggggtgagaccggactgtgagagctggcgaccttttgggacagcggtg

SEQ ID NO: 446240 - DNA, 140 bp, Artificial Sequence
  Synthetic
caccgctgtcccaaaaggtcgccagctctcacagtccggtctcacccccgctcttgtatgattcccatgaagatatgatcttcccgctttggggagtgactgacacctccctccctgtcccatatcagcagccagggcct

SEQ ID NO: 446241 - DNA, 140 bp, Artificial Sequence
  Synthetic
aggccctggctgctgatatggacccatatgacagatcccttcactcgagggtcttccctagcgggaagtgctcgggagtagcggtgtcttctacctactgctccactaaccacgattacagaccttttgggacagcggtg

SEQ ID NO: 446242 - DNA, 140 bp, Artificial Sequence
  Synthetic
caccgctgtcccaaaaggtctgtaatcgtggttagtggagcagtaggtagaagacaccgctactcccgagcacttcccgctagggaagaccctcgagtgaagggatctgtcatatgggtccatatcagcagccagggcct

SEQ ID NO: 446243 - DNA, 140 bp, Artificial Sequence
  Synthetic
atacgccatgctgggtctccagtttttggatttttggttttatttgagaagtagtttttgttgttagagttgatagttttattatttgttagtgttatgttagtttttgttagtttagttcgtacttgggagtcggccat

SEQ ID NO: 446244 - DNA, 140 bp, Artificial Sequence
  Synthetic
atggccgactcccaagtacgaactaaactaacaaaaactaacataacactaacaaataataaaactatcaactctaacaacaaaaactacttctcaaataaaaccaaaaatccaaaaactggagacccagcatggcgtat

SEQ ID NO: 446245 - DNA, 140 bp, Artificial Sequence
  Synthetic
atacgccatgctgggtctccttttatgaggagtatatgtagtaataattgttgtatttagggatttgatttgatttatatagtattttataaagtgaatgagattgaatatgtgattaatcgtacttgggagtcggccat

SEQ ID NO: 446246 - DNA, 140 bp, Artificial Sequence
  Synthetic
atggccgactcccaagtacgattaatcacatattcaatctcattcactttataaaatactatataaatcaaatcaaatccctaaatacaacaattattactacatatactcctcataaaaggagacccagcatggcgtat

SEQ ID NO: 446247 - DNA, 140 bp, Artificial Sequence
  Synthetic
atacgccatgctgggtctccatatcagatctagatcatctttattagactacagctgcttgtaaaccaggcattcccagaggtctgcacatgctgagactcttttgtgatgtgtctcgaacgtacttgggagtcggccat

SEQ ID NO: 446248 - DNA, 140 bp, Artificial Sequence
  Synthetic
atggccgactcccaagtacgttcgagacacatcacaaaagagtctcagcatgtgcagacctctgggaatgcctggtttacaagcagctgtagtctaataaagatgatctagatctgatatggagacccagcatggcgtat

SEQ ID NO: 446249 - DNA, 140 bp, Artificial Sequence
  Synthetic
atacgccatgctgggtctccttttttattttttttttaaagtttttgtggaagaaatatagtattgtttttttagtggtgagattgatttgttttatgaatttagtaaatgatattagttcgtacttgggagtcggccat

SEQ ID NO: 446250 - DNA, 140 bp, Artificial Sequence
  Synthetic
atggccgactcccaagtacgaactaatatcatttactaaattcataaaacaaatcaatctcaccactaaaaaaacaatactatatttcttccacaaaaactttaaaaaaaaaataaaaaaggagacccagcatggcgtat

SEQ ID NO: 446251 - DNA, 140 bp, Artificial Sequence
  Synthetic
aggccctggctgctgatatggggtgtttaagagttggggggaggtgtcatcctcatgtgaacggggtgtttttcaatggtataatattaggacctgacggcaatgtcttaatcccagagagaccttttgggacagcggtg

SEQ ID NO: 446252 - DNA, 140 bp, Artificial Sequence
  Synthetic
caccgctgtcccaaaaggtctctctgggattaagacattgccgtcaggtcctaatattataccattgaaaaacaccccgttcacatgaggatgacacctccccccaactcttaaacaccccatatcagcagccagggcct

SEQ ID NO: 446253 - DNA, 140 bp, Artificial Sequence
  Synthetic
atacgccatgctgggtctcctttgaagtttggtatagtattttaattagtatatattttgtgagttgttattagagtatggtgttttatgattttaataaaaggggttgttttaaaaattcgtacttgggagtcggccat

SEQ ID NO: 446254 - DNA, 140 bp, Artificial Sequence
  Synthetic
atggccgactcccaagtacgaatttttaaaacaaccccttttattaaaatcataaaacaccatactctaataacaactcacaaaatatatactaattaaaatactataccaaacttcaaaggagacccagcatggcgtat

SEQ ID NO: 446255 - DNA, 140 bp, Artificial Sequence
  Synthetic
atacgccatgctgggtctcctatgtttagggatagtggggttttttgttagttttatgttttttgttagagtttaatttttttttatattagtatgttttatttttattagagaatttggcgtacttgggagtcggccat

SEQ ID NO: 446256 - DNA, 140 bp, Artificial Sequence
  Synthetic
atggccgactcccaagtacgccaaattctctaataaaaataaaacatactaatataaaaaaaaattaaactctaacaaaaaacataaaactaacaaaaaaccccactatccctaaacataggagacccagcatggcgtat

SEQ ID NO: 446257 - DNA, 140 bp, Artificial Sequence
  Synthetic
atacgccatgctgggtctcctatatattgttaggattaagtttggtggtgtttatgtatgataaaattgatttgtatgttttatttaaattgggagttttttttagagttatatagggttcgtacttgggagtcggccat

SEQ ID NO: 446258 - DNA, 140 bp, Artificial Sequence
  Synthetic
atggccgactcccaagtacgaaccctatataactctaaaaaaaactcccaatttaaataaaacatacaaatcaattttatcatacataaacaccaccaaacttaatcctaacaatatataggagacccagcatggcgtat

SEQ ID NO: 446259 - DNA, 140 bp, Artificial Sequence
  Synthetic
aggccctggctgctgatatgtgggtagattcaagagtcatgagattttcattaatcctctcagttgatcaagcaagatcatgtagattctcataataggggagatcttctagcagtttcagaccttttgggacagcggtg

SEQ ID NO: 446260 - DNA, 140 bp, Artificial Sequence
  Synthetic
caccgctgtcccaaaaggtctgaaactgctagaagatctcccctattatgagaatctacatgatcttgcttgatcaactgagaggattaatgaaaatctcatgactcttgaatctacccacatatcagcagccagggcct

SEQ ID NO: 446261 - DNA, 140 bp, Artificial Sequence
  Synthetic
atacgccatgctgggtctccggtgtgcacagctacaacgggccgagctatcaaagcctttcggtcaagaaaaaaactgtggaacggagaagtaattgacaacacttctcatcctgagtaccgtacttgggagtcggccat

SEQ ID NO: 446262 - DNA, 140 bp, Artificial Sequence
  Synthetic
atggccgactcccaagtacggtactcaggatgagaagtgttgtcaattacttctccgttccacagtttttttcttgaccgaaaggctttgatagctcggcccgttgtagctgtgcacaccggagacccagcatggcgtat

SEQ ID NO: 446263 - DNA, 140 bp, Artificial Sequence
  Synthetic
atacgccatgctgggtctccagagagtgttttctagaacacacgagttttttcagaagtcctggatctattattcagacagatcagacctcatcgggttacgggaggatcaaatatactgcgtacttgggagtcggccat

SEQ ID NO: 446264 - DNA, 140 bp, Artificial Sequence
  Synthetic
atggccgactcccaagtacgcagtatatttgatcctcccgtaacccgatgaggtctgatctgtctgaataatagatccaggacttctgaaaaaactcgtgtgttctagaaaacactctctggagacccagcatggcgtat

SEQ ID NO: 446265 - DNA, 140 bp, Artificial Sequence
  Synthetic
aggccctggctgctgatatgcatggtgtgttccatgatagcggactcaggatgagttaattgagagaggcagtcttcctcccgtgaaggacataagcagtagctcacaatcatctcgcgtgaccttttgggacagcggtg

SEQ ID NO: 446266 - DNA, 140 bp, Artificial Sequence
  Synthetic
caccgctgtcccaaaaggtcacgcgagatgattgtgagctactgcttatgtccttcacgggaggaagactgcctctctcaattaactcatcctgagtccgctatcatggaacacaccatgcatatcagcagccagggcct

SEQ ID NO: 446267 - DNA, 140 bp, Artificial Sequence
  Synthetic
atacgccatgctgggtctcctaagaaactctgactacaatctcaactctcctctaatagaggatccagccaaattaatgttagaatggttgaaaacaggaaataggcctctccggatgaccgtacttgggagtcggccat

SEQ ID NO: 446268 - DNA, 140 bp, Artificial Sequence
  Synthetic
atggccgactcccaagtacggtcatccggagaggcctatttcctgttttcaaccattctaacattaatttggctggatcctctattagaggagagttgagattgtagtcagagtttcttaggagacccagcatggcgtat

SEQ ID NO: 446269 - DNA, 140 bp, Artificial Sequence
  Synthetic
aggccctggctgctgatatggtcgagaaaaaaacattagatcagaagaacaactggcaacacttctcaacctgagatctacttcaagatgctcgatcctggagaggtctatgatgaccctgaccttttgggacagcggtg

SEQ ID NO: 446270 - DNA, 140 bp, Artificial Sequence
  Synthetic
caccgctgtcccaaaaggtcagggtcatcatagacctctccaggatcgagcatcttgaagtagatctcaggttgagaagtgttgccagttgttcttctgatctaatgtttttttctcgaccatatcagcagccagggcct

SEQ ID NO: 446271 - DNA, 140 bp, Artificial Sequence
  Synthetic
aggccctggctgctgatatgacagggtccgctctgcatagattcaaatcagcgagatacagtgaaggggggtattcctctgtttgtccaaatctcctctcccacatctctgttagtaccggaccttttgggacagcggtg

SEQ ID NO: 446272 - DNA, 140 bp, Artificial Sequence
  Synthetic
caccgctgtcccaaaaggtccggtactaacagagatgtgggagaggagatttggacaaacagaggaataccccccttcactgtatctcgctgatttgaatctatgcagagcggaccctgtcatatcagcagccagggcct

SEQ ID NO: 446273 - DNA, 140 bp, Artificial Sequence
  Synthetic
atacgccatgctgggtctccatgatctccctctggctttatggtgcccactctgaatcaaacaggagccggaagtgtataaccgacttggctcagttctattccaagtcttcacccatagcgtacttgggagtcggccat

SEQ ID NO: 446274 - DNA, 140 bp, Artificial Sequence
  Synthetic
atggccgactcccaagtacgctatgggtgaagacttggaatagaactgagccaagtcggttatacacttccggctcctgtttgattcagagtgggcaccataaagccagagggagatcatggagacccagcatggcgtat

SEQ ID NO: 446275 - DNA, 140 bp, Artificial Sequence
  Synthetic
atacgccatgctgggtctccgaggtatctggctaacatatactcctcttatttattctttcacgtgattaccctttacatgaacgccctggattgggatgaggagaagaccatcctggcacgtacttgggagtcggccat

SEQ ID NO: 446276 - DNA, 140 bp, Artificial Sequence
  Synthetic
atggccgactcccaagtacgtgccaggatggtcttctcctcatcccaatccagggcgttcatgtaaagggtaatcacgtgaaagaataaataagaggagtatatgttagccagatacctcggagacccagcatggcgtat

SEQ ID NO: 446277 - DNA, 140 bp, Artificial Sequence
  Synthetic
atacgccatgctgggtctcccacagagttctaactgcctctttgatagaaactatacacttatgctgaaggacctttttttgtctcggttcaactctctaataatcctcctttctcctcccgtacttgggagtcggccat

SEQ ID NO: 446278 - DNA, 140 bp, Artificial Sequence
  Synthetic
atggccgactcccaagtacgggaggagaaaggaggattattagagagttgaaccgagacaaaaaaaggtccttcagcataagtgtatagtttctatcaaagaggcagttagaactctgtgggagacccagcatggcgtat

SEQ ID NO: 446279 - DNA, 140 bp, Artificial Sequence
  Synthetic
atacgccatgctgggtctccattaagatattagagccgtacgttgtgaatagcctagtccagagggcagaaaaatttagacctctcattcattccttaggggacttccctgtgtttataacgtacttgggagtcggccat

SEQ ID NO: 446280 - DNA, 140 bp, Artificial Sequence
  Synthetic
atggccgactcccaagtacgttataaacacagggaagtcccctaaggaatgaatgagaggtctaaatttttctgccctctggactaggctattcacaacgtacggctctaatatcttaatggagacccagcatggcgtat

SEQ ID NO: 446281 - DNA, 140 bp, Artificial Sequence
  Synthetic
aggccctggctgctgatatgtgctaaaagatcttttcttgtctcgcttcaactccttaatggtcttgctctctcccccagagccccgatactcagatgacttgatatctcaactatgccagaccttttgggacagcggtg

SEQ ID NO: 446282 - DNA, 140 bp, Artificial Sequence
  Synthetic
caccgctgtcccaaaaggtctggcatagttgagatatcaagtcatctgagtatcggggctctgggggagagagcaagaccattaaggagttgaagcgagacaagaaaagatcttttagcacatatcagcagccagggcct

SEQ ID NO: 446283 - DNA, 140 bp, Artificial Sequence
  Synthetic
aggccctggctgctgatatggagccccgatattcggatgatttaatatctcagctgtgccaactatacatcgctggggatcaggtcttgtcaatgtgtggaaactccggctatgaagtcagaccttttgggacagcggtg

SEQ ID NO: 446284 - DNA, 140 bp, Artificial Sequence
  Synthetic
caccgctgtcccaaaaggtctgacttcatagccggagtttccacacattgacaagacctgatccccagcgatgtatagttggcacagctgagatattaaatcatccgaatatcggggctccatatcagcagccagggcct

SEQ ID NO: 446285 - DNA, 140 bp, Artificial Sequence
  Synthetic
atacgccatgctgggtctccatatggatgttataggcattgggggcatccttacatagattatagaaggggcttgtcaaagctatatgatcaagtccacatcaagaaggtgatagataagcgtacttgggagtcggccat

SEQ ID NO: 446286 - DNA, 140 bp, Artificial Sequence
  Synthetic
atggccgactcccaagtacgcttatctatcaccttcttgatgtggacttgatcatatagctttgacaagccccttctataatctatgtaaggatgcccccaatgcctataacatccatatggagacccagcatggcgtat

SEQ ID NO: 446287 - DNA, 140 bp, Artificial Sequence
  Synthetic
aggccctggctgctgatatggggaccacccattgactccttatatcaaaacccagacatggcctcccaaacatatagtagatctggtgggtgatacttggcataagctcccgatcactcagaccttttgggacagcggtg

SEQ ID NO: 446288 - DNA, 140 bp, Artificial Sequence
  Synthetic
caccgctgtcccaaaaggtctgagtgatcgggagcttatgccaagtatcacccaccagatctactatatgtttgggaggccatgtctgggttttgatataaggagtcaatgggtggtccccatatcagcagccagggcct

SEQ ID NO: 446289 - DNA, 140 bp, Artificial Sequence
  Synthetic
aggccctggctgctgatatggtttttgtgtatggctgttacaggcattgggggcacccatatatagattatcgaaagggtctgtcaaaactatatgatcaggttcacattaaaaaagtgagaccttttgggacagcggtg

SEQ ID NO: 446290 - DNA, 140 bp, Artificial Sequence
  Synthetic
caccgctgtcccaaaaggtctcacttttttaatgtgaacctgatcatatagttttgacagaccctttcgataatctatatatgggtgcccccaatgcctgtaacagccatacacaaaaaccatatcagcagccagggcct

SEQ ID NO: 446291 - DNA, 140 bp, Artificial Sequence
  Synthetic
atacgccatgctgggtctcctcgaaagggtctgtcaaaactatatgatcaggttcacattaaaaaagtgatagataagtcctaccaggagtgcttagcaagcggcctagccaggaggatccgtacttgggagtcggccat

SEQ ID NO: 446292 - DNA, 140 bp, Artificial Sequence
  Synthetic
atggccgactcccaagtacggatcctcctggctaggccgcttgctaagcactcctggtaggacttatctatcacttttttaatgtgaacctgatcatatagttttgacagaccctttcgaggagacccagcatggcgtat

SEQ ID NO: 446293 - DNA, 140 bp, Artificial Sequence
  Synthetic
aggccctggctgctgatatgggacactcggctgaaggactccacctttcattggcatctccgatgtaacaagtgcataaggcacatcgatgacattactttggagacttcccaggtcttcgaccttttgggacagcggtg

SEQ ID NO: 446294 - DNA, 140 bp, Artificial Sequence
  Synthetic
caccgctgtcccaaaaggtcgaagacctgggaagtctccaaagtaatgtcatcgatgtgccttatgcacttgttacatcggagatgccaatgaaaggtggagtccttcagccgagtgtcccatatcagcagccagggcct

SEQ ID NO: 446295 - DNA, 140 bp, Artificial Sequence
  Synthetic
atacgccatgctgggtctccaggggagggccggtccccagtgaaaaggtcattatcacggctctctccaagcctcctgtcaaccccagagaattcttgaaatccatagacctgggaggatcgtacttgggagtcggccat

SEQ ID NO: 446296 - DNA, 140 bp, Artificial Sequence
  Synthetic
atggccgactcccaagtacgatcctcccaggtctatggatttcaagaattctctggggttgacaggaggcttggagagagccgtgataatgaccttttcactggggaccggccctcccctggagacccagcatggcgtat

SEQ ID NO: 446297 - DNA, 140 bp, Artificial Sequence
  Synthetic
atacgccatgctgggtctcctgccagacgaggatctgataatcggcctcaagcccaaggaacgggaactgaaaattgaaggtcggttcttcgctttgatgtcttggaatctgagattatacgtacttgggagtcggccat

SEQ ID NO: 446298 - DNA, 140 bp, Artificial Sequence
  Synthetic
atggccgactcccaagtacgtataatctcagattccaagacatcaaagcgaagaaccgaccttcaattttcagttcccgttccttgggcttgaggccgattatcagatcctcgtctggcaggagacccagcatggcgtat

SEQ ID NO: 446299 - DNA, 140 bp, Artificial Sequence
  Synthetic
aggccctggctgctgatatgggatgacaaatcacattctttcaccagaccgagactagcttcttggctgtcagaaaaccgaggggggcctgttcctagcgaaaaagttattatcacggccgaccttttgggacagcggtg

SEQ ID NO: 446300 - DNA, 140 bp, Artificial Sequence
  Synthetic
caccgctgtcccaaaaggtcggccgtgataataactttttcgctaggaacaggcccccctcggttttctgacagccaagaagctagtctcggtctggtgaaagaatgtgatttgtcatcccatatcagcagccagggcct

SEQ ID NO: 446301 - DNA, 140 bp, Artificial Sequence
  Synthetic
atacgccatgctgggtctccttctctagaacacatgagttttttcagaagtcttggatctattactcagacagatccgacctcatcgggttatgggaggatcagatatactgtttggacacgtacttgggagtcggccat

SEQ ID NO: 446302 - DNA, 140 bp, Artificial Sequence
  Synthetic
atggccgactcccaagtacgtgtccaaacagtatatctgatcctcccataacccgatgaggtcggatctgtctgagtaatagatccaagacttctgaaaaaactcatgtgttctagagaaggagacccagcatggcgtat

SEQ ID NO: 446303 - DNA, 140 bp, Artificial Sequence
  Synthetic
atacgccatgctgggtctcctgccattgaggagggtgcatccaaactagggctcatcataaagaaggaggagaccatgtgtagctatgactttctcatctatgggaaaactcctttatttcgtacttgggagtcggccat

SEQ ID NO: 446304 - DNA, 140 bp, Artificial Sequence
  Synthetic
atggccgactcccaagtacgaaataaaggagttttcccatagatgagaaagtcatagctacacatggtctcctccttctttatgatgagccctagtttggatgcaccctcctcaatggcaggagacccagcatggcgtat

SEQ ID NO: 446305 - DNA, 140 bp, Artificial Sequence
  Synthetic
aggccctggctgctgatatgccaccaatgcattaactgtagcacaacactctcagtctttgattaaaccaatgagggactttttgcttatgtcagtacaagccgtcttccattacttgctgaccttttgggacagcggtg

SEQ ID NO: 446306 - DNA, 140 bp, Artificial Sequence
  Synthetic
caccgctgtcccaaaaggtcagcaagtaatggaagacggcttgtactgacataagcaaaaagtccctcattggtttaatcaaagactgagagtgttgtgctacagttaatgcattggtggcatatcagcagccagggcct

SEQ ID NO: 446307 - DNA, 140 bp, Artificial Sequence
  Synthetic
aggccctggctgctgatatgagtcactgagcggtaaggagaggtcatgtcatatagggtcagcccaagggcttttatattctattctggttgcaactcatgactctggatataatgatgggaccttttgggacagcggtg

SEQ ID NO: 446308 - DNA, 140 bp, Artificial Sequence
  Synthetic
caccgctgtcccaaaaggtcccatcattatatccagagtcatgagttgcaaccagaatagaatataaaagcccttgggctgaccctatatgacatgacctctccttaccgctcagtgactcatatcagcagccagggcct

SEQ ID NO: 446309 - DNA, 140 bp, Artificial Sequence
  Synthetic
atacgccatgctgggtctccttggggggagtatctggaatgtctcttggaagattccacatacgccaattctcagaccctgtctcagaggggttgtctttctggagagagatctggctaacgtacttgggagtcggccat

SEQ ID NO: 446310 - DNA, 140 bp, Artificial Sequence
  Synthetic
atggccgactcccaagtacgttagccagatctctctccagaaagacaacccctctgagacagggtctgagaattggcgtatgtggaatcttccaagagacattccagatactccccccaaggagacccagcatggcgtat

SEQ ID NO: 446311 - DNA, 140 bp, Artificial Sequence
  Synthetic
aggccctggctgctgatatgtacagttgtcactgcttatgaagactgctcagggttggtatcgttcacagggttcataaagcagataaatctcaccgcgagagaggcaatcctatatttcgaccttttgggacagcggtg

SEQ ID NO: 446312 - DNA, 140 bp, Artificial Sequence
  Synthetic
caccgctgtcccaaaaggtcgaaatataggattgcctctctcgcggtgagatttatctgctttatgaaccctgtgaacgataccaaccctgagcagtcttcataagcagtgacaactgtacatatcagcagccagggcct

SEQ ID NO: 446313 - DNA, 140 bp, Artificial Sequence
  Synthetic
aggccctggctgctgatatgtacctgctatttagcccaatcttaaagggaagagtttacaagattctgagcgctgaaggggagagctttctcctagccatgtcaaggataatctatctaggaccttttgggacagcggtg

SEQ ID NO: 446314 - DNA, 140 bp, Artificial Sequence
  Synthetic
caccgctgtcccaaaaggtcctagatagattatccttgacatggctaggagaaagctctccccttcagcgctcagaatcttgtaaactcttccctttaagattgggctaaatagcaggtacatatcagcagccagggcct

SEQ ID NO: 446315 - DNA, 140 bp, Artificial Sequence
  Synthetic
atacgccatgctgggtctcccactaccctgaatattaaaggaggggcaagtcctaccattcttctcaaggatgcaatcaggaaggccctatatgatgaggttgacaaggtggaaaactcacgtacttgggagtcggccat

SEQ ID NO: 446316 - DNA, 140 bp, Artificial Sequence
  Synthetic
atggccgactcccaagtacgtgagttttccaccttgtcaacctcatcatatagggccttcctgattgcatccttgagaagaatggtaggacttgcccctcctttaatattcagggtagtgggagacccagcatggcgtat

SEQ ID NO: 446317 - DNA, 140 bp, Artificial Sequence
  Synthetic
atacgccatgctgggtctcctcttcagttcgtctttcttggggattcctgagtcaatcattgggttgatacagaattccagaacaataagaaggcagtttaggaggagtctctcgagaaccgtacttgggagtcggccat

SEQ ID NO: 446318 - DNA, 140 bp, Artificial Sequence
  Synthetic
atggccgactcccaagtacggttctcgagagactcctcctaaactgccttcttattgttctggaattctgtatcaacccaatgattgactcaggaatccccaagaaagacgaactgaagaggagacccagcatggcgtat

SEQ ID NO: 446319 - DNA, 140 bp, Artificial Sequence
  Synthetic
atacgccatgctgggtctcctataagacaaacattgcagacaggatagagcagatttttgagactgccccctttgtaaagatcgtagaacaccatactctaatgacaactcacaagatgtcgtacttgggagtcggccat

SEQ ID NO: 446320 - DNA, 140 bp, Artificial Sequence
  Synthetic
atggccgactcccaagtacgacatcttgtgagttgtcattagagtatggtgttctacgatctttacaaagggggcagtctcaaaaatctgctctatcctgtctgcaatgtttgtcttataggagacccagcatggcgtat

SEQ ID NO: 446321 - DNA, 140 bp, Artificial Sequence
  Synthetic
atacgccatgctgggtctccgagtgcaggtgctctggctacactaatgctgacgatcttcttaataacatgttgcagaagagtcgatagaacagaatcaatacaacgaggtccaggggagcgtacttgggagtcggccat

SEQ ID NO: 446322 - DNA, 140 bp, Artificial Sequence
  Synthetic
atggccgactcccaagtacgctcccctggacctcgttgtattgattctgttctatcgactcttctgcaacatgttattaagaagatcgtcagcattagtgtagccagagcacctgcactcggagacccagcatggcgtat

SEQ ID NO: 446323 - DNA, 140 bp, Artificial Sequence
  Synthetic
aggccctggctgctgatatgagtccctcacccttctgagatgctgtggttgcttcccaaatcctcgatttcctgcacttgtggagtaacaggaggtgggaatcctcgaatatcagtgtctgaccttttgggacagcggtg

SEQ ID NO: 446324 - DNA, 140 bp, Artificial Sequence
  Synthetic
caccgctgtcccaaaaggtcagacactgatattcgaggattcccacctcctgttactccacaagtgcaggaaatcgaggatttgggaagcaaccacagcatctcagaagggtgagggactcatatcagcagccagggcct

SEQ ID NO: 446325 - DNA, 140 bp, Artificial Sequence
  Synthetic
aggccctggctgctgatatggattgatacaaaactcccgaacgataagaaggcagtttagaaagagtctctcaaaaactttagaagaatccttctacaactcagagatccacgggattaggaccttttgggacagcggtg

SEQ ID NO: 446326 - DNA, 140 bp, Artificial Sequence
  Synthetic
caccgctgtcccaaaaggtcctaatcccgtggatctctgagttgtagaaggattcttctaaagtttttgagagactctttctaaactgccttcttatcgttcgggagttttgtatcaatccatatcagcagccagggcct

SEQ ID NO: 446327 - DNA, 140 bp, Artificial Sequence
  Synthetic
atacgccatgctgggtctcccccctgatagaatgtacagactgatactcctagacggtgcaccctgaaaaaaactggatcagaattccgaacctctgtcggcttgattgtttttccatctcgtacttgggagtcggccat

SEQ ID NO: 446328 - DNA, 140 bp, Artificial Sequence
  Synthetic
atggccgactcccaagtacgagatggaaaaacaatcaagccgacagaggttcggaattctgatccagtttttttcagggtgcaccgtctaggagtatcagtctgtacattctatcaggggggagacccagcatggcgtat

SEQ ID NO: 446329 - DNA, 140 bp, Artificial Sequence
  Synthetic
aggccctggctgctgatatgctctgtcagcacagacacgatgtctgacctgactcatgatgggagaaactatgactttatgtttcaaccgttaatgctttatgcgcagacatggacatcagaccttttgggacagcggtg

SEQ ID NO: 446330 - DNA, 140 bp, Artificial Sequence
  Synthetic
caccgctgtcccaaaaggtctgatgtccatgtctgcgcataaagcattaacggttgaaacataaagtcatagtttctcccatcatgagtcaggtcagacatcgtgtctgtgctgacagagcatatcagcagccagggcct

SEQ ID NO: 446331 - DNA, 140 bp, Artificial Sequence
  Synthetic
aggccctggctgctgatatgacaaggatgacaaacatcaacatcaatagacctcttgagctgatctctggggtgatctcatacatcttattgagactggataaccatccatcattgtacagaccttttgggacagcggtg

SEQ ID NO: 446332 - DNA, 140 bp, Artificial Sequence
  Synthetic
caccgctgtcccaaaaggtctgtacaatgatggatggttatccagtctcaataagatgtatgagatcaccccagagatcagctcaagaggtctattgatgttgatgtttgtcatccttgtcatatcagcagccagggcct

SEQ ID NO: 446333 - DNA, 140 bp, Artificial Sequence
  Synthetic
atacgccatgctgggtctcccttctcaggtcttcgagttcccggatgtttcaaggaggatatctaggatggtttctggagctgtgcctcattttcgaaagcttcctgatattcgtctgagcgtacttgggagtcggccat

SEQ ID NO: 446334 - DNA, 140 bp, Artificial Sequence
  Synthetic
atggccgactcccaagtacgctcagacgaatatcaggaagctttcgaaaatgaggcacagctccagaaaccatcctagatatcctccttgaaacatccgggaactcgaagacctgagaagggagacccagcatggcgtat

SEQ ID NO: 446335 - DNA, 140 bp, Artificial Sequence
  Synthetic
atacgccatgctgggtctccggtgatctcatacatcttattgagactggataaccatccatcattgtacataatgctcagggagccatctcttaggggagagatattttctattcctcagcgtacttgggagtcggccat

SEQ ID NO: 446336 - DNA, 140 bp, Artificial Sequence
  Synthetic
atggccgactcccaagtacgctgaggaatagaaaatatctctcccctaagagatggctccctgagcattatgtacaatgatggatggttatccagtctcaataagatgtatgagatcaccggagacccagcatggcgtat

SEQ ID NO: 446337 - DNA, 140 bp, Artificial Sequence
  Synthetic
atacgccatgctgggtctccgggtataatgacggaacaatcttccctgtaaacatatatagcaaggtctccccgagagactatttgagagggctcgcgagaggagtcttgatagggtcttcgtacttgggagtcggccat

SEQ ID NO: 446338 - DNA, 140 bp, Artificial Sequence
  Synthetic
atggccgactcccaagtacgaagaccctatcaagactcctctcgcgagccctctcaaatagtctctcggggagaccttgctatatatgtttacagggaagattgttccgtcattatacccggagacccagcatggcgtat

SEQ ID NO: 446339 - DNA, 140 bp, Artificial Sequence
  Synthetic
atacgccatgctgggtctcccccctctttgtacataatgctcagagaaccatcacttagaggagagatattttctattccccaaaaagtccccgctgcttacccgaccacaatgaaagaacgtacttgggagtcggccat

SEQ ID NO: 446340 - DNA, 140 bp, Artificial Sequence
  Synthetic
atggccgactcccaagtacgttctttcattgtggtcgggtaagcagcggggactttttggggaatagaaaatatctctcctctaagtgatggttctctgagcattatgtacaaagaggggggagacccagcatggcgtat

SEQ ID NO: 446341 - DNA, 140 bp, Artificial Sequence
  Synthetic
aggccctggctgctgatatgtccccagaagcctgcacatcctaagacttttgtgtgatgtatcttgaaaaaaacaagatcttgaatccgagcctctggctgtttgattgtttcttttatcgaccttttgggacagcggtg

SEQ ID NO: 446342 - DNA, 140 bp, Artificial Sequence
  Synthetic
caccgctgtcccaaaaggtcgataaaagaaacaatcaaacagccagaggctcggattcaagatcttgtttttttcaagatacatcacacaaaagtcttaggatgtgcaggcttctggggacatatcagcagccagggcct

SEQ ID NO: 446343 - DNA, 140 bp, Artificial Sequence
  Synthetic
aggccctggctgctgatatgtaccgtgctattgaggagggggcatccaaactggggcttatcataaagaaggaagagaccatgtgtagctatgactttctcatctatggaaagacccctcgaccttttgggacagcggtg

SEQ ID NO: 446344 - DNA, 140 bp, Artificial Sequence
  Synthetic
caccgctgtcccaaaaggtcgaggggtctttccatagatgagaaagtcatagctacacatggtctcttccttctttatgataagccccagtttggatgccccctcctcaatagcacggtacatatcagcagccagggcct

SEQ ID NO: 446345 - DNA, 140 bp, Artificial Sequence
  Synthetic
aggccctggctgctgatatgtttcacctggactatgagaagtggaacaatcatcagaggctggagtcgacagaggatgtattttctgtacttgatcaagtgtttggattaaagagggtgtgaccttttgggacagcggtg

SEQ ID NO: 446346 - DNA, 140 bp, Artificial Sequence
  Synthetic
caccgctgtcccaaaaggtcacaccctctttaatccaaacacttgatcaagtacagaaaatacatcctctgtcgactccagcctctgatgattgttccacttctcatagtccaggtgaaacatatcagcagccagggcct

SEQ ID NO: 446347 - DNA, 140 bp, Artificial Sequence
  Synthetic
atacgccatgctgggtctccaactatgacagggagttacagccccaacaagaggatgtcacgcaaggcagggtgttcagaatgggtctgctctgctcagcaggttgcggtttcaacctctcgtacttgggagtcggccat

SEQ ID NO: 446348 - DNA, 140 bp, Artificial Sequence
  Synthetic
atggccgactcccaagtacgagaggttgaaaccgcaacctgctgagcagagcagacccattctgaacaccctgccttgcgtgacatcctcttgttggggctgtaactccctgtcatagttggagacccagcatggcgtat

SEQ ID NO: 446349 - DNA, 140 bp, Artificial Sequence
  Synthetic
atacgccatgctgggtctccctggaagagtctttttataactcagagatccatgggatcaacaggatgacacagactccccaaagggtcggaagagtctggacctgctcctcagagagggcgtacttgggagtcggccat

SEQ ID NO: 446350 - DNA, 140 bp, Artificial Sequence
  Synthetic
atggccgactcccaagtacgccctctctgaggagcaggtccagactcttccgaccctttggggagtctgtgtcatcctgttgatcccatggatctctgagttataaaaagactcttccagggagacccagcatggcgtat

SEQ ID NO: 446351 - DNA, 140 bp, Artificial Sequence
  Synthetic
atacgccatgctgggtctccatgagagataacctgcgacaattgagttccttgatgaggcaggtgctgggcgggcacggagaagataccttagagtcagacgacaacattcaacgactgccgtacttgggagtcggccat

SEQ ID NO: 446352 - DNA, 140 bp, Artificial Sequence
  Synthetic
atggccgactcccaagtacggcagtcgttgaatgttgtcgtctgactctaaggtatcttctccgtgcccgcccagcacctgcctcatcaaggaactcaattgtcgcaggttatctctcatggagacccagcatggcgtat

SEQ ID NO: 446353 - DNA, 140 bp, Artificial Sequence
  Synthetic
atacgccatgctgggtctccgggcccattataagctcaaacctattctggatgatctcaatgtcttcccatccctatgtcttgtggtcggggatggatcaggagggatatcaagagcagtcgtacttgggagtcggccat

SEQ ID NO: 446354 - DNA, 140 bp, Artificial Sequence
  Synthetic
atggccgactcccaagtacgactgctcttgatatccctcctgatccatccccgaccacaagacatagggatgggaagacattgagatcatccagaataggtttgagcttataatgggcccggagacccagcatggcgtat

SEQ ID NO: 446355 - DNA, 140 bp, Artificial Sequence
  Synthetic
aggccctggctgctgatatgggttctatgtccgacatatatgttgtcgccggggctctccagagagggacttctctacgagttggagagcatatcaagaaatgctctgtcaatataccgtgaccttttgggacagcggtg

SEQ ID NO: 446356 - DNA, 140 bp, Artificial Sequence
  Synthetic
caccgctgtcccaaaaggtcacggtatattgacagagcatttcttgatatgctctccaactcgtagagaagtccctctctggagagccccggcgacaacatatatgtcggacatagaacccatatcagcagccagggcct

SEQ ID NO: 446357 - DNA, 140 bp, Artificial Sequence
  Synthetic
atacgccatgctgggtctccatgagtggaggggatgacatcatatccagggtgattgactttgactctatctgggagaaaccttctgacttgaggaacttgaccacatggagatatttcccgtacttgggagtcggccat

SEQ ID NO: 446358 - DNA, 140 bp, Artificial Sequence
  Synthetic
atggccgactcccaagtacgggaaatatctccatgtggtcaagttcctcaagtcagaaggtttctcccagatagagtcaaagtcaatcaccctggatatgatgtcatcccctccactcatggagacccagcatggcgtat

SEQ ID NO: 446359 - DNA, 140 bp, Artificial Sequence
  Synthetic
atacgccatgctgggtctcctgattttgcattgtccatagatggtccactttatctggttttcaaaacttatggtacgatgcttgtaaatccagattacagagcaattcaacacttatcccgtacttgggagtcggccat

SEQ ID NO: 446360 - DNA, 140 bp, Artificial Sequence
  Synthetic
atggccgactcccaagtacgggataagtgttgaattgctctgtaatctggatttacaagcatcgtaccataagttttgaaaaccagataaagtggaccatctatggacaatgcaaaatcaggagacccagcatggcgtat

SEQ ID NO: 446361 - DNA, 140 bp, Artificial Sequence
  Synthetic
aggccctggctgctgatatgcagcaatcatgaggggaggaaatgatatcgtctccagagtgatagatcttgactcaatctgggaaaaaccgtccgacttgagaaacttggcaacctggaagaccttttgggacagcggtg

SEQ ID NO: 446362 - DNA, 140 bp, Artificial Sequence
  Synthetic
caccgctgtcccaaaaggtcttccaggttgccaagtttctcaagtcggacggtttttcccagattgagtcaagatctatcactctggagacgatatcatttcctcccctcatgattgctgcatatcagcagccagggcct

SEQ ID NO: 446363 - DNA, 140 bp, Artificial Sequence
  Synthetic
aggccctggctgctgatatgacgaggcggaagattttgtcgaggttcaccttccggatgtccacaagcaggtctcgggagttgatctcggtctcccaagctgggggaagtatgtgctgatgaccttttgggacagcggtg

SEQ ID NO: 446364 - DNA, 140 bp, Artificial Sequence
  Synthetic
caccgctgtcccaaaaggtcatcagcacatacttcccccagcttgggagaccgagatcaactcccgagacctgcttgtggacatccggaaggtgaacctcgacaaaatcttccgcctcgtcatatcagcagccagggcct

SEQ ID NO: 446365 - DNA, 140 bp, Artificial Sequence
  Synthetic
atacgccatgctgggtctccatgcagaatacttgacctcttctactcttcgcgaaatgagccttgtattgttcaattgtagcagccctaagagtgagatgcagagagctcgctccctaaacgtacttgggagtcggccat

SEQ ID NO: 446366 - DNA, 140 bp, Artificial Sequence
  Synthetic
atggccgactcccaagtacgtttagggagcgagctctctgcatctcactcttagggctgctacaattgaacaatacaaggctcatttcgcgaagagtagaagaggtcaagtattctgcatggagacccagcatggcgtat

SEQ ID NO: 446367 - DNA, 140 bp, Artificial Sequence
  Synthetic
atacgccatgctgggtctcccaaaacttatgggactatgctagtaaatccaaactacaaggctattcaacacctgtcaagagcgttcccctcggtcacagggtttatcacccaagtaactcgtacttgggagtcggccat

SEQ ID NO: 446368 - DNA, 140 bp, Artificial Sequence
  Synthetic
atggccgactcccaagtacgagttacttgggtgataaaccctgtgaccgaggggaacgctcttgacaggtgttgaatagccttgtagtttggatttactagcatagtcccataagttttgggagacccagcatggcgtat

SEQ ID NO: 446369 - DNA, 140 bp, Artificial Sequence
  Synthetic
atacgccatgctgggtctccgttcacaagatggtagatgatctggagttgcagagaggaactttgtctaaagtttctattattatagccattgtgatagtcttctccaatagggtgttcacgtacttgggagtcggccat

SEQ ID NO: 446370 - DNA, 140 bp, Artificial Sequence
  Synthetic
atggccgactcccaagtacgtgaacaccctattggagaagactatcacaatggctataataatagaaactttagacaaagttcctctctgcaactccagatcatctaccatcttgtgaacggagacccagcatggcgtat

SEQ ID NO: 446371 - DNA, 140 bp, Artificial Sequence
  Synthetic
atacgccatgctgggtctccatgtctcaaaacccctgactgaccctttattctatccgccatctgatcccaaaatcttaagacacttcaacatatgctgtagtaccatgatgtacctgtccgtacttgggagtcggccat

SEQ ID NO: 446372 - DNA, 140 bp, Artificial Sequence
  Synthetic
atggccgactcccaagtacggacaggtacatcatggtactacagcatatgttgaagtgtcttaagattttgggatcagatggcggatagaataaagggtcagtcaggggttttgagacatggagacccagcatggcgtat

SEQ ID NO: 446373 - DNA, 140 bp, Artificial Sequence
  Synthetic
aggccctggctgctgatatgctgatcccaaaatcctgaggcacttcaacatatgttgcagtactatgatgtatctatctactgctttaggtgacgtccctagcttcgcaagacttcacgagaccttttgggacagcggtg

SEQ ID NO: 446374 - DNA, 140 bp, Artificial Sequence
  Synthetic
caccgctgtcccaaaaggtctcgtgaagtcttgcgaagctagggacgtcacctaaagcagtagatagatacatcatagtactgcaacatatgttgaagtgcctcaggattttgggatcagcatatcagcagccagggcct

SEQ ID NO: 446375 - DNA, 140 bp, Artificial Sequence
  Synthetic
atacgccatgctgggtctcccattagatcccgatcgtcccttttggattatagctgcttgtgaactatgctctctcggaggaatatacagactaaggctcttggactgtgtatcctgaaacgtacttgggagtcggccat

SEQ ID NO: 446376 - DNA, 140 bp, Artificial Sequence
  Synthetic
atggccgactcccaagtacgtttcaggatacacagtccaagagccttagtctgtatattcctccgagagagcatagttcacaagcagctataatccaaaagggacgatcgggatctaatgggagacccagcatggcgtat

SEQ ID NO: 446377 - DNA, 140 bp, Artificial Sequence
  Synthetic
aggccctggctgctgatatgtctctcggaggaatatacagactaaggctcttggactgtgtatcctgaaaaaaccgagatcctgattcagaacctctgtttgcttgattttttttcttttgaccttttgggacagcggtg

SEQ ID NO: 446378 - DNA, 140 bp, Artificial Sequence
  Synthetic
caccgctgtcccaaaaggtcaaaagaaaaaaaatcaagcaaacagaggttctgaatcaggatctcggttttttcaggatacacagtccaagagccttagtctgtatattcctccgagagacatatcagcagccagggcct

SEQ ID NO: 446379 - DNA, 140 bp, Artificial Sequence
  Synthetic
aggccctggctgctgatatggaggcaatcacagcatctccggagaatgactggttgtggatcttctcagactttagaagctccaagatgacgtatctgactctcatcacctaccagtctcgaccttttgggacagcggtg

SEQ ID NO: 446380 - DNA, 140 bp, Artificial Sequence
  Synthetic
caccgctgtcccaaaaggtcgagactggtaggtgatgagagtcagatacgtcatcttggagcttctaaagtctgagaagatccacaaccagtcattctccggagatgctgtgattgcctccatatcagcagccagggcct

SEQ ID NO: 446381 - DNA, 140 bp, Artificial Sequence
  Synthetic
aggccctggctgctgatatgcatgggttacctcagatcacttcgcgttcgggcacggacagagatcatggtgagtcccctgacagtagactcaacatgattcaactgagcagggcgatctgaccttttgggacagcggtg

SEQ ID NO: 446382 - DNA, 140 bp, Artificial Sequence
  Synthetic
caccgctgtcccaaaaggtcagatcgccctgctcagttgaatcatgttgagtctactgtcaggggactcaccatgatctctgtccgtgcccgaacgcgaagtgatctgaggtaacccatgcatatcagcagccagggcct

SEQ ID NO: 446383 - DNA, 140 bp, Artificial Sequence
  Synthetic
atacgccatgctgggtctccataaaacgcactagtgtggaagggaattgggctttgacagggggtatggagttaactagggaccccactgtttcggagcatgcatccttggttggtcttccgtacttgggagtcggccat

SEQ ID NO: 446384 - DNA, 140 bp, Artificial Sequence
  Synthetic
atggccgactcccaagtacggaagaccaaccaaggatgcatgctccgaaacagtggggtccctagttaactccataccccctgtcaaagcccaattcccttccacactagtgcgttttatggagacccagcatggcgtat

SEQ ID NO: 446385 - DNA, 140 bp, Artificial Sequence
  Synthetic
aggccctggctgctgatatgttttgtaaagatcgtagaacatcatactttgatgacaacccacaaaatgtgcgctaactggagtactataccgaacttcagattcttagccggaacctacgaccttttgggacagcggtg

SEQ ID NO: 446386 - DNA, 140 bp, Artificial Sequence
  Synthetic
caccgctgtcccaaaaggtcgtaggttccggctaagaatctgaagttcggtatagtactccagttagcgcacattttgtgggttgtcatcaaagtatgatgttctacgatctttacaaaacatatcagcagccagggcct

SEQ ID NO: 446387 - DNA, 140 bp, Artificial Sequence
  Synthetic
atacgccatgctgggtctccggtttatcaagcaaataaatctcactgcgagagaagcgctactatatttcttccacaagaactttgaggaagagataagaagaatgtttgagccagggcacgtacttgggagtcggccat

SEQ ID NO: 446388 - DNA, 140 bp, Artificial Sequence
  Synthetic
atggccgactcccaagtacgtgccctggctcaaacattcttcttatctcttcctcaaagttcttgtggaagaaatatagtagcgcttctctcgcagtgagatttatttgcttgataaaccggagacccagcatggcgtat

SEQ ID NO: 446389 - DNA, 140 bp, Artificial Sequence
  Synthetic
aggccctggctgctgatatgacagagaggaaagtgtcggtgacttctcataacggaagggtcatatcttcatgggaatcatataaaagcggaggtgagactaagctgtgaggacaagtcagaccttttgggacagcggtg

SEQ ID NO: 446390 - DNA, 140 bp, Artificial Sequence
  Synthetic
caccgctgtcccaaaaggtctgacttgtcctcacagcttagtctcacctccgcttttatatgattcccatgaagatatgacccttccgttatgagaagtcaccgacactttcctctctgtcatatcagcagccagggcct

SEQ ID NO: 446391 - DNA, 140 bp, Artificial Sequence
  Synthetic
atacgccatgctgggtctccctcattcactttgttggatgttacatgggtcaagtgagatctctgaatgcaacggttatcgccacgtgtgccccgcatgagatgtctgttctagggggttcgtacttgggagtcggccat

SEQ ID NO: 446392 - DNA, 140 bp, Artificial Sequence
  Synthetic
atggccgactcccaagtacgaaccccctagaacagacatctcatgcggggcacacgtggcgataaccgttgcattcagagatctcacttgacccatgtaacatccaacaaagtgaatgagggagacccagcatggcgtat

SEQ ID NO: 446393 - DNA, 140 bp, Artificial Sequence
  Synthetic
aggccctggctgctgatatgcctgaatacgtcccgctgaaagaacttacaagcaagaagaacatgaggaacttttgtatcaacggaggggttaaagtgtgtagcccgaatggttactcgtgaccttttgggacagcggtg

SEQ ID NO: 446394 - DNA, 140 bp, Artificial Sequence
  Synthetic
caccgctgtcccaaaaggtcacgagtaaccattcgggctacacactttaacccctccgttgatacaaaagttcctcatgttcttcttgcttgtaagttctttcagcgggacgtattcaggcatatcagcagccagggcct

SEQ ID NO: 446395 - DNA, 140 bp, Artificial Sequence
  Synthetic
atacgccatgctgggtctccgctctaatgagtcttggattcatgcgttgtgtcaagaagcaggaaaccccgatctgggagagagaacactggagagctttactcgcctgctcgaggatcccgtacttgggagtcggccat

SEQ ID NO: 446396 - DNA, 140 bp, Artificial Sequence
  Synthetic
atggccgactcccaagtacgggatcctcgagcaggcgagtaaagctctccagtgttctctctcccagatcggggtttcctgcttcttgacacaacgcatgaatccaagactcattagagcggagacccagcatggcgtat

SEQ ID NO: 446397 - DNA, 140 bp, Artificial Sequence
  Synthetic
aggccctggctgctgatatgaggggcaatatcctagtacctgagtcaaaaagatgggccagagtctcttgcatatcaaacgatcaaatagttaatcttgccaatataatgtcaacggtgtgaccttttgggacagcggtg

SEQ ID NO: 446398 - DNA, 140 bp, Artificial Sequence
  Synthetic
caccgctgtcccaaaaggtcacaccgttgacattatattggcaagattaactatttgatcgtttgatatgcaagagactctggcccatctttttgactcaggtactaggatattgcccctcatatcagcagccagggcct

SEQ ID NO: 446399 - DNA, 140 bp, Artificial Sequence
  Synthetic
atacgccatgctgggtctccggacagtctccctgacgacatgagacggcttcaattagaagatgaaaagtcatcaggttttggcggaatggccaaggcaggggaaagcaagtgtcaggaacgtacttgggagtcggccat

SEQ ID NO: 446400 - DNA, 140 bp, Artificial Sequence
  Synthetic
atggccgactcccaagtacgttcctgacacttgctttcccctgccttggccattccgccaaaacctgatgacttttcatcttctaattgaagccgtctcatgtcgtcagggagactgtccggagacccagcatggcgtat

SEQ ID NO: 446401 - DNA, 140 bp, Artificial Sequence
  Synthetic
aggccctggctgctgatatggattcctcaagatatggtctcagactgtcgaagagatcatatcctatgtaacggtcaacttccccagtctgcccaggaagtcttcagaagataaggctacgaccttttgggacagcggtg

SEQ ID NO: 446402 - DNA, 140 bp, Artificial Sequence
  Synthetic
caccgctgtcccaaaaggtcgtagccttatcttctgaagacttcctgggcagactggggaagttgaccgttacataggatatgatctcttcgacagtctgagaccatatcttgaggaatccatatcagcagccagggcct

SEQ ID NO: 446403 - DNA, 140 bp, Artificial Sequence
  Synthetic
aggccctggctgctgatatgagaggatgtattttctgtcctagatcaagtgtttggattgaagagagtgttttctagaacacacgagttttttcagaagtcctggatttattattcagacgaccttttgggacagcggtg

SEQ ID NO: 446404 - DNA, 140 bp, Artificial Sequence
  Synthetic
caccgctgtcccaaaaggtcgtctgaataataaatccaggacttctgaaaaaactcgtgtgttctagaaaacactctcttcaatccaaacacttgatctaggacagaaaatacatcctctcatatcagcagccagggcct

SEQ ID NO: 446405 - DNA, 140 bp, Artificial Sequence
  Synthetic
atacgccatgctgggtctcccaaagatgcaatcagaaaagccctatatgatgaggtagacaaagtggagaactcagagtttagagaagcgatcctcttgtccaagacccatagggataaccgtacttgggagtcggccat

SEQ ID NO: 446406 - DNA, 140 bp, Artificial Sequence
  Synthetic
atggccgactcccaagtacggttatccctatgggtcttggacaagaggatcgcttctctaaactctgagttctccactttgtctacctcatcatatagggcttttctgattgcatctttgggagacccagcatggcgtat

SEQ ID NO: 446407 - DNA, 140 bp, Artificial Sequence
  Synthetic
atacgccatgctgggtctccggtccttctgctctagaatggtctgctgccaacgaagaggatgacccatctgtggaggctgaaatagctcaccaaattgctgagagcttttctaaaaaatcgtacttgggagtcggccat

SEQ ID NO: 446408 - DNA, 140 bp, Artificial Sequence
  Synthetic
atggccgactcccaagtacgattttttagaaaagctctcagcaatttggtgagctatttcagcctccacagatgggtcatcctcttcgttggcagcagaccattctagagcagaaggaccggagacccagcatggcgtat

SEQ ID NO: 446409 - DNA, 140 bp, Artificial Sequence
  Synthetic
atacgccatgctgggtctcctgtgacccgcttggcccacgacggatcaaaactccctctgagatgtgtgctggggtgggttgccctagccaactccaaaaagttccagctgttagttgagcgtacttgggagtcggccat

SEQ ID NO: 446410 - DNA, 140 bp, Artificial Sequence
  Synthetic
atggccgactcccaagtacgctcaactaacagctggaactttttggagttggctagggcaacccaccccagcacacatctcagagggagttttgatccgtcgtgggccaagcgggtcacaggagacccagcatggcgtat

SEQ ID NO: 446411 - DNA, 140 bp, Artificial Sequence
  Synthetic
atacgccatgctgggtctcctgctccaaatccagcatgaaaaaaacaggcaacaccactgataaaatgaactttctacgcaagatagtgaagaactgtagagatgaggacactcagaagccgtacttgggagtcggccat

SEQ ID NO: 446412 - DNA, 140 bp, Artificial Sequence
  Synthetic
atggccgactcccaagtacggcttctgagtgtcctcatctctacagttcttcactatcttgcgtagaaagttcattttatcagtggtgttgcctgtttttttcatgctggatttggagcaggagacccagcatggcgtat

SEQ ID NO: 446413 - DNA, 140 bp, Artificial Sequence
  Synthetic
aggccctggctgctgatatggccggattaatgttagagtggttgaaaacggggaacagacctcaccgaatgaccctgacggacaattgctccaggtcttacaaagttctgaaagattattgaccttttgggacagcggtg

SEQ ID NO: 446414 - DNA, 140 bp, Artificial Sequence
  Synthetic
caccgctgtcccaaaaggtcaataatctttcagaactttgtaagacctggagcaattgtccgtcagggtcattcggtgaggtctgttccccgttttcaaccactctaacattaatccggccatatcagcagccagggcct

SEQ ID NO: 446415 - DNA, 140 bp, Artificial Sequence
  Synthetic
atacgccatgctgggtctccttggaatactctcaggaaatcacctgggatgatgatacagaattcgtcggactggaaatacgagtgagtgcaagacaatgccacatccaaggcaggatttcgtacttgggagtcggccat

SEQ ID NO: 446416 - DNA, 140 bp, Artificial Sequence
  Synthetic
atggccgactcccaagtacgaaatcctgccttggatgtggcattgtcttgcactcactcgtatttccagtccgacgaattctgtatcatcatcccaggtgatttcctgagagtattccaaggagacccagcatggcgtat

SEQ ID NO: 446417 - DNA, 140 bp, Artificial Sequence
  Synthetic
aggccctggctgctgatatgagagcacatgggcttgactccaaccttcgggagcaatagaacaaaaatatgtcatggtgccgttgaatcgctgcattttatcagaatcaaatctattaccgaccttttgggacagcggtg

SEQ ID NO: 446418 - DNA, 140 bp, Artificial Sequence
  Synthetic
caccgctgtcccaaaaggtcggtaatagatttgattctgataaaatgcagcgattcaacggcaccatgacatatttttgttctattgctcccgaaggttggagtcaagcccatgtgctctcatatcagcagccagggcct

SEQ ID NO: 446419 - DNA, 140 bp, Artificial Sequence
  Synthetic
atacgccatgctgggtctccaatttcctcgttgtgtttcgggaaattcccaatttacacgataccagacaagatcggcccctggagtcccatcgacatacatcatctcagctgtcctaatcgtacttgggagtcggccat

SEQ ID NO: 446420 - DNA, 140 bp, Artificial Sequence
  Synthetic
atggccgactcccaagtacgattaggacagctgagatgatgtatgtcgatgggactccaggggccgatcttgtctggtatcgtgtaaattgggaatttcccgaaacacaacgaggaaattggagacccagcatggcgtat

SEQ ID NO: 446421 - DNA, 140 bp, Artificial Sequence
  Synthetic
atacgccatgctgggtctcccttgtaccggcgttgtgacagaagccgagacctacactaattttgtgggttatgtcaccactacgttcaagagaaaacactttcgccctatgccagatgccgtacttgggagtcggccat

SEQ ID NO: 446422 - DNA, 140 bp, Artificial Sequence
  Synthetic
atggccgactcccaagtacggcatctggcatagggcgaaagtgttttctcttgaacgtagtggtgacataacccacaaaattagtgtaggtctcggcttctgtcacaacgccggtacaagggagacccagcatggcgtat

SEQ ID NO: 446423 - DNA, 140 bp, Artificial Sequence
  Synthetic
aggccctggctgctgatatgatgaatggaggtcgactgaagagatcgcatatacggagatatgtatcagtcagttccaatcatcaagctcgtccaaactcattcgcagagtttctaaacagaccttttgggacagcggtg

SEQ ID NO: 446424 - DNA, 140 bp, Artificial Sequence
  Synthetic
caccgctgtcccaaaaggtctgtttagaaactctgcgaatgagtttggacgagcttgatgattggaactgactgatacatatctccgtatatgcgatctcttcagtcgacctccattcatcatatcagcagccagggcct

SEQ ID NO: 446425 - DNA, 140 bp, Artificial Sequence
  Synthetic
atacgccatgctgggtctccaccaccaaagagtctcttgttatcatatctccaagtgtggctgatttggacccatacgacaaatcccttcactcaagagttttccctaatgggaagtgttcgtacttgggagtcggccat

SEQ ID NO: 446426 - DNA, 140 bp, Artificial Sequence
  Synthetic
atggccgactcccaagtacgaacacttcccattagggaaaactcttgagtgaagggatttgtcgtatgggtccaaatcagccacacttggagatatgataacaagagactctttggtggtggagacccagcatggcgtat

SEQ ID NO: 446427 - DNA, 140 bp, Artificial Sequence
  Synthetic
atacgccatgctgggtctcccaacagcaaggggaagagagcatctaaggggggcaggacttgtggattcgtggatgaaaggggcctgtacaagtctctaagaggagcatgtaaacttaagcgtacttgggagtcggccat

SEQ ID NO: 446428 - DNA, 140 bp, Artificial Sequence
  Synthetic
atggccgactcccaagtacgcttaagtttacatgctcctcttagagacttgtacaggcccctttcatccacgaatccacaagtcctgccccccttagatgctctcttccccttgctgttgggagacccagcatggcgtat

SEQ ID NO: 446429 - DNA, 140 bp, Artificial Sequence
  Synthetic
aggccctggctgctgatatgtgctcccgtcctttgatcagtcatttttttcacgaggccctctaaaaggatacttggggtcatccacctccatgtcgacccagctgttccatgcttgggagaccttttgggacagcggtg

SEQ ID NO: 446430 - DNA, 140 bp, Artificial Sequence
  Synthetic
caccgctgtcccaaaaggtctcccaagcatggaacagctgggtcgacatggaggtggatgaccccaagtatccttttagagggcctcgtgaaaaaaatgactgatcaaaggacgggagcacatatcagcagccagggcct

SEQ ID NO: 446431 - DNA, 140 bp, Artificial Sequence
  Synthetic
aggccctggctgctgatatgggtttggaaaggcatatactatattcaacaagaccctgatggaagctgatgctcactacaagtcagttcagacttggaacgagatcatcccctcaaaagggaccttttgggacagcggtg

SEQ ID NO: 446432 - DNA, 140 bp, Artificial Sequence
  Synthetic
caccgctgtcccaaaaggtcccttttgaggggatgatctcgttccaagtctgaactgacttgtagtgagcatcagcttccatcagggtcttgttgaatatagtatatgcctttccaaacccatatcagcagccagggcct

SEQ ID NO: 446433 - DNA, 140 bp, Artificial Sequence
  Synthetic
atacgccatgctgggtctcccttacggcagaagggctggagtctagtcagcttattgatgatagatagagaatctcaaaccaggaacacaagaaccaagatactagctcaaggagacaaccgtacttgggagtcggccat

SEQ ID NO: 446434 - DNA, 140 bp, Artificial Sequence
  Synthetic
atggccgactcccaagtacggttgtctccttgagctagtatcttggttcttgtgttcctggtttgagattctctatctatcatcaataagctgactagactccagcccttctgccgtaagggagacccagcatggcgtat

SEQ ID NO: 446435 - DNA, 140 bp, Artificial Sequence
  Synthetic
atacgccatgctgggtctcccaatcatccctacttcaacaacatatggagctgttggagtcttctgtaatccccctaatgcatcccttggcagacccatcaacagtcttcaaggacggtgcgtacttgggagtcggccat

SEQ ID NO: 446436 - DNA, 140 bp, Artificial Sequence
  Synthetic
atggccgactcccaagtacgcaccgtccttgaagactgttgatgggtctgccaagggatgcattagggggattacagaagactccaacagctccatatgttgttgaagtagggatgattgggagacccagcatggcgtat

SEQ ID NO: 446437 - DNA, 140 bp, Artificial Sequence
  Synthetic
atacgccatgctgggtctccgagtgcaggtgctctggcaatattattgttaacaatcttcttaatgacatgttgcagaagggtcaatagaacagaatcagcacagcgagatcctggagagcgtacttgggagtcggccat

SEQ ID NO: 446438 - DNA, 140 bp, Artificial Sequence
  Synthetic
atggccgactcccaagtacgctctccaggatctcgctgtgctgattctgttctattgacccttctgcaacatgtcattaagaagattgttaacaataatattgccagagcacctgcactcggagacccagcatggcgtat

SEQ ID NO: 446439 - DNA, 140 bp, Artificial Sequence
  Synthetic
atacgccatgctgggtctcccatgttgattctggtaatatatgacgtcctctgacagtatcatttactaatggtgctctcatcccctaaggactgataccaaaggtcatgaacaatccaacgtacttgggagtcggccat

SEQ ID NO: 446440 - DNA, 140 bp, Artificial Sequence
  Synthetic
atggccgactcccaagtacgttggattgttcatgacctttggtatcagtccttaggggatgagagcaccattagtaaatgatactgtcagaggacgtcatatattaccagaatcaacatgggagacccagcatggcgtat

SEQ ID NO: 446441 - DNA, 140 bp, Artificial Sequence
  Synthetic
atacgccatgctgggtctcctctcctccacacattgctttcagaaaattgcttctcttttagagctgagagaacttctccttttaacaatcattcatgaactctgcacgacagggtggatcgtacttgggagtcggccat

SEQ ID NO: 446442 - DNA, 140 bp, Artificial Sequence
  Synthetic
atggccgactcccaagtacgatccaccctgtcgtgcagagttcatgaatgattgttaaaaggagaagttctctcagctctaaaagagaagcaattttctgaaagcaatgtgtggaggagaggagacccagcatggcgtat

SEQ ID NO: 446443 - DNA, 140 bp, Artificial Sequence
  Synthetic
atacgccatgctgggtctccaaaaatgtaacacccctacaatggatgccgacaagattgtatttaaagtcaataatcaggtggtctccttgaagcccgagatcattgtagatcaatatgacgtacttgggagtcggccat

SEQ ID NO: 446444 - DNA, 140 bp, Artificial Sequence
  Synthetic
atggccgactcccaagtacgtcatattgatctacaatgatctcgggcttcaaggagaccacctgattattgactttaaatacaatcttgtcggcatccattgtaggggtgttacatttttggagacccagcatggcgtat

SEQ ID NO: 446445 - DNA, 140 bp, Artificial Sequence
  Synthetic
atacgccatgctgggtctccggtgctctcatcccccaaggactgacactgaaagttggggataagccaattgacatctcatacaactctatgcttgactttgggcagaggccatagcaagcgtacttgggagtcggccat

SEQ ID NO: 446446 - DNA, 140 bp, Artificial Sequence
  Synthetic
atggccgactcccaagtacgcttgctatggcctctgcccaaagtcaagcatagagttgtatgagatgtcaattggcttatccccaactttcagtgtcagtccttgggggatgagagcaccggagacccagcatggcgtat

SEQ ID NO: 446447 - DNA, 140 bp, Artificial Sequence
  Synthetic
atacgccatgctgggtctccaatgctgccaaacttgacccggatgatgtgtgctcctacttagcagctgcaatgcaattttttgaagggacatgccctgaagattggatcagctatgggacgtacttgggagtcggccat

SEQ ID NO: 446448 - DNA, 140 bp, Artificial Sequence
  Synthetic
atggccgactcccaagtacgtcccatagctgatccaatcttcagggcatgtcccttcaaaaaattgcattgcagctgctaagtaggagcacacatcatccgggtcaagtttggcagcattggagacccagcatggcgtat

SEQ ID NO: 446449 - DNA, 140 bp, Artificial Sequence
  Synthetic
atacgccatgctgggtctcctcctatgagggacacaagcaatatgtcacaaccatctcacatcccgacaaggtatgcaagactacaaagggctgggccatccaagcttcttagtcaagaacgtacttgggagtcggccat

SEQ ID NO: 446450 - DNA, 140 bp, Artificial Sequence
  Synthetic
atggccgactcccaagtacgttcttgactaagaagcttggatggcccagccctttgtagtcttgcataccttgtcgggatgtgagatggttgtgacatattgcttgtgtccctcataggaggagacccagcatggcgtat

SEQ ID NO: 446451 - DNA, 140 bp, Artificial Sequence
  Synthetic
atacgccatgctgggtctccatgaggcggaagattttgttgaggttcatcttccggatgttcacaaacaggtctcggagattgaccttggtctcccgagttgggggaagtatctgttgatcgtacttgggagtcggccat

SEQ ID NO: 446452 - DNA, 140 bp, Artificial Sequence
  Synthetic
atggccgactcccaagtacgatcaacagatacttcccccaactcgggagaccaaggtcaatctccgagacctgtttgtgaacatccggaagatgaacctcaacaaaatcttccgcctcatggagacccagcatggcgtat

SEQ ID NO: 446453 - DNA, 140 bp, Artificial Sequence
  Synthetic
atacgccatgctgggtctccgttgacaagagaccccactgtttctgagcatgcgtccttagttggtcttctcttgagtttgtataggttgagcaaaatatcaggacaaaacactggcaaccgtacttgggagtcggccat

SEQ ID NO: 446454 - DNA, 140 bp, Artificial Sequence
  Synthetic
atggccgactcccaagtacggttgccagtgttttgtcctgatattttgctcaacctatacaaactcaagagaagaccaactaaggacgcatgctcagaaacagtggggtctcttgtcaacggagacccagcatggcgtat

SEQ ID NO: 446455 - DNA, 140 bp, Artificial Sequence
  Synthetic
atacgccatgctgggtctccgtgctaactggagtaccataccgaacttcagattcttggctggaacttacgacatgtttttctcccggattgagcatctgtattcagctatcagagtgggcgtacttgggagtcggccat

SEQ ID NO: 446456 - DNA, 140 bp, Artificial Sequence
  Synthetic
atggccgactcccaagtacgcccactctgatagctgaatacagatgctcaatccgggagaaaaacatgtcgtaagttccagccaagaatctgaagttcggtatggtactccagttagcacggagacccagcatggcgtat

SEQ ID NO: 446457 - DNA, 140 bp, Artificial Sequence
  Synthetic
atacgccatgctgggtctccttcccccccacacaccatgcgtttagatgaccgcctctctttgagatctgaggggttctatcttcttgacagtccttcacggactttgtgcaacagggtgcgtacttgggagtcggccat

SEQ ID NO: 446458 - DNA, 140 bp, Artificial Sequence
  Synthetic
atggccgactcccaagtacgcaccctgttgcacaaagtccgtgaaggactgtcaagaagatagaacccctcagatctcaaagagaggcggtcatctaaacgcatggtgtgtgggggggaaggagacccagcatggcgtat

SEQ ID NO: 446459 - DNA, 140 bp, Artificial Sequence
  Synthetic
atacgccatgctgggtctccatgatctccctctggctgtacggtgcccactctgaatctaacaggagccggaagtgtataaccgacttggctcaattttactccaagtcttcccccatagcgtacttgggagtcggccat

SEQ ID NO: 446460 - DNA, 140 bp, Artificial Sequence
  Synthetic
atggccgactcccaagtacgctatgggggaagacttggagtaaaattgagccaagtcggttatacacttccggctcctgttagattcagagtgggcaccgtacagccagagggagatcatggagacccagcatggcgtat

SEQ ID NO: 446461 - DNA, 140 bp, Artificial Sequence
  Synthetic
atacgccatgctgggtctccttccacaagaatttcgaggaagagataagaagaatgttcgagcctgggcaagagaccgctgttcctcattcctatttcattcacttccgatcattgggcccgtacttgggagtcggccat

SEQ ID NO: 446462 - DNA, 140 bp, Artificial Sequence
  Synthetic
atggccgactcccaagtacgggcccaatgatcggaagtgaatgaaataggaatgaggaacagcggtctcttgcccaggctcgaacattcttcttatctcttcctcgaaattcttgtggaaggagacccagcatggcgtat

SEQ ID NO: 446463 - DNA, 140 bp, Artificial Sequence
  Synthetic
aggccctggctgctgatatgaatcggaaactcagataactctatgcttgagtttagatagatgccatagcatgttcccctacattagaccaaataggggtttagttgaaagaaccgacttgaccttttgggacagcggtg

SEQ ID NO: 446464 - DNA, 140 bp, Artificial Sequence
  Synthetic
caccgctgtcccaaaaggtcaagtcggttctttcaactaaacccctatttggtctaatgtaggggaacatgctatggcatctatctaaactcaagcatagagttatctgagtttccgattcatatcagcagccagggcct

SEQ ID NO: 446465 - DNA, 140 bp, Artificial Sequence
  Synthetic
atacgccatgctgggtctccacggtatttggccaatatatactcctcttatttgttctttcacgtgatcaccctttacatgaacgccttggactgggatgaggagaagaccatcctggcacgtacttgggagtcggccat

SEQ ID NO: 446466 - DNA, 140 bp, Artificial Sequence
  Synthetic
atggccgactcccaagtacgtgccaggatggtcttctcctcatcccagtccaaggcgttcatgtaaagggtgatcacgtgaaagaacaaataagaggagtatatattggccaaataccgtggagacccagcatggcgtat

SEQ ID NO: 446467 - DNA, 140 bp, Artificial Sequence
  Synthetic
atacgccatgctgggtctccaacagttattgccgcttgtgccccccatgagatgtctgttctgggaggctatttgggagaagagttttttggaaagggaacgtttgaaagaagattcttccgtacttgggagtcggccat

SEQ ID NO: 446468 - DNA, 140 bp, Artificial Sequence
  Synthetic
atggccgactcccaagtacggaagaatcttctttcaaacgttccctttccaaaaaactcttctcccaaatagcctcccagaacagacatctcatggggggcacaagcggcaataactgttggagacccagcatggcgtat

SEQ ID NO: 446469 - DNA, 140 bp, Artificial Sequence
  Synthetic
atacgccatgctgggtctccgaaaaaaactgtggaatggaggagcaattaacaacacttctcctcctgataacggcaccatgatgattgatccaggggaggtttatgatgacccgattgacgtacttgggagtcggccat

SEQ ID NO: 446470 - DNA, 140 bp, Artificial Sequence
  Synthetic
atggccgactcccaagtacgtcaatcgggtcatcataaacctcccctggatcaatcatcatggtgccgttatcaggaggagaagtgttgttaattgctcctccattccacagtttttttcggagacccagcatggcgtat

SEQ ID NO: 446471 - DNA, 140 bp, Artificial Sequence
  Synthetic
atacgccatgctgggtctccacttttctggtgagaccaggagtcctgaagctgtctatactcgaatcatgataaacggaggtcgactaaagagatcacacataaggagatacgtttccgtcgtacttgggagtcggccat

SEQ ID NO: 446472 - DNA, 140 bp, Artificial Sequence
  Synthetic
atggccgactcccaagtacgacggaaacgtatctccttatgtgtgatctctttagtcgacctccgtttatcatgattcgagtatagacagcttcaggactcctggtctcaccagaaaagtggagacccagcatggcgtat

SEQ ID NO: 446473 - DNA, 140 bp, Artificial Sequence
  Synthetic
atacgccatgctgggtctccatcaaaatattggagccatatgttgtgaacatcttagtccagcaggcggaaaaatttaggcctctcattcattccctgggggatttctctgtatttataacgtacttgggagtcggccat

SEQ ID NO: 446474 - DNA, 140 bp, Artificial Sequence
  Synthetic
atggccgactcccaagtacgttataaatacagagaaatcccccagggaatgaatgagaggcctaaatttttccgcctgctggactaagatgttcacaacatatggctccaatattttgatggagacccagcatggcgtat

SEQ ID NO: 446475 - DNA, 140 bp, Artificial Sequence
  Synthetic
atacgccatgctgggtctcccctacacattgtgtgtaccccacatgaaaaaaactaacacccctccttctgaaccatctcaaacatgagcaagatcttcgtcaatccgagtgcaatcagacgtacttgggagtcggccat

SEQ ID NO: 446476 - DNA, 140 bp, Artificial Sequence
  Synthetic
atggccgactcccaagtacgtctgattgcactcggattgacgaagatcttgctcatgtttgagatggttcagaaggaggggtgttagtttttttcatgtggggtacacacaatgtgtaggggagacccagcatggcgtat

SEQ ID NO: 446477 - DNA, 140 bp, Artificial Sequence
  Synthetic
atacgccatgctgggtctcccagaaacatagaagacaatcaagctcatctccagggggagcccatagaagtggacaatctccctgaggacatgaggcggcttcaactggatgacggaaagcgtacttgggagtcggccat

SEQ ID NO: 446478 - DNA, 140 bp, Artificial Sequence
  Synthetic
atggccgactcccaagtacgctttccgtcatccagttgaagccgcctcatgtcctcagggagattgtccacttctatgggctccccctggagatgagcttgattgtcttctatgtttctgggagacccagcatggcgtat

SEQ ID NO: 446479 - DNA, 140 bp, Artificial Sequence
  Synthetic
atacgccatgctgggtctcctcctatcaggagtgtttggcaagtgaccttgccagaaggatcctcaggtggggatttgacaagtactctaaatggtatcttgatttgcgacttctttcgacgtacttgggagtcggccat

SEQ ID NO: 446480 - DNA, 140 bp, Artificial Sequence
  Synthetic
atggccgactcccaagtacgtcgaaagaagtcgcaaatcaagataccatttagagtacttgtcaaatccccacctgaggatccttctggcaaggtcacttgccaaacactcctgataggaggagacccagcatggcgtat

SEQ ID NO: 446481 - DNA, 140 bp, Artificial Sequence
  Synthetic
atacgccatgctgggtctccggacttccagatggatgaaggagaagatccagccctcctgttccagtcatacctggacaatgttggggtccaaatggtcagacaaatgaggtccggagagcgtacttgggagtcggccat

SEQ ID NO: 446482 - DNA, 140 bp, Artificial Sequence
  Synthetic
atggccgactcccaagtacgctctccggacctcatttgtctgaccatttggaccccaacattgtccaggtatgactggaacaggagggctggatcttctccttcatccatctggaagtccggagacccagcatggcgtat

SEQ ID NO: 446483 - DNA, 140 bp, Artificial Sequence
  Synthetic
aggccctggctgctgatatgacctggacaatgttggggtccaaatggtcagacaaatgaggtccggagagagattcctcaagatttggtctcagactgtggaggaaattatctcctatgtgaccttttgggacagcggtg

SEQ ID NO: 446484 - DNA, 140 bp, Artificial Sequence
  Synthetic
caccgctgtcccaaaaggtcacataggagataatttcctccacagtctgagaccaaatcttgaggaatctctctccggacctcatttgtctgaccatttggaccccaacattgtccaggtcatatcagcagccagggcct

SEQ ID NO: 446485 - DNA, 140 bp, Artificial Sequence
  Synthetic
atacgccatgctgggtctccgtttaaggatcaaatatggggattgctgattgtgaccaaagactttgtgtactcccaaagctctggctgcctctttgatagaaactatacacttatgctgcgtacttgggagtcggccat

SEQ ID NO: 446486 - DNA, 140 bp, Artificial Sequence
  Synthetic
atggccgactcccaagtacgcagcataagtgtatagtttctatcaaagaggcagccagagctttgggagtacacaaagtctttggtcacaatcagcaatccccatatttgatccttaaacggagacccagcatggcgtat

SEQ ID NO: 446487 - DNA, 140 bp, Artificial Sequence
  Synthetic
atacgccatgctgggtctccgatcttcgagatccccgaatcaatggacccatctgagatactagatgataaatcacactctttcactagaacaagactagcgtcgtggctatcagagaaccgtacttgggagtcggccat

SEQ ID NO: 446488 - DNA, 140 bp, Artificial Sequence
  Synthetic
atggccgactcccaagtacggttctctgatagccacgacgctagtcttgttctagtgaaagagtgtgatttatcatctagtatctcagatgggtccattgattcggggatctcgaagatcggagacccagcatggcgtat

SEQ ID NO: 446489 - DNA, 140 bp, Artificial Sequence
  Synthetic
aggccctggctgctgatatgaatcacactctttcactagaacaagactagcgtcgtggctatcagagaacagaggagggccggtccccagcgagaaggtcattattacagctctttccaagaccttttgggacagcggtg

SEQ ID NO: 446490 - DNA, 140 bp, Artificial Sequence
  Synthetic
caccgctgtcccaaaaggtcttggaaagagctgtaataatgaccttctcgctggggaccggccctcctctgttctctgatagccacgacgctagtcttgttctagtgaaagagtgtgattcatatcagcagccagggcct

SEQ ID NO: 446491 - DNA, 140 bp, Artificial Sequence
  Synthetic
atacgccatgctgggtctcccagagaaagagccagtccttgaaagcccgaacagaggttcatacgacctctggtcctccagctcttgaatggtctgctaccaacgaagaagacgacctatcgtacttgggagtcggccat

SEQ ID NO: 446492 - DNA, 140 bp, Artificial Sequence
  Synthetic
atggccgactcccaagtacgataggtcgtcttcttcgttggtagcagaccattcaagagctggaggaccagaggtcgtatgaacctctgttcgggctttcaaggactggctctttctctgggagacccagcatggcgtat

SEQ ID NO: 446493 - DNA, 140 bp, Artificial Sequence
  Synthetic
aggccctggctgctgatatgacctcctgtcaaccccaaagaattcttgaaatctatagaccttgggggattgccagacgaagatttgataatcggcctcaaacctaaggaaagggagctggaccttttgggacagcggtg

SEQ ID NO: 446494 - DNA, 140 bp, Artificial Sequence
  Synthetic
caccgctgtcccaaaaggtccagctccctttccttaggtttgaggccgattatcaaatcttcgtctggcaatcccccaaggtctatagatttcaagaattctttggggttgacaggaggtcatatcagcagccagggcct

SEQ ID NO: 446495 - DNA, 140 bp, Artificial Sequence
  Synthetic
atacgccatgctgggtctccgttgaagatgaaccttgacgacatagtcaaggagtcaaagaatgtgccgggtataacccatttggctcatgatggatctaagctccctctcagatgtatacgtacttgggagtcggccat

SEQ ID NO: 446496 - DNA, 140 bp, Artificial Sequence
  Synthetic
atggccgactcccaagtacgtatacatctgagagggagcttagatccatcatgagccaaatgggttatacccggcacattctttgactccttgactatgtcgtcaaggttcatcttcaacggagacccagcatggcgtat

SEQ ID NO: 446497 - DNA, 140 bp, Artificial Sequence
  Synthetic
aggccctggctgctgatatgacgcactgactatgacagacaacttgaacaaagtgtttaaaaagctgatcgacagagtcaccggacaggggcttttagactattcaagggttacatacgcgaccttttgggacagcggtg

SEQ ID NO: 446498 - DNA, 140 bp, Artificial Sequence
  Synthetic
caccgctgtcccaaaaggtcgcgtatgtaacccttgaatagtctaaaagcccctgtccggtgactctgtcgatcagctttttaaacactttgttcaagttgtctgtcatagtcagtgcgtcatatcagcagccagggcct

SEQ ID NO: 446499 - DNA, 140 bp, Artificial Sequence
  Synthetic
atacgccatgctgggtctccgacagagtcaccggacaggggcttttagactattcaagggttacatacgcttttcacctggactatgagaagtggaacaatcatcagaggctggaatcgacgtacttgggagtcggccat

SEQ ID NO: 446500 - DNA, 140 bp, Artificial Sequence
  Synthetic
atggccgactcccaagtacgtcgattccagcctctgatgattgttccacttctcatagtccaggtgaaaagcgtatgtaacccttgaatagtctaaaagcccctgtccggtgactctgtcggagacccagcatggcgtat

SEQ ID NO: 446501 - DNA, 140 bp, Artificial Sequence
  Synthetic
atacgccatgctgggtctcccctgctgacagtttttgaactctggcatgctagataatggagcctaacctgttctgggttcgacatgaaaaaaacagacaacaccactgataagatgaaccgtacttgggagtcggccat

SEQ ID NO: 446502 - DNA, 140 bp, Artificial Sequence
  Synthetic
atggccgactcccaagtacggttcatcttatcagtggtgttgtctgtttttttcatgtcgaacccagaacaggttaggctccattatctagcatgccagagttcaaaaactgtcagcaggggagacccagcatggcgtat

SEQ ID NO: 446503 - DNA, 140 bp, Artificial Sequence
  Synthetic
atacgccatgctgggtctcccagaatacgtcccgttgaaggaactcacgggcaagaaaaacatgaggaacttctgtatcaatggggaggtcagggtgtgcagtccgactggctattcgttcgtacttgggagtcggccat

SEQ ID NO: 446504 - DNA, 140 bp, Artificial Sequence
  Synthetic
atggccgactcccaagtacgaacgaatagccagtcggactgcacaccctgacctccccattgatacagaagttcctcatgtttttcttgcccgtgagttccttcaacgggacgtattctgggagacccagcatggcgtat

SEQ ID NO: 446505 - DNA, 140 bp, Artificial Sequence
  Synthetic
atacgccatgctgggtctcccgaattgatctcgggggtgatctcatatatcctcttgagattggataaccacccatccttgtatataatgctcagagagccatctcttagaggagagatccgtacttgggagtcggccat

SEQ ID NO: 446506 - DNA, 140 bp, Artificial Sequence
  Synthetic
atggccgactcccaagtacggatctctcctctaagagatggctctctgagcattatatacaaggatgggtggttatccaatctcaagaggatatatgagatcacccccgagatcaattcgggagacccagcatggcgtat

SEQ ID NO: 446507 - DNA, 140 bp, Artificial Sequence
  Synthetic
atacgccatgctgggtctccgactaccggatgaggatttaataatcggtcttaagcctaaggaaagggagctaaaaattgaaggtcggttttttgcattgatgtcctggaatttgaggttcgtacttgggagtcggccat

SEQ ID NO: 446508 - DNA, 140 bp, Artificial Sequence
  Synthetic
atggccgactcccaagtacgaacctcaaattccaggacatcaatgcaaaaaaccgaccttcaatttttagctccctttccttaggcttaagaccgattattaaatcctcatccggtagtcggagacccagcatggcgtat

SEQ ID NO: 446509 - DNA, 140 bp, Artificial Sequence
  Synthetic
atacgccatgctgggtctcctctcatcttccaatgggctgattccaggggtccccttgagggggaggagttggagtactctcaagagatcacctgggatgatgacactgagtttgtcggacgtacttgggagtcggccat

SEQ ID NO: 446510 - DNA, 140 bp, Artificial Sequence
  Synthetic
atggccgactcccaagtacgtccgacaaactcagtgtcatcatcccaggtgatctcttgagagtactccaactcctccccctcaaggggacccctggaatcagcccattggaagatgagaggagacccagcatggcgtat

SEQ ID NO: 446511 - DNA, 140 bp, Artificial Sequence
  Synthetic
atacgccatgctgggtctccattgacagagttactggacagggacttttagactattcaagggttacatatgcttttcacctggactacgagaagtggaacaatcatcagaggctggaatcgtacttgggagtcggccat

SEQ ID NO: 446512 - DNA, 140 bp, Artificial Sequence
  Synthetic
atggccgactcccaagtacgattccagcctctgatgattgttccacttctcgtagtccaggtgaaaagcatatgtaacccttgaatagtctaaaagtccctgtccagtaactctgtcaatggagacccagcatggcgtat

SEQ ID NO: 446513 - DNA, 140 bp, Artificial Sequence
  Synthetic
atacgccatgctgggtctccttcggacacaaaggtcagaagaggacaaggactcgtctttgcttctagaatagtcagattatatcccacagacttaccacttgtttacctctggaggaggcgtacttgggagtcggccat

SEQ ID NO: 446514 - DNA, 140 bp, Artificial Sequence
  Synthetic
atggccgactcccaagtacgcctcctccagaggtaaacaagtggtaagtctgtgggatataatctgactattctagaagcaaagacgagtccttgtcctcttctgacctttgtgtccgaaggagacccagcatggcgtat

SEQ ID NO: 446515 - DNA, 140 bp, Artificial Sequence
  Synthetic
aggccctggctgctgatatgcctgggagctgtacaaaagtggaggagaaaccaatctgtgaaggcgggtcatctccctcacactctgtgttaagagggttacctctctctaggatctgatgaccttttgggacagcggtg

SEQ ID NO: 446516 - DNA, 140 bp, Artificial Sequence
  Synthetic
caccgctgtcccaaaaggtcatcagatcctagagagaggtaaccctcttaacacagagtgtgagggagatgacccgccttcacagattggtttctcctccacttttgtacagctcccaggcatatcagcagccagggcct

SEQ ID NO: 446517 - DNA, 140 bp, Artificial Sequence
  Synthetic
aggccctggctgctgatatgacggtaccatgctagtaaacccggactataaggctattcaacacttgtcaagagcgttcccctcagttacagggtttataacccaagtgacttcgtccttgaccttttgggacagcggtg

SEQ ID NO: 446518 - DNA, 140 bp, Artificial Sequence
  Synthetic
caccgctgtcccaaaaggtcaaggacgaagtcacttgggttataaaccctgtaactgaggggaacgctcttgacaagtgttgaatagccttatagtccgggtttactagcatggtaccgtcatatcagcagccagggcct

SEQ ID NO: 446519 - DNA, 140 bp, Artificial Sequence
  Synthetic
aggccctggctgctgatatgatctgggagagagaacactggagagttttactcgccttctcgaggatcctactaccctaaatattaaaggaggggccagccctaccattcttcttaaagagaccttttgggacagcggtg

SEQ ID NO: 446520 - DNA, 140 bp, Artificial Sequence
  Synthetic
caccgctgtcccaaaaggtctctttaagaagaatggtagggctggcccctcctttaatatttagggtagtaggatcctcgagaaggcgagtaaaactctccagtgttctctctcccagatcatatcagcagccagggcct

SEQ ID NO: 446521 - DNA, 140 bp, Artificial Sequence
  Synthetic
atacgccatgctgggtctccaagacttaaggaaagatgattcctcaggctcttctgtttgtaccctttctgggttttccgttgtgtctcgggaagtttcctatttacacgataccagacacgtacttgggagtcggccat

SEQ ID NO: 446522 - DNA, 140 bp, Artificial Sequence
  Synthetic
atggccgactcccaagtacgtgtctggtatcgtgtaaataggaaacttcccgagacacaacggaaaacccagaaagggtacaaacagaagagcctgaggaatcatctttccttaagtcttggagacccagcatggcgtat

SEQ ID NO: 446523 - DNA, 140 bp, Artificial Sequence
  Synthetic
atacgccatgctgggtctccatcaggttttgtgtccgacatatatgctgtcgccggggctctcaagagaagggcttctctacgagttagagagcatatcaagaaatgccctctcaatctacgtacttgggagtcggccat

SEQ ID NO: 446524 - DNA, 140 bp, Artificial Sequence
  Synthetic
atggccgactcccaagtacgtagattgagagggcatttcttgatatgctctctaactcgtagagaagcccttctcttgagagccccggcgacagcatatatgtcggacacaaaacctgatggagacccagcatggcgtat

SEQ ID NO: 446525 - DNA, 140 bp, Artificial Sequence
  Synthetic
aggccctggctgctgatatgctttctacgcaaaatcgtgaaaaactgtagggatgaggacacccagaagccctcccctgtatcggctcctcccgatgatgatgacctgtggctgcctcctgaccttttgggacagcggtg

SEQ ID NO: 446526 - DNA, 140 bp, Artificial Sequence
  Synthetic
caccgctgtcccaaaaggtcaggaggcagccacaggtcatcatcatcgggaggagccgatacaggggagggcttctgggtgtcctcatccctacagtttttcacgattttgcgtagaaagcatatcagcagccagggcct

SEQ ID NO: 446527 - DNA, 140 bp, Artificial Sequence
  Synthetic
atacgccatgctgggtctcccatggagctcaaagtaggatacatttcagccataaaggtgaacgggttcacctgtacgggtgtggtgacggaagcagagacctataccaactttgttggccgtacttgggagtcggccat

SEQ ID NO: 446528 - DNA, 140 bp, Artificial Sequence
  Synthetic
atggccgactcccaagtacggccaacaaagttggtataggtctctgcttccgtcaccacacccgtacaggtgaacccgttcacctttatggctgaaatgtatcctactttgagctccatgggagacccagcatggcgtat

SEQ ID NO: 446529 - DNA, 140 bp, Artificial Sequence
  Synthetic
aggccctggctgctgatatgttgggccgacgacacctcagtatttaagagggtggcttgcaactccagcttgagtctctcatctcactggatcaggttgatctacaaaataataaagaccgaccttttgggacagcggtg

SEQ ID NO: 446530 - DNA, 140 bp, Artificial Sequence
  Synthetic
caccgctgtcccaaaaggtcggtctttattattttgtagatcaacctgatccagtgagatgagagactcaagctggagttgcaagccaccctcttaaatactgaggtgtcgtcggcccaacatatcagcagccagggcct

SEQ ID NO: 446531 - DNA, 140 bp, Artificial Sequence
  Synthetic
atacgccatgctgggtctccatgcagagatgcgcataactggaagatggctggggaccccagatatgaagagtctttgcataatccttatcctgattatcattggcttcggactgtaaagcgtacttgggagtcggccat

SEQ ID NO: 446532 - DNA, 140 bp, Artificial Sequence
  Synthetic
atggccgactcccaagtacgctttacagtccgaagccaatgataatcaggataaggattatgcaaagactcttcatatctggggtccccagccatcttccagttatgcgcatctctgcatggagacccagcatggcgtat

SEQ ID NO: 446533 - DNA, 140 bp, Artificial Sequence
  Synthetic
atacgccatgctgggtctccctcagactccccaaagggtcggaagggtttggccctgctcctctgagagggcagatctcctaagagagatctcgtgggggaggaaggtggtaggcacaaccgtacttgggagtcggccat

SEQ ID NO: 446534 - DNA, 140 bp, Artificial Sequence
  Synthetic
atggccgactcccaagtacggttgtgcctaccaccttcctcccccacgagatctctcttaggagatctgccctctcagaggagcagggccaaacccttccgaccctttggggagtctgagggagacccagcatggcgtat

SEQ ID NO: 446535 - DNA, 140 bp, Artificial Sequence
  Synthetic
atacgccatgctgggtctcccccgtatgacaaatctcttcattctagcgtttttcctggtgggaaatgctcaggaataacagtgtcctctacttactgttctaccaaccatgattacacccgtacttgggagtcggccat

SEQ ID NO: 446536 - DNA, 140 bp, Artificial Sequence
  Synthetic
atggccgactcccaagtacgggtgtaatcatggttggtagaacagtaagtagaggacactgttattcctgagcatttcccaccaggaaaaacgctagaatgaagagatttgtcatacgggggagacccagcatggcgtat

SEQ ID NO: 446537 - DNA, 140 bp, Artificial Sequence
  Synthetic
atacgccatgctgggtctcctagatgagagaggcttgtacaagtctttgaaaggagcatgtaagctgaagctgtgtggggttcctggactcagacttatggatggaacatgggtcgcgatcgtacttgggagtcggccat

SEQ ID NO: 446538 - DNA, 140 bp, Artificial Sequence
  Synthetic
atggccgactcccaagtacgatcgcgacccatgttccatccataagtctgagtccaggaaccccacacagcttcagcttacatgctcctttcaaagacttgtacaagcctctctcatctaggagacccagcatggcgtat

SEQ ID NO: 446539 - DNA, 140 bp, Artificial Sequence
  Synthetic
aggccctggctgctgatatgaaatcttgaggcacttcaacatatgctgcagtacaatgatgtatttggcaacggctctaggtgatgtccccagctttgctaggcttcatgacttgtacaagaccttttgggacagcggtg

SEQ ID NO: 446540 - DNA, 140 bp, Artificial Sequence
  Synthetic
caccgctgtcccaaaaggtcttgtacaagtcatgaagcctagcaaagctggggacatcacctagagccgttgccaaatacatcattgtactgcagcatatgttgaagtgcctcaagatttcatatcagcagccagggcct

SEQ ID NO: 446541 - DNA, 140 bp, Artificial Sequence
  Synthetic
atacgccatgctgggtctcctccataaactggttcattacaagaaactctaatctagcccaaactctgattaggaacataatgtctctgacaggcccagattttccgctggaagaggccccgtacttgggagtcggccat

SEQ ID NO: 446542 - DNA, 140 bp, Artificial Sequence
  Synthetic
atggccgactcccaagtacggggcctcttccagcggaaaatctgggcctgtcagagacattatgttcctaatcagagtttgggctagattagagtttcttgtaatgaaccagtttatggaggagacccagcatggcgtat

SEQ ID NO: 446543 - DNA, 140 bp, Artificial Sequence
  Synthetic
aggccctggctgctgatatggacttcagaagttccaaaatgacatacctgactctcatcacttatcagtctcatcttttgcttcaaaggattgaaagaaatctgtccaagagtatgaggtgaccttttgggacagcggtg

SEQ ID NO: 446544 - DNA, 140 bp, Artificial Sequence
  Synthetic
caccgctgtcccaaaaggtcacctcatactcttggacagatttctttcaatcctttgaagcaaaagatgagactgataagtgatgagagtcaggtatgtcattttggaacttctgaagtccatatcagcagccagggcct

SEQ ID NO: 446545 - DNA, 140 bp, Artificial Sequence
  Synthetic
atacgccatgctgggtctccgtcaagaaacgggaggagtgtttagatgcattagagtccatcatgaccactaagtcagtgagtttcagacgtcttagtcacttgaggaaacttgtgcctgcgtacttgggagtcggccat

SEQ ID NO: 446546 - DNA, 140 bp, Artificial Sequence
  Synthetic
atggccgactcccaagtacgcaggcacaagtttcctcaagtgactaagacgtctgaaactcactgacttagtggtcatgatggactctaatgcatctaaacactcctcccgtttcttgacggagacccagcatggcgtat

SEQ ID NO: 446547 - DNA, 140 bp, Artificial Sequence
  Synthetic
aggccctggctgctgatatgacggtcaacttctccagtctgccggggaagtctacagaagacaaagccactcaaactgccagccgtgaacccaagaaagagactgtgtctgctccctctcgaccttttgggacagcggtg

SEQ ID NO: 446548 - DNA, 140 bp, Artificial Sequence
  Synthetic
caccgctgtcccaaaaggtcgagagggagcagacacagtctctttcttgggttcacggctggcagtttgagtggctttgtcttctgtagacttccccggcagactggagaagttgaccgtcatatcagcagccagggcct

SEQ ID NO: 446549 - DNA, 140 bp, Artificial Sequence
  Synthetic
atacgccatgctgggtctccggtttgggaaagcgtataccatattcaacaagaccttgatggaggctgatgctcattacaaatcggtcaggacttggaatgagatcatcccctctaaaggcgtacttgggagtcggccat

SEQ ID NO: 446550 - DNA, 140 bp, Artificial Sequence
  Synthetic
atggccgactcccaagtacgcctttagaggggatgatctcattccaagtcctgaccgatttgtaatgagcatcagcctccatcaaggtcttgttgaatatggtatacgctttcccaaaccggagacccagcatggcgtat

SEQ ID NO: 446551 - DNA, 140 bp, Artificial Sequence
  Synthetic
atacgccatgctgggtctcccaatcgtccctcctccagcagcatatggagttgttagaatcttctgtcattcccttaatgcatcccttggcagatccctcggcggttttcaaaactggtgcgtacttgggagtcggccat

SEQ ID NO: 446552 - DNA, 140 bp, Artificial Sequence
  Synthetic
atggccgactcccaagtacgcaccagttttgaaaaccgccgagggatctgccaagggatgcattaagggaatgacagaagattctaacaactccatatgctgctggaggagggacgattgggagacccagcatggcgtat

SEQ ID NO: 446553 - DNA, 140 bp, Artificial Sequence
  Synthetic
atacgccatgctgggtctccctcagaccctgtctcagaagggttgtctttctggagagagatttggctgagctccaatgagtcttggattcacgcactgtgtcaagaagcgggaaacccacgtacttgggagtcggccat

SEQ ID NO: 446554 - DNA, 140 bp, Artificial Sequence
  Synthetic
atggccgactcccaagtacgtgggtttcccgcttcttgacacagtgcgtgaatccaagactcattggagctcagccaaatctctctccagaaagacaacccttctgagacagggtctgagggagacccagcatggcgtat

SEQ ID NO: 446555 - DNA, 140 bp, Artificial Sequence
  Synthetic
atacgccatgctgggtctccgagcgcaggcgtcctgatcgtactagtgctgatgattttcttgatgacgtgttgtaaaaggcctaatagagcggagctaatacaccacagtcctagggagcgtacttgggagtcggccat

SEQ ID NO: 446556 - DNA, 140 bp, Artificial Sequence
  Synthetic
atggccgactcccaagtacgctccctaggactgtggtgtattagctccgctctattaggccttttacaacacgtcatcaagaaaatcatcagcactagtacgatcaggacgcctgcgctcggagacccagcatggcgtat

SEQ ID NO: 446557 - DNA, 140 bp, Artificial Sequence
  Synthetic
atacgccatgctgggtctcctctcctctatatttcgaatcccaaagttcacatccccttgaggttaaggggacatctctggattcaacagtcttctttagactcctcgcaacagggtaagcgtacttgggagtcggccat

SEQ ID NO: 446558 - DNA, 140 bp, Artificial Sequence
  Synthetic
atggccgactcccaagtacgcttaccctgttgcgaggagtctaaagaagactgttgaatccagagatgtccccttaacctcaaggggatgtgaactttgggattcgaaatatagaggagaggagacccagcatggcgtat

SEQ ID NO: 446559 - DNA, 140 bp, Artificial Sequence
  Synthetic
aggccctggctgctgatatgccctctcctgtgtcagcccctccggatgacgacgacctgtggcttccaccccctgaatacgtcccgctgaaagaattcacaagcaagaagaacatgaggagaccttttgggacagcggtg

SEQ ID NO: 446560 - DNA, 140 bp, Artificial Sequence
  Synthetic
caccgctgtcccaaaaggtctcctcatgttcttcttgcttgtgaattctttcagcgggacgtattcagggggtggaagccacaggtcgtcgtcatccggaggggctgacacaggagagggcatatcagcagccagggcct

SEQ ID NO: 446561 - DNA, 140 bp, Artificial Sequence
  Synthetic
atacgccatgctgggtctcccggtgctttcaccctccaagaacagataccaaaggtggtgaacaaaccgggagatatctcagataacgttgtgtttggacacagccagagattgtagtcacgtacttgggagtcggccat

SEQ ID NO: 446562 - DNA, 140 bp, Artificial Sequence
  Synthetic
atggccgactcccaagtacgtgactacaatctctggctgtgtccaaacacaacgttatctgagatatctcccggtttgttcaccacctttggtatctgttcttggagggtgaaagcaccgggagacccagcatggcgtat

SEQ ID NO: 446563 - DNA, 140 bp, Artificial Sequence
  Synthetic
aggccctggctgctgatatggagatatctcagataacgttgtgtttggacacagccagagattgtagtcagtccccggatactacactgggtaagggttgatcaagaaaggagacctgtcgaccttttgggacagcggtg

SEQ ID NO: 446564 - DNA, 140 bp, Artificial Sequence
  Synthetic
caccgctgtcccaaaaggtcgacaggtctcctttcttgatcaacccttacccagtgtagtatccggggactgactacaatctctggctgtgtccaaacacaacgttatctgagatatctccatatcagcagccagggcct

SEQ ID NO: 446565 - DNA, 140 bp, Artificial Sequence
  Synthetic
atacgccatgctgggtctcctctttgcgcaggacaaaatgggtagatcaggaagtgcgccatgcgacaagaaccatgacgggaggctacagccccaacaagaggatgtcacgcaaagcagcgtacttgggagtcggccat

SEQ ID NO: 446566 - DNA, 140 bp, Artificial Sequence
  Synthetic
atggccgactcccaagtacgctgctttgcgtgacatcctcttgttggggctgtagcctcccgtcatggttcttgtcgcatggcgcacttcctgatctacccattttgtcctgcgcaaagaggagacccagcatggcgtat

SEQ ID NO: 446567 - DNA, 140 bp, Artificial Sequence
  Synthetic
atacgccatgctgggtctccaaaaactataaaactgaaagacaactagcaacacttctcatcttgagactctcaccatgatgattgacccaggagaggtttatgatgacccgattgatcccgtacttgggagtcggccat

SEQ ID NO: 446568 - DNA, 140 bp, Artificial Sequence
  Synthetic
atggccgactcccaagtacgggatcaatcgggtcatcataaacctctcctgggtcaatcatcatggtgagagtctcaagatgagaagtgttgctagttgtctttcagttttatagtttttggagacccagcatggcgtat

SEQ ID NO: 446569 - DNA, 140 bp, Artificial Sequence
  Synthetic
atacgccatgctgggtctcctgtagaggctgaaattgctcatcagattgccgagagcttctccaaaaagtacaaattcccttctcgatcatcagggatatttctgtacaattttgagcagcgtacttgggagtcggccat

SEQ ID NO: 446570 - DNA, 140 bp, Artificial Sequence
  Synthetic
atggccgactcccaagtacgctgctcaaaattgtacagaaatatccctgatgatcgagaagggaatttgtactttttggagaagctctcggcaatctgatgagcaatttcagcctctacaggagacccagcatggcgtat

SEQ ID NO: 446571 - DNA, 140 bp, Artificial Sequence
  Synthetic
atacgccatgctgggtctccgcttcaaaacccgttgatctctggcttgagagtggttcagtgggcaacaggggcccattacaagctcaaacctattttggatgatctcaatgtgttcccacgtacttgggagtcggccat

SEQ ID NO: 446572 - DNA, 140 bp, Artificial Sequence
  Synthetic
atggccgactcccaagtacgtgggaacacattgagatcatccaaaataggtttgagcttgtaatgggcccctgttgcccactgaaccactctcaagccagagatcaacgggttttgaagcggagacccagcatggcgtat

SEQ ID NO: 446573 - DNA, 140 bp, Artificial Sequence
  Synthetic
atacgccatgctgggtctccaaattaatgttagagtggttgaagacgggaaatagaccttaccgtataactctgacagacaactgttctaggtcttacaaagtcctgaaagattacttcacgtacttgggagtcggccat

SEQ ID NO: 446574 - DNA, 140 bp, Artificial Sequence
  Synthetic
atggccgactcccaagtacgtgaagtaatctttcaggactttgtaagacctagaacagttgtctgtcagagttatacggtaaggtctatttcccgtcttcaaccactctaacattaatttggagacccagcatggcgtat

SEQ ID NO: 446575 - DNA, 140 bp, Artificial Sequence
  Synthetic
atacgccatgctgggtctccgaatgacctgatggcgtcgggaacacatccgttgcccccctcggcaatcatgagcggaggagatgacatcatttccagagtaattgactttgactccatccgtacttgggagtcggccat

SEQ ID NO: 446576 - DNA, 140 bp, Artificial Sequence
  Synthetic
atggccgactcccaagtacggatggagtcaaagtcaattactctggaaatgatgtcatctcctccgctcatgattgccgaggggggcaacggatgtgttcccgacgccatcaggtcattcggagacccagcatggcgtat

SEQ ID NO: 446577 - DNA, 140 bp, Artificial Sequence
  Synthetic
atacgccatgctgggtctccgaggtgtatgaccgacttggcccatttctattcaaagtcttcccccatagagaagttgttaaactgcacacttggaaatagaggactgaaaatccccccacgtacttgggagtcggccat

SEQ ID NO: 446578 - DNA, 140 bp, Artificial Sequence
  Synthetic
atggccgactcccaagtacgtggggggattttcagtcctctatttccaagtgtgcagtttaacaacttctctatgggggaagactttgaatagaaatgggccaagtcggtcatacacctcggagacccagcatggcgtat

SEQ ID NO: 446579 - DNA, 140 bp, Artificial Sequence
  Synthetic
atacgccatgctgggtctccccctgtacatgaatgccctagattgggatgaagaaaagaccatcttggctttatggagagatctgacatcagtggatgttgggaaggacttagtaaagttcgtacttgggagtcggccat

SEQ ID NO: 446580 - DNA, 140 bp, Artificial Sequence
  Synthetic
atggccgactcccaagtacgaactttactaagtccttcccaacatccactgatgtcagatctctccataaagccaagatggtcttttcttcatcccaatctagggcattcatgtacagggggagacccagcatggcgtat

SEQ ID NO: 446581 - DNA, 140 bp, Artificial Sequence
  Synthetic
aggccctggctgctgatatgttatggagagatctgacatcagtggatgttgggaaggacttagtaaagttcaaagatcaaatatggggactattaattgtgacgaaggactttgtgtattgaccttttgggacagcggtg

SEQ ID NO: 446582 - DNA, 140 bp, Artificial Sequence
  Synthetic
caccgctgtcccaaaaggtcaatacacaaagtccttcgtcacaattaatagtccccatatttgatctttgaactttactaagtccttcccaacatccactgatgtcagatctctccataacatatcagcagccagggcct

SEQ ID NO: 446583 - DNA, 140 bp, Artificial Sequence
  Synthetic
atacgccatgctgggtctccatgcagagtacttgacctcttctactcttcgagaaatgagccttgtgttgttcaactgtagcagccccaagagcgagatgcagagagcccgttctctgaacgtacttgggagtcggccat

SEQ ID NO: 446584 - DNA, 140 bp, Artificial Sequence
  Synthetic
atggccgactcccaagtacgttcagagaacgggctctctgcatctcgctcttggggctgctacagttgaacaacacaaggctcatttctcgaagagtagaagaggtcaagtactctgcatggagacccagcatggcgtat

SEQ ID NO: 446585 - DNA, 140 bp, Artificial Sequence
  Synthetic
aggccctggctgctgatatgcgaaccccggtattcagacgacctgatatctcaactttgccaactatacattgcaggagatcgagtattgtccatgtgtggaaactcaggttatgaagtcgaccttttgggacagcggtg

SEQ ID NO: 446586 - DNA, 140 bp, Artificial Sequence
  Synthetic
caccgctgtcccaaaaggtcgacttcataacctgagtttccacacatggacaatactcgatctcctgcaatgtatagttggcaaagttgagatatcaggtcgtctgaataccggggttcgcatatcagcagccagggcct

SEQ ID NO: 446587 - DNA, 140 bp, Artificial Sequence
  Synthetic
aggccctggctgctgatatgttgcaggagatcgagtattgtccatgtgtggaaactcaggttatgaagtcatcaagatattggagccatatgttgtgaatagcttagtccaaagggcagagaccttttgggacagcggtg

SEQ ID NO: 446588 - DNA, 140 bp, Artificial Sequence
  Synthetic
caccgctgtcccaaaaggtctctgccctttggactaagctattcacaacatatggctccaatatcttgatgacttcataacctgagtttccacacatggacaatactcgatctcctgcaacatatcagcagccagggcct

SEQ ID NO: 446589 - DNA, 140 bp, Artificial Sequence
  Synthetic
aggccctggctgctgatatgggacttccagatggatgagggggaagatccaggtttcttattccagtcatacctggacaatgtcggagtccagatagtcagacaaatgaggtcaggagaagaccttttgggacagcggtg

SEQ ID NO: 446590 - DNA, 140 bp, Artificial Sequence
  Synthetic
caccgctgtcccaaaaggtcttctcctgacctcatttgtctgactatctggactccgacattgtccaggtatgactggaataagaaacctggatcttccccctcatccatctggaagtcccatatcagcagccagggcct

SEQ ID NO: 446591 - DNA, 140 bp, Artificial Sequence
  Synthetic
atacgccatgctgggtctccaagtaaatgacctgatggcatcaggaacacatccactgcccccctcagcaatcatgagtgggggagatgatatcatctccagggtaattgactttgattccgtacttgggagtcggccat

SEQ ID NO: 446592 - DNA, 140 bp, Artificial Sequence
  Synthetic
atggccgactcccaagtacggaatcaaagtcaattaccctggagatgatatcatctcccccactcatgattgctgaggggggcagtggatgtgttcctgatgccatcaggtcatttacttggagacccagcatggcgtat

SEQ ID NO: 446593 - DNA, 140 bp, Artificial Sequence
  Synthetic
atacgccatgctgggtctccttctttgaggttctggatcaattcgacaacatccatgacctggtcttcgtgtatggttgttacagacattgggggcatccttacatagattatagaaaggcgtacttgggagtcggccat

SEQ ID NO: 446594 - DNA, 140 bp, Artificial Sequence
  Synthetic
atggccgactcccaagtacgcctttctataatctatgtaaggatgcccccaatgtctgtaacaaccatacacgaagaccaggtcatggatgttgtcgaattgatccagaacctcaaagaaggagacccagcatggcgtat

SEQ ID NO: 446595 - DNA, 140 bp, Artificial Sequence
  Synthetic
atacgccatgctgggtctccacagacccataacttattatttcaggaaacaagtcattcgggggaatacttatctgtcttggagttggtccgatgacacctcagtgtttaagagggtggccgtacttgggagtcggccat

SEQ ID NO: 446596 - DNA, 140 bp, Artificial Sequence
  Synthetic
atggccgactcccaagtacggccaccctcttaaacactgaggtgtcatcggaccaactccaagacagataagtattcccccgaatgacttgtttcctgaaataataagttatgggtctgtggagacccagcatggcgtat

SEQ ID NO: 446597 - DNA, 140 bp, Artificial Sequence
  Synthetic
atacgccatgctgggtctccgggatttgacaagtactctaagtggtatattgactcacgacgtctccccagagaccatcccctgactccttacattaaaactcaaacatggccacctaaacgtacttgggagtcggccat

SEQ ID NO: 446598 - DNA, 140 bp, Artificial Sequence
  Synthetic
atggccgactcccaagtacgtttaggtggccatgtttgagttttaatgtaaggagtcaggggatggtctctggggagacgtcgtgagtcaatataccacttagagtacttgtcaaatcccggagacccagcatggcgtat

SEQ ID NO: 446599 - DNA, 140 bp, Artificial Sequence
  Synthetic
atacgccatgctgggtctccgaagtggagaagcaccttagagggtacaacaggtggatcacccttgatgacattagatccagatcatctctcttagattatagctgcttgtaaaccagaccgtacttgggagtcggccat

SEQ ID NO: 446600 - DNA, 140 bp, Artificial Sequence
  Synthetic
atggccgactcccaagtacggtctggtttacaagcagctataatctaagagagatgatctggatctaatgtcatcaagggtgatccacctgttgtaccctctaaggtgcttctccacttcggagacccagcatggcgtat

SEQ ID NO: 446601 - DNA, 140 bp, Artificial Sequence
  Synthetic
atacgccatgctgggtctccagtcgcactctttcaccagaacgagactagcctcttggctgtcagagaatagagggggaccagttcccagcgaaaaggtcattatcacggctctgtccaacgtacttgggagtcggccat

SEQ ID NO: 446602 - DNA, 140 bp, Artificial Sequence
  Synthetic
atggccgactcccaagtacgttggacagagccgtgataatgaccttttcgctgggaactggtccccctctattctctgacagccaagaggctagtctcgttctggtgaaagagtgcgactggagacccagcatggcgtat

SEQ ID NO: 446603 - DNA, 140 bp, Artificial Sequence
  Synthetic
atacgccatgctgggtctccattctcgagggaatatacagactgagactcttggacggtgcaccctgaaaaaaacgaaatcttaattcattgcctctgtttgcttgattgtttttccatccgtacttgggagtcggccat

SEQ ID NO: 446604 - DNA, 140 bp, Artificial Sequence
  Synthetic
atggccgactcccaagtacggatggaaaaacaatcaagcaaacagaggcaatgaattaagatttcgtttttttcagggtgcaccgtccaagagtctcagtctgtatattccctcgagaatggagacccagcatggcgtat

SEQ ID NO: 446605 - DNA, 140 bp, Artificial Sequence
  Synthetic
atacgccatgctgggtctccgccgcctgtcaaccccagagagtttttaaaatctatcgatctcggggggttacccgacgaggacctgataattggcctcaagccaaaggaaagggagctgcgtacttgggagtcggccat

SEQ ID NO: 446606 - DNA, 140 bp, Artificial Sequence
  Synthetic
atggccgactcccaagtacgcagctccctttcctttggcttgaggccaattatcaggtcctcgtcgggtaaccccccgagatcgatagattttaaaaactctctggggttgacaggcggcggagacccagcatggcgtat

SEQ ID NO: 446607 - DNA, 140 bp, Artificial Sequence
  Synthetic
aggccctggctgctgatatgagaggacacgttagagtcagatgatgacattcaaaggctattaaaggactccctgcgtagaacgaggtgggtggatcaagaagtgcgccatgcagccagagaccttttgggacagcggtg

SEQ ID NO: 446608 - DNA, 140 bp, Artificial Sequence
  Synthetic
caccgctgtcccaaaaggtctctggctgcatggcgcacttcttgatccacccacctcgttctacgcagggagtcctttaatagcctttgaatgtcatcatctgactctaacgtgtcctctcatatcagcagccagggcct

SEQ ID NO: 446609 - DNA, 140 bp, Artificial Sequence
  Synthetic
atacgccatgctgggtctccatgcactaactatgacagacaatctgaacaaggtgtttaaaaagttgatcgatagagtgaccggacaagggcttttggactattcaagagtcacatatgccgtacttgggagtcggccat

SEQ ID NO: 446610 - DNA, 140 bp, Artificial Sequence
  Synthetic
atggccgactcccaagtacggcatatgtgactcttgaatagtccaaaagcccttgtccggtcactctatcgatcaactttttaaacaccttgttcagattgtctgtcatagttagtgcatggagacccagcatggcgtat

SEQ ID NO: 446611 - DNA, 140 bp, Artificial Sequence
  Synthetic
aggccctggctgctgatatggaaaagcccctgacttgaacaaagcatacaaatcaattttatccggcatgaatgcagccaaactcgaccctgatgatgtatgctcttatctagcagccgcgaccttttgggacagcggtg

SEQ ID NO: 446612 - DNA, 140 bp, Artificial Sequence
  Synthetic
caccgctgtcccaaaaggtcgcggctgctagataagagcatacatcatcagggtcgagtttggctgcattcatgccggataaaattgatttgtatgctttgttcaagtcaggggcttttccatatcagcagccagggcct

SEQ ID NO: 446613 - DNA, 140 bp, Artificial Sequence
  Synthetic
atacgccatgctgggtctccttttcgaggactcatgagttttttcagaagtcctggatctactattctgacagatcagacctcatcgggttatggggggaccaaatatactgcctggacacgtacttgggagtcggccat

SEQ ID NO: 446614 - DNA, 140 bp, Artificial Sequence
  Synthetic
atggccgactcccaagtacgtgtccaggcagtatatttggtccccccataacccgatgaggtctgatctgtcagaatagtagatccaggacttctgaaaaaactcatgagtcctcgaaaaggagacccagcatggcgtat

SEQ ID NO: 446615 - DNA, 140 bp, Artificial Sequence
  Synthetic
atacgccatgctgggtctccgcaccatgatgattgatccgggagaggtttttgacgaccccgtagatccgattgagttggaggccgagtcgagagggaaccccgccatccccaacatcttcgtacttgggagtcggccat

SEQ ID NO: 446616 - DNA, 140 bp, Artificial Sequence
  Synthetic
atggccgactcccaagtacgaagatgttggggatggcggggttccctctcgactcggcctccaactcaatcggatctacggggtcgtcaaaaacctctcccggatcaatcatcatggtgcggagacccagcatggcgtat

SEQ ID NO: 446617 - DNA, 140 bp, Artificial Sequence
  Synthetic
atacgccatgctgggtctcctgtctaacggcccgacctgttggaatggtcaagatggcgggctggaaggcctacggcagaaaggctggagtctggtcagcctattgatgatagacagagacgtacttgggagtcggccat

SEQ ID NO: 446618 - DNA, 140 bp, Artificial Sequence
  Synthetic
atggccgactcccaagtacgtctctgtctatcatcaataggctgaccagactccagcctttctgccgtaggccttccagcccgccatcttgaccattccaacaggtcgggccgttagacaggagacccagcatggcgtat

SEQ ID NO: 446619 - DNA, 140 bp, Artificial Sequence
  Synthetic
atacgccatgctgggtctccggcactctcgagggaatgtatgaactagtaatcttgaacgatacaccgtgaaaaaaactggatcccaattcttaacctctatctgcttgattatttttcccgtacttgggagtcggccat

SEQ ID NO: 446620 - DNA, 140 bp, Artificial Sequence
  Synthetic
atggccgactcccaagtacgggaaaaataatcaagcagatagaggttaagaattgggatccagtttttttcacggtgtatcgttcaagattactagttcatacattccctcgagagtgccggagacccagcatggcgtat

SEQ ID NO: 446621 - DNA, 140 bp, Artificial Sequence
  Synthetic
atacgccatgctgggtctccctcctctatgagctagagagcatatcaagaaacgctctctcaatctaccgagccatcgaagaaggggcatccaagctagggctgattatcaaaaaggaagcgtacttgggagtcggccat

SEQ ID NO: 446622 - DNA, 140 bp, Artificial Sequence
  Synthetic
atggccgactcccaagtacgcttcctttttgataatcagccctagcttggatgccccttcttcgatggctcggtagattgagagagcgtttcttgatatgctctctagctcatagaggagggagacccagcatggcgtat

SEQ ID NO: 446623 - DNA, 140 bp, Artificial Sequence
  Synthetic
aggccctggctgctgatatgaaaaatgtaacacccctacaatggatgccgacaagattgtgtttaaagtcaataataaggtggtttctctgaagcctgaaattatagtagaccaatatgagaccttttgggacagcggtg

SEQ ID NO: 446624 - DNA, 140 bp, Artificial Sequence
  Synthetic
caccgctgtcccaaaaggtctcatattggtctactataatttcaggcttcagagaaaccaccttattattgactttaaacacaatcttgtcggcatccattgtaggggtgttacatttttcatatcagcagccagggcct

SEQ ID NO: 446625 - DNA, 140 bp, Artificial Sequence
  Synthetic
atacgccatgctgggtctcccatctcgaacgaccaaatagtcaaccttgccaatataatgtctaccgtgtccaccaacgcattaactgtggctcaacattctcaatctctgatcaaaccgcgtacttgggagtcggccat

SEQ ID NO: 446626 - DNA, 140 bp, Artificial Sequence
  Synthetic
atggccgactcccaagtacgcggtttgatcagagattgagaatgttgagccacagttaatgcgttggtggacacggtagacattatattggcaaggttgactatttggtcgttcgagatgggagacccagcatggcgtat

SEQ ID NO: 446627 - DNA, 140 bp, Artificial Sequence
  Synthetic
aggccctggctgctgatatgccaccaacgcattaactgtggctcaacattctcaatctctgatcaaaccgatgagggactttctgcttatgtcagtacaggcagtcttccattacctgctgaccttttgggacagcggtg

SEQ ID NO: 446628 - DNA, 140 bp, Artificial Sequence
  Synthetic
caccgctgtcccaaaaggtcagcaggtaatggaagactgcctgtactgacataagcagaaagtccctcatcggtttgatcagagattgagaatgttgagccacagttaatgcgttggtggcatatcagcagccagggcct

SEQ ID NO: 446629 - DNA, 140 bp, Artificial Sequence
  Synthetic
atacgccatgctgggtctccctagggggggtgtctgggatgtcactggggagatttcatatacgccagttctcagatcctgtctccgagggattgtccttctggagagagatctggctgacgtacttgggagtcggccat

SEQ ID NO: 446630 - DNA, 140 bp, Artificial Sequence
  Synthetic
atggccgactcccaagtacgtcagccagatctctctccagaaggacaatccctcggagacaggatctgagaactggcgtatatgaaatctccccagtgacatcccagacaccccccctagggagacccagcatggcgtat

SEQ ID NO: 446631 - DNA, 140 bp, Artificial Sequence
  Synthetic
atacgccatgctgggtctcctacagtcgtcactgcttatgaagactgctcagggctagtatcgtttacagggtttataaagcagataaatctcaccgcaagggaggcaatactatatttccgtacttgggagtcggccat

SEQ ID NO: 446632 - DNA, 140 bp, Artificial Sequence
  Synthetic
atggccgactcccaagtacggaaatatagtattgcctcccttgcggtgagatttatctgctttataaaccctgtaaacgatactagccctgagcagtcttcataagcagtgacgactgtaggagacccagcatggcgtat

SEQ ID NO: 446633 - DNA, 140 bp, Artificial Sequence
  Synthetic
aggccctggctgctgatatgttccacaaaaactttgaggaagagataagaagaatgttcgaaccagggcaggagactgctgttcctcattcctatttcatccacttccgttcattaggtcgaccttttgggacagcggtg

SEQ ID NO: 446634 - DNA, 140 bp, Artificial Sequence
  Synthetic
caccgctgtcccaaaaggtcgacctaatgaacggaagtggatgaaataggaatgaggaacagcagtctcctgccctggttcgaacattcttcttatctcttcctcaaagtttttgtggaacatatcagcagccagggcct

SEQ ID NO: 446635 - DNA, 140 bp, Artificial Sequence
  Synthetic
atacgccatgctgggtctcccactactttaaatatcaagggaggggctagccccaccatcttacttaaagacgcaatcagaaaagccctatatgatgaagtagacaaggtagagaattcacgtacttgggagtcggccat

SEQ ID NO: 446636 - DNA, 140 bp, Artificial Sequence
  Synthetic
atggccgactcccaagtacgtgaattctctaccttgtctacttcatcatatagggcttttctgattgcgtctttaagtaagatggtggggctagcccctcccttgatatttaaagtagtgggagacccagcatggcgtat

SEQ ID NO: 446637 - DNA, 140 bp, Artificial Sequence
  Synthetic
aggccctggctgctgatatgcagctccaatcatcaagctcgccccaactcattcgccgagtttttaaacaagacatactcgaatgattcgtaaaaagttgaacaacaagattgtaaaaacgaccttttgggacagcggtg

SEQ ID NO: 446638 - DNA, 140 bp, Artificial Sequence
  Synthetic
caccgctgtcccaaaaggtcgtttttacaatcttgttgttcaactttttacgaatcattcgagtatgtcttgtttaaaaactcggcgaatgagttggggcgagcttgatgattggagctgcatatcagcagccagggcct

SEQ ID NO: 446639 - DNA, 140 bp, Artificial Sequence
  Synthetic
atacgccatgctgggtctccttttcagctcatccttcttggggattcctgagtcaatcattggattgatacaaaactcccggactataagaaggcaatttagaagaaatctctcaagaaccgtacttgggagtcggccat

SEQ ID NO: 446640 - DNA, 140 bp, Artificial Sequence
  Synthetic
atggccgactcccaagtacggttcttgagagatttcttctaaattgccttcttatagtccgggagttttgtatcaatccaatgattgactcaggaatccccaagaaggatgagctgaaaaggagacccagcatggcgtat

SEQ ID NO: 446641 - DNA, 140 bp, Artificial Sequence
  Synthetic
atacgccatgctgggtctccttccataagaactttgaagaagagataagaagaatgtttgagcctgggcaggaaaccgcagttcctcactcctatttcatccattttcgttcattgggcccgtacttgggagtcggccat

SEQ ID NO: 446642 - DNA, 140 bp, Artificial Sequence
  Synthetic
atggccgactcccaagtacgggcccaatgaacgaaaatggatgaaataggagtgaggaactgcggtttcctgcccaggctcaaacattcttcttatctcttcttcaaagttcttatggaaggagacccagcatggcgtat

SEQ ID NO: 446643 - DNA, 140 bp, Artificial Sequence
  Synthetic
atacgccatgctgggtctcctttggaggagtccttctataattcagagatccatgggatcaacaggatgacccagacaccccaacgagtagggagggtttggccctgctcttcggagaggcgtacttgggagtcggccat

SEQ ID NO: 446644 - DNA, 140 bp, Artificial Sequence
  Synthetic
atggccgactcccaagtacgcctctccgaagagcagggccaaaccctccctactcgttggggtgtctgggtcatcctgttgatcccatggatctctgaattatagaaggactcctccaaaggagacccagcatggcgtat

SEQ ID NO: 446645 - DNA, 140 bp, Artificial Sequence
  Synthetic
atacgccatgctgggtctccagttcctcacccctctgagatgttgggactgcttcctaagtcctccatctcttgtacttgcggagcaacaggaggagggaatcctagagtctcggtgtctcgtacttgggagtcggccat

SEQ ID NO: 446646 - DNA, 140 bp, Artificial Sequence
  Synthetic
atggccgactcccaagtacgagacaccgagactctaggattccctcctcctgttgctccgcaagtacaagagatggaggacttaggaagcagtcccaacatctcagaggggtgaggaactggagacccagcatggcgtat

SEQ ID NO: 446647 - DNA, 140 bp, Artificial Sequence
  Synthetic
aggccctggctgctgatatggaaccatcccaaccatgagcaagatcttcgtcaatccgagtgcaatcagggccggcctggctgaccttgagatggctgaggagactgttgatctaatcaagaccttttgggacagcggtg

SEQ ID NO: 446648 - DNA, 140 bp, Artificial Sequence
  Synthetic
caccgctgtcccaaaaggtcttgattagatcaacagtctcctcagccatctcaaggtcagccaggccggccctgattgcactcggattgacgaagatcttgctcatggttgggatggttccatatcagcagccagggcct

SEQ ID NO: 446649 - DNA, 140 bp, Artificial Sequence
  Synthetic
atacgccatgctgggtctccagaaagtcactaatgttcatgtggtgaaaagggctctatcactaaaggagtctataaattggttcatcacaaggaactcgaatttggctcagactctaatcgtacttgggagtcggccat

SEQ ID NO: 446650 - DNA, 140 bp, Artificial Sequence
  Synthetic
atggccgactcccaagtacgattagagtctgagccaaattcgagttccttgtgatgaaccaatttatagactcctttagtgatagagcccttttcaccacatgaacattagtgactttctggagacccagcatggcgtat

SEQ ID NO: 446651 - DNA, 140 bp, Artificial Sequence
  Synthetic
aggccctggctgctgatatgcagaaacatagaagataatcaggcccatctccagggagagcccatagaagtggacaatctccctgaggacatgaggcggcttcagttagatgatgggaaggaccttttgggacagcggtg

SEQ ID NO: 446652 - DNA, 140 bp, Artificial Sequence
  Synthetic
caccgctgtcccaaaaggtccttcccatcatctaactgaagccgcctcatgtcctcagggagattgtccacttctatgggctctccctggagatgggcctgattatcttctatgtttctgcatatcagcagccagggcct

SEQ ID NO: 446653 - DNA, 140 bp, Artificial Sequence
  Synthetic
atacgccatgctgggtctcctacagtgaagggggatattcctctgtatgccctaatcttctctctcatatatccgtaagtacagacaccatgtccgatttgactcaagatgggaagaattcgtacttgggagtcggccat

SEQ ID NO: 446654 - DNA, 140 bp, Artificial Sequence
  Synthetic
atggccgactcccaagtacgaattcttcccatcttgagtcaaatcggacatggtgtctgtacttacggatatatgagagagaagattagggcatacagaggaatatcccccttcactgtaggagacccagcatggcgtat

SEQ ID NO: 446655 - DNA, 140 bp, Artificial Sequence
  Synthetic
aggccctggctgctgatatgatccgtaagtacagacaccatgtccgatttgactcaagatgggaagaattatgatttcatgttccagcccttgatgctttatgcgcagacgtggacatccgaccttttgggacagcggtg

SEQ ID NO: 446656 - DNA, 140 bp, Artificial Sequence
  Synthetic
caccgctgtcccaaaaggtcggatgtccacgtctgcgcataaagcatcaagggctggaacatgaaatcataattcttcccatcttgagtcaaatcggacatggtgtctgtacttacggatcatatcagcagccagggcct

SEQ ID NO: 446657 - DNA, 140 bp, Artificial Sequence
  Synthetic
atacgccatgctgggtctccagattcctcaagatttggtcacagactgtagaggaaattgtctcctatgtcatgactaacttccctaacccgtcgggaaggtcttcagaagataggtccacgtacttgggagtcggccat

SEQ ID NO: 446658 - DNA, 140 bp, Artificial Sequence
  Synthetic
atggccgactcccaagtacgtggacctatcttctgaagaccttcccgacgggttagggaagttagtcatgacataggagacaatttcctctacagtctgtgaccaaatcttgaggaatctggagacccagcatggcgtat

SEQ ID NO: 446659 - DNA, 140 bp, Artificial Sequence
  Synthetic
atacgccatgctgggtctccggacagtctccccgaagacatgaaacggcttcaattggaagacgagaaaccttctggcctcggcgagatggccaaatcaggggagagcaaatgtcaggaacgtacttgggagtcggccat

SEQ ID NO: 446660 - DNA, 140 bp, Artificial Sequence
  Synthetic
atggccgactcccaagtacgttcctgacatttgctctcccctgatttggccatctcgccgaggccagaaggtttctcgtcttccaattgaagccgtttcatgtcttcggggagactgtccggagacccagcatggcgtat

SEQ ID NO: 446661 - DNA, 140 bp, Artificial Sequence
  Synthetic
atacgccatgctgggtctcccctcccagatctttgagtttccggatgtgtctaaaagaatatcccggatggtctctggagctgtgcctcacttccagaagcttcctgatatccatctgagcgtacttgggagtcggccat

SEQ ID NO: 446662 - DNA, 140 bp, Artificial Sequence
  Synthetic
atggccgactcccaagtacgctcagatggatatcaggaagcttctggaagtgaggcacagctccagagaccatccgggatattcttttagacacatccggaaactcaaagatctgggaggggagacccagcatggcgtat

SEQ ID NO: 446663 - DNA, 140 bp, Artificial Sequence
  Synthetic
aggccctggctgctgatatgtggccctcccgctctcgagtggtctgcgaccaacgaagaggacgatttatctgtagaggcggagattgcccaccagattgctgagagcttctccaagaaagaccttttgggacagcggtg

SEQ ID NO: 446664 - DNA, 140 bp, Artificial Sequence
  Synthetic
caccgctgtcccaaaaggtctttcttggagaagctctcagcaatctggtgggcaatctccgcctctacagataaatcgtcctcttcgttggtcgcagaccactcgagagcgggagggccacatatcagcagccagggcct

SEQ ID NO: 446665 - DNA, 140 bp, Artificial Sequence
  Synthetic
atacgccatgctgggtctccggttcctcaagatatggtctcataccgtcgaggagatcatatcatatgtcatggtcaattttcccagtctgccgaggaagtcttccgaagacaaagctaccgtacttgggagtcggccat

SEQ ID NO: 446666 - DNA, 140 bp, Artificial Sequence
  Synthetic
atggccgactcccaagtacggtagctttgtcttcggaagacttcctcggcagactgggaaaattgaccatgacatatgatatgatctcctcgacggtatgagaccatatcttgaggaaccggagacccagcatggcgtat

SEQ ID NO: 446667 - DNA, 140 bp, Artificial Sequence
  Synthetic
atacgccatgctgggtctccggatacaatgatgggaccatctttcctatcaacatatatggcaaggtctcccccagagactatttacggggactcgcaagaggagtcttgatagggtcttcgtacttgggagtcggccat

SEQ ID NO: 446668 - DNA, 140 bp, Artificial Sequence
  Synthetic
atggccgactcccaagtacgaagaccctatcaagactcctcttgcgagtccccgtaaatagtctctgggggagaccttgccatatatgttgataggaaagatggtcccatcattgtatccggagacccagcatggcgtat

SEQ ID NO: 446669 - DNA, 140 bp, Artificial Sequence
  Synthetic
atacgccatgctgggtctccctggggtgggttgctctggctaactctaaaaagttccaactattagttgagccagaaaagttgaataaaattatgcaggatgatctaaaccgttatacgtcgtacttgggagtcggccat

SEQ ID NO: 446670 - DNA, 140 bp, Artificial Sequence
  Synthetic
atggccgactcccaagtacgacgtataacggtttagatcatcctgcataattttattcaacttttctggctcaactaatagttggaactttttagagttagccagagcaacccaccccagggagacccagcatggcgtat

SEQ ID NO: 446671 - DNA, 140 bp, Artificial Sequence
  Synthetic
aggccctggctgctgatatgaatcagagaatgatcgggttggtcaaagttgtcgtcggattggcgttgtcaggagccccagtccctgagggtatgaactgggtatacaaattgaggagaagaccttttgggacagcggtg

SEQ ID NO: 446672 - DNA, 140 bp, Artificial Sequence
  Synthetic
caccgctgtcccaaaaggtcttctcctcaatttgtatacccagttcataccctcagggactggggctcctgacaacgccaatccgacgacaactttgaccaacccgatcattctctgattcatatcagcagccagggcct

SEQ ID NO: 446673 - DNA, 140 bp, Artificial Sequence
  Synthetic
atacgccatgctgggtctcccccgtctttgtacataatgctcagagagccatctttgagaggagagatattctctataccccaaaagattccagctgcttacccaaccacgatgaaagagcgtacttgggagtcggccat

SEQ ID NO: 446674 - DNA, 140 bp, Artificial Sequence
  Synthetic
atggccgactcccaagtacgctctttcatcgtggttgggtaagcagctggaatcttttggggtatagagaatatctctcctctcaaagatggctctctgagcattatgtacaaagacgggggagacccagcatggcgtat

SEQ ID NO: 446675 - DNA, 140 bp, Artificial Sequence
  Synthetic
aggccctggctgctgatatgtttctacgcaagatagtgaaaaactgtagggatgaggacacccagaagccctcccctgtatctgctcctccagatgatgatgacttgtggctgccccctcgaccttttgggacagcggtg

SEQ ID NO: 446676 - DNA, 140 bp, Artificial Sequence
  Synthetic
caccgctgtcccaaaaggtcgagggggcagccacaagtcatcatcatctggaggagcagatacaggggagggcttctgggtgtcctcatccctacagtttttcactatcttgcgtagaaacatatcagcagccagggcct

SEQ ID NO: 446677 - DNA, 140 bp, Artificial Sequence
  Synthetic
atacgccatgctgggtctccactttaggagttccaagatgacttacctaactcttgtcacttatcagtcttatcttctacttcagagggttgaaagaaatctatcgaagagcatgagagacgtacttgggagtcggccat

SEQ ID NO: 446678 - DNA, 140 bp, Artificial Sequence
  Synthetic
atggccgactcccaagtacgtctctcatgctcttcgatagatttctttcaaccctctgaagtagaagataagactgataagtgacaagagttaggtaagtcatcttggaactcctaaagtggagacccagcatggcgtat

SEQ ID NO: 446679 - DNA, 140 bp, Artificial Sequence
  Synthetic
aggccctggctgctgatatgttctgcatcaatggtgaggtcaaggtgtgcagtccaaacggctattcgttcaagatcttacggcatattctgagatcatttgatgagatatattctggaagaccttttgggacagcggtg

SEQ ID NO: 446680 - DNA, 140 bp, Artificial Sequence
  Synthetic
caccgctgtcccaaaaggtcttccagaatatatctcatcaaatgatctcagaatatgccgtaagatcttgaacgaatagccgtttggactgcacaccttgacctcaccattgatgcagaacatatcagcagccagggcct

SEQ ID NO: 446681 - DNA, 140 bp, Artificial Sequence
  Synthetic
atacgccatgctgggtctcctctctgcgtaggacgaggtgggtggatcaagaggtgcgccacgcagctagaactatgacggggaattacagccccaacaagaagatgtcccgcaaggcagcgtacttgggagtcggccat

SEQ ID NO: 446682 - DNA, 140 bp, Artificial Sequence
  Synthetic
atggccgactcccaagtacgctgccttgcgggacatcttcttgttggggctgtaattccccgtcatagttctagctgcgtggcgcacctcttgatccacccacctcgtcctacgcagagaggagacccagcatggcgtat

SEQ ID NO: 446683 - DNA, 140 bp, Artificial Sequence
  Synthetic
atacgccatgctgggtctccgtttcaaaaccctcttatctcaggcttaagagtggttcagtgggcaactggcgcccattataaactcaaacccattttagatgatctcaacgttttcccacgtacttgggagtcggccat

SEQ ID NO: 446684 - DNA, 140 bp, Artificial Sequence
  Synthetic
atggccgactcccaagtacgtgggaaaacgttgagatcatctaaaatgggtttgagtttataatgggcgccagttgcccactgaaccactcttaagcctgagataagagggttttgaaacggagacccagcatggcgtat

SEQ ID NO: 446685 - DNA, 140 bp, Artificial Sequence
  Synthetic
aggccctggctgctgatatggaacatacgggcttaactccaacctttgggagcaatagaacaaaaatatgttatggtgccattaaaccgctgcattttatcgaaaccagattaatgacctgaccttttgggacagcggtg

SEQ ID NO: 446686 - DNA, 140 bp, Artificial Sequence
  Synthetic
caccgctgtcccaaaaggtcaggtcattaatctggtttcgataaaatgcagcggtttaatggcaccataacatatttttgttctattgctcccaaaggttggagttaagcccgtatgttccatatcagcagccagggcct

SEQ ID NO: 446687 - DNA, 140 bp, Artificial Sequence
  Synthetic
atacgccatgctgggtctcctgaatgacctaatggcatccggaacacatccattgcctccctcagcaatcatgagcggaggagatgacattgtctccagagtgatagactttgactcgatcgtacttgggagtcggccat

SEQ ID NO: 446688 - DNA, 140 bp, Artificial Sequence
  Synthetic
atggccgactcccaagtacgatcgagtcaaagtctatcactctggagacaatgtcatctcctccgctcatgattgctgagggaggcaatggatgtgttccggatgccattaggtcattcaggagacccagcatggcgtat

SEQ ID NO: 446689 - DNA, 140 bp, Artificial Sequence
  Synthetic
aggccctggctgctgatatgtacagtgaagggggttactcttctatttgtccaaatctcctctctcacatctctgtcagtacagacacgatgtctgaattgactcatgatgggagaaattgaccttttgggacagcggtg

SEQ ID NO: 446690 - DNA, 140 bp, Artificial Sequence
  Synthetic
caccgctgtcccaaaaggtcaatttctcccatcatgagtcaattcagacatcgtgtctgtactgacagagatgtgagagaggagatttggacaaatagaagagtaacccccttcactgtacatatcagcagccagggcct

SEQ ID NO: 446691 - DNA, 140 bp, Artificial Sequence
  Synthetic
atacgccatgctgggtctccaatcagttcaaaataaggtgaacatgtcttatgacctcatcatttgtgatgcagaagtcacggacattgcatcaattaatcggataactctcttgatgtccgtacttgggagtcggccat

SEQ ID NO: 446692 - DNA, 140 bp, Artificial Sequence
  Synthetic
atggccgactcccaagtacggacatcaagagagttatccgattaattgatgcaatgtccgtgacttctgcatcacaaatgatgaggtcataagacatgttcaccttattttgaactgattggagacccagcatggcgtat

SEQ ID NO: 446693 - DNA, 140 bp, Artificial Sequence
  Synthetic
atacgccatgctgggtctcccgactttgcattatccatagatggcccgctttatctggttttcaagacttatggaactatgcttgtaaatccggaatatagagcaattcaacatctgtcgcgtacttgggagtcggccat

SEQ ID NO: 446694 - DNA, 140 bp, Artificial Sequence
  Synthetic
atggccgactcccaagtacgcgacagatgttgaattgctctatattccggatttacaagcatagttccataagtcttgaaaaccagataaagcgggccatctatggataatgcaaagtcgggagacccagcatggcgtat

SEQ ID NO: 446695 - DNA, 140 bp, Artificial Sequence
  Synthetic
atacgccatgctgggtctcccaacagcagagggaaaagagcatctaaggggggcaagacttgcggattcgtggacgaaaggggcttgtataagtctctaaaaggggcatgtaaactcaagcgtacttgggagtcggccat

SEQ ID NO: 446696 - DNA, 140 bp, Artificial Sequence
  Synthetic
atggccgactcccaagtacgcttgagtttacatgccccttttagagacttatacaagcccctttcgtccacgaatccgcaagtcttgccccccttagatgctcttttccctctgctgttgggagacccagcatggcgtat

SEQ ID NO: 446697 - DNA, 140 bp, Artificial Sequence
  Synthetic
aggccctggctgctgatatgtactgttgtcactgcttacgaagattgctcaggactggtatcgtttacagggttcataaagcagataaatctcactgcaagggaggcaatactgtacttcgaccttttgggacagcggtg

SEQ ID NO: 446698 - DNA, 140 bp, Artificial Sequence
  Synthetic
caccgctgtcccaaaaggtcgaagtacagtattgcctcccttgcagtgagatttatctgctttatgaaccctgtaaacgataccagtcctgagcaatcttcgtaagcagtgacaacagtacatatcagcagccagggcct

SEQ ID NO: 446699 - DNA, 140 bp, Artificial Sequence
  Synthetic
atacgccatgctgggtctccaaagacctaaggaaagatgatccctcaggctcttttgtctgtgcctcttctaatttcctcgttgtgtttcgggaaattccccatctacacgataccagagcgtacttgggagtcggccat

SEQ ID NO: 446700 - DNA, 140 bp, Artificial Sequence
  Synthetic
atggccgactcccaagtacgctctggtatcgtgtagatggggaatttcccgaaacacaacgaggaaattagaagaggcacagacaaaagagcctgagggatcatctttccttaggtctttggagacccagcatggcgtat

SEQ ID NO: 446701 - DNA, 140 bp, Artificial Sequence
  Synthetic
atacgccatgctgggtctccatgctgagtacttgacctcttccacccttcgagagatgagcctcgtcttgttcaactgtagcagccctaagagtgagatgcaaagagcccgatctttgaacgtacttgggagtcggccat

SEQ ID NO: 446702 - DNA, 140 bp, Artificial Sequence
  Synthetic
atggccgactcccaagtacgttcaaagatcgggctctttgcatctcactcttagggctgctacagttgaacaagacgaggctcatctctcgaagggtggaagaggtcaagtactcagcatggagacccagcatggcgtat

SEQ ID NO: 446703 - DNA, 140 bp, Artificial Sequence
  Synthetic
aggccctggctgctgatatgttcaactgtagcagccctaagagtgagatgcaaagagcccgatctttgaattatcaagatcttgtgaggggattcccagaggagattatatccaatccttgaccttttgggacagcggtg

SEQ ID NO: 446704 - DNA, 140 bp, Artificial Sequence
  Synthetic
caccgctgtcccaaaaggtcaaggattggatataatctcctctgggaatcccctcacaagatcttgataattcaaagatcgggctctttgcatctcactcttagggctgctacagttgaacatatcagcagccagggcct

SEQ ID NO: 446705 - DNA, 140 bp, Artificial Sequence
  Synthetic
atacgccatgctgggtctcccttcaaacacaaaggtcagaggaggataaagattcttcagtgcttctggaatagtctaattatatcctaaaaattcctcaattgtatacctctggaggagcgtacttgggagtcggccat

SEQ ID NO: 446706 - DNA, 140 bp, Artificial Sequence
  Synthetic
atggccgactcccaagtacgctcctccagaggtatacaattgaggaatttttaggatataattagactattccagaagcactgaagaatctttatcctcctctgacctttgtgtttgaagggagacccagcatggcgtat

SEQ ID NO: 446707 - DNA, 140 bp, Artificial Sequence
  Synthetic
aggccctggctgctgatatgccgtacgataaatcccttcattcgagagtttttcctagagggaaatgctcaggaataacggtgtcctctacctactgctctaccaaccatgactacaccagaccttttgggacagcggtg

SEQ ID NO: 446708 - DNA, 140 bp, Artificial Sequence
  Synthetic
caccgctgtcccaaaaggtctggtgtagtcatggttggtagagcagtaggtagaggacaccgttattcctgagcatttccctctaggaaaaactctcgaatgaagggatttatcgtacggcatatcagcagccagggcct

SEQ ID NO: 446709 - DNA, 140 bp, Artificial Sequence
  Synthetic
atacgccatgctgggtctccgatgtctatcattatagccatcgtgatagtcttctccaatagagttttcaatgtttctaagccattgaccgaccccctgttctatccaccgtcagacccccgtacttgggagtcggccat

SEQ ID NO: 446710 - DNA, 140 bp, Artificial Sequence
  Synthetic
atggccgactcccaagtacgggggtctgacggtggatagaacagggggtcggtcaatggcttagaaacattgaaaactctattggagaagactatcacgatggctataatgatagacatcggagacccagcatggcgtat

SEQ ID NO: 446711 - DNA, 140 bp, Artificial Sequence
  Synthetic
atacgccatgctgggtctccgagtcccttcacaatccttatcctgattaccattggctaaggactgtaaaaaccaccaaagaatcccttattatcatatcgccaagtgtggctgatttggcgtacttgggagtcggccat

SEQ ID NO: 446712 - DNA, 140 bp, Artificial Sequence
  Synthetic
atggccgactcccaagtacgccaaatcagccacacttggcgatatgataataagggattctttggtggtttttacagtccttagccaatggtaatcaggataaggattgtgaagggactcggagacccagcatggcgtat

SEQ ID NO: 446713 - DNA, 140 bp, Artificial Sequence
  Synthetic
atacgccatgctgggtctccatagacctataacttattactttaagaaacaagtcattcgagggaacatctatctatcctggagttggtctgacgacacctcagtgttcaagagggtagccgtacttgggagtcggccat

SEQ ID NO: 446714 - DNA, 140 bp, Artificial Sequence
  Synthetic
atggccgactcccaagtacggctaccctcttgaacactgaggtgtcgtcagaccaactccaggatagatagatgttccctcgaatgacttgtttcttaaagtaataagttataggtctatggagacccagcatggcgtat

SEQ ID NO: 446715 - DNA, 140 bp, Artificial Sequence
  Synthetic
atacgccatgctgggtctccttgggaataacaatctcttccacctactgttcaactaatcatgattatactatctggatgcccgaagaagcaagactcgggacatcttgtgacatttttacgtacttgggagtcggccat

SEQ ID NO: 446716 - DNA, 140 bp, Artificial Sequence
  Synthetic
atggccgactcccaagtacgtaaaaatgtcacaagatgtcccgagtcttgcttcttcgggcatccagatagtataatcatgattagttgaacagtaggtggaagagattgttattcccaaggagacccagcatggcgtat

SEQ ID NO: 446717 - DNA, 140 bp, Artificial Sequence
  Synthetic
atacgccatgctgggtctccgaggtggagagacatcttcatgggtataataggtggatcacccttgcggacatcagatctagatcatctctactagattacagctgcctatgaaatgaaccgtacttgggagtcggccat

SEQ ID NO: 446718 - DNA, 140 bp, Artificial Sequence
  Synthetic
atggccgactcccaagtacggttcatttcataggcagctgtaatctagtagagatgatctagatctgatgtccgcaagggtgatccacctattatacccatgaagatgtctctccacctcggagacccagcatggcgtat

SEQ ID NO: 446719 - DNA, 140 bp, Artificial Sequence
  Synthetic
aggccctggctgctgatatggctgtgcggagttcctggactcagacttatggatggaacgtgggtcgctattcagacaccaaatgagaccaaatggtgctctcctgatcagctggtgaatgaccttttgggacagcggtg

SEQ ID NO: 446720 - DNA, 140 bp, Artificial Sequence
  Synthetic
caccgctgtcccaaaaggtcattcaccagctgatcaggagagcaccatttggtctcatttggtgtctgaatagcgacccacgttccatccataagtctgagtccaggaactccgcacagccatatcagcagccagggcct

SEQ ID NO: 446721 - DNA, 140 bp, Artificial Sequence
  Synthetic
atacgccatgctgggtctccatttttgaggctcgtggaagccgaagctctcaaaccatgtaccctgaaaaaaacgagatcccaaatcagaacctctggttgtttgatcattctttttgtccgtacttgggagtcggccat

SEQ ID NO: 446722 - DNA, 140 bp, Artificial Sequence
  Synthetic
atggccgactcccaagtacggacaaaaagaatgatcaaacaaccagaggttctgatttgggatctcgtttttttcagggtacatggtttgagagcttcggcttccacgagcctcaaaaatggagacccagcatggcgtat

SEQ ID NO: 446723 - DNA, 140 bp, Artificial Sequence
  Synthetic
atacgccatgctgggtctcctcttcgatgcaacaagtgcataaggcccatcgatgatattacccttgagacctctcaaatcttcgagttcccggatgtttcaagaaggatatctaggatgcgtacttgggagtcggccat

SEQ ID NO: 446724 - DNA, 140 bp, Artificial Sequence
  Synthetic
atggccgactcccaagtacgcatcctagatatccttcttgaaacatccgggaactcgaagatttgagaggtctcaagggtaatatcatcgatgggccttatgcacttgttgcatcgaagaggagacccagcatggcgtat

SEQ ID NO: 446725 - DNA, 140 bp, Artificial Sequence
  Synthetic
aggccctggctgctgatatgagtcatccctcctccagcagcatatggagctgttggaatcctcagttatccccttgatgcatcctttggcagatccatcaacggtttttaaaaatggtgagaccttttgggacagcggtg

SEQ ID NO: 446726 - DNA, 140 bp, Artificial Sequence
  Synthetic
caccgctgtcccaaaaggtctcaccatttttaaaaaccgttgatggatctgccaaaggatgcatcaaggggataactgaggattccaacagctccatatgctgctggaggagggatgactcatatcagcagccagggcct

SEQ ID NO: 446727 - DNA, 140 bp, Artificial Sequence
  Synthetic
atacgccatgctgggtctcccaaaatcagtaagcttcaggcgtctcagcaacttgagaaaacttgttcctgggtttggaaaggcatatactatattcaacaaaaccttgatggaggctgacgtacttgggagtcggccat

SEQ ID NO: 446728 - DNA, 140 bp, Artificial Sequence
  Synthetic
atggccgactcccaagtacgtcagcctccatcaaggttttgttgaatatagtatatgcctttccaaacccaggaacaagttttctcaagttgctgagacgcctgaagcttactgattttgggagacccagcatggcgtat

SEQ ID NO: 446729 - DNA, 140 bp, Artificial Sequence
  Synthetic
atacgccatgctgggtctcctgatatcttagataactctacgcttgagcttgagcagaggccatagcaagttccactacattagaccaaatgggatttagttgagagaagtgatttgcctcgtacttgggagtcggccat

SEQ ID NO: 446730 - DNA, 140 bp, Artificial Sequence
  Synthetic
atggccgactcccaagtacgaggcaaatcacttctctcaactaaatcccatttggtctaatgtagtggaacttgctatggcctctgctcaagctcaagcgtagagttatctaagatatcaggagacccagcatggcgtat

SEQ ID NO: 446731 - DNA, 140 bp, Artificial Sequence
  Synthetic
aggccctggctgctgatatgttgccgaaggaccaatagaccagaatcaatacaacacagtcttggagagacggggaggaaagtgtcggtaacctcccaaagcgggagggtcatatcttcagaccttttgggacagcggtg

SEQ ID NO: 446732 - DNA, 140 bp, Artificial Sequence
  Synthetic
caccgctgtcccaaaaggtctgaagatatgaccctcccgctttgggaggttaccgacactttcctccccgtctctccaagactgtgttgtattgattctggtctattggtccttcggcaacatatcagcagccagggcct

SEQ ID NO: 446733 - DNA, 140 bp, Artificial Sequence
  Synthetic
atacgccatgctgggtctcccggggaggaaagtgtcggtaacctcccaaagcgggagggtcatatcttcatgggagtcatataaaagtggaggtgagaccaagctgtaaagacaggtcatcgtacttgggagtcggccat

SEQ ID NO: 446734 - DNA, 140 bp, Artificial Sequence
  Synthetic
atggccgactcccaagtacgatgacctgtctttacagcttggtctcacctccacttttatatgactcccatgaagatatgaccctcccgctttgggaggttaccgacactttcctccccgggagacccagcatggcgtat

SEQ ID NO: 446735 - DNA, 140 bp, Artificial Sequence
  Synthetic
atacgccatgctgggtctccggtctcaggggttgacctcggtctcccagactgggggaagtatgtgctgatgagtgcaggtgctctagcgaccgtgatgctgacaatattcttgataacccgtacttgggagtcggccat

SEQ ID NO: 446736 - DNA, 140 bp, Artificial Sequence
  Synthetic
atggccgactcccaagtacgggttatcaagaatattgtcagcatcacggtcgctagagcacctgcactcatcagcacatacttcccccagtctgggagaccgaggtcaacccctgagaccggagacccagcatggcgtat

SEQ ID NO: 446737 - DNA, 140 bp, Artificial Sequence
  Synthetic
aggccctggctgctgatatgtcgagaatgttgagacctcccttaatcatctcaaccgatcaaacatggtcatgtagattcttataacacaagaaatcttctagcagttccagtgaccaacgaccttttgggacagcggtg

SEQ ID NO: 446738 - DNA, 140 bp, Artificial Sequence
  Synthetic
caccgctgtcccaaaaggtcgttggtcactggaactgctagaagatttcttgtgttataagaatctacatgaccatgtttgatcggttgagatgattaagggaggtctcaacattctcgacatatcagcagccagggcct

SEQ ID NO: 446739 - DNA, 140 bp, Artificial Sequence
  Synthetic
atacgccatgctgggtctccatgtagattcttataacacaagaaatcttctagcagttccagtgaccaacggtgcttttatcctccaagaactgataccaaaggtggtggacaggcctagcgtacttgggagtcggccat

SEQ ID NO: 446740 - DNA, 140 bp, Artificial Sequence
  Synthetic
atggccgactcccaagtacgctaggcctgtccaccacctttggtatcagttcttggaggataaaagcaccgttggtcactggaactgctagaagatttcttgtgttataagaatctacatggagacccagcatggcgtat

SEQ ID NO: 446741 - DNA, 140 bp, Artificial Sequence
  Synthetic
atacgccatgctgggtctcccatgggaatattacaagagtggaggcgggaccaggctgtgagagcaggtcatctcctccgtaccttgcgtgtggatgatcatctctcctctagatctgggcgtacttgggagtcggccat

SEQ ID NO: 446742 - DNA, 140 bp, Artificial Sequence
  Synthetic
atggccgactcccaagtacgcccagatctagaggagagatgatcatccacacgcaaggtacggaggagatgacctgctctcacagcctggtcccgcctccactcttgtaatattcccatgggagacccagcatggcgtat

SEQ ID NO: 446743 - DNA, 140 bp, Artificial Sequence
  Synthetic
aggccctggctgctgatatgcccccagatactagactgggcaagagtttgttaagaaagagtacttgcctcctatgaaggacataagcaatagatcaccgtcatcttgcatttcagcaaagaccttttgggacagcggtg

SEQ ID NO: 446744 - DNA, 140 bp, Artificial Sequence
  Synthetic
caccgctgtcccaaaaggtctttgctgaaatgcaagatgacggtgatctattgcttatgtccttcataggaggcaagtactctttcttaacaaactcttgcccagtctagtatctgggggcatatcagcagccagggcct

SEQ ID NO: 446745 - DNA, 140 bp, Artificial Sequence
  Synthetic
atacgccatgctgggtctccaaggggagagttttcttttagccatgtcaaggataatctacttagatccttctttgggaggagtgtctggaatgtctcttggaaggttccatatacgtcacgtacttgggagtcggccat

SEQ ID NO: 446746 - DNA, 140 bp, Artificial Sequence
  Synthetic
atggccgactcccaagtacgtgacgtatatggaaccttccaagagacattccagacactcctcccaaagaaggatctaagtagattatccttgacatggctaaaagaaaactctccccttggagacccagcatggcgtat

SEQ ID NO: 446747 - DNA, 140 bp, Artificial Sequence
  Synthetic
aggccctggctgctgatatggtttgcataattataaaaggctgggtcgttcgtgattttcagtcgagaaaaaaactatagaactgaagaacaactagcaacacttctcatcttgagactcgaccttttgggacagcggtg

SEQ ID NO: 446748 - DNA, 140 bp, Artificial Sequence
  Synthetic
caccgctgtcccaaaaggtcgagtctcaagatgagaagtgttgctagttgttcttcagttctatagtttttttctcgactgaaaatcacgaacgacccagccttttataattatgcaaaccatatcagcagccagggcct

SEQ ID NO: 446749 - DNA, 140 bp, Artificial Sequence
  Synthetic
atacgccatgctgggtctcccatgtagattttgatgatgtatgatttcttctgacagtatcagtgactaatggtgctctcatttcctaaggactgataccaaaggctttggacaatccaacgtacttgggagtcggccat

SEQ ID NO: 446750 - DNA, 140 bp, Artificial Sequence
  Synthetic
atggccgactcccaagtacgttggattgtccaaagcctttggtatcagtccttaggaaatgagagcaccattagtcactgatactgtcagaagaaatcatacatcatcaaaatctacatgggagacccagcatggcgtat

SEQ ID NO: 446751 - DNA, 140 bp, Artificial Sequence
  Synthetic
aggccctggctgctgatatgcggtatctggctaacatatattcctcttatttgttctttcacgtgatcaccctttacatgaatgccttggactgggatgaggagaagaccatcctagcacgaccttttgggacagcggtg

SEQ ID NO: 446752 - DNA, 140 bp, Artificial Sequence
  Synthetic
caccgctgtcccaaaaggtcgtgctaggatggtcttctcctcatcccagtccaaggcattcatgtaaagggtgatcacgtgaaagaacaaataagaggaatatatgttagccagataccgcatatcagcagccagggcct

SEQ ID NO: 446753 - DNA, 140 bp, Artificial Sequence
  Synthetic
atacgccatgctgggtctccaaagatcaaatatggggattgctgattgtgaccaaggattttgtgtactctcaaagttctggctgtctctttgatagaaactatacacttatgctgaaagcgtacttgggagtcggccat

SEQ ID NO: 446754 - DNA, 140 bp, Artificial Sequence
  Synthetic
atggccgactcccaagtacgctttcagcataagtgtatagtttctatcaaagagacagccagaactttgagagtacacaaaatccttggtcacaatcagcaatccccatatttgatctttggagacccagcatggcgtat

SEQ ID NO: 446755 - DNA, 140 bp, Artificial Sequence
  Synthetic
aggccctggctgctgatatggaagttagatctgggttccctcaaagtgggtggaaccgcagcccagtcaatgatctccctctggttatatggcgctcactctgagtcaaacaggagccgggaccttttgggacagcggtg

SEQ ID NO: 446756 - DNA, 140 bp, Artificial Sequence
  Synthetic
caccgctgtcccaaaaggtcccggctcctgtttgactcagagtgagcgccatataaccagagggagatcattgactgggctgcggttccacccactttgagggaacccagatctaacttccatatcagcagccagggcct

SEQ ID NO: 446757 - DNA, 140 bp, Artificial Sequence
  Synthetic
atacgccatgctgggtctcctgatctccctctggttatatggcgctcactctgagtcaaacaggagccggaaatgtatgactgacctggcccatttctattccaagtcttctcccatagacgtacttgggagtcggccat

SEQ ID NO: 446758 - DNA, 140 bp, Artificial Sequence
  Synthetic
atggccgactcccaagtacgtctatgggagaagacttggaatagaaatgggccaggtcagtcatacatttccggctcctgtttgactcagagtgagcgccatataaccagagggagatcaggagacccagcatggcgtat

SEQ ID NO: 446759 - DNA, 140 bp, Artificial Sequence
  Synthetic
atacgccatgctgggtctccaatcgattcagaggctgagccaagagggaatcccaccattcctaacatcttaagaaactccgactacaatctcaactctcctctaatagaggatccagcccgtacttgggagtcggccat

SEQ ID NO: 446760 - DNA, 140 bp, Artificial Sequence
  Synthetic
atggccgactcccaagtacgggctggatcctctattagaggagagttgagattgtagtcggagtttcttaagatgttaggaatggtgggattccctcttggctcagcctctgaatcgattggagacccagcatggcgtat

SEQ ID NO: 446761 - DNA, 140 bp, Artificial Sequence
  Synthetic
aggccctggctgctgatatgagatatctcgccaatacgtattcctcttatctgttcttccacgtgattaccttatacatgaatgccctagactgggatgaagagaagaccatcttagcttgaccttttgggacagcggtg

SEQ ID NO: 446762 - DNA, 140 bp, Artificial Sequence
  Synthetic
caccgctgtcccaaaaggtcaagctaagatggtcttctcttcatcccagtctagggcattcatgtataaggtaatcacgtggaagaacagataagaggaatacgtattggcgagatatctcatatcagcagccagggcct

SEQ ID NO: 446763 - DNA, 140 bp, Artificial Sequence
  Synthetic
atacgccatgctgggtctccagaaggtggatctagggtctatcaaagtgggtggagctgctgcacaatctatgatctccctttggctgcacggtgcccattcggaatcaaataggagccgcgtacttgggagtcggccat

SEQ ID NO: 446764 - DNA, 140 bp, Artificial Sequence
  Synthetic
atggccgactcccaagtacgcggctcctatttgattccgaatgggcaccgtgcagccaaagggagatcatagattgtgcagcagctccacccactttgatagaccctagatccaccttctggagacccagcatggcgtat

SEQ ID NO: 446765 - DNA, 140 bp, Artificial Sequence
  Synthetic
atacgccatgctgggtctccttatctatcctggagttggtctgatgacacttcagtgtttaaaagggtggcctgtaactctagtttgagtctgtcatctcattggatcagattaatttaccgtacttgggagtcggccat

SEQ ID NO: 446766 - DNA, 140 bp, Artificial Sequence
  Synthetic
atggccgactcccaagtacggtaaattaatctgatccaatgagatgacagactcaaactagagttacaggccacccttttaaacactgaagtgtcatcagaccaactccaggatagataaggagacccagcatggcgtat

SEQ ID NO: 446767 - DNA, 140 bp, Artificial Sequence
  Synthetic
aggccctggctgctgatatgacctggacaatgttggggttcaaatggtcagacaaatgaggtctggagagagattcctcaagatttggtctcaaactgtggaggagattatctcctatgtgaccttttgggacagcggtg

SEQ ID NO: 446768 - DNA, 140 bp, Artificial Sequence
  Synthetic
caccgctgtcccaaaaggtcacataggagataatctcctccacagtttgagaccaaatcttgaggaatctctctccagacctcatttgtctgaccatttgaaccccaacattgtccaggtcatatcagcagccagggcct

SEQ ID NO: 446769 - DNA, 140 bp, Artificial Sequence
  Synthetic
atacgccatgctgggtctccgaccttttcttgtctcggttcaactctttgatgattcttctttcccctcctgaacccagatattcagatgacctgatatctcaactgtgtcagttatatacgtacttgggagtcggccat

SEQ ID NO: 446770 - DNA, 140 bp, Artificial Sequence
  Synthetic
atggccgactcccaagtacgtatataactgacacagttgagatatcaggtcatctgaatatctgggttcaggaggggaaagaagaatcatcaaagagttgaaccgagacaagaaaaggtcggagacccagcatggcgtat

SEQ ID NO: 446771 - DNA, 140 bp, Artificial Sequence
  Synthetic
aggccctggctgctgatatgtgaacccagatattcagatgacctgatatctcaactgtgtcagttatatatcgccggagatcatgtcttgtctatgtgcgggaacgcgggttatgaagtcgaccttttgggacagcggtg

SEQ ID NO: 446772 - DNA, 140 bp, Artificial Sequence
  Synthetic
caccgctgtcccaaaaggtcgacttcataacccgcgttcccgcacatagacaagacatgatctccggcgatatataactgacacagttgagatatcaggtcatctgaatatctgggttcacatatcagcagccagggcct

SEQ ID NO: 446773 - DNA, 140 bp, Artificial Sequence
  Synthetic
aggccctggctgctgatatgaagataaggtgggtcagcttgaaggaacatttggtcctagtgcaaaaaggttcttcagggttctagatcaattcgacaacatacatgacttagtctttgtgaccttttgggacagcggtg

SEQ ID NO: 446774 - DNA, 140 bp, Artificial Sequence
  Synthetic
caccgctgtcccaaaaggtcacaaagactaagtcatgtatgttgtcgaattgatctagaaccctgaagaacctttttgcactaggaccaaatgttccttcaagctgacccaccttatcttcatatcagcagccagggcct

SEQ ID NO: 446775 - DNA, 140 bp, Artificial Sequence
  Synthetic
atacgccatgctgggtctcctcctatcaggagtgtttggcaagcgatctggctagaaggatcctcaggtggggatttgataagtattccaaatggtatcttgatccacgacttcttgcaacgtacttgggagtcggccat

SEQ ID NO: 446776 - DNA, 140 bp, Artificial Sequence
  Synthetic
atggccgactcccaagtacgttgcaagaagtcgtggatcaagataccatttggaatacttatcaaatccccacctgaggatccttctagccagatcgcttgccaaacactcctgataggaggagacccagcatggcgtat

SEQ ID NO: 446777 - DNA, 140 bp, Artificial Sequence
  Synthetic
aggccctggctgctgatatgagattgagggccgattttttgccttgatgtcttggaatctgagactgtacttcgttattaccgagaagctcctagctaattacatcttgccactctttgagaccttttgggacagcggtg

SEQ ID NO: 446778 - DNA, 140 bp, Artificial Sequence
  Synthetic
caccgctgtcccaaaaggtctcaaagagtggcaagatgtaattagctaggagcttctcggtaataacgaagtacagtctcagattccaagacatcaaggcaaaaaatcggccctcaatctcatatcagcagccagggcct

SEQ ID NO: 446779 - DNA, 140 bp, Artificial Sequence
  Synthetic
atacgccatgctgggtctccgatcttcgatatccccgaatcaatggatccatctgagatactagatgataaatcacactcttttactagaacaagactagcatcatggctatctgagaaccgtacttgggagtcggccat

SEQ ID NO: 446780 - DNA, 140 bp, Artificial Sequence
  Synthetic
atggccgactcccaagtacggttctcagatagccatgatgctagtcttgttctagtaaaagagtgtgatttatcatctagtatctcagatggatccattgattcggggatatcgaagatcggagacccagcatggcgtat

SEQ ID NO: 446781 - DNA, 140 bp, Artificial Sequence
  Synthetic
aggccctggctgctgatatgtttcacctggactatgagaagtggaacaatcatcaaaggttggagtcaacagaagatgtattttctgtcctagatcaggtgtttggattaaaaagggtgtgaccttttgggacagcggtg

SEQ ID NO: 446782 - DNA, 140 bp, Artificial Sequence
  Synthetic
caccgctgtcccaaaaggtcacaccctttttaatccaaacacctgatctaggacagaaaatacatcttctgttgactccaacctttgatgattgttccacttctcatagtccaggtgaaacatatcagcagccagggcct

SEQ ID NO: 446783 - DNA, 140 bp, Artificial Sequence
  Synthetic
aggccctggctgctgatatgtctcaaggactcatgagtttttccagaagtcctggatctattattcagacagatcagacctcatcgggctatgggaggaccaaatatactgcttggacatgaccttttgggacagcggtg

SEQ ID NO: 446784 - DNA, 140 bp, Artificial Sequence
  Synthetic
caccgctgtcccaaaaggtcatgtccaagcagtatatttggtcctcccatagcccgatgaggtctgatctgtctgaataatagatccaggacttctggaaaaactcatgagtccttgagacatatcagcagccagggcct

SEQ ID NO: 446785 - DNA, 140 bp, Artificial Sequence
  Synthetic
aggccctggctgctgatatgtctcagactaggaacacaagaaccaagatattggcacaaggagataaccaggttctatgtccgacatacatgctatcgcctgggctgtcgagagaggggcgaccttttgggacagcggtg

SEQ ID NO: 446786 - DNA, 140 bp, Artificial Sequence
  Synthetic
caccgctgtcccaaaaggtcgcccctctctcgacagcccaggcgatagcatgtatgtcggacatagaacctggttatctccttgtgccaatatcttggttcttgtgttcctagtctgagacatatcagcagccagggcct

SEQ ID NO: 446787 - DNA, 140 bp, Artificial Sequence
  Synthetic
aggccctggctgctgatatgtagacccataacttattacttcaagaagcaggttattcgagggagtatttatctgtcttggagttggtctgatgatacctctgtgttcaagagggtggctgaccttttgggacagcggtg

SEQ ID NO: 446788 - DNA, 140 bp, Artificial Sequence
  Synthetic
caccgctgtcccaaaaggtcagccaccctcttgaacacagaggtatcatcagaccaactccaagacagataaatactccctcgaataacctgcttcttgaagtaataagttatgggtctacatatcagcagccagggcct

SEQ ID NO: 446789 - DNA, 140 bp, Artificial Sequence
  Synthetic
aggccctggctgctgatatgtgagggacttcctgcttatgtcagtgcaggcagtctttcactacttgctgttcagccccatcttaaagggcagagtctacaaaattctaaatgctgaagggaccttttgggacagcggtg

SEQ ID NO: 446790 - DNA, 140 bp, Artificial Sequence
  Synthetic
caccgctgtcccaaaaggtcccttcagcatttagaattttgtagactctgccctttaagatggggctgaacagcaagtagtgaaagactgcctgcactgacataagcaggaagtccctcacatatcagcagccagggcct

SEQ ID NO: 446791 - DNA, 140 bp, Artificial Sequence
  Synthetic
atacgccatgctgggtctcccttctctacgagttggagagcatctcaagaaatgcgctctcaatatatcgtgccattgaggaaggggcatccaaactggggctcatcataaagaaggaggcgtacttgggagtcggccat

SEQ ID NO: 446792 - DNA, 140 bp, Artificial Sequence
  Synthetic
atggccgactcccaagtacgcctccttctttatgatgagccccagtttggatgccccttcctcaatggcacgatatattgagagcgcatttcttgagatgctctccaactcgtagagaagggagacccagcatggcgtat

SEQ ID NO: 446793 - DNA, 140 bp, Artificial Sequence
  Synthetic
atacgccatgctgggtctccagaccatgtgtagctatgactttcttatttatgggaaaactcctttatttcgtggtaacattttagtgcctgagtccaaaagatgggctagggtctcctgcgtacttgggagtcggccat

SEQ ID NO: 446794 - DNA, 140 bp, Artificial Sequence
  Synthetic
atggccgactcccaagtacgcaggagaccctagcccatcttttggactcaggcactaaaatgttaccacgaaataaaggagttttcccataaataagaaagtcatagctacacatggtctggagacccagcatggcgtat

SEQ ID NO: 446795 - DNA, 140 bp, Artificial Sequence
  Synthetic
atacgccatgctgggtctcccttggaagagtccttttataactcggagatccatgggatcaaccggatgactcagactcctcagagggtcggaagggtttggccgtgctcttctgagaggcgtacttgggagtcggccat

SEQ ID NO: 446796 - DNA, 140 bp, Artificial Sequence
  Synthetic
atggccgactcccaagtacgcctctcagaagagcacggccaaacccttccgaccctctgaggagtctgagtcatccggttgatcccatggatctccgagttataaaaggactcttccaagggagacccagcatggcgtat

SEQ ID NO: 446797 - DNA, 140 bp, Artificial Sequence
  Synthetic
aggccctggctgctgatatgtttcagctcatccttcttggggattcctgagtcaatcatcggattgatacaaaactcccggacaataaggaggcagtttagaaagagcctctcaagaactgaccttttgggacagcggtg

SEQ ID NO: 446798 - DNA, 140 bp, Artificial Sequence
  Synthetic
caccgctgtcccaaaaggtcagttcttgagaggctctttctaaactgcctccttattgtccgggagttttgtatcaatccgatgattgactcaggaatccccaagaaggatgagctgaaacatatcagcagccagggcct

SEQ ID NO: 446799 - DNA, 140 bp, Artificial Sequence
  Synthetic
aggccctggctgctgatatgcatcttttacttcagagggttgagaaaaatctctccaaaagtatgagggccaacttaagacaaatgagctctctgatgaggcaggtgctaggtgggcatggaccttttgggacagcggtg

SEQ ID NO: 446800 - DNA, 140 bp, Artificial Sequence
  Synthetic
caccgctgtcccaaaaggtccatgcccacctagcacctgcctcatcagagagctcatttgtcttaagttggccctcatacttttggagagatttttctcaaccctctgaagtaaaagatgcatatcagcagccagggcct

SEQ ID NO: 446801 - DNA, 140 bp, Artificial Sequence
  Synthetic
aggccctggctgctgatatggaaggtcaccaatgttcatgtggtgaaaagggccctctcactaaaagaatccataaactggttcatcacaagaaactcgaatttggctcagactctgattgaccttttgggacagcggtg

SEQ ID NO: 446802 - DNA, 140 bp, Artificial Sequence
  Synthetic
caccgctgtcccaaaaggtcaatcagagtctgagccaaattcgagtttcttgtgatgaaccagtttatggattcttttagtgagagggcccttttcaccacatgaacattggtgaccttccatatcagcagccagggcct

SEQ ID NO: 446803 - DNA, 140 bp, Artificial Sequence
  Synthetic
atacgccatgctgggtctccccataaactggttcatcacaagaaactcgaatttggctcagactctgattagaaacatcatgtctctgacaggccctgattttcctatagaagaggcccccgtacttgggagtcggccat

SEQ ID NO: 446804 - DNA, 140 bp, Artificial Sequence
  Synthetic
atggccgactcccaagtacgggggcctcttctataggaaaatcagggcctgtcagagacatgatgtttctaatcagagtctgagccaaattcgagtttcttgtgatgaaccagtttatggggagacccagcatggcgtat

SEQ ID NO: 446805 - DNA, 140 bp, Artificial Sequence
  Synthetic
aggccctggctgctgatatgacagtgaaggggggtattcctctgtgtgccccaatctcctctctcatatctccgtgagtacagacaccatgtctgatttaacccaggacgggaagaattagaccttttgggacagcggtg

SEQ ID NO: 446806 - DNA, 140 bp, Artificial Sequence
  Synthetic
caccgctgtcccaaaaggtctaattcttcccgtcctgggttaaatcagacatggtgtctgtactcacggagatatgagagaggagattggggcacacagaggaataccccccttcactgtcatatcagcagccagggcct

SEQ ID NO: 446807 - DNA, 140 bp, Artificial Sequence
  Synthetic
atacgccatgctgggtctccagaaagtcaccaatgtccatgtggtgaaacgagctttgtcactcaaggaatctataaactggttcattacaagagactcgaatttggcccaaactttgatcgtacttgggagtcggccat

SEQ ID NO: 446808 - DNA, 140 bp, Artificial Sequence
  Synthetic
atggccgactcccaagtacgatcaaagtttgggccaaattcgagtctcttgtaatgaaccagtttatagattccttgagtgacaaagctcgtttcaccacatggacattggtgactttctggagacccagcatggcgtat

SEQ ID NO: 446809 - DNA, 140 bp, Artificial Sequence
  Synthetic
  misc_feature (21)..(21): n is a, c, g, or t
aggccctggctgctgatatgnggatatctcagataacgttgtgtttggacacagctagagattgtagtcagtccccggacactacactaggtaagagttgatcaggaaaggagacctgccgaccttttgggacagcggtg

SEQ ID NO: 446810 - DNA, 140 bp, Artificial Sequence
  Synthetic
  misc_feature (120)..(120): n is a, c, g, or t
caccgctgtcccaaaaggtcggcaggtctcctttcctgatcaactcttacctagtgtagtgtccggggactgactacaatctctagctgtgtccaaacacaacgttatctgagatatccncatatcagcagccagggcct

SEQ ID NO: 446811 - DNA, 140 bp, Artificial Sequence
  Synthetic
aggccctggctgctgatatgccgggagattttgaatctttaagtggtagggaaaaatcccgtcacatagggtcggctcaagggctcctatattcaatcttggtcgcaatacatgactcaggaccttttgggacagcggtg

SEQ ID NO: 446812 - DNA, 140 bp, Artificial Sequence
  Synthetic
caccgctgtcccaaaaggtcctgagtcatgtattgcgaccaagattgaatataggagcccttgagccgaccctatgtgacgggatttttccctaccacttaaagattcaaaatctcccggcatatcagcagccagggcct

SEQ ID NO: 446813 - DNA, 140 bp, Artificial Sequence
  Synthetic
atacgccatgctgggtctccgtcggctcaagggctcctatattcaatcttggtcgcaatacatgactcaggatacaatgatggaactatcttccctgtcaacatatatggcaaggtctcccgtacttgggagtcggccat

SEQ ID NO: 446814 - DNA, 140 bp, Artificial Sequence
  Synthetic
atggccgactcccaagtacgggagaccttgccatatatgttgacagggaagatagttccatcattgtatcctgagtcatgtattgcgaccaagattgaatataggagcccttgagccgacggagacccagcatggcgtat

SEQ ID NO: 446815 - DNA, 140 bp, Artificial Sequence
  Synthetic
atacgccatgctgggtctccatcacactcttttactagaacaagattggcgtcatggctgtcggagaacagaggagggccggtccccagtgagaaggtcattattacggctctttccaggcgtacttgggagtcggccat

SEQ ID NO: 446816 - DNA, 140 bp, Artificial Sequence
  Synthetic
atggccgactcccaagtacgcctggaaagagccgtaataatgaccttctcactggggaccggccctcctctgttctccgacagccatgacgccaatcttgttctagtaaaagagtgtgatggagacccagcatggcgtat

SEQ ID NO: 446817 - DNA, 140 bp, Artificial Sequence
  Synthetic
aggccctggctgctgatatgagttgatatcaggtgtgatctcatatatcctattgagactggataatcacccatctttgtacataatgctcagagaaccatctcttagaggagagatattgaccttttgggacagcggtg

SEQ ID NO: 446818 - DNA, 140 bp, Artificial Sequence
  Synthetic
caccgctgtcccaaaaggtcaatatctctcctctaagagatggttctctgagcattatgtacaaagatgggtgattatccagtctcaataggatatatgagatcacacctgatatcaactcatatcagcagccagggcct

SEQ ID NO: 446819 - DNA, 140 bp, Artificial Sequence
  Synthetic
atacgccatgctgggtctccgatcggcccaagggctcttatattcaatcttggttgcgactcatgactccgggtacaatgatggaaccatttttcctgttaacatatatagcaaggtttccgtacttgggagtcggccat

SEQ ID NO: 446820 - DNA, 140 bp, Artificial Sequence
  Synthetic
atggccgactcccaagtacggaaaccttgctatatatgttaacaggaaaaatggttccatcattgtacccggagtcatgagtcgcaaccaagattgaatataagagcccttgggccgatcggagacccagcatggcgtat

SEQ ID NO: 446821 - DNA, 140 bp, Artificial Sequence
  Synthetic
aggccctggctgctgatatgttccacaagaactttgaggaagagataagaagaatgtttgagccggggcaggagactgctgttcctcattcctatttcatccacttccgttcactgggccgaccttttgggacagcggtg

SEQ ID NO: 446822 - DNA, 140 bp, Artificial Sequence
  Synthetic
caccgctgtcccaaaaggtcggcccagtgaacggaagtggatgaaataggaatgaggaacagcagtctcctgccccggctcaaacattcttcttatctcttcctcaaagttcttgtggaacatatcagcagccagggcct

SEQ ID NO: 446823 - DNA, 140 bp, Artificial Sequence
  Synthetic
aggccctggctgctgatatgaacctgcgacagatgagttccttgatgaggcaggtgctgggaggacatggggaggacaccttagagtctgatgatgacattcagaggctattaaaggactgaccttttgggacagcggtg

SEQ ID NO: 446824 - DNA, 140 bp, Artificial Sequence
  Synthetic
caccgctgtcccaaaaggtcagtcctttaatagcctctgaatgtcatcatcagactctaaggtgtcctccccatgtcctcccagcacctgcctcatcaaggaactcatctgtcgcaggttcatatcagcagccagggcct

SEQ ID NO: 446825 - DNA, 140 bp, Artificial Sequence
  Synthetic
atacgccatgctgggtctccgaactgatctcaggagtgatctcatacatcctcttgagactggacaatcacccatctttgtacataatgcttagagagccatctctgagaggagagatatcgtacttgggagtcggccat

SEQ ID NO: 446826 - DNA, 140 bp, Artificial Sequence
  Synthetic
atggccgactcccaagtacgatatctctcctctcagagatggctctctaagcattatgtacaaagatgggtgattgtccagtctcaagaggatgtatgagatcactcctgagatcagttcggagacccagcatggcgtat

SEQ ID NO: 446827 - DNA, 140 bp, Artificial Sequence
  Synthetic
atacgccatgctgggtctcctttctattccccaaaaagtccccgctgcttacccgaccacgatgaaggaaggtaatagatctgttctgtgctacctccagcacgtgttgcgctacgagcgcgtacttgggagtcggccat

SEQ ID NO: 446828 - DNA, 140 bp, Artificial Sequence
  Synthetic
atggccgactcccaagtacgcgctcgtagcgcaacacgtgctggaggtagcacagaacagatctattaccttccttcatcgtggtcgggtaagcagcggggactttttggggaatagaaaggagacccagcatggcgtat

SEQ ID NO: 446829 - DNA, 140 bp, Artificial Sequence
  Synthetic
atacgccatgctgggtctcctcaactgtagcagccctaagagcgagatgcagagagcccgctctctaaattaccaagatcttgtaagaggatttccagatgagatcatatccaatccttacgtacttgggagtcggccat

SEQ ID NO: 446830 - DNA, 140 bp, Artificial Sequence
  Synthetic
atggccgactcccaagtacgtaaggattggatatgatctcatctggaaatcctcttacaagatcttggtaatttagagagcgggctctctgcatctcgctcttagggctgctacagttgaggagacccagcatggcgtat

SEQ ID NO: 446831 - DNA, 140 bp, Artificial Sequence
  Synthetic
atacgccatgctgggtctccaactatgacaggggtttacagccccaccaagaagatgtcacgcaaagcagggtgttcagaatgggtctgctctgctcagcaggtggcagtttcaacttcacgtacttgggagtcggccat

SEQ ID NO: 446832 - DNA, 140 bp, Artificial Sequence
  Synthetic
atggccgactcccaagtacgtgaagttgaaactgccacctgctgagcagagcagacccattctgaacaccctgctttgcgtgacatcttcttggtggggctgtaaacccctgtcatagttggagacccagcatggcgtat

SEQ ID NO: 446833 - DNA, 140 bp, Artificial Sequence
  Synthetic
atacgccatgctgggtctccacacaaagaccccctagtgcttatcaagtatatcatggattactttcctgtgatatctgttgatttgcagagtggtcgtcgtgttgtgtcagtggagtaccgtacttgggagtcggccat

SEQ ID NO: 446834 - DNA, 140 bp, Artificial Sequence
  Synthetic
atggccgactcccaagtacggtactccactgacacaacacgacgaccactctgcaaatcaacagatatcacaggaaagtaatccatgatatacttgataagcactagggggtctttgtgtggagacccagcatggcgtat

SEQ ID NO: 446835 - DNA, 140 bp, Artificial Sequence
  Synthetic
atacgccatgctgggtctccgactttgcatcaaacgttgcacctccaccagcaaagccttttcagagacttattgatctaataggccatatgactctcagtgattttacaaagttccccacgtacttgggagtcggccat

SEQ ID NO: 446836 - DNA, 140 bp, Artificial Sequence
  Synthetic
atggccgactcccaagtacgtggggaactttgtaaaatcactgagagtcatatggcctattagatcaataagtctctgaaaaggctttgctggtggaggtgcaacgtttgatgcaaagtcggagacccagcatggcgtat

SEQ ID NO: 446837 - DNA, 140 bp, Artificial Sequence
  Synthetic
aggccctggctgctgatatgttgtgtctttctcatgcaccatcgtcctagtcacgaggttcgcttgcgattctctgatttctacaatgtcggagaattcccataccgagtcggacttggagaccttttgggacagcggtg

SEQ ID NO: 446838 - DNA, 140 bp, Artificial Sequence
  Synthetic
caccgctgtcccaaaaggtctccaagtccgactcggtatgggaattctccgacattgtagaaatcagagaatcgcaagcgaacctcgtgactaggacgatggtgcatgagaaagacacaacatatcagcagccagggcct

SEQ ID NO: 446839 - DNA, 140 bp, Artificial Sequence
  Synthetic
aggccctggctgctgatatgctaatgctgtagttccaaactcagcccttattgctcttatggaggagagcctgatgctgcgctcatcacttcctagcatgatggggagaaacaactggatgaccttttgggacagcggtg

SEQ ID NO: 446840 - DNA, 140 bp, Artificial Sequence
  Synthetic
caccgctgtcccaaaaggtcatccagttgtttctccccatcatgctaggaagtgatgagcgcagcatcaggctctcctccataagagcaataagggctgagtttggaactacagcattagcatatcagcagccagggcct

SEQ ID NO: 446841 - DNA, 140 bp, Artificial Sequence
  Synthetic
aggccctggctgctgatatggactttgcatcaaacgttgcacctccaccagcaaagccttttcagagacttattgatctaataggccatatgactcttagtgatttcacaaggttccccagaccttttgggacagcggtg

SEQ ID NO: 446842 - DNA, 140 bp, Artificial Sequence
  Synthetic
caccgctgtcccaaaaggtctggggaaccttgtgaaatcactaagagtcatatggcctattagatcaataagtctctgaaaaggctttgctggtggaggtgcaacgtttgatgcaaagtccatatcagcagccagggcct

SEQ ID NO: 446843 - DNA, 140 bp, Artificial Sequence
  Synthetic
aggccctggctgctgatatgatctaaaagaagccatatcctggcctcttggagaaccctcactggctttctttgacctaagctctactagagtgcacaggaatgacgacattaggagggagaccttttgggacagcggtg

SEQ ID NO: 446844 - DNA, 140 bp, Artificial Sequence
  Synthetic
caccgctgtcccaaaaggtctccctcctaatgtcgtcattcctgtgcactctagtagagcttaggtcaaagaaagccagtgagggttctccaagaggccaggatatggcttcttttagatcatatcagcagccagggcct

SEQ ID NO: 446845 - DNA, 140 bp, Artificial Sequence
  Synthetic
aggccctggctgctgatatgtcagattgctactctagcaatgaggagctgcaagattaccaatgatctagaggactcctttgttggcttacacaggatgatagtgaccgaggctatcctcgaccttttgggacagcggtg

SEQ ID NO: 446846 - DNA, 140 bp, Artificial Sequence
  Synthetic
caccgctgtcccaaaaggtcgaggatagcctcggtcactatcatcctgtgtaagccaacaaaggagtcctctagatcattggtaatcttgcagctcctcattgctagagtagcaatctgacatatcagcagccagggcct

SEQ ID NO: 446847 - DNA, 140 bp, Artificial Sequence
  Synthetic
aggccctggctgctgatatgtgctcacgtgcagtgtgttcggctcctgcaggcagcaaaagaggacatttctaatgctgtagttccaaattcagccctcattgctcttatggaggagagcgaccttttgggacagcggtg

SEQ ID NO: 446848 - DNA, 140 bp, Artificial Sequence
  Synthetic
caccgctgtcccaaaaggtcgctctcctccataagagcaatgagggctgaatttggaactacagcattagaaatgtcctcttttgctgcctgcaggagccgaacacactgcacgtgagcacatatcagcagccagggcct

SEQ ID NO: 446849 - DNA, 140 bp, Artificial Sequence
  Synthetic
aggccctggctgctgatatgctaatgctgtagttccaaattcagccctcattgctcttatggaggagagcctgatgctgcgctcatcacttcctagcatgatggggagaaacaactggatgaccttttgggacagcggtg

SEQ ID NO: 446850 - DNA, 140 bp, Artificial Sequence
  Synthetic
caccgctgtcccaaaaggtcatccagttgtttctccccatcatgctaggaagtgatgagcgcagcatcaggctctcctccataagagcaatgagggctgaatttggaactacagcattagcatatcagcagccagggcct

SEQ ID NO: 446851 - DNA, 140 bp, Artificial Sequence
  Synthetic
aggccctggctgctgatatgcccagttgttcctccaatcccagatgttgagatggaatcaggggaagagagtgatgatgatggatttgttgaggttgattagaggttaaggctgccccacgaccttttgggacagcggtg

SEQ ID NO: 446852 - DNA, 140 bp, Artificial Sequence
  Synthetic
caccgctgtcccaaaaggtcgtggggcagccttaacctctaatcaacctcaacaaatccatcatcatcactctcttcccctgattccatctcaacatctgggattggaggaacaactgggcatatcagcagccagggcct

SEQ ID NO: 446853 - DNA, 140 bp, Artificial Sequence
  Synthetic
aggccctggctgctgatatggtgatgatgatggatttgttgaggttgattagaggttaaggctgccccaccccccaccccccaatcccgaccgtaaccccaaccccattttcccaaccccgaccttttgggacagcggtg

SEQ ID NO: 446854 - DNA, 140 bp, Artificial Sequence
  Synthetic
caccgctgtcccaaaaggtcggggttgggaaaatggggttggggttacggtcgggattggggggtggggggtggggcagccttaacctctaatcaacctcaacaaatccatcatcatcaccatatcagcagccagggcct

SEQ ID NO: 446855 - DNA, 140 bp, Artificial Sequence
  Synthetic
atacgccatgctgggtctccttggtgactccaccaacccagagatgattgaaggagcttgggattcactcagagaggaggagatgccagaggagctctcctgctctgtatcaggcataagcgtacttgggagtcggccat

SEQ ID NO: 446856 - DNA, 140 bp, Artificial Sequence
  Synthetic
atggccgactcccaagtacgcttatgcctgatacagagcaggagagctcctctggcatctcctcctctctgagtgaatcccaagctccttcaatcatctctgggttggtggagtcaccaaggagacccagcatggcgtat

SEQ ID NO: 446857 - DNA, 140 bp, Artificial Sequence
  Synthetic
aggccctggctgctgatatgggggcacaactacattgacgggatgactcaggaggatgccacatgcaaacctgtgacatatgctggggcatgtagcagttttgatgtcttgcttgaaaaggaccttttgggacagcggtg

SEQ ID NO: 446858 - DNA, 140 bp, Artificial Sequence
  Synthetic
caccgctgtcccaaaaggtccttttcaagcaagacatcaaaactgctacatgccccagcatatgtcacaggtttgcatgtggcatcctcctgagtcatcccgtcaatgtagttgtgcccccatatcagcagccagggcct

SEQ ID NO: 446859 - DNA, 140 bp, Artificial Sequence
  Synthetic
atacgccatgctgggtctccgggaaatttccccttttccagtcatatgctcatcatagaactctactagaggcagttcacgacaccatcattgcaaaggctgatccacctagctgtgacccgtacttgggagtcggccat

SEQ ID NO: 446860 - DNA, 140 bp, Artificial Sequence
  Synthetic
atggccgactcccaagtacgggtcacagctaggtggatcagcctttgcaatgatggtgtcgtgaactgcctctagtagagttctatgatgagcatatgactggaaaaggggaaatttcccggagacccagcatggcgtat

SEQ ID NO: 446861 - DNA, 140 bp, Artificial Sequence
  Synthetic
atacgccatgctgggtctccatctcattgcggtccactgcttgagcagcaaactggatcgcaagctcttgatagttgtccattattgtaatagtgtttgtatctctagggagctttgtgtcgtacttgggagtcggccat

SEQ ID NO: 446862 - DNA, 140 bp, Artificial Sequence
  Synthetic
atggccgactcccaagtacgacacaaagctccctagagatacaaacactattacaataatggacaactatcaagagcttgcgatccagtttgctgctcaagcagtggaccgcaatgagatggagacccagcatggcgtat

SEQ ID NO: 446863 - DNA, 140 bp, Artificial Sequence
  Synthetic
atacgccatgctgggtctccacacaaagacggtgcattaaatgtatgttttattgacaattctaatctcggttctggtgtgtgaagcggttattagagtgtctctaagctccacaagagacgtacttgggagtcggccat

SEQ ID NO: 446864 - DNA, 140 bp, Artificial Sequence
  Synthetic
atggccgactcccaagtacgtctcttgtggagcttagagacactctaataaccgcttcacacaccagaaccgagattagaattgtcaataaaacatacatttaatgcaccgtctttgtgtggagacccagcatggcgtat

SEQ ID NO: 446865 - DNA, 140 bp, Artificial Sequence
  Synthetic
aggccctggctgctgatatgtcaggcataagggaggttaagacctcaagccaggagttatacagagcattaaaagccatcattgctgctgatggcttgaacaacatcacctgccatggtagaccttttgggacagcggtg

SEQ ID NO: 446866 - DNA, 140 bp, Artificial Sequence
  Synthetic
caccgctgtcccaaaaggtctaccatggcaggtgatgttgttcaagccatcagcagcaatgatggcttttaatgctctgtataactcctggcttgaggtcttaacctcccttatgcctgacatatcagcagccagggcct

SEQ ID NO: 446867 - DNA, 140 bp, Artificial Sequence
  Synthetic
aggccctggctgctgatatgtagctgtgacctccagagtgctcatgggaatccctgtatgaaagagaaacttgtgatgaagacacattgtcctaacgactaccagtcagctcattacctcgaccttttgggacagcggtg

SEQ ID NO: 446868 - DNA, 140 bp, Artificial Sequence
  Synthetic
caccgctgtcccaaaaggtcgaggtaatgagctgactggtagtcgttaggacaatgtgtcttcatcacaagtttctctttcatacagggattcccatgagcactctggaggtcacagctacatatcagcagccagggcct

SEQ ID NO: 446869 - DNA, 140 bp, Artificial Sequence
  Synthetic
atacgccatgctgggtctccagcactcaaaaagtgtgatggccaactcagcactgcacatgaggttgtgccctttgcagtgtttaagaactcaaagaaggtttatcttgataagcttgaccgtacttgggagtcggccat

SEQ ID NO: 446870 - DNA, 140 bp, Artificial Sequence
  Synthetic
atggccgactcccaagtacggtcaagcttatcaagataaaccttctttgagttcttaaacactgcaaagggcacaacctcatgtgcagtgctgagttggccatcacactttttgagtgctggagacccagcatggcgtat

SEQ ID NO: 446871 - DNA, 140 bp, Artificial Sequence
  Synthetic
aggccctggctgctgatatgcctttgcagtgtttaagaactcaaagaaggtttatcttgataagcttgacctcaagactgaggagaatctgctaccagactcatttgtctgcttcgagcagaccttttgggacagcggtg

SEQ ID NO: 446872 - DNA, 140 bp, Artificial Sequence
  Synthetic
caccgctgtcccaaaaggtctgctcgaagcagacaaatgagtctggtagcagattctcctcagtcttgaggtcaagcttatcaagataaaccttctttgagttcttaaacactgcaaaggcatatcagcagccagggcct

SEQ ID NO: 446873 - DNA, 140 bp, Artificial Sequence
  Synthetic
aggccctggctgctgatatgtgacagcagctgacggcttcccattggaatccacaagcccaaaagctttcaagaattctctcctcttctcatggcttataaagttgctattcactgctgcgaccttttgggacagcggtg

SEQ ID NO: 446874 - DNA, 140 bp, Artificial Sequence
  Synthetic
caccgctgtcccaaaaggtcgcagcagtgaatagcaactttataagccatgagaagaggagagaattcttgaaagcttttgggcttgtggattccaatgggaagccgtcagctgctgtcacatatcagcagccagggcct

SEQ ID NO: 446875 - DNA, 140 bp, Artificial Sequence
  Synthetic
atacgccatgctgggtctcctcagtatgccaatgcctattgttcacatgctaatgggtcagggattgtgcagattcaagtatcaggggtctggaagaaacctttatgtgtggggtatgagcgtacttgggagtcggccat

SEQ ID NO: 446876 - DNA, 140 bp, Artificial Sequence
  Synthetic
atggccgactcccaagtacgctcataccccacacataaaggtttcttccagacccctgatacttgaatctgcacaatccctgacccattagcatgtgaacaataggcattggcatactgaggagacccagcatggcgtat

SEQ ID NO: 446877 - DNA, 140 bp, Artificial Sequence
  Synthetic
aggccctggctgctgatatgagattcaagtatcaggggtctggaagaaacctttatgtgtggggtatgagagagtggttgtgaagagagaactctcagccaaacccatccagagagttgagaccttttgggacagcggtg

SEQ ID NO: 446878 - DNA, 140 bp, Artificial Sequence
  Synthetic
caccgctgtcccaaaaggtctcaactctctggatgggtttggctgagagttctctcttcacaaccactctctcataccccacacataaaggtttcttccagacccctgatacttgaatctcatatcagcagccagggcct

SEQ ID NO: 446879 - DNA, 140 bp, Artificial Sequence
  Synthetic
aggccctggctgctgatatgagagtggttgtgaagagagaactctcagccaaacccatccagagagttgagccttgcacaacttgcataaccaaatgtgagcctcatggattggttgtccgaccttttgggacagcggtg

SEQ ID NO: 446880 - DNA, 140 bp, Artificial Sequence
  Synthetic
caccgctgtcccaaaaggtcggacaaccaatccatgaggctcacatttggttatgcaagttgtgcaaggctcaactctctggatgggtttggctgagagttctctcttcacaaccactctcatatcagcagccagggcct

SEQ ID NO: 446881 - DNA, 140 bp, Artificial Sequence
  Synthetic
aggccctggctgctgatatgagggatatcccagtcctctgggggggacataggggttcacatggcacacgatgatcagtcagttagctccaaaatagtagctcactgccctccccaggacgaccttttgggacagcggtg

SEQ ID NO: 446882 - DNA, 140 bp, Artificial Sequence
  Synthetic
caccgctgtcccaaaaggtcgtcctggggagggcagtgagctactattttggagctaactgactgatcatcgtgtgccatgtgaacccctatgtcccccccagaggactgggatatccctcatatcagcagccagggcct

SEQ ID NO: 446883 - DNA, 140 bp, Artificial Sequence
  Synthetic
aggccctggctgctgatatgatgatcagtcagttagctccaaaatagtagctcactgccctccccaggacccgtgcttagtgcatggctgcatagtgtgtgctcatggcctgataaattagaccttttgggacagcggtg

SEQ ID NO: 446884 - DNA, 140 bp, Artificial Sequence
  Synthetic
caccgctgtcccaaaaggtctaatttatcaggccatgagcacacactatgcagccatgcactaagcacgggtcctggggagggcagtgagctactattttggagctaactgactgatcatcatatcagcagccagggcct

SEQ ID NO: 446885 - DNA, 140 bp, Artificial Sequence
  Synthetic
aggccctggctgctgatatgccgtgcttagtgcatggctgcatagtgtgtgctcatggcctgataaattaccagtgtcacactgctctcagtgcctttgttgttgtatttgtattcagttgaccttttgggacagcggtg

SEQ ID NO: 446886 - DNA, 140 bp, Artificial Sequence
  Synthetic
caccgctgtcccaaaaggtcaactgaatacaaatacaacaacaaaggcactgagagcagtgtgacactggtaatttatcaggccatgagcacacactatgcagccatgcactaagcacggcatatcagcagccagggcct

SEQ ID NO: 446887 - DNA, 140 bp, Artificial Sequence
  Synthetic
atacgccatgctgggtctccctattgcaataatttgcttagctattctttatagggtgctcaagtgcctaaagattgccccaaggaaagttctgaatccactaatgtggattacagccttcgtacttgggagtcggccat

SEQ ID NO: 446888 - DNA, 140 bp, Artificial Sequence
  Synthetic
atggccgactcccaagtacgaaggctgtaatccacattagtggattcagaactttccttggggcaatctttaggcacttgagcaccctataaagaatagctaagcaaattattgcaatagggagacccagcatggcgtat

SEQ ID NO: 446889 - DNA, 140 bp, Artificial Sequence
  Synthetic
aggccctggctgctgatatgccgccttcttgaatttgacaggttgctattcttgcaatgcaggggccagagtctgcctgtctatcacatccacaggaactggaactctctctgcccacaagaccttttgggacagcggtg

SEQ ID NO: 446890 - DNA, 140 bp, Artificial Sequence
  Synthetic
caccgctgtcccaaaaggtcttgtgggcagagagagttccagttcctgtggatgtgatagacaggcagactctggcccctgcattgcaagaatagcaacctgtcaaattcaagaaggcggcatatcagcagccagggcct

SEQ ID NO: 446891 - DNA, 140 bp, Artificial Sequence
  Synthetic
aggccctggctgctgatatgtcttaaagataaaaactgtctcaagtgagctatcgtgcagggagggccagagctattggactgggtcctttagccccaagtgcctgagctcaagaagatggaccttttgggacagcggtg

SEQ ID NO: 446892 - DNA, 140 bp, Artificial Sequence
  Synthetic
caccgctgtcccaaaaggtccatcttcttgagctcaggcacttggggctaaaggacccagtccaatagctctggccctccctgcacgatagctcacttgagacagtttttatctttaagacatatcagcagccagggcct

SEQ ID NO: 446893 - DNA, 140 bp, Artificial Sequence
  Synthetic
aggccctggctgctgatatggagaataagtgttttgagcagtgtggaggatgggggtgtggatgtttcaatgtgaacccttcttgcttatttgtgcacacgtatctgcagtcagttagaagaccttttgggacagcggtg

SEQ ID NO: 446894 - DNA, 140 bp, Artificial Sequence
  Synthetic
caccgctgtcccaaaaggtcttctaactgactgcagatacgtgtgcacaaataagcaagaagggttcacattgaaacatccacacccccatcctccacactgctcaaaacacttattctccatatcagcagccagggcct

SEQ ID NO: 446895 - DNA, 140 bp, Artificial Sequence
  Synthetic
atacgccatgctgggtctccaaagggtatgcaattgttgatgagccattctcagaaattcctcggcaagggttcttgggggagatcaggtgcaattcagagtcctcagtcctgagtgctccgtacttgggagtcggccat

SEQ ID NO: 446896 - DNA, 140 bp, Artificial Sequence
  Synthetic
atggccgactcccaagtacggagcactcaggactgaggactctgaattgcacctgatctcccccaagaacccttgccgaggaatttctgagaatggctcatcaacaattgcataccctttggagacccagcatggcgtat

SEQ ID NO: 446897 - DNA, 140 bp, Artificial Sequence
  Synthetic
aggccctggctgctgatatggttcttgggggagatcaggtgcaattcagagtcctcagtcctgagtgctcatgaatcatgccttagggcaccaaaccttatctcgtacaagcccatgatagaccttttgggacagcggtg

SEQ ID NO: 446898 - DNA, 140 bp, Artificial Sequence
  Synthetic
caccgctgtcccaaaaggtctatcatgggcttgtacgagataaggtttggtgccctaaggcatgattcatgagcactcaggactgaggactctgaattgcacctgatctcccccaagaaccatatcagcagccagggcct

SEQ ID NO: 446899 - DNA, 140 bp, Artificial Sequence
  Synthetic
atacgccatgctgggtctccatgaatcatgccttagggcaccaaaccttatctcgtacaagcccatgatagatcaattggagtgcactacaaatctgattgatccctttgttgtctttgacgtacttgggagtcggccat

SEQ ID NO: 446900 - DNA, 140 bp, Artificial Sequence
  Synthetic
atggccgactcccaagtacgtcaaagacaacaaagggatcaatcagatttgtagtgcactccaattgatctatcatgggcttgtacgagataaggtttggtgccctaaggcatgattcatggagacccagcatggcgtat

SEQ ID NO: 446901 - DNA, 140 bp, Artificial Sequence
  Synthetic
aggccctggctgctgatatgcagcagtctcaagtgctcgtgaatatactagttggcgtgattgtcttttgccagattagttgggaattaaactaactctttgaagttgcaccggtctttggaccttttgggacagcggtg

SEQ ID NO: 446902 - DNA, 140 bp, Artificial Sequence
  Synthetic
caccgctgtcccaaaaggtccaaagaccggtgcaacttcaaagagttagtttaattcccaactaatctggcaaaagacaatcacgccaactagtatattcacgagcacttgagactgctgcatatcagcagccagggcct

SEQ ID NO: 446903 - DNA, 140 bp, Artificial Sequence
  Synthetic
atacgccatgctgggtctccctgactctgatgtttgataattttgaggtggactttgtgggagcagccgtgtcttgtgatgccgccttcttgaatttgacaggttgctattcttgcaatgcgtacttgggagtcggccat

SEQ ID NO: 446904 - DNA, 140 bp, Artificial Sequence
  Synthetic
atggccgactcccaagtacgcattgcaagaatagcaacctgtcaaattcaagaaggcggcatcacaagacacggctgctcccacaaagtccacctcaaaattatcaaacatcagagtcagggagacccagcatggcgtat

SEQ ID NO: 446905 - DNA, 140 bp, Artificial Sequence
  Synthetic
aggccctggctgctgatatggtcttgtgatgccgccttcttgaatttgacaggttgctattcttgcaatgcaggggccagagtctgcctgtctatcacatccacaggaactgggactctcgaccttttgggacagcggtg

SEQ ID NO: 446906 - DNA, 140 bp, Artificial Sequence
  Synthetic
caccgctgtcccaaaaggtcgagagtcccagttcctgtggatgtgatagacaggcagactctggcccctgcattgcaagaatagcaacctgtcaaattcaagaaggcggcatcacaagaccatatcagcagccagggcct

SEQ ID NO: 446907 - DNA, 140 bp, Artificial Sequence
  Synthetic
atacgccatgctgggtctcctctgcccacaataaggacgggtctctgcatatagttctcccatcagagaatgggacaaaagatcagtgtcagatactacatttcactgtacctgaagtagcgtacttgggagtcggccat

SEQ ID NO: 446908 - DNA, 140 bp, Artificial Sequence
  Synthetic
atggccgactcccaagtacgctacttcaggtacagtgaaatgtagtatctgacactgatcttttgtcccattctctgatgggagaactatatgcagagacccgtccttattgtgggcagaggagacccagcatggcgtat

SEQ ID NO: 446909 - DNA, 140 bp, Artificial Sequence
  Synthetic
atacgccatgctgggtctccaagaggagtttatgtactcttgtgatggagatgagcggcctctgttagtgaaagggaccctgatagctattgacccatttgatgataggcgggaggcaggcgtacttgggagtcggccat

SEQ ID NO: 446910 - DNA, 140 bp, Artificial Sequence
  Synthetic
atggccgactcccaagtacgcctgcctcccgcctatcatcaaatgggtcaatagctatcagggtccctttcactaacagaggccgctcatctccatcacaagagtacataaactcctcttggagacccagcatggcgtat

SEQ ID NO: 446911 - DNA, 140 bp, Artificial Sequence
  Synthetic
aggccctggctgctgatatggagatatgtgaggggaagagacagataaaaggaattaacagaaccagactctcagagattgtgagaatttgttctgaatcttccctaagatcaaaagtcggaccttttgggacagcggtg

SEQ ID NO: 446912 - DNA, 140 bp, Artificial Sequence
  Synthetic
caccgctgtcccaaaaggtccgacttttgatcttagggaagattcagaacaaattctcacaatctctgagagtctggttctgttaattccttttatctgtctcttcccctcacatatctccatatcagcagccagggcct

SEQ ID NO: 446913 - DNA, 140 bp, Artificial Sequence
  Synthetic
atacgccatgctgggtctccctcctcatttgcctgtatgttgcattatcaattgggctcttcttcctccttatatatcttggaagaacaggcctctctaaaatgtggcttgctgctactacgtacttgggagtcggccat

SEQ ID NO: 446914 - DNA, 140 bp, Artificial Sequence
  Synthetic
atggccgactcccaagtacgtagtagcagcaagccacattttagagaggcctgttcttccaagatatataaggaggaagaagagcccaattgataatgcaacatacaggcaaatgaggagggagacccagcatggcgtat

SEQ ID NO: 446915 - DNA, 140 bp, Artificial Sequence
  Synthetic
aggccctggctgctgatatgctccctggctgtcctatcacgatgttgatggcaaagacctgtgccctcttcagggattagatataagaggggaccatcccatgtgcaacctgtggagggagaccttttgggacagcggtg

SEQ ID NO: 446916 - DNA, 140 bp, Artificial Sequence
  Synthetic
caccgctgtcccaaaaggtctccctccacaggttgcacatgggatggtcccctcttatatctaatccctgaagagggcacaggtctttgccatcaacatcgtgataggacagccagggagcatatcagcagccagggcct

SEQ ID NO: 446917 - DNA, 140 bp, Artificial Sequence
  Synthetic
atacgccatgctgggtctcccagcagcagaacttgagtttgccctttcgggagtaaaggacaggccagatgagagaaacagataccatagagtccatctaaatatgggctcagatgatagcgtacttgggagtcggccat

SEQ ID NO: 446918 - DNA, 140 bp, Artificial Sequence
  Synthetic
atggccgactcccaagtacgctatcatctgagcccatatttagatggactctatggtatctgtttctctcatctggcctgtcctttactcccgaaagggcaaactcaagttctgctgctgggagacccagcatggcgtat

SEQ ID NO: 446919 - DNA, 140 bp, Artificial Sequence
  Synthetic
atacgccatgctgggtctcctgtctacatagctgctttaggagttaatggaaagaagcacaaagcagacactttagtgcagcaaatgagagacaggagtaaacagcctttctccccagatcgtacttgggagtcggccat

SEQ ID NO: 446920 - DNA, 140 bp, Artificial Sequence
  Synthetic
atggccgactcccaagtacgatctggggagaaaggctgtttactcctgtctctcatttgctgcactaaagtgtctgctttgtgcttctttccattaactcctaaagcagctatgtagacaggagacccagcatggcgtat

SEQ ID NO: 446921 - DNA, 140 bp, Artificial Sequence
  Synthetic
atacgccatgctgggtctcctgggatttccaagcttagaaacttatgcaataatacattaggtgtaagcttagttgtaatttggggtggtggggtgaggcagcagcagtctcaagtgctccgtacttgggagtcggccat

SEQ ID NO: 446922 - DNA, 140 bp, Artificial Sequence
  Synthetic
atggccgactcccaagtacggagcacttgagactgctgctgcctcaccccaccaccccaaattacaactaagcttacacctaatgtattattgcataagtttctaagcttggaaatcccaggagacccagcatggcgtat

SEQ ID NO: 446923 - DNA, 140 bp, Artificial Sequence
  Synthetic
aggccctggctgctgatatgcagtctcaagtgctcgtgaatatactagttggcgtgattgtcttttgccagattagttgggaattaaactaactctttgaagttgcaccggtctttgtgtgaccttttgggacagcggtg

SEQ ID NO: 446924 - DNA, 140 bp, Artificial Sequence
  Synthetic
caccgctgtcccaaaaggtcacacaaagaccggtgcaacttcaaagagttagtttaattcccaactaatctggcaaaagacaatcacgccaactagtatattcacgagcacttgagactgcatatcagcagccagggcct

SEQ ID NO: 446925 - DNA, 140 bp, Artificial Sequence
  Synthetic
atacgccatgctgggtctccacacaaaggcgcccaatcatggattctatattatcaaaacagctggttgacaagactggttttgttagagtgccaatcaagcattatgactgtacaatgccgtacttgggagtcggccat

SEQ ID NO: 446926 - DNA, 140 bp, Artificial Sequence
  Synthetic
atggccgactcccaagtacggcattgtacagtcataatgcttgattggcactctaacaaaaccagtcttgtcaaccagctgttttgataatatagaatccatgattgggcgcctttgtgtggagacccagcatggcgtat

SEQ ID NO: 446927 - DNA, 140 bp, Artificial Sequence
  Synthetic
aggccctggctgctgatatgccactgcttgatatgcaaccactcatcagctgttgttacaatggttactttaaaaacaaagaagaagagactgagccttcatccctttctgggatgtatagaccttttgggacagcggtg

SEQ ID NO: 446928 - DNA, 140 bp, Artificial Sequence
  Synthetic
caccgctgtcccaaaaggtctatacatcccagaaagggatgaaggctcagtctcttcttctttgtttttaaagtaaccattgtaacaacagctgatgagtggttgcatatcaagcagtggcatatcagcagccagggcct

SEQ ID NO: 446929 - DNA, 140 bp, Artificial Sequence
  Synthetic
atacgccatgctgggtctcctaaaaacaaagaagaagagactgagccttcatccctttctgggatgtataagaaaattatagaacttgagcaccttagaccacagtcagatgatttcttacgtacttgggagtcggccat

SEQ ID NO: 446930 - DNA, 140 bp, Artificial Sequence
  Synthetic
atggccgactcccaagtacgtaagaaatcatctgactgtggtctaaggtgctcaagttctataattttcttatacatcccagaaagggatgaaggctcagtctcttcttctttgtttttaggagacccagcatggcgtat

SEQ ID NO: 446931 - DNA, 140 bp, Artificial Sequence
  Synthetic
aggccctggctgctgatatgaccatagacttcaatctggatgatatacaaggagcatctgaaataggttcaactttactaccctccatgtcgatagatgtggaagatatggccaattttggaccttttgggacagcggtg

SEQ ID NO: 446932 - DNA, 140 bp, Artificial Sequence
  Synthetic
caccgctgtcccaaaaggtccaaaattggccatatcttccacatctatcgacatggagggtagtaaagttgaacctatttcagatgctccttgtatatcatccagattgaagtctatggtcatatcagcagccagggcct

SEQ ID NO: 446933 - DNA, 140 bp, Artificial Sequence
  Synthetic
aggccctggctgctgatatgttcacgatttcacctttggccacttagctgacaagactgacagactgttaatgcgtgagtttcccatgatgaatgacgggtttgatcatttaagccctgagaccttttgggacagcggtg

SEQ ID NO: 446934 - DNA, 140 bp, Artificial Sequence
  Synthetic
caccgctgtcccaaaaggtctcagggcttaaatgatcaaacccgtcattcatcatgggaaactcacgcattaacagtctgtcagtcttgtcagctaagtggccaaaggtgaaatcgtgaacatatcagcagccagggcct

SEQ ID NO: 446935 - DNA, 140 bp, Artificial Sequence
  Synthetic
atacgccatgctgggtctccatgcgtgagtttcccatgatgaatgacgggtttgatcatttaagccctgacatgatcattaaaaccacatctggcatgtacaacatcgttgagttcaccacgtacttgggagtcggccat

SEQ ID NO: 446936 - DNA, 140 bp, Artificial Sequence
  Synthetic
atggccgactcccaagtacgtggtgaactcaacgatgttgtacatgccagatgtggttttaatgatcatgtcagggcttaaatgatcaaacccgtcattcatcatgggaaactcacgcatggagacccagcatggcgtat

SEQ ID NO: 446937 - DNA, 140 bp, Artificial Sequence
  Synthetic
atacgccatgctgggtctcccctttaggggagatgaaagaggtgcattccaggctgccatgactaaactcgctaagtatgaggttccttgtgagaacagatctcagggcaggactgttgtcgtacttgggagtcggccat

SEQ ID NO: 446938 - DNA, 140 bp, Artificial Sequence
  Synthetic
atggccgactcccaagtacgacaacagtcctgccctgagatctgttctcacaaggaacctcatacttagcgagtttagtcatggcagcctggaatgcacctctttcatctcccctaaaggggagacccagcatggcgtat

SEQ ID NO: 446939 - DNA, 140 bp, Artificial Sequence
  Synthetic
aggccctggctgctgatatggctaagtatgaggttccttgtgagaacagatctcagggcaggactgttgttctttatgttgttagcgcctatcggcatggtgtatggtctaatttggagcgaccttttgggacagcggtg

SEQ ID NO: 446940 - DNA, 140 bp, Artificial Sequence
  Synthetic
caccgctgtcccaaaaggtcgctccaaattagaccatacaccatgccgataggcgctaacaacataaagaacaacagtcctgccctgagatctgttctcacaaggaacctcatacttagccatatcagcagccagggcct

SEQ ID NO: 446941 - DNA, 140 bp, Artificial Sequence
  Synthetic
atacgccatgctgggtctcctagaggactctgaagcagaggagatggtttataggtacagacttgctcttagtgtgatggatgagctaaggaccttatttccagaactgtcttccacagacgtacttgggagtcggccat

SEQ ID NO: 446942 - DNA, 140 bp, Artificial Sequence
  Synthetic
atggccgactcccaagtacgtctgtggaagacagttctggaaataaggtccttagctcatccatcacactaagagcaagtctgtacctataaaccatctcctctgcttcagagtcctctaggagacccagcatggcgtat

SEQ ID NO: 446943 - DNA, 140 bp, Artificial Sequence
  Synthetic
atacgccatgctgggtctcctgaggaactagggaagactgagagagagttgctagccatggtctcctccatccaaataaattggtcagtcacagaatctgtgtttccaccctttagcagacgtacttgggagtcggccat

SEQ ID NO: 446944 - DNA, 140 bp, Artificial Sequence
  Synthetic
atggccgactcccaagtacgtctgctaaagggtggaaacacagattctgtgactgaccaatttatttggatggaggagaccatggctagcaactctctctcagtcttccctagttcctcaggagacccagcatggcgtat

SEQ ID NO: 446945 - DNA, 140 bp, Artificial Sequence
  Synthetic
atacgccatgctgggtctccgagatgtttgacaagtttagatcctcccctcccgattcagagtatatcacaaggatagtgagcagatgcctcataaattctcaagagaaactcatcaatacgtacttgggagtcggccat

SEQ ID NO: 446946 - DNA, 140 bp, Artificial Sequence
  Synthetic
atggccgactcccaagtacgtattgatgagtttctcttgagaatttatgaggcatctgctcactatccttgtgatatactctgaatcgggaggggaggatctaaacttgtcaaacatctcggagacccagcatggcgtat

SEQ ID NO: 446947 - DNA, 140 bp, Artificial Sequence
  Synthetic
aggccctggctgctgatatggctgaagagtgtaccttggcaatagagagagccttaaatcagtatagagcagaagacaaccttagggacctcaatgaccacaagtcaactattcagctgcgaccttttgggacagcggtg

SEQ ID NO: 446948 - DNA, 140 bp, Artificial Sequence
  Synthetic
caccgctgtcccaaaaggtcgcagctgaatagttgacttgtggtcattgaggtccctaaggttgtcttctgctctatactgatttaaggctctctctattgccaaggtacactcttcagccatatcagcagccagggcct

SEQ ID NO: 446949 - DNA, 140 bp, Artificial Sequence
  Synthetic
aggccctggctgctgatatgcctttgcagtgtttaagaactcaaagaaggtttatcttgataagcttgaccttaagactgaggagaatctgctaccagactcatttgtctgtttcgagcagaccttttgggacagcggtg

SEQ ID NO: 446950 - DNA, 140 bp, Artificial Sequence
  Synthetic
caccgctgtcccaaaaggtctgctcgaaacagacaaatgagtctggtagcagattctcctcagtcttaaggtcaagcttatcaagataaaccttctttgagttcttaaacactgcaaaggcatatcagcagccagggcct

SEQ ID NO: 446951 - DNA, 140 bp, Artificial Sequence
  Synthetic
aggccctggctgctgatatgcagggattagatataagaggggaccatcccatgtgcaacctgtggagggaagtggtcacctctgcaaatctagaggagattgagaggatgcacgatgatggaccttttgggacagcggtg

SEQ ID NO: 446952 - DNA, 140 bp, Artificial Sequence
  Synthetic
caccgctgtcccaaaaggtccatcatcgtgcatcctctcaatctcctctagatttgcagaggtgaccacttccctccacaggttgcacatgggatggtcccctcttatatctaatccctgcatatcagcagccagggcct

SEQ ID NO: 446953 - DNA, 140 bp, Artificial Sequence
  Synthetic
aggccctggctgctgatatgagtggtcacctctgcaaatctagaggagattgagaggatgcacgatgatgcagcagcagaacttgagtttgccctttcgggagtaaaggacaggccagatgaccttttgggacagcggtg

SEQ ID NO: 446954 - DNA, 140 bp, Artificial Sequence
  Synthetic
caccgctgtcccaaaaggtcatctggcctgtcctttactcccgaaagggcaaactcaagttctgctgctgcatcatcgtgcatcctctcaatctcctctagatttgcagaggtgaccactcatatcagcagccagggcct

SEQ ID NO: 446955 - DNA, 140 bp, Artificial Sequence
  Synthetic
atacgccatgctgggtctccggttatccgtgacaatttctcccggatgggccacctccgaggtgtagaagaccttgctggcttcactcgtagtgtgtcagctgaaattctcaagcactttcgtacttgggagtcggccat

SEQ ID NO: 446956 - DNA, 140 bp, Artificial Sequence
  Synthetic
atggccgactcccaagtacgaaagtgcttgagaatttcagctgacacactacgagtgaagccagcaaggtcttctacacctcggaggtggcccatccgggagaaattgtcacggataaccggagacccagcatggcgtat

SEQ ID NO: 446957 - DNA, 140 bp, Artificial Sequence
  Synthetic
atacgccatgctgggtctccatggtaagacaaaaaccaatttgattgggatccttcagagatttctagatggtgatcacgttgtccccataattgaagagatgggagccggaacagtgggcgtacttgggagtcggccat

SEQ ID NO: 446958 - DNA, 140 bp, Artificial Sequence
  Synthetic
atggccgactcccaagtacgcccactgttccggctcccatctcttcaattatggggacaacgtgatcaccatctagaaatctctgaaggatcccaatcaaattggtttttgtcttaccatggagacccagcatggcgtat

SEQ ID NO: 446959 - DNA, 140 bp, Artificial Sequence
  Synthetic
atacgccatgctgggtctccttcaatgaaatcataacagagcattacaaatttatgggaagtaggataggttcatggtgccaaatggtcagcttgataggagctgagctatcagcttctgcgtacttgggagtcggccat

SEQ ID NO: 446960 - DNA, 140 bp, Artificial Sequence
  Synthetic
atggccgactcccaagtacgcagaagctgatagctcagctcctatcaagctgaccatttggcaccatgaacctatcctacttcccataaatttgtaatgctctgttatgatttcattgaaggagacccagcatggcgtat

SEQ ID NO: 446961 - DNA, 140 bp, Artificial Sequence
  Synthetic
aggccctggctgctgatatgttaagcaacatgtcaagcctaactattttgtgattaaacgactactaggttctgggattttcttgctaatcaagcccacttccagcaaaagccacatattgaccttttgggacagcggtg

SEQ ID NO: 446962 - DNA, 140 bp, Artificial Sequence
  Synthetic
caccgctgtcccaaaaggtcaatatgtggcttttgctggaagtgggcttgattagcaagaaaatcccagaacctagtagtcgtttaatcacaaaatagttaggcttgacatgttgcttaacatatcagcagccagggcct

SEQ ID NO: 446963 - DNA, 140 bp, Artificial Sequence
  Synthetic
atacgccatgctgggtctcctttgtttcttataagctaagcaagcttactaacctctgcaagtgcgtttcattaatggagtcctccttctcattctgggcagaagcatttggaattccaacgtacttgggagtcggccat

SEQ ID NO: 446964 - DNA, 140 bp, Artificial Sequence
  Synthetic
atggccgactcccaagtacgttggaattccaaatgcttctgcccagaatgagaaggaggactccattaatgaaacgcacttgcagaggttagtaagcttgcttagcttataagaaacaaaggagacccagcatggcgtat

SEQ ID NO: 446965 - DNA, 140 bp, Artificial Sequence
  Synthetic
aggccctggctgctgatatggaccaataagcaaagtcaggcttagatttagggatactatgctagtattggaatccatgtgggttctgatactagcatagtgctacaatattgggcggtcgaccttttgggacagcggtg

SEQ ID NO: 446966 - DNA, 140 bp, Artificial Sequence
  Synthetic
caccgctgtcccaaaaggtcgaccgcccaatattgtagcactatgctagtatcagaacccacatggattccaatactagcatagtatccctaaatctaagcctgactttgcttattggtccatatcagcagccagggcct

SEQ ID NO: 446967 - DNA, 140 bp, Artificial Sequence
  Synthetic
aggccctggctgctgatatggatgcctcatacatgggcaaactttctttattaacccttttggaagacaaagcaacaactgaagagttacagactattgcaagatatataatcatggagggaccttttgggacagcggtg

SEQ ID NO: 446968 - DNA, 140 bp, Artificial Sequence
  Synthetic
caccgctgtcccaaaaggtccctccatgattatatatcttgcaatagtctgtaactcttcagttgttgctttgtcttccaaaagggttaataaagaaagtttgcccatgtatgaggcatccatatcagcagccagggcct

SEQ ID NO: 446969 - DNA, 140 bp, Artificial Sequence
  Synthetic
aggccctggctgctgatatgagaaaattatagaacttgagcaccttagaccacagtcagatgctttcttgggttataaagatccagaactgcctagaatgcatgagtttagtgtttcttagaccttttgggacagcggtg

SEQ ID NO: 446970 - DNA, 140 bp, Artificial Sequence
  Synthetic
caccgctgtcccaaaaggtctaagaaacactaaactcatgcattctaggcagttctggatctttataacccaagaaagcatctgactgtggtctaaggtgctcaagttctataattttctcatatcagcagccagggcct

SEQ ID NO: 446971 - DNA, 140 bp, Artificial Sequence
  Synthetic
aggccctggctgctgatatgggttataaagatccagaactgcctagaatgcatgagtttagtgtttcttacttgaaggaggcttgcaatcatgctaagctagtcttaaggagcctctatggaccttttgggacagcggtg

SEQ ID NO: 446972 - DNA, 140 bp, Artificial Sequence
  Synthetic
caccgctgtcccaaaaggtccatagaggctccttaagactagcttagcatgattgcaagcctccttcaagtaagaaacactaaactcatgcattctaggcagttctggatctttataacccatatcagcagccagggcct

SEQ ID NO: 446973 - DNA, 140 bp, Artificial Sequence
  Synthetic
atacgccatgctgggtctccctcatcccgggaaggattcccttcctttagcttatacttgttgatgagagcctccacagttgctttgccttctttcgacattttcatcatcatcctccggcgtacttgggagtcggccat

SEQ ID NO: 446974 - DNA, 140 bp, Artificial Sequence
  Synthetic
atggccgactcccaagtacgccggaggatgatgatgaaaatgtcgaaagaaggcaaagcaactgtggaggctctcatcaacaagtataagctaaaggaagggaatccttcccgggatgagggagacccagcatggcgtat

SEQ ID NO: 446975 - DNA, 140 bp, Artificial Sequence
  Synthetic
atacgccatgctgggtctccaccatagaataaggtatcctgggaggaccatcacctctaatatactccactgacacaacacgacgaccactctgcaaatcaacagatatcacaggaaagtcgtacttgggagtcggccat

SEQ ID NO: 446976 - DNA, 140 bp, Artificial Sequence
  Synthetic
atggccgactcccaagtacgactttcctgtgatatctgttgatttgcagagtggtcgtcgtgttgtgtcagtggagtatattagaggtgatggtcctcccaggataccttattctatggtggagacccagcatggcgtat

SEQ ID NO: 446977 - DNA, 140 bp, Artificial Sequence
  Synthetic
atacgccatgctgggtctccctcaagactgaggagaatctgctaccagactcatttgtctgcttcgagcataagggacagtataaaggaacaatggactctggtcagactaagagggagccgtacttgggagtcggccat

SEQ ID NO: 446978 - DNA, 140 bp, Artificial Sequence
  Synthetic
atggccgactcccaagtacggctccctcttagtctgaccagagtccattgttcctttatactgtcccttatgctcgaagcagacaaatgagtctggtagcagattctcctcagtcttgagggagacccagcatggcgtat

SEQ ID NO: 446979 - DNA, 140 bp, Artificial Sequence
  Synthetic
aggccctggctgctgatatgtaagggacagtataaaggaacaatggactctggtcagactaagagggagctcaaaagctttgatatctctcagtgccccaagattggaggacatggtagtgaccttttgggacagcggtg

SEQ ID NO: 446980 - DNA, 140 bp, Artificial Sequence
  Synthetic
caccgctgtcccaaaaggtcactaccatgtcctccaatcttggggcactgagagatatcaaagcttttgagctccctcttagtctgaccagagtccattgttcctttatactgtcccttacatatcagcagccagggcct

SEQ ID NO: 446981 - DNA, 140 bp, Artificial Sequence
  Synthetic
aggccctggctgctgatatgtctatgtgatgggtgcagaggagagaattgttcaatcggtggtggagacaatagccaggtccatagggaagttctttgcttctgataccctctgtaacccgaccttttgggacagcggtg

SEQ ID NO: 446982 - DNA, 140 bp, Artificial Sequence
  Synthetic
caccgctgtcccaaaaggtcgggttacagagggtatcagaagcaaagaacttccctatggacctggctattgtctccaccaccgattgaacaattctctcctctgcacccatcacatagacatatcagcagccagggcct

SEQ ID NO: 446983 - DNA, 140 bp, Artificial Sequence
  Synthetic
atacgccatgctgggtctccatagccaggtccatagggaagttctttgcttctgataccctctgtaacccccccaataaagtgaaaattcctgagacacatggcatcagggctcggaagccgtacttgggagtcggccat

SEQ ID NO: 446984 - DNA, 140 bp, Artificial Sequence
  Synthetic
atggccgactcccaagtacggcttccgagccctgatgccatgtgtctcaggaattttcactttattgggggggttacagagggtatcagaagcaaagaacttccctatggacctggctatggagacccagcatggcgtat

SEQ ID NO: 446985 - DNA, 140 bp, Artificial Sequence
  Synthetic
aggccctggctgctgatatgccccaataaagtgaaaattcctgagacacatggcatcagggctcggaagcaatgtaaggggcctgtgtggacttgtgcaacatcagatgatgcaaggaaggaccttttgggacagcggtg

SEQ ID NO: 446986 - DNA, 140 bp, Artificial Sequence
  Synthetic
caccgctgtcccaaaaggtccttccttgcatcatctgatgttgcacaagtccacacaggccccttacattgcttccgagccctgatgccatgtgtctcaggaattttcactttattggggcatatcagcagccagggcct

SEQ ID NO: 446987 - DNA, 140 bp, Artificial Sequence
  Synthetic
atacgccatgctgggtctccaatgtaaggggcctgtgtggacttgtgcaacatcagatgatgcaaggaagtggaaccaaggccattttgttacaaagtttgccctcatgctatgtgagttcgtacttgggagtcggccat

SEQ ID NO: 446988 - DNA, 140 bp, Artificial Sequence
  Synthetic
atggccgactcccaagtacgaactcacatagcatgagggcaaactttgtaacaaaatggccttggttccacttccttgcatcatctgatgttgcacaagtccacacaggccccttacattggagacccagcatggcgtat

SEQ ID NO: 446989 - DNA, 140 bp, Artificial Sequence
  Synthetic
atacgccatgctgggtctcccacctctcctaaatggtggccactgatcattaggggatgttcaatgtttaccaggaagaggatgatgatgaatttgaattatcttaagatcctggatggtcgtacttgggagtcggccat

SEQ ID NO: 446990 - DNA, 140 bp, Artificial Sequence
  Synthetic
atggccgactcccaagtacgaccatccaggatcttaagataattcaaattcatcatcatcctcttcctggtaaacattgaacatcccctaatgatcagtggccaccatttaggagaggtgggagacccagcatggcgtat

SEQ ID NO: 446991 - DNA, 140 bp, Artificial Sequence
  Synthetic
aggccctggctgctgatatgtggaaaccacaacagggatgatgcagggaatattgcattacacttcctcactattacacaccattcatcaagaatatatccggtccttgtcctttaaaatgaccttttgggacagcggtg

SEQ ID NO: 446992 - DNA, 140 bp, Artificial Sequence
  Synthetic
caccgctgtcccaaaaggtcattttaaaggacaaggaccggatatattcttgatgaatggtgtgtaatagtgaggaagtgtaatgcaatattccctgcatcatccctgttgtggtttccacatatcagcagccagggcct

SEQ ID NO: 446993 - DNA, 140 bp, Artificial Sequence
  Synthetic
aggccctggctgctgatatgtaatgacttcagtcactgaggggggtgggtcattctccttagctgcaatgattcagcaagctcagtgcactctccattacatgctgatgggcatgggagtgaccttttgggacagcggtg

SEQ ID NO: 446994 - DNA, 140 bp, Artificial Sequence
  Synthetic
caccgctgtcccaaaaggtcactcccatgcccatcagcatgtaatggagagtgcactgagcttgctgaatcattgcagctaaggagaatgacccacccccctcagtgactgaagtcattacatatcagcagccagggcct

SEQ ID NO: 446995 - DNA, 140 bp, Artificial Sequence
  Synthetic
aggccctggctgctgatatgaagaagtgcactggggacgcagcattttgctctgcttatgaatgcactgctcagtatgccaatgcctattgttcacatgctaatgggtcagggattgtgcgaccttttgggacagcggtg

SEQ ID NO: 446996 - DNA, 140 bp, Artificial Sequence
  Synthetic
caccgctgtcccaaaaggtcgcacaatccctgacccattagcatgtgaacaataggcattggcatactgagcagtgcattcataagcagagcaaaatgctgcgtccccagtgcacttcttcatatcagcagccagggcct

SEQ ID NO: 446997 - DNA, 140 bp, Artificial Sequence
  Synthetic
aggccctggctgctgatatgatattgttgcgcattgcagagaaagtccatagcccaggtgttgtgtcatcattgtcttctggcaatgcagtctgtaaagtcatggcctcagctgtatactgaccttttgggacagcggtg

SEQ ID NO: 446998 - DNA, 140 bp, Artificial Sequence
  Synthetic
caccgctgtcccaaaaggtcagtatacagctgaggccatgactttacagactgcattgccagaagacaatgatgacacaacacctgggctatggactttctctgcaatgcgcaacaatatcatatcagcagccagggcct

SEQ ID NO: 446999 - DNA, 140 bp, Artificial Sequence
  Synthetic
aggccctggctgctgatatgattgtcttctggcaatgcagtctgtaaagtcatggcctcagctgtatacttcttatcagcaacaatttttgaggacactggacgtcctgagttcaacttcgaccttttgggacagcggtg

SEQ ID NO: 447000 - DNA, 140 bp, Artificial Sequence
  Synthetic
caccgctgtcccaaaaggtcgaagttgaactcaggacgtccagtgtcctcaaaaattgttgctgataagaagtatacagctgaggccatgactttacagactgcattgccagaagacaatcatatcagcagccagggcct

SEQ ID NO: 447001 - DNA, 140 bp, Artificial Sequence
  Synthetic
aggccctggctgctgatatgtcttatcagcaacaatttttgaggacactggacgtcctgagttcaacttcttggaggattctaagtacagcttgctacaaaagatggctgcatattctgggaccttttgggacagcggtg

SEQ ID NO: 447002 - DNA, 140 bp, Artificial Sequence
  Synthetic
caccgctgtcccaaaaggtcccagaatatgcagccatcttttgtagcaagctgtacttagaatcctccaagaagttgaactcaggacgtccagtgtcctcaaaaattgttgctgataagacatatcagcagccagggcct

SEQ ID NO: 447003 - DNA, 140 bp, Artificial Sequence
  Synthetic
atacgccatgctgggtctccatcaagtgaacagagaaataggatggatggaaggaggtcagttggttctagggaaccctgcccctattcctcgtcatgccccaatcccacgttatagcaccgtacttgggagtcggccat

SEQ ID NO: 447004 - DNA, 140 bp, Artificial Sequence
  Synthetic
atggccgactcccaagtacggtgctataacgtgggattggggcatgacgaggaataggggcagggttccctagaaccaactgacctccttccatccatcctatttctctgttcacttgatggagacccagcatggcgtat

SEQ ID NO: 447005 - DNA, 140 bp, Artificial Sequence
  Synthetic
aggccctggctgctgatatgctttcatggtttcaatgatatggagccggaagatatattattcctatttccgaatattgaggaattagaatcactggattctatagtttacaacaagggagaccttttgggacagcggtg

SEQ ID NO: 447006 - DNA, 140 bp, Artificial Sequence
  Synthetic
caccgctgtcccaaaaggtctcccttgttgtaaactatagaatccagtgattctaattcctcaatattcggaaataggaataatatatcttccggctccatatcattgaaaccatgaaagcatatcagcagccagggcct

SEQ ID NO: 447007 - DNA, 140 bp, Artificial Sequence
  Synthetic
atacgccatgctgggtctccgaaatagacatcatcccaagagtcaacatcagggatgcaacccaaaccagggtcaccatctttaatgagcagaagaccctccgaacatctccagagaagtcgtacttgggagtcggccat

SEQ ID NO: 447008 - DNA, 140 bp, Artificial Sequence
  Synthetic
atggccgactcccaagtacgacttctctggagatgttcggagggtcttctgctcattaaagatggtgaccctggtttgggttgcatccctgatgttgactcttgggatgatgtctatttcggagacccagcatggcgtat

SEQ ID NO: 447009 - DNA, 140 bp, Artificial Sequence
  Synthetic
aggccctggctgctgatatgaccttcctggctgaatgggaaaagctaaagaaaattgtgaagtggttagaagatactccagaagcaactcttgctcacaccccactgaataaccacattcgaccttttgggacagcggtg

SEQ ID NO: 447010 - DNA, 140 bp, Artificial Sequence
  Synthetic
caccgctgtcccaaaaggtcgaatgtggttattcagtggggtgtgagcaagagttgcttctggagtatcttctaaccacttcacaattttctttagcttttcccattcagccaggaaggtcatatcagcagccagggcct

SEQ ID NO: 447011 - DNA, 140 bp, Artificial Sequence
  Synthetic
aggccctggctgctgatatgaagttaggaatttctttgctagaatggaaagcaagcctagaacagtcagaataacaggagcccctgtaaagaagaggtcaggggtcagtaagatagccatgaccttttgggacagcggtg

SEQ ID NO: 447012 - DNA, 140 bp, Artificial Sequence
  Synthetic
caccgctgtcccaaaaggtcatggctatcttactgacccctgacctcttctttacaggggctcctgttattctgactgttctaggcttgctttccattctagcaaagaaattcctaacttcatatcagcagccagggcct

SEQ ID NO: 447013 - DNA, 140 bp, Artificial Sequence
  Synthetic
aggccctggctgctgatatgctgttctgtatactacagggtccatacagtgagagctataagctacagctaatctacagagtcctaagctcagtgtcaaacgttgagataaaggaatcaggaccttttgggacagcggtg

SEQ ID NO: 447014 - DNA, 140 bp, Artificial Sequence
  Synthetic
caccgctgtcccaaaaggtcctgattcctttatctcaacgtttgacactgagcttaggactctgtagattagctgtagcttatagctctcactgtatggaccctgtagtatacagaacagcatatcagcagccagggcct

SEQ ID NO: 447015 - DNA, 140 bp, Artificial Sequence
  Synthetic
atacgccatgctgggtctccagagggattgacctgtgcctgttgccaggctttgacctaatgtatgaggttgctcacgttcagtgtgttcggctcctgcgggcagcaaaagaggacatttcgtacttgggagtcggccat

SEQ ID NO: 447016 - DNA, 140 bp, Artificial Sequence
  Synthetic
atggccgactcccaagtacgaaatgtcctcttttgctgcccgcaggagccgaacacactgaacgtgagcaacctcatacattaggtcaaagcctggcaacaggcacaggtcaatccctctggagacccagcatggcgtat

SEQ ID NO: 447017 - DNA, 140 bp, Artificial Sequence
  Synthetic
aggccctggctgctgatatggccaagtatgaggttccttgtgagaacagatctcagggcaggactgttgttctttatgttgttagcgcctaccggcatggtgtttggtctaacttggaacgaccttttgggacagcggtg

SEQ ID NO: 447018 - DNA, 140 bp, Artificial Sequence
  Synthetic
caccgctgtcccaaaaggtcgttccaagttagaccaaacaccatgccggtaggcgctaacaacataaagaacaacagtcctgccctgagatctgttctcacaaggaacctcatacttggccatatcagcagccagggcct

SEQ ID NO: 447019 - DNA, 140 bp, Artificial Sequence
  Synthetic
atacgccatgctgggtctccgggcagaagacatgggggtcacaaacaaccaggattattcttctaaatctagcagaggagccagatattggatgcattcatttaggatgcaaggacctagcgtacttgggagtcggccat

SEQ ID NO: 447020 - DNA, 140 bp, Artificial Sequence
  Synthetic
atggccgactcccaagtacgctaggtccttgcatcctaaatgaatgcatccaatatctggctcctctgctagatttagaagaataatcctggttgtttgtgacccccatgtcttctgcccggagacccagcatggcgtat

SEQ ID NO: 447021 - DNA, 140 bp, Artificial Sequence
  Synthetic
atacgccatgctgggtctcccaaaccatttggatgcccagtttatattattaagggtgatatgtcagatgtcatcagactgagaaaggaagaggtggagatgaaagtacggggctccactcgtacttgggagtcggccat

SEQ ID NO: 447022 - DNA, 140 bp, Artificial Sequence
  Synthetic
atggccgactcccaagtacgagtggagccccgtactttcatctccacctcttcctttctcagtctgatgacatctgacatatcacccttaataatataaactgggcatccaaatggtttgggagacccagcatggcgtat

SEQ ID NO: 447023 - DNA, 140 bp, Artificial Sequence
  Synthetic
aggccctggctgctgatatgctcaacttgtacaccaagcaccattctcatcaggacctacacattttatcttacactgcatcagacaatgatctcagtccaggcattttcaagtcaatatgaccttttgggacagcggtg

SEQ ID NO: 447024 - DNA, 140 bp, Artificial Sequence
  Synthetic
caccgctgtcccaaaaggtcatattgacttgaaaatgcctggactgagatcattgtctgatgcagtgtaagataaaatgtgtaggtcctgatgagaatggtgcttggtgtacaagttgagcatatcagcagccagggcct

SEQ ID NO: 447025 - DNA, 140 bp, Artificial Sequence
  Synthetic
aggccctggctgctgatatgttacactgcatcagacaatgatctcagtccaggcattttcaagtcaatatcagatgagggggtagctcaagccctgcaattatttgagagggagccaagcgaccttttgggacagcggtg

SEQ ID NO: 447026 - DNA, 140 bp, Artificial Sequence
  Synthetic
caccgctgtcccaaaaggtcgcttggctccctctcaaataattgcagggcttgagctaccccctcatctgatattgacttgaaaatgcctggactgagatcattgtctgatgcagtgtaacatatcagcagccagggcct

SEQ ID NO: 447027 - DNA, 140 bp, Artificial Sequence
  Synthetic
atacgccatgctgggtctccccttgagatatgtgaggggaagagacagataaaaggaattaacagaaccagactctcagagattgtgagaatttgttctgaatcttccctaagatcaaaacgtacttgggagtcggccat

SEQ ID NO: 447028 - DNA, 140 bp, Artificial Sequence
  Synthetic
atggccgactcccaagtacgttttgatcttagggaagattcagaacaaattctcacaatctctgagagtctggttctgttaattccttttatctgtctcttcccctcacatatctcaaggggagacccagcatggcgtat

SEQ ID NO: 447029 - DNA, 140 bp, Artificial Sequence
  Synthetic
aggccctggctgctgatatgacaagtacaagctaaaggaggggaatccttcccgggatgagttgactctatcacgagttgctgccgccctggctggctggacatgccaggctttggtcgtgaccttttgggacagcggtg

SEQ ID NO: 447030 - DNA, 140 bp, Artificial Sequence
  Synthetic
caccgctgtcccaaaaggtcacgaccaaagcctggcatgtccagccagccagggcggcagcaactcgtgatagagtcaactcatcccgggaaggattcccctcctttagcttgtacttgtcatatcagcagccagggcct

SEQ ID NO: 447031 - DNA, 140 bp, Artificial Sequence
  Synthetic
atacgccatgctgggtctcctgattcaggcaagctccagaatcaccacttgctctacagagggtgtcaacaccaagtgtagactgtctggcacagcattgatcagggcagggtcagttggcgtacttgggagtcggccat

SEQ ID NO: 447032 - DNA, 140 bp, Artificial Sequence
  Synthetic
atggccgactcccaagtacgccaactgaccctgccctgatcaatgctgtgccagacagtctacacttggtgttgacaccctctgtagagcaagtggtgattctggagcttgcctgaatcaggagacccagcatggcgtat

SEQ ID NO: 447033 - DNA, 140 bp, Artificial Sequence
  Synthetic
aggccctggctgctgatatgtctcttcagaactctacagagaccagaagaaagcattaggatagatgatctggagttatatgaggagacagatgtggcggatgacatgctaggctaagacgaccttttgggacagcggtg

SEQ ID NO: 447034 - DNA, 140 bp, Artificial Sequence
  Synthetic
caccgctgtcccaaaaggtcgtcttagcctagcatgtcatccgccacatctgtctcctcatataactccagatcatctatcctaatgctttcttctggtctctgtagagttctgaagagacatatcagcagccagggcct

SEQ ID NO: 447035 - DNA, 140 bp, Artificial Sequence
  Synthetic
atacgccatgctgggtctcctggagttatatgaggagacagatgtggcggatgacatgctaggctaagaccaataagcaaagtcaggcttagatttagggatactatgctagtattggaacgtacttgggagtcggccat

SEQ ID NO: 447036 - DNA, 140 bp, Artificial Sequence
  Synthetic
atggccgactcccaagtacgttccaatactagcatagtatccctaaatctaagcctgactttgcttattggtcttagcctagcatgtcatccgccacatctgtctcctcatataactccaggagacccagcatggcgtat

SEQ ID NO: 447037 - DNA, 140 bp, Artificial Sequence
  Synthetic
aggccctggctgctgatatgaagcaaagtcaggcttagatttagggatactatgctagtattggaatccatgtgggttctgatactagcatagtgctacaatattgggcggtctttgtgtgaccttttgggacagcggtg

SEQ ID NO: 447038 - DNA, 140 bp, Artificial Sequence
  Synthetic
caccgctgtcccaaaaggtcacacaaagaccgcccaatattgtagcactatgctagtatcagaacccacatggattccaatactagcatagtatccctaaatctaagcctgactttgcttcatatcagcagccagggcct

SEQ ID NO: 447039 - DNA, 140 bp, Artificial Sequence
  Synthetic
aggccctggctgctgatatggcagtctcaagtgctcgtgaatatactagttggcgtgattgtcttttgccagattagttgggaattaaactaactctttgaagttgcaccggtctttgtggaccttttgggacagcggtg

SEQ ID NO: 447040 - DNA, 140 bp, Artificial Sequence
  Synthetic
caccgctgtcccaaaaggtccacaaagaccggtgcaacttcaaagagttagtttaattcccaactaatctggcaaaagacaatcacgccaactagtatattcacgagcacttgagactgccatatcagcagccagggcct

SEQ ID NO: 447041 - DNA, 140 bp, Artificial Sequence
  Synthetic
aggccctggctgctgatatgaaaggcgcccaatcatggattctatattatcaaaacagctggttgacaagactggttttgttagagtgccaatcaagcattatgactgtacaatgctaacgaccttttgggacagcggtg

SEQ ID NO: 447042 - DNA, 140 bp, Artificial Sequence
  Synthetic
caccgctgtcccaaaaggtcgttagcattgtacagtcataatgcttgattggcactctaacaaaaccagtcttgtcaaccagctgttttgataatatagaatccatgattgggcgcctttcatatcagcagccagggcct

SEQ ID NO: 447043 - DNA, 140 bp, Artificial Sequence
  Synthetic
aggccctggctgctgatatgctaatgctgtagttccaaactcagccctcattgctcttatggaggagagcctgatgctgcgctcatcacttcctagcatgatggggagaaacaactggatgaccttttgggacagcggtg

SEQ ID NO: 447044 - DNA, 140 bp, Artificial Sequence
  Synthetic
caccgctgtcccaaaaggtcatccagttgtttctccccatcatgctaggaagtgatgagcgcagcatcaggctctcctccataagagcaatgagggctgagtttggaactacagcattagcatatcagcagccagggcct

SEQ ID NO: 447045 - DNA, 140 bp, Artificial Sequence
  Synthetic
aggccctggctgctgatatgcccccaccccccaatcccgaccgtaaccccaacccccatcttccccaacccccctgggcagccacttaggctgctgtcttgtaggcctgagcagctgccagaccttttgggacagcggtg

SEQ ID NO: 447046 - DNA, 140 bp, Artificial Sequence
  Synthetic
caccgctgtcccaaaaggtctggcagctgctcaggcctacaagacagcagcctaagtggctgcccaggggggttggggaagatgggggttggggttacggtcgggattggggggtgggggcatatcagcagccagggcct

SEQ ID NO: 447047 - DNA, 140 bp, Artificial Sequence
  Synthetic
aggccctggctgctgatatgggaggtttgggttgatgacccgggagaactgcagcagatacagagagtgagcatctaatattgcccttagatagtcttctggtagagaagggtccaccatgaccttttgggacagcggtg

SEQ ID NO: 447048 - DNA, 140 bp, Artificial Sequence
  Synthetic
caccgctgtcccaaaaggtcatggtggacccttctctaccagaagactatctaagggcaatattagatgctcactctctgtatctgctgcagttctcccgggtcatcaacccaaacctcccatatcagcagccagggcct

SEQ ID NO: 447049 - DNA, 140 bp, Artificial Sequence
  Synthetic
aggccctggctgctgatatggccagcaaagctgggatgcatcatatgcctcgggtatgcaggggatagaccgtccatggttgtcccagtgacaggaagccactcactcaagacgaccaaagaccttttgggacagcggtg

SEQ ID NO: 447050 - DNA, 140 bp, Artificial Sequence
  Synthetic
caccgctgtcccaaaaggtctttggtcgtcttgagtgagtggcttcctgtcactgggacaaccatggacggtctatcccctgcatacccgaggcatatgatgcatcccagctttgctggccatatcagcagccagggcct

SEQ ID NO: 447051 - DNA, 140 bp, Artificial Sequence
  Synthetic
aggccctggctgctgatatgatagtgagcagatgcctcataaattctcaagagaaactcatcaataattctttctttgctgaagggaatgacaaagttctgagattttcaaaaaacgctggaccttttgggacagcggtg

SEQ ID NO: 447052 - DNA, 140 bp, Artificial Sequence
  Synthetic
caccgctgtcccaaaaggtccagcgttttttgaaaatctcagaactttgtcattcccttcagcaaagaaagaattattgatgagtttctcttgagaatttatgaggcatctgctcactatcatatcagcagccagggcct

SEQ ID NO: 447053 - DNA, 140 bp, Artificial Sequence
  Synthetic
aggccctggctgctgatatgaagagtgttccttggcaatagagagagccttaaatcagtatagagcagaagacaaccttagggacctcaatgaccacaagtcaactattcagctgcctccgaccttttgggacagcggtg

SEQ ID NO: 447054 - DNA, 140 bp, Artificial Sequence
  Synthetic
caccgctgtcccaaaaggtcggaggcagctgaatagttgacttgtggtcattgaggtccctaaggttgtcttctgctctatactgatttaaggctctctctattgccaaggaacactcttcatatcagcagccagggcct

SEQ ID NO: 447055 - DNA, 140 bp, Artificial Sequence
  Synthetic
aggccctggctgctgatatgctcccagtcagccccaccatactgctttaagagttcgataaccctacgagcatcaaacccttgataagcaaactctcggacccactgttcaatctcattggaccttttgggacagcggtg

SEQ ID NO: 447056 - DNA, 140 bp, Artificial Sequence
  Synthetic
caccgctgtcccaaaaggtccaatgagattgaacagtgggtccgagagtttgcttatcaagggtttgatgctcgtagggttatcgaactcttaaagcagtatggtggggctgactgggagcatatcagcagccagggcct

SEQ ID NO: 447057 - DNA, 140 bp, Artificial Sequence
  Synthetic
aggccctggctgctgatatgagaatcctgaggacaagatttctctcataaagggtcctcctcacaaaaagcgggtggggatagtccggtgtgagagacgaagagatgctaagcaaatagggaccttttgggacagcggtg

SEQ ID NO: 447058 - DNA, 140 bp, Artificial Sequence
  Synthetic
caccgctgtcccaaaaggtccctatttgcttagcatctcttcgtctctcacaccggactatccccacccgctttttgtgaggaggaccctttatgagagaaatcttgtcctcaggattctcatatcagcagccagggcct

SEQ ID NO: 447059 - DNA, 140 bp, Artificial Sequence
  Synthetic
atacgccatgctgggtctcccgggtggggatagtccggtgtgagagacgaagagatgctaagcaaatagggagagaaaccatggcagggattgcgatgacagtccttccagccttagcagcgtacttgggagtcggccat

SEQ ID NO: 447060 - DNA, 140 bp, Artificial Sequence
  Synthetic
atggccgactcccaagtacgctgctaaggctggaaggactgtcatcgcaatccctgccatggtttctctccctatttgcttagcatctcttcgtctctcacaccggactatccccacccgggagacccagcatggcgtat

SEQ ID NO: 447061 - DNA, 140 bp, Artificial Sequence
  Synthetic
atacgccatgctgggtctcctttttgctttggcacctgttgtttttgctgaagacccccatctcagaaacagaccagggaaggggcacaactacattgacgggatgactcaggaggatgccgtacttgggagtcggccat

SEQ ID NO: 447062 - DNA, 140 bp, Artificial Sequence
  Synthetic
atggccgactcccaagtacggcatcctcctgagtcatcccgtcaatgtagttgtgccccttccctggtctgtttctgagatgggggtcttcagcaaaaacaacaggtgccaaagcaaaaaggagacccagcatggcgtat

SEQ ID NO: 447063 - DNA, 140 bp, Artificial Sequence
  Synthetic
aggccctggctgctgatatgagaccagggaaggggcacaactacattgacgggatgactcaggaggatgccacatgcaaacctgtgacatatgctggggcatgtagcagttttgatgtctgaccttttgggacagcggtg

SEQ ID NO: 447064 - DNA, 140 bp, Artificial Sequence
  Synthetic
caccgctgtcccaaaaggtcagacatcaaaactgctacatgccccagcatatgtcacaggtttgcatgtggcatcctcctgagtcatcccgtcaatgtagttgtgccccttccctggtctcatatcagcagccagggcct

SEQ ID NO: 447065 - DNA, 140 bp, Artificial Sequence
  Synthetic
aggccctggctgctgatatggcaacagatgaggacctatacaaccctctctcttgtgataaagagcttagattggcagcccagaggattcatcagccatccttgtcagaaaggggcttcagaccttttgggacagcggtg

SEQ ID NO: 447066 - DNA, 140 bp, Artificial Sequence
  Synthetic
caccgctgtcccaaaaggtctgaagcccctttctgacaaggatggctgatgaatcctctgggctgccaatctaagctctttatcacaagagagagggttgtataggtcctcatctgttgccatatcagcagccagggcct

SEQ ID NO: 447067 - DNA, 140 bp, Artificial Sequence
  Synthetic
atacgccatgctgggtctcccccccacccccaatcccgactgtaaccccaaccaccccctttcccccaaacccctgggcagccacttaggctgctgtcttgtatgcctgagcagctgccacgtacttgggagtcggccat

SEQ ID NO: 447068 - DNA, 140 bp, Artificial Sequence
  Synthetic
atggccgactcccaagtacgtggcagctgctcaggcatacaagacagcagcctaagtggctgcccaggggtttgggggaaagggggtggttggggttacagtcgggattgggggtgggggggagacccagcatggcgtat

SEQ ID NO: 447069 - DNA, 140 bp, Artificial Sequence
  Synthetic
atacgccatgctgggtctcctcaaaagctttgatatctctcagtgccccaagattggagggcatggtagtaagaagtgcactggggacgcagcattttgctctgcttatgaatgcactgccgtacttgggagtcggccat

SEQ ID NO: 447070 - DNA, 140 bp, Artificial Sequence
  Synthetic
atggccgactcccaagtacggcagtgcattcataagcagagcaaaatgctgcgtccccagtgcacttcttactaccatgccctccaatcttggggcactgagagatatcaaagcttttgaggagacccagcatggcgtat

SEQ ID NO: 447071 - DNA, 140 bp, Artificial Sequence
  Synthetic
aggccctggctgctgatatgatggagtcctccttctcattctgggcagaagcatttggaattccaagctggaactttgttggtgacttgttcaggtcctcagactctgcagcaatggatggaccttttgggacagcggtg

SEQ ID NO: 447072 - DNA, 140 bp, Artificial Sequence
  Synthetic
caccgctgtcccaaaaggtccatccattgctgcagagtctgaggacctgaacaagtcaccaacaaagttccagcttggaattccaaatgcttctgcccagaatgagaaggaggactccatcatatcagcagccagggcct

SEQ ID NO: 447073 - DNA, 140 bp, Artificial Sequence
  Synthetic
atacgccatgctgggtctccccagtgtcacactgctctcagtgcctttgttgtcatatttgtattcagttctactgcaataatttgcttagctgttctttatagggtgctcaagtgcttacgtacttgggagtcggccat

SEQ ID NO: 447074 - DNA, 140 bp, Artificial Sequence
  Synthetic
atggccgactcccaagtacgtaagcacttgagcaccctataaagaacagctaagcaaattattgcagtagaactgaatacaaatatgacaacaaaggcactgagagcagtgtgacactggggagacccagcatggcgtat

SEQ ID NO: 447075 - DNA, 140 bp, Artificial Sequence
  Synthetic
aggccctggctgctgatatggggaaccctgcccctattcctcgtcatgccccaatcccacgttatagcacatacctaatgctactattgattgtctcatatgcatcagcatgttcagaacgaccttttgggacagcggtg

SEQ ID NO: 447076 - DNA, 140 bp, Artificial Sequence
  Synthetic
caccgctgtcccaaaaggtcgttctgaacatgctgatgcatatgagacaatcaatagtagcattaggtatgtgctataacgtgggattggggcatgacgaggaataggggcagggttccccatatcagcagccagggcct

SEQ ID NO: 447077 - DNA, 140 bp, Artificial Sequence
  Synthetic
aggccctggctgctgatatgaccaagtgtagactgtctggcacagcattgatcagggcagggtcagttggggcagaggcttgtttgatgttgaagggggtcaaggaagatcaaaccaagtgaccttttgggacagcggtg

SEQ ID NO: 447078 - DNA, 140 bp, Artificial Sequence
  Synthetic
caccgctgtcccaaaaggtcacttggtttgatcttccttgacccccttcaacatcaaacaagcctctgccccaactgaccctgccctgatcaatgctgtgccagacagtctacacttggtcatatcagcagccagggcct

SEQ ID NO: 447079 - DNA, 140 bp, Artificial Sequence
  Synthetic
aggccctggctgctgatatgtgtgatgggtgcagaggagagaattgttcaatcggtggtggagacaatagccaggtccatagggaagttctttgcttctgataccctctgtaacccccccgaccttttgggacagcggtg

SEQ ID NO: 447080 - DNA, 140 bp, Artificial Sequence
  Synthetic
caccgctgtcccaaaaggtcgggggggttacagagggtatcagaagcaaagaacttccctatggacctggctattgtctccaccaccgattgaacaattctctcctctgcacccatcacacatatcagcagccagggcct

SEQ ID NO: 447081 - DNA, 140 bp, Artificial Sequence
  Synthetic
aggccctggctgctgatatgcagagggcatttcaggctcaaatagcttttcttttattgagagcccaggcaaagggtatgcaattgttgatgagccattctcagagatccctcggcaagggaccttttgggacagcggtg

SEQ ID NO: 447082 - DNA, 140 bp, Artificial Sequence
  Synthetic
caccgctgtcccaaaaggtcccttgccgagggatctctgagaatggctcatcaacaattgcataccctttgcctgggctctcaataaaagaaaagctatttgagcctgaaatgccctctgcatatcagcagccagggcct

SEQ ID NO: 447083 - DNA, 140 bp, Artificial Sequence
  Synthetic
aggccctggctgctgatatgtctgcccacaataaggacgggtctctgcatatagttctcccatcagagaacgggacaaaagatcagtgtcagatactacattttactgtacctgaagtaggaccttttgggacagcggtg

SEQ ID NO: 447084 - DNA, 140 bp, Artificial Sequence
  Synthetic
caccgctgtcccaaaaggtcctacttcaggtacagtaaaatgtagtatctgacactgatcttttgtcccgttctctgatgggagaactatatgcagagacccgtccttattgtgggcagacatatcagcagccagggcct

SEQ ID NO: 447085 - DNA, 140 bp, Artificial Sequence
  Synthetic
atacgccatgctgggtctccccatctagtcggggaatgtcatgtgaacaggtgtctgtcttggagggacaatgaaacttcagcagagttttcatttattggggaaagcacgactatgcgacgtacttgggagtcggccat

SEQ ID NO: 447086 - DNA, 140 bp, Artificial Sequence
  Synthetic
atggccgactcccaagtacgtcgcatagtcgtgctttccccaataaatgaaaactctgctgaagtttcattgtccctccaagacagacacctgttcacatgacattccccgactagatggggagacccagcatggcgtat

SEQ ID NO: 447087 - DNA, 140 bp, Artificial Sequence
  Synthetic
aggccctggctgctgatatgtgggatatccaagcttagaaacttatgcaataatacattagatgtaagcttagttgttatttggggtggtggggtgaggcagcagcagtctcaagtgctcgaccttttgggacagcggtg

SEQ ID NO: 447088 - DNA, 140 bp, Artificial Sequence
  Synthetic
caccgctgtcccaaaaggtcgagcacttgagactgctgctgcctcaccccaccaccccaaataacaactaagcttacatctaatgtattattgcataagtttctaagcttggatatcccacatatcagcagccagggcct

SEQ ID NO: 447089 - DNA, 140 bp, Artificial Sequence
  Synthetic
atacgccatgctgggtctccgtcttgtgatgcagccttcttaaatctgacaggttgttattcttgcaatgcaggggccagagtctgcctgtctatcacatccacaggaactgggactctccgtacttgggagtcggccat

SEQ ID NO: 447090 - DNA, 140 bp, Artificial Sequence
  Synthetic
atggccgactcccaagtacggagagtcccagttcctgtggatgtgatagacaggcagactctggcccctgcattgcaagaataacaacctgtcagatttaagaaggctgcatcacaagacggagacccagcatggcgtat

SEQ ID NO: 447091 - DNA, 140 bp, Artificial Sequence
  Synthetic
aggccctggctgctgatatgattaatggagtcctccttctcattctgggcagaagcatttggaattccaagctggaactttgttggtgacttgttcaggtcctcagactctgcagcaatggaccttttgggacagcggtg

SEQ ID NO: 447092 - DNA, 140 bp, Artificial Sequence
  Synthetic
caccgctgtcccaaaaggtccattgctgcagagtctgaggacctgaacaagtcaccaacaaagttccagcttggaattccaaatgcttctgcccagaatgagaaggaggactccattaatcatatcagcagccagggcct

SEQ ID NO: 447093 - DNA, 140 bp, Artificial Sequence
  Synthetic
aggccctggctgctgatatgtgaggaactagggaagactgagagagagttgctagccatggtctcctctatccaaataaattggtcagtcacagaatctgtgtttccaccctttagcagagaccttttgggacagcggtg

SEQ ID NO: 447094 - DNA, 140 bp, Artificial Sequence
  Synthetic
caccgctgtcccaaaaggtctctgctaaagggtggaaacacagattctgtgactgaccaatttatttggatagaggagaccatggctagcaactctctctcagtcttccctagttcctcacatatcagcagccagggcct

SEQ ID NO: 447095 - DNA, 140 bp, Artificial Sequence
  Synthetic
aggccctggctgctgatatgaggggaatcaacagttgtgaatccaaaatctggatcttggaatttctttgactggttttctggactcatgagttggtttggagggcctcttaagactatagaccttttgggacagcggtg

SEQ ID NO: 447096 - DNA, 140 bp, Artificial Sequence
  Synthetic
caccgctgtcccaaaaggtctatagtcttaagaggccctccaaaccaactcatgagtccagaaaaccagtcaaagaaattccaagatccagattttggattcacaactgttgattcccctcatatcagcagccagggcct

SEQ ID NO: 447097 - DNA, 140 bp, Artificial Sequence
  Synthetic
atacgccatgctgggtctccagaaggcctcataaatcagcacgtgtagaagcaatatatagaagtaaatagacacaagcaaacctaattatgtaaacattgtacagataagccaaactatcgtacttgggagtcggccat

SEQ ID NO: 447098 - DNA, 140 bp, Artificial Sequence
  Synthetic
atggccgactcccaagtacgatagtttggcttatctgtacaatgtttacataattaggtttgcttgtgtctatttacttctatatattgcttctacacgtgctgatttatgaggccttctggagacccagcatggcgtat

SEQ ID NO: 447099 - DNA, 140 bp, Artificial Sequence
  Synthetic
aggccctggctgctgatatgaagttaggaatttctttgctagaatggaaagcaagcctagaacggtcagaataacaggagctcctgtaaagaagaggtcaggggttagcaagatagctatgaccttttgggacagcggtg

SEQ ID NO: 447100 - DNA, 140 bp, Artificial Sequence
  Synthetic
caccgctgtcccaaaaggtcatagctatcttgctaacccctgacctcttctttacaggagctcctgttattctgaccgttctaggcttgctttccattctagcaaagaaattcctaacttcatatcagcagccagggcct

SEQ ID NO: 447101 - DNA, 140 bp, Artificial Sequence
  Synthetic
atacgccatgctgggtctcctgggatatctaagtttagaaacttatgcaataatactttagatgtaagcttaatcataatttggggtggtggggtgaggcagcagcagtcttaggttcttcgtacttgggagtcggccat

SEQ ID NO: 447102 - DNA, 140 bp, Artificial Sequence
  Synthetic
atggccgactcccaagtacgaagaacctaagactgctgctgcctcaccccaccaccccaaattatgattaagcttacatctaaagtattattgcataagtttctaaacttagatatcccaggagacccagcatggcgtat

SEQ ID NO: 447103 - DNA, 140 bp, Artificial Sequence
  Synthetic
aggccctggctgctgatatgcagtcttaggttcttgtgaatattctagttggcgtgattgtcttctgccaaattagctgggaattaaactaactctttaaagttgcaccggtctttgtgtgaccttttgggacagcggtg

SEQ ID NO: 447104 - DNA, 140 bp, Artificial Sequence
  Synthetic
caccgctgtcccaaaaggtcacacaaagaccggtgcaactttaaagagttagtttaattcccagctaatttggcagaagacaatcacgccaactagaatattcacaagaacctaagactgcatatcagcagccagggcct

SEQ ID NO: 447105 - DNA, 140 bp, Artificial Sequence
  Synthetic
aggccctggctgctgatatggagagaaacagataccatagagtccatctaaatatgggctcagatgatagtgtctacatagctgctttaggagttaatggaaagaagcacaaagcagacagaccttttgggacagcggtg

SEQ ID NO: 447106 - DNA, 140 bp, Artificial Sequence
  Synthetic
caccgctgtcccaaaaggtctgtctgctttgtgcttctttccattaactcctaaagcagctatgtagacactatcatctgagcccatatttagatggactctatggtatctgtttctctccatatcagcagccagggcct

SEQ ID NO: 447107 - DNA, 140 bp, Artificial Sequence
  Synthetic
aggccctggctgctgatatgtgtctacatagctgctttaggagttaatggaaagaagcacaaagcagacactttagtgcagcaaatgagaaacaggagtaaacagcttttctccccagatgaccttttgggacagcggtg

SEQ ID NO: 447108 - DNA, 140 bp, Artificial Sequence
  Synthetic
caccgctgtcccaaaaggtcatctggggagaaaagctgtttactcctgtttctcatttgctgcactaaagtgtctgctttgtgcttctttccattaactcctaaagcagctatgtagacacatatcagcagccagggcct

SEQ ID NO: 447109 - DNA, 140 bp, Artificial Sequence
  Synthetic
atacgccatgctgggtctccactccagaagcaactctagctcacaccccactgaataaccatattcaagttaggaatttctttgctagaatggaaagcaagcctagaacagtcagaataacgtacttgggagtcggccat

SEQ ID NO: 447110 - DNA, 140 bp, Artificial Sequence
  Synthetic
atggccgactcccaagtacgttattctgactgttctaggcttgctttccattctagcaaagaaattcctaacttgaatatggttattcagtggggtgtgagctagagttgcttctggagtggagacccagcatggcgtat

SEQ ID NO: 447111 - DNA, 140 bp, Artificial Sequence
  Synthetic
aggccctggctgctgatatggaggatagtgagcagatgcctcataaattctcaagagaaactcatcaataattccttctttgctgaagggaatgataaagctctgagattttcaaaaaacgaccttttgggacagcggtg

SEQ ID NO: 447112 - DNA, 140 bp, Artificial Sequence
  Synthetic
caccgctgtcccaaaaggtcgttttttgaaaatctcagagctttatcattcccttcagcaaagaaggaattattgatgagtttctcttgagaatttatgaggcatctgctcactatcctccatatcagcagccagggcct

SEQ ID NO: 447113 - DNA, 140 bp, Artificial Sequence
  Synthetic
atacgccatgctgggtctccttaagcaacatgtcaagcctaactattttgtgattaaacgactactgggttctggaattttcttgctaatcaagcccacttccagcaaaagccacatattcgtacttgggagtcggccat

SEQ ID NO: 447114 - DNA, 140 bp, Artificial Sequence
  Synthetic
atggccgactcccaagtacgaatatgtggcttttgctggaagtgggcttgattagcaagaaaattccagaacccagtagtcgtttaatcacaaaatagttaggcttgacatgttgcttaaggagacccagcatggcgtat

SEQ ID NO: 447115 - DNA, 140 bp, Artificial Sequence
  Synthetic
atacgccatgctgggtctcctgtgtctttcgcaattaagcgctcttgctgggcctttgatctctccacttccagggttttcaagccctacatagatgctggggatctgttagttactgaccgtacttgggagtcggccat

SEQ ID NO: 447116 - DNA, 140 bp, Artificial Sequence
  Synthetic
atggccgactcccaagtacggtcagtaactaacagatccccagcatctatgtagggcttgaaaaccctggaagtggagagatcaaaggcccagcaagagcgcttaattgcgaaagacacaggagacccagcatggcgtat

SEQ ID NO: 447117 - DNA, 140 bp, Artificial Sequence
  Synthetic
atacgccatgctgggtctccctccctggctgtcctaccacgatgccgatggcaaggatctgtgccctcttcagggattggatgtgagagggggccatcctatgtgcaacctgtggagagacgtacttgggagtcggccat

SEQ ID NO: 447118 - DNA, 140 bp, Artificial Sequence
  Synthetic
atggccgactcccaagtacgtctctccacaggttgcacataggatggccccctctcacatccaatccctgaagagggcacagatccttgccatcggcatcgtggtaggacagccagggagggagacccagcatggcgtat

SEQ ID NO: 447119 - DNA, 140 bp, Artificial Sequence
  Synthetic
atacgccatgctgggtctcctttcccaaggttctcaggtcagagctgcaggtttacttattaaactgcttatgcagaactatccagagaatagcaggtgagcccttcattcttaagaagacgtacttgggagtcggccat

SEQ ID NO: 447120 - DNA, 140 bp, Artificial Sequence
  Synthetic
atggccgactcccaagtacgtcttcttaagaatgaagggctcacctgctattctctggatagttctgcataagcagtttaataagtaaacctgcagctctgacctgagaaccttgggaaaggagacccagcatggcgtat

SEQ ID NO: 447121 - DNA, 140 bp, Artificial Sequence
  Synthetic
  misc_feature (37)..(37): n is a, c, g, or t
atacgccatgctgggtctccactctactagaggcagntcatgacaccatcattgcaaaggctgatccacccagttgtgaccttcagagtgctcatgggaatccttgcatgaaagagaaaccgtacttgggagtcggccat

SEQ ID NO: 447122 - DNA, 140 bp, Artificial Sequence
  Synthetic
  misc_feature (104)..(104): n is a, c, g, or t
atggccgactcccaagtacggtttctctttcatgcaaggattcccatgagcactctgaaggtcacaactgggtggatcagcctttgcaatgatggtgtcatganctgcctctagtagagtggagacccagcatggcgtat

SEQ ID NO: 447123 - DNA, 140 bp, Artificial Sequence
  Synthetic
aggccctggctgctgatatgtgggatatccaagcttagaaacttatgcaataatactttagatgcaagcttagttgtaatttggggtggtggggagaggcagcagcagtctcaagtgcttgaccttttgggacagcggtg

SEQ ID NO: 447124 - DNA, 140 bp, Artificial Sequence
  Synthetic
caccgctgtcccaaaaggtcaagcacttgagactgctgctgcctctccccaccaccccaaattacaactaagcttgcatctaaagtattattgcataagtttctaagcttggatatcccacatatcagcagccagggcct

SEQ ID NO: 447125 - DNA, 140 bp, Artificial Sequence
  Synthetic
aggccctggctgctgatatggacagaatttcatggagcaaatagacaatcagattatacgagagctcagtgggttgactctagaaaggttagccacacttaaggccacaagcaacttcaagaccttttgggacagcggtg

SEQ ID NO: 447126 - DNA, 140 bp, Artificial Sequence
  Synthetic
caccgctgtcccaaaaggtcttgaagttgcttgtggccttaagtgtggctaacctttctagagtcaacccactgagctctcgtataatctgattgtctatttgctccatgaaattctgtccatatcagcagccagggcct

SEQ ID NO: 447127 - DNA, 140 bp, Artificial Sequence
  Synthetic
aggccctggctgctgatatgactgcatcagacaatgatctcagtccaggcattttcaagtcaatatcagatgagggggtagctcaagccctgcaattatttgaaagggagccaagcaactgaccttttgggacagcggtg

SEQ ID NO: 447128 - DNA, 140 bp, Artificial Sequence
  Synthetic
caccgctgtcccaaaaggtcagttgcttggctccctttcaaataattgcagggcttgagctaccccctcatctgatattgacttgaaaatgcctggactgagatcattgtctgatgcagtcatatcagcagccagggcct

SEQ ID NO: 447129 - DNA, 140 bp, Artificial Sequence
  Synthetic
atacgccatgctgggtctccataaattattagtgaagatgtcaaaatatgcctctgagggaaagagcctagctatccagaagtttgaggattgtatgaggcagatagagtcacaaggatgcgtacttgggagtcggccat

SEQ ID NO: 447130 - DNA, 140 bp, Artificial Sequence
  Synthetic
atggccgactcccaagtacgcatccttgtgactctatctgcctcatacaatcctcaaacttctggatagctaggctctttccctcagaggcatattttgacatcttcactaataatttatggagacccagcatggcgtat

SEQ ID NO: 447131 - DNA, 140 bp, Artificial Sequence
  Synthetic
atacgccatgctgggtctccattaatggagtcctctttctcattttgggcagaagcatttggaattccaagctggaactttgttggtgacttgttcaggtcatcagactctgcagcaatgcgtacttgggagtcggccat

SEQ ID NO: 447132 - DNA, 140 bp, Artificial Sequence
  Synthetic
atggccgactcccaagtacgcattgctgcagagtctgatgacctgaacaagtcaccaacaaagttccagcttggaattccaaatgcttctgcccaaaatgagaaagaggactccattaatggagacccagcatggcgtat

SEQ ID NO: 447133 - DNA, 140 bp, Artificial Sequence
  Synthetic
aggccctggctgctgatatggatctatgttctcatttgtcgccaatgtcgaggaggcccatgatgttgattatgatgcgttgatggatctaatgatagaagatgccaagaacaatgcattgaccttttgggacagcggtg

SEQ ID NO: 447134 - DNA, 140 bp, Artificial Sequence
  Synthetic
caccgctgtcccaaaaggtcaatgcattgttcttggcatcttctatcattagatccatcaacgcatcataatcaacatcatgggcctcctcgacattggcgacaaatgagaacatagatccatatcagcagccagggcct

SEQ ID NO: 447135 - DNA, 140 bp, Artificial Sequence
  Synthetic
atacgccatgctgggtctccattcaacctgaaggttgctcctgagatgagcaagagcctggtttgtgacatgatgcaaggatcagatgatagtagcatgctaatcagcttcccagctgatcgtacttgggagtcggccat

SEQ ID NO: 447136 - DNA, 140 bp, Artificial Sequence
  Synthetic
atggccgactcccaagtacgatcagctgggaagctgattagcatgctactatcatctgatccttgcatcatgtcacaaaccaggctcttgctcatctcaggagcaaccttcaggttgaatggagacccagcatggcgtat

SEQ ID NO: 447137 - DNA, 140 bp, Artificial Sequence
  Synthetic
aggccctggctgctgatatgtctgcccacaataaggatgggtctctgcatatagtccttccatcagagaatggaacaaaagaccagtgtcagatactacacttcactgtgcctgaagtaggaccttttgggacagcggtg

SEQ ID NO: 447138 - DNA, 140 bp, Artificial Sequence
  Synthetic
caccgctgtcccaaaaggtcctacttcaggcacagtgaagtgtagtatctgacactggtcttttgttccattctctgatggaaggactatatgcagagacccatccttattgtgggcagacatatcagcagccagggcct

SEQ ID NO: 447139 - DNA, 140 bp, Artificial Sequence
  Synthetic
aggccctggctgctgatatgtggaaccaaggccattttgttacaaagtttgccctcatgctatgtgagttcacctctcctaagtggtggccactgatcattaggggatgttcaatgtttagaccttttgggacagcggtg

SEQ ID NO: 447140 - DNA, 140 bp, Artificial Sequence
  Synthetic
caccgctgtcccaaaaggtctaaacattgaacatcccctaatgatcagtggccaccacttaggagaggtgaactcacatagcatgagggcaaactttgtaacaaaatggccttggttccacatatcagcagccagggcct

SEQ ID NO: 447141 - DNA, 140 bp, Artificial Sequence
  Synthetic
aggccctggctgctgatatgtggtgtcagacaagtggtttgggactcagaagagtaggataggcaaaacaaccttcctggctgaatgggaaaagctaaagaaaattgtgaagtggttggagaccttttgggacagcggtg

SEQ ID NO: 447142 - DNA, 140 bp, Artificial Sequence
  Synthetic
caccgctgtcccaaaaggtctccaaccacttcacaattttctttagcttttcccattcagccaggaaggttgttttgcctatcctactcttctgagtcccaaaccacttgtctgacaccacatatcagcagccagggcct

SEQ ID NO: 447143 - DNA, 140 bp, Artificial Sequence
  Synthetic
atacgccatgctgggtctccatctgaaagaagccgtatcatggcctcttggagaaccttctctggctttctttgacctaagttctactagagtgcacaggaatgatgatattagaagggacgtacttgggagtcggccat

SEQ ID NO: 447144 - DNA, 140 bp, Artificial Sequence
  Synthetic
atggccgactcccaagtacgtcccttctaatatcatcattcctgtgcactctagtagaacttaggtcaaagaaagccagagaaggttctccaagaggccatgatacggcttctttcagatggagacccagcatggcgtat

SEQ ID NO: 447145 - DNA, 140 bp, Artificial Sequence
  Synthetic
atacgccatgctgggtctcctcagattgctactctagcaatgaggagctgcaagattaccaatgatctggaagattcctttgttggcttacacaggatgatagtaaccgaggccattctccgtacttgggagtcggccat

SEQ ID NO: 447146 - DNA, 140 bp, Artificial Sequence
  Synthetic
atggccgactcccaagtacggagaatggcctcggttactatcatcctgtgtaagccaacaaaggaatcttccagatcattggtaatcttgcagctcctcattgctagagtagcaatctgaggagacccagcatggcgtat

SEQ ID NO: 447147 - DNA, 140 bp, Artificial Sequence
  Synthetic
aggccctggctgctgatatgggttatccgtgacaatttctcccggatgggccacctccgaggtgtagaagaccttgctggcttcactcgtagtgtttcagctgaaattctcaagcactttgaccttttgggacagcggtg

SEQ ID NO: 447148 - DNA, 140 bp, Artificial Sequence
  Synthetic
caccgctgtcccaaaaggtcaaagtgcttgagaatttcagctgaaacactacgagtgaagccagcaaggtcttctacacctcggaggtggcccatccgggagaaattgtcacggataacccatatcagcagccagggcct

SEQ ID NO: 447149 - DNA, 140 bp, Artificial Sequence
  Synthetic
aggccctggctgctgatatgtccagttgttcctccagtcccagatgttgagatggaatcagaagaagagagtgatgatgatggatttgttgaggttgattagaggttgaggctgccccacgaccttttgggacagcggtg

SEQ ID NO: 447150 - DNA, 140 bp, Artificial Sequence
  Synthetic
caccgctgtcccaaaaggtcgtggggcagcctcaacctctaatcaacctcaacaaatccatcatcatcactctcttcttctgattccatctcaacatctgggactggaggaacaactggacatatcagcagccagggcct

SEQ ID NO: 447151 - DNA, 140 bp, Artificial Sequence
  Synthetic
aggccctggctgctgatatggctatatgccttcttcatgaagaaagtcaagggctcagctgctagggactgggcagatgaggatgtcaccatcccagaaacgtgtagtgtgagcccaggtgaccttttgggacagcggtg

SEQ ID NO: 447152 - DNA, 140 bp, Artificial Sequence
  Synthetic
caccgctgtcccaaaaggtcacctgggctcacactacacgtttctgggatggtgacatcctcatctgcccagtccctagcagctgagcccttgactttcttcatgaagaaggcatatagccatatcagcagccagggcct

SEQ ID NO: 447153 - DNA, 140 bp, Artificial Sequence
  Synthetic
atacgccatgctgggtctcccaagccatttggatgcccagtttatatcattaagggtgatatgtcagatgtcatcaggctgagaaaggaagaggtggagatgaaagtgcggggctctactcgtacttgggagtcggccat

SEQ ID NO: 447154 - DNA, 140 bp, Artificial Sequence
  Synthetic
atggccgactcccaagtacgagtagagccccgcactttcatctccacctcttcctttctcagcctgatgacatctgacatatcacccttaatgatataaactgggcatccaaatggcttgggagacccagcatggcgtat

SEQ ID NO: 447155 - DNA, 140 bp, Artificial Sequence
  Synthetic
aggccctggctgctgatatgcccctgggcagccacttaggctgctgtcttgtatgcctgagcagctgccatgacagccgctgacggctttccattagaatctacaagcccaaaagctttcgaccttttgggacagcggtg

SEQ ID NO: 447156 - DNA, 140 bp, Artificial Sequence
  Synthetic
caccgctgtcccaaaaggtcgaaagcttttgggcttgtagattctaatggaaagccgtcagcggctgtcatggcagctgctcaggcatacaagacagcagcctaagtggctgcccaggggcatatcagcagccagggcct

SEQ ID NO: 447157 - DNA, 140 bp, Artificial Sequence
  Synthetic
aggccctggctgctgatatgctacaaggacatcagttcattatctatgattgctcatcccttgatggataagtttgttgattatgctatttctaagatggggagagcctcagttaggaaagaccttttgggacagcggtg

SEQ ID NO: 447158 - DNA, 140 bp, Artificial Sequence
  Synthetic
caccgctgtcccaaaaggtctttcctaactgaggctctccccatcttagaaatagcataatcaacaaacttatccatcaagggatgagcaatcatagataatgaactgatgtccttgtagcatatcagcagccagggcct

SEQ ID NO: 447159 - DNA, 140 bp, Artificial Sequence
  Synthetic
atacgccatgctgggtctccatctcgctggattcactcgtagtgtgtcagctgaaatcctcaagcacttcctattctgtatactacagggcccttatagtgagagctataagctacagctcgtacttgggagtcggccat

SEQ ID NO: 447160 - DNA, 140 bp, Artificial Sequence
  Synthetic
atggccgactcccaagtacgagctgtagcttatagctctcactataagggccctgtagtatacagaataggaagtgcttgaggatttcagctgacacactacgagtgaatccagcgagatggagacccagcatggcgtat

SEQ ID NO: 447161 - DNA, 140 bp, Artificial Sequence
  Synthetic
atacgccatgctgggtctccattagaggtgatggtcctcccaggataccttattctatggttgggccctgttgtgtctttctcatgcaccatcgtcctagtcacgaggttcgcttgcgatcgtacttgggagtcggccat

SEQ ID NO: 447162 - DNA, 140 bp, Artificial Sequence
  Synthetic
atggccgactcccaagtacgatcgcaagcgaacctcgtgactaggacgatggtgcatgagaaagacacaacagggcccaaccatagaataaggtatcctgggaggaccatcacctctaatggagacccagcatggcgtat

SEQ ID NO: 447163 - DNA, 140 bp, Artificial Sequence
  Synthetic
aggccctggctgctgatatgtattgatctaataggccatatgactcttagtgatttcacaaggttccccaatctgaaagaagccatatcctggcctcttggagaaccctcactggctttcgaccttttgggacagcggtg

SEQ ID NO: 447164 - DNA, 140 bp, Artificial Sequence
  Synthetic
caccgctgtcccaaaaggtcgaaagccagtgagggttctccaagaggccaggatatggcttctttcagattggggaaccttgtgaaatcactaagagtcatatggcctattagatcaatacatatcagcagccagggcct

SEQ ID NO: 447165 - DNA, 140 bp, Artificial Sequence
  Synthetic
aggccctggctgctgatatgatctgaaagaagccatatcctggcctcttggagaaccctcactggctttctttgacctaagctctactagagtgcacaggaatgatgacattagaagggagaccttttgggacagcggtg

SEQ ID NO: 447166 - DNA, 140 bp, Artificial Sequence
  Synthetic
caccgctgtcccaaaaggtctcccttctaatgtcatcattcctgtgcactctagtagagcttaggtcaaagaaagccagtgagggttctccaagaggccaggatatggcttctttcagatcatatcagcagccagggcct

SEQ ID NO: 447167 - DNA, 140 bp, Artificial Sequence
  Synthetic
aggccctggctgctgatatgtttgacctaagctcaactagagtgcacaggaatgatgaaattagaagggaccagattgccactctagcaatgaggagctgcaagatcaccaatgatctaggaccttttgggacagcggtg

SEQ ID NO: 447168 - DNA, 140 bp, Artificial Sequence
  Synthetic
caccgctgtcccaaaaggtcctagatcattggtgatcttgcagctcctcattgctagagtggcaatctggtcccttctaatttcatcattcctgtgcactctagttgagcttaggtcaaacatatcagcagccagggcct

SEQ ID NO: 447169 - DNA, 140 bp, Artificial Sequence
  Synthetic
aggccctggctgctgatatgagagggattgacctgtgcctgttgccaggctttgacctcatgtatgaggttgctcacgtacagtgtgttcggctcctgcaggcagcaaaagaggacatttgaccttttgggacagcggtg

SEQ ID NO: 447170 - DNA, 140 bp, Artificial Sequence
  Synthetic
caccgctgtcccaaaaggtcaaatgtcctcttttgctgcctgcaggagccgaacacactgtacgtgagcaacctcatacatgaggtcaaagcctggcaacaggcacaggtcaatccctctcatatcagcagccagggcct

SEQ ID NO: 447171 - DNA, 140 bp, Artificial Sequence
  Synthetic
atacgccatgctgggtctcccccccaccccccaatcccgaccgtaaccccaacccccctttcccccaaccccctgggcagccacttaggctgctgtcttgtaagcctgagcagctgccatcgtacttgggagtcggccat

SEQ ID NO: 447172 - DNA, 140 bp, Artificial Sequence
  Synthetic
atggccgactcccaagtacgatggcagctgctcaggcttacaagacagcagcctaagtggctgcccagggggttgggggaaaggggggttggggttacggtcgggattggggggtgggggggagacccagcatggcgtat

SEQ ID NO: 447173 - DNA, 140 bp, Artificial Sequence
  Synthetic
atacgccatgctgggtctccggcttgttgccacgagtcagagccaggacaatcattttcttggcatccttctcccagtcagccccaccatactgctttaagagttcgataaccctacgggcgtacttgggagtcggccat

SEQ ID NO: 447174 - DNA, 140 bp, Artificial Sequence
  Synthetic
atggccgactcccaagtacgcccgtagggttatcgaactcttaaagcagtatggtggggctgactgggagaaggatgccaagaaaatgattgtcctggctctgactcgtggcaacaagccggagacccagcatggcgtat

SEQ ID NO: 447175 - DNA, 140 bp, Artificial Sequence
  Synthetic
aggccctggctgctgatatgctcccagtcagccccaccatactgctttaagagttcgataaccctacgggcatcaaacccttgataagcaaactctcggacccactgttcaatctcattggaccttttgggacagcggtg

SEQ ID NO: 447176 - DNA, 140 bp, Artificial Sequence
  Synthetic
caccgctgtcccaaaaggtccaatgagattgaacagtgggtccgagagtttgcttatcaagggtttgatgcccgtagggttatcgaactcttaaagcagtatggtggggctgactgggagcatatcagcagccagggcct

SEQ ID NO: 447177 - DNA, 140 bp, Artificial Sequence
  Synthetic
atacgccatgctgggtctcctattgatctaataggccatatgactcttagtgatttcacaaggttccccaatctgaaagaagccatatcctggcctcttggagaaccctccctggctttccgtacttgggagtcggccat

SEQ ID NO: 447178 - DNA, 140 bp, Artificial Sequence
  Synthetic
atggccgactcccaagtacggaaagccagggagggttctccaagaggccaggatatggcttctttcagattggggaaccttgtgaaatcactaagagtcatatggcctattagatcaataggagacccagcatggcgtat

SEQ ID NO: 447179 - DNA, 140 bp, Artificial Sequence
  Synthetic
aggccctggctgctgatatgatctgaaagaagccatatcctggcctcttggagaaccctccctggctttctttgacctaagctctactagagtgcacaggaatgatgacattagaagggagaccttttgggacagcggtg

SEQ ID NO: 447180 - DNA, 140 bp, Artificial Sequence
  Synthetic
caccgctgtcccaaaaggtctcccttctaatgtcatcattcctgtgcactctagtagagcttaggtcaaagaaagccagggagggttctccaagaggccaggatatggcttctttcagatcatatcagcagccagggcct

SEQ ID NO: 447181 - DNA, 140 bp, Artificial Sequence
  Synthetic
atacgccatgctgggtctcctttgacctaagctctactagagtgcacaggaatgatgacattagaagggatcagattgccactctagcaatgaggagctgcaagattaccaatgatctagcgtacttgggagtcggccat

SEQ ID NO: 447182 - DNA, 140 bp, Artificial Sequence
  Synthetic
atggccgactcccaagtacgctagatcattggtaatcttgcagctcctcattgctagagtggcaatctgatcccttctaatgtcatcattcctgtgcactctagtagagcttaggtcaaaggagacccagcatggcgtat

SEQ ID NO: 447183 - DNA, 140 bp, Artificial Sequence
  Synthetic
aggccctggctgctgatatgtcagattgccactctagcaatgaggagctgcaagattaccaatgatctagaagactcctttgttggcttacacaggatgatagtgaccgaggctattctcgaccttttgggacagcggtg

SEQ ID NO: 447184 - DNA, 140 bp, Artificial Sequence
  Synthetic
caccgctgtcccaaaaggtcgagaatagcctcggtcactatcatcctgtgtaagccaacaaaggagtcttctagatcattggtaatcttgcagctcctcattgctagagtggcaatctgacatatcagcagccagggcct

SEQ ID NO: 447185 - DNA, 140 bp, Artificial Sequence
  Synthetic
atacgccatgctgggtctcctgcgtcacaggatcgcagagtccttctaccgagattacactcaagtatccagggatatcccagtcctctgggggggacataggggttcacatggcacacgcgtacttgggagtcggccat

SEQ ID NO: 447186 - DNA, 140 bp, Artificial Sequence
  Synthetic
atggccgactcccaagtacgcgtgtgccatgtgaacccctatgtcccccccagaggactgggatatccctggatacttgagtgtaatctcggtagaaggactctgcgatcctgtgacgcaggagacccagcatggcgtat

SEQ ID NO: 447187 - DNA, 140 bp, Artificial Sequence
  Synthetic
atacgccatgctgggtctcctgctcacgtccagtgtgttcggctcctgcaggcagcaaaagaggacatttctaatgctgtagttccaaactcagccctcattgctcttatggaggagagccgtacttgggagtcggccat

SEQ ID NO: 447188 - DNA, 140 bp, Artificial Sequence
  Synthetic
atggccgactcccaagtacggctctcctccataagagcaatgagggctgagtttggaactacagcattagaaatgtcctcttttgctgcctgcaggagccgaacacactggacgtgagcaggagacccagcatggcgtat

SEQ ID NO: 447189 - DNA, 140 bp, Artificial Sequence
  Synthetic
aggccctggctgctgatatgcatgatgtggatcacatatctgaatttctctctgcatgctctagtgacttatgggcaacagatgaagacctgtacaaccctctttcttgtgacaaggagcgaccttttgggacagcggtg

SEQ ID NO: 447190 - DNA, 140 bp, Artificial Sequence
  Synthetic
caccgctgtcccaaaaggtcgctccttgtcacaagaaagagggttgtacaggtcttcatctgttgcccataagtcactagagcatgcagagagaaattcagatatgtgatccacatcatgcatatcagcagccagggcct

SEQ ID NO: 447191 - DNA, 140 bp, Artificial Sequence
  Synthetic
atacgccatgctgggtctcccccccaccccccaaccccaaccgtaaccccaacccccccttccccccaaacccctgggcagccacttaggctgctgttttgtacgcctgagcagctgccacgtacttgggagtcggccat

SEQ ID NO: 447192 - DNA, 140 bp, Artificial Sequence
  Synthetic
atggccgactcccaagtacgtggcagctgctcaggcgtacaaaacagcagcctaagtggctgcccaggggtttggggggaagggggggttggggttacggttggggttggggggtgggggggagacccagcatggcgtat

SEQ ID NO: 447193 - DNA, 140 bp, Artificial Sequence
  Synthetic
atacgccatgctgggtctccttaagcaacatgtcaagcctaactactttgtgattaaacgactattaggttctgggattttcttgctaatcaagcccacttccagcaaaagccatatattcgtacttgggagtcggccat

SEQ ID NO: 447194 - DNA, 140 bp, Artificial Sequence
  Synthetic
atggccgactcccaagtacgaatatatggcttttgctggaagtgggcttgattagcaagaaaatcccagaacctaatagtcgtttaatcacaaagtagttaggcttgacatgttgcttaaggagacccagcatggcgtat

SEQ ID NO: 447195 - DNA, 140 bp, Artificial Sequence
  Synthetic
atacgccatgctgggtctccgggattcactcagagaggaggagatgccagaagagctctcctgttccatatcaggcataagggaggttaaaacctcaagccaggaattatatagggcattcgtacttgggagtcggccat

SEQ ID NO: 447196 - DNA, 140 bp, Artificial Sequence
  Synthetic
atggccgactcccaagtacgaatgccctatataattcctggcttgaggttttaacctcccttatgcctgatatggaacaggagagctcttctggcatctcctcctctctgagtgaatcccggagacccagcatggcgtat

SEQ ID NO: 447197 - DNA, 140 bp, Artificial Sequence
  Synthetic
atacgccatgctgggtctccccatcttgttggagagtgtcatgtgaataggtgtctgtcttggagggacaatgaaacttcagcagagttttcatttgttggggaaagcacgatcatgcgacgtacttgggagtcggccat

SEQ ID NO: 447198 - DNA, 140 bp, Artificial Sequence
  Synthetic
atggccgactcccaagtacgtcgcatgatcgtgctttccccaacaaatgaaaactctgctgaagtttcattgtccctccaagacagacacctattcacatgacactctccaacaagatggggagacccagcatggcgtat

SEQ ID NO: 447199 - DNA, 140 bp, Artificial Sequence
  Synthetic
atacgccatgctgggtctccgagaataagtgttttgagcagtgtggaggatgggggtgtgggtgtttcaatgtgaacccatcttgcttatttgtgcacacgtatctgcagtcagttagaacgtacttgggagtcggccat

SEQ ID NO: 447200 - DNA, 140 bp, Artificial Sequence
  Synthetic
atggccgactcccaagtacgttctaactgactgcagatacgtgtgcacaaataagcaagatgggttcacattgaaacacccacacccccatcctccacactgctcaaaacacttattctcggagacccagcatggcgtat

SEQ ID NO: 447201 - DNA, 140 bp, Artificial Sequence
  Synthetic
aggccctggctgctgatatgcatccatggtagtcccagtgacaggaagccactcactcaagacgaccaaagcctggcatgtccagccagccagggcggcagcaactcgtgatagagtcaagaccttttgggacagcggtg

SEQ ID NO: 447202 - DNA, 140 bp, Artificial Sequence
  Synthetic
caccgctgtcccaaaaggtcttgactctatcacgagttgctgccgccctggctggctggacatgccaggctttggtcgtcttgagtgagtggcttcctgtcactgggactaccatggatgcatatcagcagccagggcct

SEQ ID NO: 447203 - DNA, 140 bp, Artificial Sequence
  Synthetic
aggccctggctgctgatatggcctggcatgtccagccagccagggcggcagcaactcgtgatagagtcaactcatcccgggagggattcccctcctttagcttatacttgttgatgagaggaccttttgggacagcggtg

SEQ ID NO: 447204 - DNA, 140 bp, Artificial Sequence
  Synthetic
caccgctgtcccaaaaggtcctctcatcaacaagtataagctaaaggaggggaatccctcccgggatgagttgactctatcacgagttgctgccgccctggctggctggacatgccaggccatatcagcagccagggcct

SEQ ID NO: 447205 - DNA, 140 bp, Artificial Sequence
  Synthetic
atacgccatgctgggtctcctggaacaaaagatcagtgtcagatactacacttcactgtacctgaagtagaggaggagtttatgtactcttgtgatggagatgagcggcctctgttggtgcgtacttgggagtcggccat

SEQ ID NO: 447206 - DNA, 140 bp, Artificial Sequence
  Synthetic
atggccgactcccaagtacgcaccaacagaggccgctcatctccatcacaagagtacataaactcctcctctacttcaggtacagtgaagtgtagtatctgacactgatcttttgttccaggagacccagcatggcgtat

SEQ ID NO: 447207 - DNA, 140 bp, Artificial Sequence
  Synthetic
atacgccatgctgggtctccagaaacctgttttggtgactccaccaacccagagatgattgaaggagcttgggattcactcagagaggaggagatgccagaggagctctcctgttccatacgtacttgggagtcggccat

SEQ ID NO: 447208 - DNA, 140 bp, Artificial Sequence
  Synthetic
atggccgactcccaagtacgtatggaacaggagagctcctctggcatctcctcctctctgagtgaatcccaagctccttcaatcatctctgggttggtggagtcaccaaaacaggtttctggagacccagcatggcgtat

SEQ ID NO: 447209 - DNA, 140 bp, Artificial Sequence
  Synthetic
atacgccatgctgggtctccgacataagcaaacctaattatgtaaatattttacagatagatcaaattattgggatatccaagcttagatacttatgcaataatacttttgatgtaagctcgtacttgggagtcggccat

SEQ ID NO: 447210 - DNA, 140 bp, Artificial Sequence
  Synthetic
atggccgactcccaagtacgagcttacatcaaaagtattattgcataagtatctaagcttggatatcccaataatttgatctatctgtaaaatatttacataattaggtttgcttatgtcggagacccagcatggcgtat

SEQ ID NO: 447211 - DNA, 140 bp, Artificial Sequence
  Synthetic
aggccctggctgctgatatggagagaaaccatggcagggattgcaatgacagtccttccagccttagcagtttttgctttggcacctgttgtttttgctgaagaccctcatctcagaaacgaccttttgggacagcggtg

SEQ ID NO: 447212 - DNA, 140 bp, Artificial Sequence
  Synthetic
caccgctgtcccaaaaggtcgtttctgagatgagggtcttcagcaaaaacaacaggtgccaaagcaaaaactgctaaggctggaaggactgtcattgcaatccctgccatggtttctctccatatcagcagccagggcct

SEQ ID NO: 447213 - DNA, 140 bp, Artificial Sequence
  Synthetic
atacgccatgctgggtctccgtcggatctatgttctcatttgttgctaatgtcgaggaggcccatgatgttgactatgatgcgttaatggatctaatgatagaagatgccaagaacaatgcgtacttgggagtcggccat

SEQ ID NO: 447214 - DNA, 140 bp, Artificial Sequence
  Synthetic
atggccgactcccaagtacgcattgttcttggcatcttctatcattagatccattaacgcatcatagtcaacatcatgggcctcctcgacattagcaacaaatgagaacatagatccgacggagacccagcatggcgtat

SEQ ID NO: 447215 - DNA, 140 bp, Artificial Sequence
  Synthetic
aggccctggctgctgatatgactctattagaggcagttcacgacaccatcattgcaaaggctgatccacctagctgtgaccttcagagtgctcatgggaatccctgcatgaaagagaaacgaccttttgggacagcggtg

SEQ ID NO: 447216 - DNA, 140 bp, Artificial Sequence
  Synthetic
caccgctgtcccaaaaggtcgtttctctttcatgcagggattcccatgagcactctgaaggtcacagctaggtggatcagcctttgcaatgatggtgtcgtgaactgcctctaatagagtcatatcagcagccagggcct

SEQ ID NO: 447217 - DNA, 140 bp, Artificial Sequence
  Synthetic
atacgccatgctgggtctcctcgtaatgaagacacactgtccaaatgactaccagtcagctcattacctcaacaatgacgggaaaatggcttcagtcaagtgccctcctaagtatgagctcgtacttgggagtcggccat

SEQ ID NO: 447218 - DNA, 140 bp, Artificial Sequence
  Synthetic
atggccgactcccaagtacgagctcatacttaggagggcacttgactgaagccattttcccgtcattgttgaggtaatgagctgactggtagtcatttggacagtgtgtcttcattacgaggagacccagcatggcgtat

SEQ ID NO: 447219 - DNA, 140 bp, Artificial Sequence
  Synthetic
aggccctggctgctgatatgaacaatgacgggaaaatggcttcagtcaagtgccctcctaagtatgagctcactgaggactgcaacttttgtaggcagatgacaggtgctagcttgaagagaccttttgggacagcggtg

SEQ ID NO: 447220 - DNA, 140 bp, Artificial Sequence
  Synthetic
caccgctgtcccaaaaggtctcttcaagctagcacctgtcatctgcctacaaaagttgcagtcctcagtgagctcatacttaggagggcacttgactgaagccattttcccgtcattgttcatatcagcagccagggcct

SEQ ID NO: 447221 - DNA, 140 bp, Artificial Sequence
  Synthetic
aggccctggctgctgatatgaggggtcttatcctctccaagacttattttgtcagtcaagtgaggatgatggatcaaaattaaaaacaaaaatgaaaggggtctgcgaagtgggggttcagaccttttgggacagcggtg

SEQ ID NO: 447222 - DNA, 140 bp, Artificial Sequence
  Synthetic
caccgctgtcccaaaaggtctgaacccccacttcgcagacccctttcatttttgtttttaattttgatccatcatcctcacttgactgacaaaataagtcttggagaggataagacccctcatatcagcagccagggcct

SEQ ID NO: 447223 - DNA, 140 bp, Artificial Sequence
  Synthetic
aggccctggctgctgatatgggatcaaaattaaaaacaaaaatgaaaggggtctgcgaagtgggggttcaagcactcaaaaagtgtgatggccaactcagcactgcacatgaggttgtgcgaccttttgggacagcggtg

SEQ ID NO: 447224 - DNA, 140 bp, Artificial Sequence
  Synthetic
caccgctgtcccaaaaggtcgcacaacctcatgtgcagtgctgagttggccatcacactttttgagtgcttgaacccccacttcgcagacccctttcatttttgtttttaattttgatcccatatcagcagccagggcct

SEQ ID NO: 447225 - DNA, 140 bp, Artificial Sequence
  Synthetic
aggccctggctgctgatatgcctttgcagtgtttaagaactcaaagaaggtttatcttgacaagcttgacctcaagactgaggaaaatctgctaccagactcatttgtctgcttcgagcagaccttttgggacagcggtg

SEQ ID NO: 447226 - DNA, 140 bp, Artificial Sequence
  Synthetic
caccgctgtcccaaaaggtctgctcgaagcagacaaatgagtctggtagcagattttcctcagtcttgaggtcaagcttgtcaagataaaccttctttgagttcttaaacactgcaaaggcatatcagcagccagggcct

SEQ ID NO: 447227 - DNA, 140 bp, Artificial Sequence
  Synthetic
aggccctggctgctgatatgctcaagactgaggaaaatctgctaccagactcatttgtctgcttcgagcataagggacagtacaaaggaacaatggactctggtcagattaagagggagcgaccttttgggacagcggtg

SEQ ID NO: 447228 - DNA, 140 bp, Artificial Sequence
  Synthetic
caccgctgtcccaaaaggtcgctccctcttaatctgaccagagtccattgttcctttgtactgtcccttatgctcgaagcagacaaatgagtctggtagcagattttcctcagtcttgagcatatcagcagccagggcct

SEQ ID NO: 447229 - DNA, 140 bp, Artificial Sequence
  Synthetic
atacgccatgctgggtctccagatacaagtatccggggtctggaagaagcctttatgtgtagggtatgagagagtggttgtgaagagagaactctctgccaagcccatccagagagttgacgtacttgggagtcggccat

SEQ ID NO: 447230 - DNA, 140 bp, Artificial Sequence
  Synthetic
atggccgactcccaagtacgtcaactctctggatgggcttggcagagagttctctcttcacaaccactctctcataccctacacataaaggcttcttccagaccccggatacttgtatctggagacccagcatggcgtat

SEQ ID NO: 447231 - DNA, 140 bp, Artificial Sequence
  Synthetic
atacgccatgctgggtctcctggaaaccacaacaggaatgatgcaggggatattgcattacacttcctcactattacacaccattcatcaagaatatatccggtccttgtcctttaagatcgtacttgggagtcggccat

SEQ ID NO: 447232 - DNA, 140 bp, Artificial Sequence
  Synthetic
atggccgactcccaagtacgatcttaaaggacaaggaccggatatattcttgatgaatggtgtgtaatagtgaggaagtgtaatgcaatatcccctgcatcattcctgttgtggtttccaggagacccagcatggcgtat

SEQ ID NO: 447233 - DNA, 140 bp, Artificial Sequence
  Synthetic
aggccctggctgctgatatggccttgcacaacttgtataaccaaatgtgagcctcatggattggttgtccgatcaacagggttcaagatatcatctgcagttgcttgtgctagcggagttgaccttttgggacagcggtg

SEQ ID NO: 447234 - DNA, 140 bp, Artificial Sequence
  Synthetic
caccgctgtcccaaaaggtcaactccgctagcacaagcaactgcagatgatatcttgaaccctgttgatcggacaaccaatccatgaggctcacatttggttatacaagttgtgcaaggccatatcagcagccagggcct

SEQ ID NO: 447235 - DNA, 140 bp, Artificial Sequence
  Synthetic
aggccctggctgctgatatggatcaacagggttcaagatatcatctgcagttgcttgtgctagcggagtttgcgtcacaggatcgcagagcccttctactgagattacactcaagtatccgaccttttgggacagcggtg

SEQ ID NO: 447236 - DNA, 140 bp, Artificial Sequence
  Synthetic
caccgctgtcccaaaaggtcggatacttgagtgtaatctcagtagaagggctctgcgatcctgtgacgcaaactccgctagcacaagcaactgcagatgatatcttgaaccctgttgatccatatcagcagccagggcct

SEQ ID NO: 447237 - DNA, 140 bp, Artificial Sequence
  Synthetic
aggccctggctgctgatatgtgcgtcacaggatcgcagagcccttctactgagattacactcaagtatccagggatatcccagtcctctgggggagacataggggttcacatggcacatggaccttttgggacagcggtg

SEQ ID NO: 447238 - DNA, 140 bp, Artificial Sequence
  Synthetic
caccgctgtcccaaaaggtccatgtgccatgtgaacccctatgtctcccccagaggactgggatatccctggatacttgagtgtaatctcagtagaagggctctgcgatcctgtgacgcacatatcagcagccagggcct

SEQ ID NO: 447239 - DNA, 140 bp, Artificial Sequence
  Synthetic
aggccctggctgctgatatgatgatcagtcagttagctccaaaatagtagctcactgccccccccaggacccgtgcctagtgcatggctgcatagtgtgtgctcatggcttgataaattagaccttttgggacagcggtg

SEQ ID NO: 447240 - DNA, 140 bp, Artificial Sequence
  Synthetic
caccgctgtcccaaaaggtctaatttatcaagccatgagcacacactatgcagccatgcactaggcacgggtcctggggggggcagtgagctactattttggagctaactgactgatcatcatatcagcagccagggcct

SEQ ID NO: 447241 - DNA, 140 bp, Artificial Sequence
  Synthetic
aggccctggctgctgatatgccgtgcctagtgcatggctgcatagtgtgtgctcatggcttgataaattaccagtgtcacactgctctcagtgcctttgttgttgtgttcgtattcagctgaccttttgggacagcggtg

SEQ ID NO: 447242 - DNA, 140 bp, Artificial Sequence
  Synthetic
caccgctgtcccaaaaggtcagctgaatacgaacacaacaacaaaggcactgagagcagtgtgacactggtaatttatcaagccatgagcacacactatgcagccatgcactaggcacggcatatcagcagccagggcct

SEQ ID NO: 447243 - DNA, 140 bp, Artificial Sequence
  Synthetic
atacgccatgctgggtctccccagtgtcacactgctctcagtgcctttgttgttgtgttcgtattcagctctgttgcaataatttgtttggccattctttataaggtgctcaagtgcctacgtacttgggagtcggccat

SEQ ID NO: 447244 - DNA, 140 bp, Artificial Sequence
  Synthetic
atggccgactcccaagtacgtaggcacttgagcaccttataaagaatggccaaacaaattattgcaacagagctgaatacgaacacaacaacaaaggcactgagagcagtgtgacactggggagacccagcatggcgtat

SEQ ID NO: 447245 - DNA, 140 bp, Artificial Sequence
  Synthetic
atacgccatgctgggtctccgggttgactctagaaaggttggccacacttaaggccacaagcaactttaatgagaattggtatgtctataaggatgtggcagacaagaactacacaagggcgtacttgggagtcggccat

SEQ ID NO: 447246 - DNA, 140 bp, Artificial Sequence
  Synthetic
atggccgactcccaagtacgcccttgtgtagttcttgtctgccacatccttatagacataccaattctcattaaagttgcttgtggccttaagtgtggccaacctttctagagtcaacccggagacccagcatggcgtat

SEQ ID NO: 447247 - DNA, 140 bp, Artificial Sequence
  Synthetic
atacgccatgctgggtctccctcaggcgtacaagacagcagcctaaatggctgcccaggggtttgggggaaaggggtggttggggttacggtcgggattggggggtggggggtggggcagcgtacttgggagtcggccat

SEQ ID NO: 447248 - DNA, 140 bp, Artificial Sequence
  Synthetic
atggccgactcccaagtacgctgccccaccccccaccccccaatcccgaccgtaaccccaaccacccctttcccccaaacccctgggcagccatttaggctgctgtcttgtacgcctgagggagacccagcatggcgtat

SEQ ID NO: 447249 - DNA, 140 bp, Artificial Sequence
  Synthetic
atacgccatgctgggtctccaccaagtgtaggctgtctggcacagcattaatcagggcagggtcagttggggcagaggcttgtttgatgttaaagggggtcaaggaagaccagaccaagtcgtacttgggagtcggccat

SEQ ID NO: 447250 - DNA, 140 bp, Artificial Sequence
  Synthetic
atggccgactcccaagtacgacttggtctggtcttccttgaccccctttaacatcaaacaagcctctgccccaactgaccctgccctgattaatgctgtgccagacagcctacacttggtggagacccagcatggcgtat

SEQ ID NO: 447251 - DNA, 140 bp, Artificial Sequence
  Synthetic
aggccctggctgctgatatgtcttgaagataaaaactgtctcaagtgagctatcgtgtagggagggccagagctattggactgggtcctttagccccaaatgtctgagctcaaggagatggaccttttgggacagcggtg

SEQ ID NO: 447252 - DNA, 140 bp, Artificial Sequence
  Synthetic
caccgctgtcccaaaaggtccatctccttgagctcagacatttggggctaaaggacccagtccaatagctctggccctccctacacgatagctcacttgagacagtttttatcttcaagacatatcagcagccagggcct

SEQ ID NO: 447253 - DNA, 140 bp, Artificial Sequence
  Synthetic
aggccctggctgctgatatgtaatgacttcagttactgaggggggtgggtcattctccttagctgcaatgattcagcaagctcagtgcactctccattacatgctgatgggcatgggagtgaccttttgggacagcggtg

SEQ ID NO: 447254 - DNA, 140 bp, Artificial Sequence
  Synthetic
caccgctgtcccaaaaggtcactcccatgcccatcagcatgtaatggagagtgcactgagcttgctgaatcattgcagctaaggagaatgacccacccccctcagtaactgaagtcattacatatcagcagccagggcct

SEQ ID NO: 447255 - DNA, 140 bp, Artificial Sequence
  Synthetic
aggccctggctgctgatatggagaataagtgttttgagcagtgtggaggatggggatgtgggtgtttcaatgtgaacccatcttgcttatttgtgcacacgtatctgcagtcagttagaagaccttttgggacagcggtg

SEQ ID NO: 447256 - DNA, 140 bp, Artificial Sequence
  Synthetic
caccgctgtcccaaaaggtcttctaactgactgcagatacgtgtgcacaaataagcaagatgggttcacattgaaacacccacatccccatcctccacactgctcaaaacacttattctccatatcagcagccagggcct

SEQ ID NO: 447257 - DNA, 140 bp, Artificial Sequence
  Synthetic
atacgccatgctgggtctccaagaggcccttagagtttttaactgtattgattgggtgcataaactcactctagagatcacagactttgatggctctgtttcaacagtagacttgggagccgtacttgggagtcggccat

SEQ ID NO: 447258 - DNA, 140 bp, Artificial Sequence
  Synthetic
atggccgactcccaagtacggctcccaagtctactgttgaaacagagccatcaaagtctgtgatctctagagtgagtttatgcacccaatcaatacagttaaaaactctaagggcctcttggagacccagcatggcgtat

SEQ ID NO: 447259 - DNA, 140 bp, Artificial Sequence
  Synthetic
atacgccatgctgggtctccgaaatagacatcatcccaagagtcaacatcagggatgcaacccaaaccagggtcactatctttaatgagcagaagaccctccgaacatctccagagaagtcgtacttgggagtcggccat

SEQ ID NO: 447260 - DNA, 140 bp, Artificial Sequence
  Synthetic
atggccgactcccaagtacgacttctctggagatgttcggagggtcttctgctcattaaagatagtgaccctggtttgggttgcatccctgatgttgactcttgggatgatgtctatttcggagacccagcatggcgtat

SEQ ID NO: 447261 - DNA, 140 bp, Artificial Sequence
  Synthetic
atacgccatgctgggtctccatgaatcatgccttagggcaccaaaccttatctcatacaaacccatgatagatcagttggagtgcacaacaaatctgattgatccctttgttgtctttgacgtacttgggagtcggccat

SEQ ID NO: 447262 - DNA, 140 bp, Artificial Sequence
  Synthetic
atggccgactcccaagtacgtcaaagacaacaaagggatcaatcagatttgttgtgcactccaactgatctatcatgggtttgtatgagataaggtttggtgccctaaggcatgattcatggagacccagcatggcgtat

SEQ ID NO: 447263 - DNA, 140 bp, Artificial Sequence
  Synthetic
aggccctggctgctgatatgataagcaaagtcaggcttagatttagggatactatgctagtattggaatccatgtgggttctgatactagcatagtgctacaatattgggcggtctttgtgaccttttgggacagcggtg

SEQ ID NO: 447264 - DNA, 140 bp, Artificial Sequence
  Synthetic
caccgctgtcccaaaaggtcacaaagaccgcccaatattgtagcactatgctagtatcagaacccacatggattccaatactagcatagtatccctaaatctaagcctgactttgcttatcatatcagcagccagggcct

SEQ ID NO: 447265 - DNA, 140 bp, Artificial Sequence
  Synthetic
aggccctggctgctgatatgaaggaaataggggtgttcaagctttctctaagggctctgtacaagctgatctaactctgatgtttgacaattttgaggtggactttgtgggagcagccgtgaccttttgggacagcggtg

SEQ ID NO: 447266 - DNA, 140 bp, Artificial Sequence
  Synthetic
caccgctgtcccaaaaggtcacggctgctcccacaaagtccacctcaaaattgtcaaacatcagagttagatcagcttgtacagagcccttagagaaagcttgaacacccctatttccttcatatcagcagccagggcct

SEQ ID NO: 447267 - DNA, 140 bp, Artificial Sequence
  Synthetic
aggccctggctgctgatatggtcttgtgatgccgccttcttaaacttgacaggttgctattcctgcaatgcaggggccagagtctgtctgtctatcacatctacaggaactggaactcttgaccttttgggacagcggtg

SEQ ID NO: 447268 - DNA, 140 bp, Artificial Sequence
  Synthetic
caccgctgtcccaaaaggtcaagagttccagttcctgtagatgtgatagacagacagactctggcccctgcattgcaggaatagcaacctgtcaagtttaagaaggcggcatcacaagaccatatcagcagccagggcct

SEQ ID NO: 447269 - DNA, 140 bp, Artificial Sequence
  Synthetic
aggccctggctgctgatatggtgcattaaatgtatgttttattgacaattctaatctcggttctggtgtgtgaagcggttattagagtgtctctaagctccacaagagaggagacctgttgaccttttgggacagcggtg

SEQ ID NO: 447270 - DNA, 140 bp, Artificial Sequence
  Synthetic
caccgctgtcccaaaaggtcaacaggtctcctctcttgtggagcttagagacactctaataaccgcttcacacaccagaaccgagattagaattgtcaataaaacatacatttaatgcaccatatcagcagccagggcct

SEQ ID NO: 447271 - DNA, 140 bp, Artificial Sequence
  Synthetic
atacgccatgctgggtctcctcagattgctactctagcaatgaggagttgcaagatcaccaatgatctagaagactcctttgttggcttacacaggatgatagtgaccgaggccattctccgtacttgggagtcggccat

SEQ ID NO: 447272 - DNA, 140 bp, Artificial Sequence
  Synthetic
atggccgactcccaagtacggagaatggcctcggtcactatcatcctgtgtaagccaacaaaggagtcttctagatcattggtgatcttgcaactcctcattgctagagtagcaatctgaggagacccagcatggcgtat

SEQ ID NO: 447273 - DNA, 140 bp, Artificial Sequence
  Synthetic
aggccctggctgctgatatgaggaggagtttatgtactcttgtgatggagatgagcggcctctgttggtgaaggggaccctgatagctattgatccatttgatgataggcgagaagcagggaccttttgggacagcggtg

SEQ ID NO: 447274 - DNA, 140 bp, Artificial Sequence
  Synthetic
caccgctgtcccaaaaggtccctgcttctcgcctatcatcaaatggatcaatagctatcagggtccccttcaccaacagaggccgctcatctccatcacaagagtacataaactcctcctcatatcagcagccagggcct

SEQ ID NO: 447275 - DNA, 140 bp, Artificial Sequence
  Synthetic
aggccctggctgctgatatgaaggggaccctgatagctattgatccatttgatgataggcgagaagcagggggggaatcaacagttgtgaatccaaaatctggatcttggaacttctttggaccttttgggacagcggtg

SEQ ID NO: 447276 - DNA, 140 bp, Artificial Sequence
  Synthetic
caccgctgtcccaaaaggtccaaagaagttccaagatccagattttggattcacaactgttgattccccccctgcttctcgcctatcatcaaatggatcaatagctatcagggtccccttcatatcagcagccagggcct

SEQ ID NO: 447277 - DNA, 140 bp, Artificial Sequence
  Synthetic
aggccctggctgctgatatgactggttttctggacttatgagttggtttggagggcctcttaagactatactcctaatttgcctgtatgtagcattatcaattgggctctttttccttctgaccttttgggacagcggtg

SEQ ID NO: 447278 - DNA, 140 bp, Artificial Sequence
  Synthetic
caccgctgtcccaaaaggtcagaaggaaaaagagcccaattgataatgctacatacaggcaaattaggagtatagtcttaagaggccctccaaaccaactcataagtccagaaaaccagtcatatcagcagccagggcct

SEQ ID NO: 447279 - DNA, 140 bp, Artificial Sequence
  Synthetic
aggccctggctgctgatatgctcctaatttgcctgtatgtagcattatcaattgggctctttttccttcttatatatcttggaagaacaggtctctccaaaatgtggcttgctgccactagaccttttgggacagcggtg

SEQ ID NO: 447280 - DNA, 140 bp, Artificial Sequence
  Synthetic
caccgctgtcccaaaaggtctagtggcagcaagccacattttggagagacctgttcttccaagatatataagaaggaaaaagagcccaattgataatgctacatacaggcaaattaggagcatatcagcagccagggcct

SEQ ID NO: 447281 - DNA, 140 bp, Artificial Sequence
  Synthetic
aggccctggctgctgatatgcccctgggcagccacttaggctgctgtcttgtacgcctgagcagctgccatgacagccgctgacggcttcccattagaatccacaagcccaaaagctttcgaccttttgggacagcggtg

SEQ ID NO: 447282 - DNA, 140 bp, Artificial Sequence
  Synthetic
caccgctgtcccaaaaggtcgaaagcttttgggcttgtggattctaatgggaagccgtcagcggctgtcatggcagctgctcaggcgtacaagacagcagcctaagtggctgcccaggggcatatcagcagccagggcct

SEQ ID NO: 447283 - DNA, 140 bp, Artificial Sequence
  Synthetic
aggccctggctgctgatatgaatataaaaaaatctaattatgtaaatattgtacagataggtcaaactattaggatacccaagtttagaatcttatacaatagtactttagatgtgagctgaccttttgggacagcggtg

SEQ ID NO: 447284 - DNA, 140 bp, Artificial Sequence
  Synthetic
caccgctgtcccaaaaggtcagctcacatctaaagtactattgtataagattctaaacttgggtatcctaatagtttgacctatctgtacaatatttacataattagatttttttatattcatatcagcagccagggcct

SEQ ID NO: 447285 - DNA, 140 bp, Artificial Sequence
  Synthetic
atacgccatgctgggtctcctaggatacccaagtttagaatcttatacaatagtactttagatgtgagcttagttgtaatttggggtggtggggtgaggcagcagcagtctcaagcacttcgtacttgggagtcggccat

SEQ ID NO: 447286 - DNA, 140 bp, Artificial Sequence
  Synthetic
atggccgactcccaagtacgaagtgcttgagactgctgctgcctcaccccaccaccccaaattacaactaagctcacatctaaagtactattgtataagattctaaacttgggtatcctaggagacccagcatggcgtat

SEQ ID NO: 447287 - DNA, 140 bp, Artificial Sequence
  Synthetic
aggccctggctgctgatatgcagtctcaagcacttgtggatattctagtcggcgtgattgtcttttgccagattagctgggaattaaactaactctttgaagttgcaccggtctttgtgtgaccttttgggacagcggtg

SEQ ID NO: 447288 - DNA, 140 bp, Artificial Sequence
  Synthetic
caccgctgtcccaaaaggtcacacaaagaccggtgcaacttcaaagagttagtttaattcccagctaatctggcaaaagacaatcacgccgactagaatatccacaagtgcttgagactgcatatcagcagccagggcct

SEQ ID NO: 447289 - DNA, 140 bp, Artificial Sequence
  Synthetic
atacgccatgctgggtctccgttctagaaacaggtcggtgctccagcaaagactatgatttatcaaaggttctcttcagaactctacagagaccagaagagagcattaggatagatgatccgtacttgggagtcggccat

SEQ ID NO: 447290 - DNA, 140 bp, Artificial Sequence
  Synthetic
atggccgactcccaagtacggatcatctatcctaatgctctcttctggtctctgtagagttctgaagagaacctttgataaatcatagtctttgctggagcaccgacctgtttctagaacggagacccagcatggcgtat

SEQ ID NO: 447291 - DNA, 140 bp, Artificial Sequence
  Synthetic
aggccctggctgctgatatgttcacgatttcacctttggccacttagctgacaagactgacagactgttaatgcgtgagtttcccatgatgaatgacgggtttgatcatttgagccctgagaccttttgggacagcggtg

SEQ ID NO: 447292 - DNA, 140 bp, Artificial Sequence
  Synthetic
caccgctgtcccaaaaggtctcagggctcaaatgatcaaacccgtcattcatcatgggaaactcacgcattaacagtctgtcagtcttgtcagctaagtggccaaaggtgaaatcgtgaacatatcagcagccagggcct

SEQ ID NO: 447293 - DNA, 140 bp, Artificial Sequence
  Synthetic
aggccctggctgctgatatgcatgatcatcaaaaccacttctggcatgtacaacatcgttgagttcaccacctttaggggagatgaaagaggtgcattccaggctgccatgactaaactcgaccttttgggacagcggtg

SEQ ID NO: 447294 - DNA, 140 bp, Artificial Sequence
  Synthetic
caccgctgtcccaaaaggtcgagtttagtcatggcagcctggaatgcacctctttcatctcccctaaaggtggtgaactcaacgatgttgtacatgccagaagtggttttgatgatcatgcatatcagcagccagggcct

SEQ ID NO: 447295 - DNA, 140 bp, Artificial Sequence
  Synthetic
aggccctggctgctgatatggggattcactcagagaggaggagatgccagaagagctctcctgttccatatcaggcataagagaggttaagacctcaagccaggaattatacagggcactgaccttttgggacagcggtg

SEQ ID NO: 447296 - DNA, 140 bp, Artificial Sequence
  Synthetic
caccgctgtcccaaaaggtcagtgccctgtataattcctggcttgaggtcttaacctctcttatgcctgatatggaacaggagagctcttctggcatctcctcctctctgagtgaatccccatatcagcagccagggcct

SEQ ID NO: 447297 - DNA, 140 bp, Artificial Sequence
  Synthetic
aggccctggctgctgatatgtctttatgttgttagcgcctatcggcatggtgtttggtctaatttggagctggaggactctgaagcagaggagatggtttataggtatagacttgctcttgaccttttgggacagcggtg

SEQ ID NO: 447298 - DNA, 140 bp, Artificial Sequence
  Synthetic
caccgctgtcccaaaaggtcaagagcaagtctatacctataaaccatctcctctgcttcagagtcctccagctccaaattagaccaaacaccatgccgataggcgctaacaacataaagacatatcagcagccagggcct

SEQ ID NO: 447299 - DNA, 140 bp, Artificial Sequence
  Synthetic
atacgccatgctgggtctcctggaggactctgaagcagaggagatggtttataggtatagacttgctcttagtgtaatggatgagctaaggaccttgtttccagaactgtcatccacagacgtacttgggagtcggccat

SEQ ID NO: 447300 - DNA, 140 bp, Artificial Sequence
  Synthetic
atggccgactcccaagtacgtctgtggatgacagttctggaaacaaggtccttagctcatccattacactaagagcaagtctatacctataaaccatctcctctgcttcagagtcctccaggagacccagcatggcgtat

SEQ ID NO: 447301 - DNA, 140 bp, Artificial Sequence
  Synthetic
aggccctggctgctgatatgcacatgtaaacctgtgacatatgctggggcatgtagcagttttgatgtcttgctcgaaaagggaaaattccccctcttccagtcatatgctcatcatagagaccttttgggacagcggtg

SEQ ID NO: 447302 - DNA, 140 bp, Artificial Sequence
  Synthetic
caccgctgtcccaaaaggtctctatgatgagcatatgactggaagagggggaattttcccttttcgagcaagacatcaaaactgctacatgccccagcatatgtcacaggtttacatgtgcatatcagcagccagggcct

SEQ ID NO: 447303 - DNA, 140 bp, Artificial Sequence
  Synthetic
aggccctggctgctgatatggtgatgacgatggatttgttgaggttgattagagattaaggctgccccaccccccacccccaatcccgaccgtaaccccaaccacccccttttccccaaagaccttttgggacagcggtg

SEQ ID NO: 447304 - DNA, 140 bp, Artificial Sequence
  Synthetic
caccgctgtcccaaaaggtctttggggaaaagggggtggttggggttacggtcgggattgggggtggggggtggggcagccttaatctctaatcaacctcaacaaatccatcgtcatcaccatatcagcagccagggcct

SEQ ID NO: 447305 - DNA, 140 bp, Artificial Sequence
  Synthetic
aggccctggctgctgatatgtccaaataaattggtcagtcacagaatccgtgtttccaccctttagcagagaaatgtttgacaggtttagatcttctcctcccgactcagagtatatcacgaccttttgggacagcggtg

SEQ ID NO: 447306 - DNA, 140 bp, Artificial Sequence
  Synthetic
caccgctgtcccaaaaggtcgtgatatactctgagtcgggaggagaagatctaaacctgtcaaacatttctctgctaaagggtggaaacacggattctgtgactgaccaatttatttggacatatcagcagccagggcct

SEQ ID NO: 447307 - DNA, 140 bp, Artificial Sequence
  Synthetic
aggccctggctgctgatatgattccttctttgctgaagggaatgataaagttctgagattttcaaaaaatgctgaggagtgttccttggcaatagagagagctttaaatcagtatagggcgaccttttgggacagcggtg

SEQ ID NO: 447308 - DNA, 140 bp, Artificial Sequence
  Synthetic
caccgctgtcccaaaaggtcgccctatactgatttaaagctctctctattgccaaggaacactcctcagcattttttgaaaatctcagaactttatcattcccttcagcaaagaaggaatcatatcagcagccagggcct

SEQ ID NO: 447309 - DNA, 140 bp, Artificial Sequence
  Synthetic
atacgccatgctgggtctccgctgaggagtgttccttggcaatagagagagctttaaatcagtatagggcagaagacaaccttagggacctcaatgaccacaagtcaactattcagctgccgtacttgggagtcggccat

SEQ ID NO: 447310 - DNA, 140 bp, Artificial Sequence
  Synthetic
atggccgactcccaagtacggcagctgaatagttgacttgtggtcattgaggtccctaaggttgtcttctgccctatactgatttaaagctctctctattgccaaggaacactcctcagcggagacccagcatggcgtat

SEQ ID NO: 447311 - DNA, 140 bp, Artificial Sequence
  Synthetic
atacgccatgctgggtctccagaagacaaccttagggacctcaatgaccacaagtcaactattcagctgcctccctggctgtcctatcatgatgtcgatggcaaagatctatgccctcttcgtacttgggagtcggccat

SEQ ID NO: 447312 - DNA, 140 bp, Artificial Sequence
  Synthetic
atggccgactcccaagtacgaagagggcatagatctttgccatcgacatcatgataggacagccagggaggcagctgaatagttgacttgtggtcattgaggtccctaaggttgtcttctggagacccagcatggcgtat

SEQ ID NO: 447313 - DNA, 140 bp, Artificial Sequence
  Synthetic
aggccctggctgctgatatgtgtgtctttcgcaattaagcgctcttgctgggcctttgatctctccacttccagggttttcaaaccctacatagatgctggggatctgttagttactgacgaccttttgggacagcggtg

SEQ ID NO: 447314 - DNA, 140 bp, Artificial Sequence
  Synthetic
caccgctgtcccaaaaggtcgtcagtaactaacagatccccagcatctatgtagggtttgaaaaccctggaagtggagagatcaaaggcccagcaagagcgcttaattgcgaaagacacacatatcagcagccagggcct

SEQ ID NO: 447315 - DNA, 140 bp, Artificial Sequence
  Synthetic
atacgccatgctgggtctcccagtctcaattacttgtggatatcctaatcggcgtggttgtcttttgccagattagctgggaattaaactaactctttgaagttgcaccggtctttgtgtcgtacttgggagtcggccat

SEQ ID NO: 447316 - DNA, 140 bp, Artificial Sequence
  Synthetic
atggccgactcccaagtacgacacaaagaccggtgcaacttcaaagagttagtttaattcccagctaatctggcaaaagacaaccacgccgattaggatatccacaagtaattgagactgggagacccagcatggcgtat

SEQ ID NO: 447317 - DNA, 140 bp, Artificial Sequence
  Synthetic
atacgccatgctgggtctccaagaagtgcactggggacgcagcattttgctctgcttatgagtgcactgctcaatacgccaatgcctattgttcacatgctaatgggtcaggaattgtaccgtacttgggagtcggccat

SEQ ID NO: 447318 - DNA, 140 bp, Artificial Sequence
  Synthetic
atggccgactcccaagtacggtacaattcctgacccattagcatgtgaacaataggcattggcgtattgagcagtgcactcataagcagagcaaaatgctgcgtccccagtgcacttcttggagacccagcatggcgtat

SEQ ID NO: 447319 - DNA, 140 bp, Artificial Sequence
  Synthetic
atacgccatgctgggtctccatccatggtggtcccggtgacaggaagccactcactcaagacgaccagagcctggcaagtccagccagccaaggcggcagcaactcgtgatagagtcaaccgtacttgggagtcggccat

SEQ ID NO: 447320 - DNA, 140 bp, Artificial Sequence
  Synthetic
atggccgactcccaagtacggttgactctatcacgagttgctgccgccttggctggctggacttgccaggctctggtcgtcttgagtgagtggcttcctgtcaccgggaccaccatggatggagacccagcatggcgtat

SEQ ID NO: 447321 - DNA, 140 bp, Artificial Sequence
  Synthetic
aggccctggctgctgatatgcatgatgtggatcacatatctgaatttctctctgcatgctctagtgacttgtgggcaacagatgaagacctgtacaaccctctctcttgtgataaagagcgaccttttgggacagcggtg

SEQ ID NO: 447322 - DNA, 140 bp, Artificial Sequence
  Synthetic
caccgctgtcccaaaaggtcgctctttatcacaagagagagggttgtacaggtcttcatctgttgcccacaagtcactagagcatgcagagagaaattcagatatgtgatccacatcatgcatatcagcagccagggcct

SEQ ID NO: 447323 - DNA, 140 bp, Artificial Sequence
  Synthetic
aggccctggctgctgatatgctccacagttgctttgccttctttcgacattttcatcatcatcctccggggcttgttgccacgagttagagccagaacaatcattttcttggcatccttcgaccttttgggacagcggtg

SEQ ID NO: 447324 - DNA, 140 bp, Artificial Sequence
  Synthetic
caccgctgtcccaaaaggtcgaaggatgccaagaaaatgattgttctggctctaactcgtggcaacaagccccggaggatgatgatgaaaatgtcgaaagaaggcaaagcaactgtggagcatatcagcagccagggcct

SEQ ID NO: 447325 - DNA, 140 bp, Artificial Sequence
  Synthetic
aggccctggctgctgatatgttcaatgagatcataacagagcactacaaatttatgggaagtaggataggttcatggtgccaaatggttagtctgataggagctgagttatcagcttctggaccttttgggacagcggtg

SEQ ID NO: 447326 - DNA, 140 bp, Artificial Sequence
  Synthetic
caccgctgtcccaaaaggtccagaagctgataactcagctcctatcagactaaccatttggcaccatgaacctatcctacttcccataaatttgtagtgctctgttatgatctcattgaacatatcagcagccagggcct

SEQ ID NO: 447327 - DNA, 140 bp, Artificial Sequence
  Synthetic
atacgccatgctgggtctcctaaagcaacatgtcaagcctaactattttgtgattaaacgactactaggttctgggattttcttgctgattaagcccacttccagcaaaagccatatattcgtacttgggagtcggccat

SEQ ID NO: 447328 - DNA, 140 bp, Artificial Sequence
  Synthetic
atggccgactcccaagtacgaatatatggcttttgctggaagtgggcttaatcagcaagaaaatcccagaacctagtagtcgtttaatcacaaaatagttaggcttgacatgttgctttaggagacccagcatggcgtat

SEQ ID NO: 447329 - DNA, 140 bp, Artificial Sequence
  Synthetic
aggccctggctgctgatatgtgtgtctttcgcaatcaagcgctcttgctgggcctttgatctctccacttccagggttttcaaaccctacatagatgctggggatctgttagttactgacgaccttttgggacagcggtg

SEQ ID NO: 447330 - DNA, 140 bp, Artificial Sequence
  Synthetic
caccgctgtcccaaaaggtcgtcagtaactaacagatccccagcatctatgtagggtttgaaaaccctggaagtggagagatcaaaggcccagcaagagcgcttgattgcgaaagacacacatatcagcagccagggcct

SEQ ID NO: 447331 - DNA, 140 bp, Artificial Sequence
  Synthetic
aggccctggctgctgatatgccagggttttcaaaccctacatagatgctggggatctgttagttactgactttgtttcttacaaactaagtaagcttactaacctctgcaagtgcgtttcgaccttttgggacagcggtg

SEQ ID NO: 447332 - DNA, 140 bp, Artificial Sequence
  Synthetic
caccgctgtcccaaaaggtcgaaacgcacttgcagaggttagtaagcttacttagtttgtaagaaacaaagtcagtaactaacagatccccagcatctatgtagggtttgaaaaccctggcatatcagcagccagggcct

SEQ ID NO: 447333 - DNA, 140 bp, Artificial Sequence
  Synthetic
atacgccatgctgggtctcctttgtttcttacaaactaagtaagcttactaacctctgcaagtgcgtttcattgatggagtcctctttctcattctgggcagaagcatttggaattccaacgtacttgggagtcggccat

SEQ ID NO: 447334 - DNA, 140 bp, Artificial Sequence
  Synthetic
atggccgactcccaagtacgttggaattccaaatgcttctgcccagaatgagaaagaggactccatcaatgaaacgcacttgcagaggttagtaagcttacttagtttgtaagaaacaaaggagacccagcatggcgtat

SEQ ID NO: 447335 - DNA, 140 bp, Artificial Sequence
  Synthetic
atacgccatgctgggtctccgctggaactttgttggtgacttgttcaggtcctcagactctgcagcaatggatgcctcatatatgggtaaactttctttattgacccttttggaagacaacgtacttgggagtcggccat

SEQ ID NO: 447336 - DNA, 140 bp, Artificial Sequence
  Synthetic
atggccgactcccaagtacgttgtcttccaaaagggtcaataaagaaagtttacccatatatgaggcatccattgctgcagagtctgaggacctgaacaagtcaccaacaaagttccagcggagacccagcatggcgtat

SEQ ID NO: 447337 - DNA, 140 bp, Artificial Sequence
  Synthetic
atacgccatgctgggtctccgccatagacttcaatctggacgacatacaaggagcatctgaaataggctcaactttgctaccctccatgtcaatagatgtggaagacatggctaattttgcgtacttgggagtcggccat

SEQ ID NO: 447338 - DNA, 140 bp, Artificial Sequence
  Synthetic
atggccgactcccaagtacgcaaaattagccatgtcttccacatctattgacatggagggtagcaaagttgagcctatttcagatgctccttgtatgtcgtccagattgaagtctatggcggagacccagcatggcgtat

SEQ ID NO: 447339 - DNA, 140 bp, Artificial Sequence
  Synthetic
atacgccatgctgggtctcctttcccaaagttctcagatcagagctgcaggtttacttattaaactgcttatgcagaactatccagagaatagcaagtgagccctttattcttaagaagacgtacttgggagtcggccat

SEQ ID NO: 447340 - DNA, 140 bp, Artificial Sequence
  Synthetic
atggccgactcccaagtacgtcttcttaagaataaagggctcacttgctattctctggatagttctgcataagcagtttaataagtaaacctgcagctctgatctgagaactttgggaaaggagacccagcatggcgtat

SEQ ID NO: 447341 - DNA, 140 bp, Artificial Sequence
  Synthetic
aggccctggctgctgatatgccactgcttgacatgcaaccactcatcagctgttgttacaatggttactttaaaaataaagaagaagagactgagccttcgtccctttctgggatgtatagaccttttgggacagcggtg

SEQ ID NO: 447342 - DNA, 140 bp, Artificial Sequence
  Synthetic
caccgctgtcccaaaaggtctatacatcccagaaagggacgaaggctcagtctcttcttctttatttttaaagtaaccattgtaacaacagctgatgagtggttgcatgtcaagcagtggcatatcagcagccagggcct

SEQ ID NO: 447343 - DNA, 140 bp, Artificial Sequence
  Synthetic
aggccctggctgctgatatgcctggcatgtccagccagccagggcggcagcaactcgtgatagagtcaactcatctcgggaaggattcccttcctttagtttatatctgttgatgagagcgaccttttgggacagcggtg

SEQ ID NO: 447344 - DNA, 140 bp, Artificial Sequence
  Synthetic
caccgctgtcccaaaaggtcgctctcatcaacagatataaactaaaggaagggaatccttcccgagatgagttgactctatcacgagttgctgccgccctggctggctggacatgccaggcatatcagcagccagggcct

SEQ ID NO: 447345 - DNA, 140 bp, Artificial Sequence
  Synthetic
aggccctggctgctgatatgagagggattgacctgtgcctgttaccaggctttgacctcatgtatgaggttgctcacgtccagtgtgttcggctcctgcaggcagcaaaagaggacatttgaccttttgggacagcggtg

SEQ ID NO: 447346 - DNA, 140 bp, Artificial Sequence
  Synthetic
caccgctgtcccaaaaggtcaaatgtcctcttttgctgcctgcaggagccgaacacactggacgtgagcaacctcatacatgaggtcaaagcctggtaacaggcacaggtcaatccctctcatatcagcagccagggcct

SEQ ID NO: 447347 - DNA, 140 bp, Artificial Sequence
  Synthetic
atacgccatgctgggtctccgggctgactctagaaaggctagccacacttaaggccacaagcaactttaatgagaattggtatgtctataaagatgtggcagacaagaactacacaagggcgtacttgggagtcggccat

SEQ ID NO: 447348 - DNA, 140 bp, Artificial Sequence
  Synthetic
atggccgactcccaagtacgcccttgtgtagttcttgtctgccacatctttatagacataccaattctcattaaagttgcttgtggccttaagtgtggctagcctttctagagtcagcccggagacccagcatggcgtat

SEQ ID NO: 447349 - DNA, 140 bp, Artificial Sequence
  Synthetic
atacgccatgctgggtctccgtcttgtgatgccgccttcttaaatttaacaggttgctattcctgcaatgcaggagccagagtctgcttgtctatcacatccacaggaactggaactctccgtacttgggagtcggccat

SEQ ID NO: 447350 - DNA, 140 bp, Artificial Sequence
  Synthetic
atggccgactcccaagtacggagagttccagttcctgtggatgtgatagacaagcagactctggctcctgcattgcaggaatagcaacctgttaaatttaagaaggcggcatcacaagacggagacccagcatggcgtat

SEQ ID NO: 447351 - DNA, 140 bp, Artificial Sequence
  Synthetic
atacgccatgctgggtctcccacctctcctaaatggtggccactgatcattaggggatgttcaatgtttaccaggaaaaggatgatgatgaatttgaattatcttaagatcctggatggtcgtacttgggagtcggccat

SEQ ID NO: 447352 - DNA, 140 bp, Artificial Sequence
  Synthetic
atggccgactcccaagtacgaccatccaggatcttaagataattcaaattcatcatcatccttttcctggtaaacattgaacatcccctaatgatcagtggccaccatttaggagaggtgggagacccagcatggcgtat

SEQ ID NO: 447353 - DNA, 140 bp, Artificial Sequence
  Synthetic
aggccctggctgctgatatgccaggaaaaggatgatgatgaatttgaattatcttaagatcctggatggtcatcgggagcttgatattagagatgactttgtgatggatctcttcaaagcgaccttttgggacagcggtg

SEQ ID NO: 447354 - DNA, 140 bp, Artificial Sequence
  Synthetic
caccgctgtcccaaaaggtcgctttgaagagatccatcacaaagtcatctctaatatcaagctcccgatgaccatccaggatcttaagataattcaaattcatcatcatccttttcctggcatatcagcagccagggcct

SEQ ID NO: 447355 - DNA, 140 bp, Artificial Sequence
  Synthetic
atacgccatgctgggtctccaggggaatcaacagttgtgaatccaaaatctggttcttggaatttctttgactggttttctggacttatgagttggtttggagggcctcttaagaccatacgtacttgggagtcggccat

SEQ ID NO: 447356 - DNA, 140 bp, Artificial Sequence
  Synthetic
atggccgactcccaagtacgtatggtcttaagaggccctccaaaccaactcataagtccagaaaaccagtcaaagaaattccaagaaccagattttggattcacaactgttgattcccctggagacccagcatggcgtat

SEQ ID NO: 447357 - DNA, 140 bp, Artificial Sequence
  Synthetic
aggccctggctgctgatatgactggttttctggacttatgagttggtttggagggcctcttaagaccatactcctaatttgcctgtatgtggcattatcaattgggctctttttcctcctgaccttttgggacagcggtg

SEQ ID NO: 447358 - DNA, 140 bp, Artificial Sequence
  Synthetic
caccgctgtcccaaaaggtcaggaggaaaaagagcccaattgataatgccacatacaggcaaattaggagtatggtcttaagaggccctccaaaccaactcataagtccagaaaaccagtcatatcagcagccagggcct

SEQ ID NO: 447359 - DNA, 140 bp, Artificial Sequence
  Synthetic
aggccctggctgctgatatgtgatgcaaggatcagatgatagtagcatgctaatcagcttcccagctgatgacgagaaggttctcaccagatgcaaagtggccgcagccatatgcttccggaccttttgggacagcggtg

SEQ ID NO: 447360 - DNA, 140 bp, Artificial Sequence
  Synthetic
caccgctgtcccaaaaggtccggaagcatatggctgcggccactttgcatctggtgagaaccttctcgtcatcagctgggaagctgattagcatgctactatcatctgatccttgcatcacatatcagcagccagggcct

SEQ ID NO: 447361 - DNA, 140 bp, Artificial Sequence
  Synthetic
atacgccatgctgggtctccgacgagaaggttctcaccagatgcaaagtggccgcagccatatgcttccgcatgaagaaggagctgggagtgtaccttgccatttacccctcagagaagtcgtacttgggagtcggccat

SEQ ID NO: 447362 - DNA, 140 bp, Artificial Sequence
  Synthetic
atggccgactcccaagtacgacttctctgaggggtaaatggcaaggtacactcccagctccttcttcatgcggaagcatatggctgcggccactttgcatctggtgagaaccttctcgtcggagacccagcatggcgtat

SEQ ID NO: 447363 - DNA, 140 bp, Artificial Sequence
  Synthetic
atacgccatgctgggtctcccagtctcaagtacttgtggatattctagttggcgtgattgtcttttgccagactagctgggaattaaactaactctttgaagttgcaccggtctttgtgtcgtacttgggagtcggccat

SEQ ID NO: 447364 - DNA, 140 bp, Artificial Sequence
  Synthetic
atggccgactcccaagtacgacacaaagaccggtgcaacttcaaagagttagtttaattcccagctagtctggcaaaagacaatcacgccaactagaatatccacaagtacttgagactgggagacccagcatggcgtat

SEQ ID NO: 447365 - DNA, 140 bp, Artificial Sequence
  Synthetic
aggccctggctgctgatatgcacacccagcatgttagacctacgatcaggtggattgcagcatgttgcagcctgccagaagtggaaacactagtagcccgccaagaagaggcctctaatcgaccttttgggacagcggtg

SEQ ID NO: 447366 - DNA, 140 bp, Artificial Sequence
  Synthetic
caccgctgtcccaaaaggtcgattagaggcctcttcttggcgggctactagtgtttccacttctggcaggctgcaacatgctgcaatccacctgatcgtaggtctaacatgctgggtgtgcatatcagcagccagggcct

SEQ ID NO: 447367 - DNA, 140 bp, Artificial Sequence
  Synthetic
aggccctggctgctgatatgattcagcaagctcagtgcactctccattacatgctgatgggcatgggagtgtctgagctattcttagagtataagaaggcagtgctaaagtggaatgaccgaccttttgggacagcggtg

SEQ ID NO: 447368 - DNA, 140 bp, Artificial Sequence
  Synthetic
caccgctgtcccaaaaggtcggtcattccactttagcactgccttcttatactctaagaatagctcagacactcccatgcccatcagcatgtaatggagagtgcactgagcttgctgaatcatatcagcagccagggcct

SEQ ID NO: 447369 - DNA, 140 bp, Artificial Sequence
  Synthetic
aggccctggctgctgatatggatcaacagggttcaagatatcatctgcagttgcttgtgctagcggagtttgcgtcacaggatcacagagcccttctaccgagattacactcaagtatccgaccttttgggacagcggtg

SEQ ID NO: 447370 - DNA, 140 bp, Artificial Sequence
  Synthetic
caccgctgtcccaaaaggtcggatacttgagtgtaatctcggtagaagggctctgtgatcctgtgacgcaaactccgctagcacaagcaactgcagatgatatcttgaaccctgttgatccatatcagcagccagggcct

SEQ ID NO: 447371 - DNA, 140 bp, Artificial Sequence
  Synthetic
aggccctggctgctgatatgctggcctaggtttcttcctgcttgacaatccttatgcgtgcgggttgggaggttttagatttaatctcttcaaagctatcaccagaactgatttgcagaagaccttttgggacagcggtg

SEQ ID NO: 447372 - DNA, 140 bp, Artificial Sequence
  Synthetic
caccgctgtcccaaaaggtcttctgcaaatcagttctggtgatagctttgaagagattaaatctaaaacctcccaacccgcacgcataaggattgtcaagcaggaagaaacctaggccagcatatcagcagccagggcct

SEQ ID NO: 447373 - DNA, 140 bp, Artificial Sequence
  Synthetic
aggccctggctgctgatatgggttttagatttaatctcttcaaagctatcaccagaactgatttgcagaagctatatgccttcttcatgaagaaggtcaagggctcagctgctagggactgaccttttgggacagcggtg

SEQ ID NO: 447374 - DNA, 140 bp, Artificial Sequence
  Synthetic
caccgctgtcccaaaaggtcagtccctagcagctgagcccttgaccttcttcatgaagaaggcatatagcttctgcaaatcagttctggtgatagctttgaagagattaaatctaaaacccatatcagcagccagggcct

SEQ ID NO: 447375 - DNA, 140 bp, Artificial Sequence
  Synthetic
aggccctggctgctgatatggctatatgccttcttcatgaagaaggtcaagggctcagctgctagggactgggcagatgaagatatcaccattccagaaacgtgtagcgtaagcccaggtgaccttttgggacagcggtg

SEQ ID NO: 447376 - DNA, 140 bp, Artificial Sequence
  Synthetic
caccgctgtcccaaaaggtcacctgggcttacgctacacgtttctggaatggtgatatcttcatctgcccagtccctagcagctgagcccttgaccttcttcatgaagaaggcatatagccatatcagcagccagggcct

SEQ ID NO: 447377 - DNA, 140 bp, Artificial Sequence
  Synthetic
aggccctggctgctgatatgccagtgtcacactgccctcagtgcctttgttgttgtgtttgtattcagttctattgcaataatttgtttagccattctttatagggtgctcaagtgcttagaccttttgggacagcggtg

SEQ ID NO: 447378 - DNA, 140 bp, Artificial Sequence
  Synthetic
caccgctgtcccaaaaggtctaagcacttgagcaccctataaagaatggctaaacaaattattgcaatagaactgaatacaaacacaacaacaaaggcactgagggcagtgtgacactggcatatcagcagccagggcct

SEQ ID NO: 447379 - DNA, 140 bp, Artificial Sequence
  Synthetic
atacgccatgctgggtctcctcagaaactgagagaccgtttgaacataccagagaactggatcgaactaataaatgagaatccagaggtgctctatcgggctcccagaacaggcccagaacgtacttgggagtcggccat

SEQ ID NO: 447380 - DNA, 140 bp, Artificial Sequence
  Synthetic
atggccgactcccaagtacgttctgggcctgttctgggagcccgatagagcacctctggattctcatttattagttcgatccagttctctggtatgttcaaacggtctctcagtttctgaggagacccagcatggcgtat

SEQ ID NO: 447381 - DNA, 140 bp, Artificial Sequence
  Synthetic
aggccctggctgctgatatgtaaatgagaatccagaggtgctctatcgggctcccagaacaggcccagaaatattgttgcgcattgcagagaaagtccatagcccaggtgttgtgtcatcgaccttttgggacagcggtg

SEQ ID NO: 447382 - DNA, 140 bp, Artificial Sequence
  Synthetic
caccgctgtcccaaaaggtcgatgacacaacacctgggctatggactttctctgcaatgcgcaacaatatttctgggcctgttctgggagcccgatagagcacctctggattctcatttacatatcagcagccagggcct

SEQ ID NO: 447383 - DNA, 140 bp, Artificial Sequence
  Synthetic
atacgccatgctgggtctccattgtcttctggcaatgcagtctgtaaagtcatggcctcagctgtatacttcttatcagcaacaatttttgaggacactgggcgtcctgagttcaacttccgtacttgggagtcggccat

SEQ ID NO: 447384 - DNA, 140 bp, Artificial Sequence
  Synthetic
atggccgactcccaagtacggaagttgaactcaggacgcccagtgtcctcaaaaattgttgctgataagaagtatacagctgaggccatgactttacagactgcattgccagaagacaatggagacccagcatggcgtat

SEQ ID NO: 447385 - DNA, 140 bp, Artificial Sequence
  Synthetic
atacgccatgctgggtctccatacctaatgctactgctaattgtctcatatgcatcagcatgttcagaactaattcaggcaagctccagaatcactacttgctccacagagggtgtcaaccgtacttgggagtcggccat

SEQ ID NO: 447386 - DNA, 140 bp, Artificial Sequence
  Synthetic
atggccgactcccaagtacggttgacaccctctgtggagcaagtagtgattctggagcttgcctgaattagttctgaacatgctgatgcatatgagacaattagcagtagcattaggtatggagacccagcatggcgtat

SEQ ID NO: 447387 - DNA, 140 bp, Artificial Sequence
  Synthetic
atacgccatgctgggtctccgagagaaacagataccatagagtccacctgaatgtggacttagatgatagtgtctacatagctgctttgggagttaatgggaaaaagcataaagcagatacgtacttgggagtcggccat

SEQ ID NO: 447388 - DNA, 140 bp, Artificial Sequence
  Synthetic
atggccgactcccaagtacgtatctgctttatgctttttcccattaactcccaaagcagctatgtagacactatcatctaagtccacattcaggtggactctatggtatctgtttctctcggagacccagcatggcgtat

SEQ ID NO: 447389 - DNA, 140 bp, Artificial Sequence
  Synthetic
aggccctggctgctgatatgaccttcctggctgaatgggaaaagctaaagaaaattgtgaagtggttagaagacactccagaagcaactctagctcacactccactgaataaccatattcgaccttttgggacagcggtg

SEQ ID NO: 447390 - DNA, 140 bp, Artificial Sequence
  Synthetic
caccgctgtcccaaaaggtcgaatatggttattcagtggagtgtgagctagagttgcttctggagtgtcttctaaccacttcacaattttctttagcttttcccattcagccaggaaggtcatatcagcagccagggcct

SEQ ID NO: 447391 - DNA, 140 bp, Artificial Sequence
  Synthetic
atacgccatgctgggtctccagacactccagaagcaactctagctcacactccactgaataaccatattcaagttaggaatttctttgctagaatggaaagcaagcctagaacggtcagacgtacttgggagtcggccat

SEQ ID NO: 447392 - DNA, 140 bp, Artificial Sequence
  Synthetic
atggccgactcccaagtacgtctgaccgttctaggcttgctttccattctagcaaagaaattcctaacttgaatatggttattcagtggagtgtgagctagagttgcttctggagtgtctggagacccagcatggcgtat

SEQ ID NO: 447393 - DNA, 140 bp, Artificial Sequence
  Synthetic
aggccctggctgctgatatgaagttaggaatttctttgctagaatggaaagcaagcctagaacggtcagaataacaggagctcctgtaaagaagaggtcaggggttagcaagatagccatgaccttttgggacagcggtg

SEQ ID NO: 447394 - DNA, 140 bp, Artificial Sequence
  Synthetic
caccgctgtcccaaaaggtcatggctatcttgctaacccctgacctcttctttacaggagctcctgttattctgaccgttctaggcttgctttccattctagcaaagaaattcctaacttcatatcagcagccagggcct

SEQ ID NO: 447395 - DNA, 140 bp, Artificial Sequence
  Synthetic
aggccctggctgctgatatgggttatccgtgacaatttctcccggataggccatcttcgaggtgtagaagacctcgctggcttcactcgtagtgtgtcagctgaaatcctcaagcattttgaccttttgggacagcggtg

SEQ ID NO: 447396 - DNA, 140 bp, Artificial Sequence
  Synthetic
caccgctgtcccaaaaggtcaaaatgcttgaggatttcagctgacacactacgagtgaagccagcgaggtcttctacacctcgaagatggcctatccgggagaaattgtcacggataacccatatcagcagccagggcct

SEQ ID NO: 447397 - DNA, 140 bp, Artificial Sequence
  Synthetic
atacgccatgctgggtctcctggaacaaaagatcaatgccagatactacacttcactgtacctgaagtagaggaggagtttatgtactcttgtgatggagatgagcggcctctattagtgcgtacttgggagtcggccat

SEQ ID NO: 447398 - DNA, 140 bp, Artificial Sequence
  Synthetic
atggccgactcccaagtacgcactaatagaggccgctcatctccatcacaagagtacataaactcctcctctacttcaggtacagtgaagtgtagtatctggcattgatcttttgttccaggagacccagcatggcgtat

SEQ ID NO: 447399 - DNA, 140 bp, Artificial Sequence
  Synthetic
atacgccatgctgggtctccctcctcatttgcctgtatgttgcattatcaattgggctctttttcctcctcatatatcttggaagaacagggctctctaaaatgtggcttgctgctactacgtacttgggagtcggccat

SEQ ID NO: 447400 - DNA, 140 bp, Artificial Sequence
  Synthetic
atggccgactcccaagtacgtagtagcagcaagccacattttagagagccctgttcttccaagatatatgaggaggaaaaagagcccaattgataatgcaacatacaggcaaatgaggagggagacccagcatggcgtat

SEQ ID NO: 447401 - DNA, 140 bp, Artificial Sequence
  Synthetic
aggccctggctgctgatatgattatggagttgggatctggagaggcttcatggatggatatcaggtccatcttgagatagaaaatgacataggacagcccccaaggcttaggaatgtcacgaccttttgggacagcggtg

SEQ ID NO: 447402 - DNA, 140 bp, Artificial Sequence
  Synthetic
caccgctgtcccaaaaggtcgtgacattcctaagccttgggggctgtcctatgtcattttctatctcaagatggacctgatatccatccatgaagcctctccagatcccaactccataatcatatcagcagccagggcct

SEQ ID NO: 447403 - DNA, 140 bp, Artificial Sequence
  Synthetic
atacgccatgctgggtctccgacatgagcaaacctaattatgtaaatattgtacagataggtcaaattattgggatatctaagcttagaaacttctgcaataatactttagatataagctcgtacttgggagtcggccat

SEQ ID NO: 447404 - DNA, 140 bp, Artificial Sequence
  Synthetic
atggccgactcccaagtacgagcttatatctaaagtattattgcagaagtttctaagcttagatatcccaataatttgacctatctgtacaatatttacataattaggtttgctcatgtcggagacccagcatggcgtat

SEQ ID NO: 447405 - DNA, 140 bp, Artificial Sequence
  Synthetic
atacgccatgctgggtctccgaaatgtttgacaggtttagatcttctcctcccgactcagaatatatcacgaggatagtgagtagatgcctcataaactctcaagagaaactcatcaatacgtacttgggagtcggccat

SEQ ID NO: 447406 - DNA, 140 bp, Artificial Sequence
  Synthetic
atggccgactcccaagtacgtattgatgagtttctcttgagagtttatgaggcatctactcactatcctcgtgatatattctgagtcgggaggagaagatctaaacctgtcaaacatttcggagacccagcatggcgtat

SEQ ID NO: 447407 - DNA, 140 bp, Artificial Sequence
  Synthetic
aggccctggctgctgatatggctaagtatgaggttccttgtgagaacagatctcagggcaggactgttgttctttatgttgtcagcgcctatcggcatggtgtatggtccaatttggagcgaccttttgggacagcggtg

SEQ ID NO: 447408 - DNA, 140 bp, Artificial Sequence
  Synthetic
caccgctgtcccaaaaggtcgctccaaattggaccatacaccatgccgataggcgctgacaacataaagaacaacagtcctgccctgagatctgttctcacaaggaacctcatacttagccatatcagcagccagggcct

SEQ ID NO: 447409 - DNA, 140 bp, Artificial Sequence
  Synthetic
atacgccatgctgggtctccgtcggatctatgttctcatttgtcgccaatgtcgaggaggcccatgatgttgattatgatgcgttaatggatctaatgatagaagatgccaagaacaatgcgtacttgggagtcggccat

SEQ ID NO: 447410 - DNA, 140 bp, Artificial Sequence
  Synthetic
atggccgactcccaagtacgcattgttcttggcatcttctatcattagatccattaacgcatcataatcaacatcatgggcctcctcgacattggcgacaaatgagaacatagatccgacggagacccagcatggcgtat

SEQ ID NO: 447411 - DNA, 140 bp, Artificial Sequence
  Synthetic
aggccctggctgctgatatgcattcagtcatgttgtcaattgcatagagttggatgttagtggtccttacgagatggagtcttttgatacatctgatgtcaacctctttgggccagcccagaccttttgggacagcggtg

SEQ ID NO: 447412 - DNA, 140 bp, Artificial Sequence
  Synthetic
caccgctgtcccaaaaggtctgggctggcccaaagaggttgacatcagatgtatcaaaagactccatctcgtaaggaccactaacatccaactctatgcaattgacaacatgactgaatgcatatcagcagccagggcct

SEQ ID NO: 447413 - DNA, 140 bp, Artificial Sequence
  Synthetic
aggccctggctgctgatatggagatggagtcttttgatacatctgatgtcaacctctttgggccagcccattacaaggacatcagttcattatctatgattgctcatcccttaatggatagaccttttgggacagcggtg

SEQ ID NO: 447414 - DNA, 140 bp, Artificial Sequence
  Synthetic
caccgctgtcccaaaaggtctatccattaagggatgagcaatcatagataatgaactgatgtccttgtaatgggctggcccaaagaggttgacatcagatgtatcaaaagactccatctccatatcagcagccagggcct

SEQ ID NO: 447415 - DNA, 140 bp, Artificial Sequence
  Synthetic
aggccctggctgctgatatgtggaaaccacaacagggatgatgcaggggatattgcattatacttcctcactattacacaccattcatcaagaatacatccggtccttgtcctttaaaatgaccttttgggacagcggtg

SEQ ID NO: 447416 - DNA, 140 bp, Artificial Sequence
  Synthetic
caccgctgtcccaaaaggtcattttaaaggacaaggaccggatgtattcttgatgaatggtgtgtaatagtgaggaagtataatgcaatatcccctgcatcatccctgttgtggtttccacatatcagcagccagggcct

SEQ ID NO: 447417 - DNA, 140 bp, Artificial Sequence
  Synthetic
aggccctggctgctgatatgctccctggttgtcctaccacgatgtcgatggcaaagatctgtgccctcttcagggattagatgtgagaggggaccatcccatgtgcaacttgtggagggagaccttttgggacagcggtg

SEQ ID NO: 447418 - DNA, 140 bp, Artificial Sequence
  Synthetic
caccgctgtcccaaaaggtctccctccacaagttgcacatgggatggtcccctctcacatctaatccctgaagagggcacagatctttgccatcgacatcgtggtaggacaaccagggagcatatcagcagccagggcct

SEQ ID NO: 447419 - DNA, 140 bp, Artificial Sequence
  Synthetic
aggccctggctgctgatatgtctcttcagaactctacagagaccagaagagagcattaggatagatgatctggagttatatgaggagacagatgtggcggatgacatgctaggctaagacgaccttttgggacagcggtg

SEQ ID NO: 447420 - DNA, 140 bp, Artificial Sequence
  Synthetic
caccgctgtcccaaaaggtcgtcttagcctagcatgtcatccgccacatctgtctcctcatataactccagatcatctatcctaatgctctcttctggtctctgtagagttctgaagagacatatcagcagccagggcct

SEQ ID NO: 447421 - DNA, 140 bp, Artificial Sequence
  Synthetic
aggccctggctgctgatatgttcaatgagattataacagagcactacaaatttatgggaagtaggataggatcatggtgccaaatggtcagtttgataggagctgagctatcagcctctggaccttttgggacagcggtg

SEQ ID NO: 447422 - DNA, 140 bp, Artificial Sequence
  Synthetic
caccgctgtcccaaaaggtccagaggctgatagctcagctcctatcaaactgaccatttggcaccatgatcctatcctacttcccataaatttgtagtgctctgttataatctcattgaacatatcagcagccagggcct

SEQ ID NO: 447423 - DNA, 140 bp, Artificial Sequence
  Synthetic
aggccctggctgctgatatgtgatatctgttgatttgcagagtggtcgtcgtgttgtgtcagtggagtactttagaggagatggtcctcccaggataccttattctatggttgtgccctggaccttttgggacagcggtg

SEQ ID NO: 447424 - DNA, 140 bp, Artificial Sequence
  Synthetic
caccgctgtcccaaaaggtccagggcacaaccatagaataaggtatcctgggaggaccatctcctctaaagtactccactgacacaacacgacgaccactctgcaaatcaacagatatcacatatcagcagccagggcct

SEQ ID NO: 447425 - DNA, 140 bp, Artificial Sequence
  Synthetic
aggccctggctgctgatatgattgtcttctggcaatgcagtctgtaaagtcatggcctcagctgtgtacttcttatcagcaacaatttttgaagacactgggcgtcctgagtttaacttcgaccttttgggacagcggtg

SEQ ID NO: 447426 - DNA, 140 bp, Artificial Sequence
  Synthetic
caccgctgtcccaaaaggtcgaagttaaactcaggacgcccagtgtcttcaaaaattgttgctgataagaagtacacagctgaggccatgactttacagactgcattgccagaagacaatcatatcagcagccagggcct

SEQ ID NO: 447427 - DNA, 140 bp, Artificial Sequence
  Synthetic
aggccctggctgctgatatggctggaactttgttggtgacttgttcaggtcttcagactctgcagcaatggatgcctcatacatgggcaaactttccctgttaacccttttggaggacaagaccttttgggacagcggtg

SEQ ID NO: 447428 - DNA, 140 bp, Artificial Sequence
  Synthetic
caccgctgtcccaaaaggtcttgtcctccaaaagggttaacagggaaagtttgcccatgtatgaggcatccattgctgcagagtctgaagacctgaacaagtcaccaacaaagttccagccatatcagcagccagggcct

SEQ ID NO: 447429 - DNA, 140 bp, Artificial Sequence
  Synthetic
atacgccatgctgggtctccagagggattgacctgtgcctgttgccaggctttgatctcatgtatgaggttgctcacgtacagtgcgttcggcttctgcaagcagcaaagaggacatttccgtacttgggagtcggccat

SEQ ID NO: 447430 - DNA, 140 bp, Artificial Sequence
  Synthetic
atggccgactcccaagtacggaaatgtcctctttgctgcttgcagaagccgaacgcactgtacgtgagcaacctcatacatgagatcaaagcctggcaacaggcacaggtcaatccctctggagacccagcatggcgtat

SEQ ID NO: 447431 - DNA, 140 bp, Artificial Sequence
  Synthetic
aggccctggctgctgatatgccagttattcctccaatcccagatgttgagatggaatcagaggaggagagtgatgatgatggatttgttgaggttgattagaggttaaggctgccccaccgaccttttgggacagcggtg

SEQ ID NO: 447432 - DNA, 140 bp, Artificial Sequence
  Synthetic
caccgctgtcccaaaaggtcggtggggcagccttaacctctaatcaacctcaacaaatccatcatcatcactctcctcctctgattccatctcaacatctgggattggaggaataactggcatatcagcagccagggcct

SEQ ID NO: 447433 - DNA, 140 bp, Artificial Sequence
  Synthetic
aggccctggctgctgatatgcatatatcttggaagaacagggctctctaaaatgtggcttgctgctactaagaaggcctcatagactagtacgtgtggaagcaatatgtagagataagtagaccttttgggacagcggtg

SEQ ID NO: 447434 - DNA, 140 bp, Artificial Sequence
  Synthetic
caccgctgtcccaaaaggtctacttatctctacatattgcttccacacgtactagtctatgaggccttcttagtagcagcaagccacattttagagagccctgttcttccaagatatatgcatatcagcagccagggcct

SEQ ID NO: 447435 - DNA, 140 bp, Artificial Sequence
  Synthetic
atacgccatgctgggtctccctgttctgtattctacagggcccatatagtgaaagctacaagctacagctaatctacagagtcctaagctcagtgtcaaacgttgagataaaggaatcagcgtacttgggagtcggccat

SEQ ID NO: 447436 - DNA, 140 bp, Artificial Sequence
  Synthetic
atggccgactcccaagtacgctgattcctttatctcaacgtttgacactgagcttaggactctgtagattagctgtagcttgtagctttcactatatgggccctgtagaatacagaacagggagacccagcatggcgtat

SEQ ID NO: 447437 - DNA, 140 bp, Artificial Sequence
  Synthetic
aggccctggctgctgatatgaggtttgggttgatgacccgggagaactgcagcagatacagagagtgagcatctaatattgcccttagatagtctcctggtagagaaggatccaccatgcgaccttttgggacagcggtg

SEQ ID NO: 447438 - DNA, 140 bp, Artificial Sequence
  Synthetic
caccgctgtcccaaaaggtcgcatggtggatccttctctaccaggagactatctaagggcaatattagatgctcactctctgtatctgctgcagttctcccgggtcatcaacccaaacctcatatcagcagccagggcct

SEQ ID NO: 447439 - DNA, 140 bp, Artificial Sequence
  Synthetic
aggccctggctgctgatatgcagcaaagctggggtgcatcatatgccttgggtatgcaggggataggccgtccatggtagtcccagtgacaggaagccactcactcaagacgaccaaagcgaccttttgggacagcggtg

SEQ ID NO: 447440 - DNA, 140 bp, Artificial Sequence
  Synthetic
caccgctgtcccaaaaggtcgctttggtcgtcttgagtgagtggcttcctgtcactgggactaccatggacggcctatcccctgcatacccaaggcatatgatgcaccccagctttgctgcatatcagcagccagggcct

SEQ ID NO: 447441 - DNA, 140 bp, Artificial Sequence
  Synthetic
aggccctggctgctgatatgtccatggtagtcccagtgacaggaagccactcactcaagacgaccaaagcctggcatgtccagccagccagggcggcagcaactcgtgatagagtcaactgaccttttgggacagcggtg

SEQ ID NO: 447442 - DNA, 140 bp, Artificial Sequence
  Synthetic
caccgctgtcccaaaaggtcagttgactctatcacgagttgctgccgccctggctggctggacatgccaggctttggtcgtcttgagtgagtggcttcctgtcactgggactaccatggacatatcagcagccagggcct

SEQ ID NO: 447443 - DNA, 140 bp, Artificial Sequence
  Synthetic
aggccctggctgctgatatgacacaaagacggtgcattaaatgtatgttttattaacaattctaatctcggttctggtgtgtgaagcggttattagagtgtctctaagctccacaagagagaccttttgggacagcggtg

SEQ ID NO: 447444 - DNA, 140 bp, Artificial Sequence
  Synthetic
caccgctgtcccaaaaggtctctcttgtggagcttagagacactctaataaccgcttcacacaccagaaccgagattagaattgttaataaaacatacatttaatgcaccgtctttgtgtcatatcagcagccagggcct

SEQ ID NO: 447445 - DNA, 140 bp, Artificial Sequence
  Synthetic
aggccctggctgctgatatgtgattatgatgcgttaatggatctaatgatagaagatgccaagaacaatgcattcagccacgttgtcaattgcatagaattggatgttagtggtccttacgaccttttgggacagcggtg

SEQ ID NO: 447446 - DNA, 140 bp, Artificial Sequence
  Synthetic
caccgctgtcccaaaaggtcgtaaggaccactaacatccaattctatgcaattgacaacgtggctgaatgcattgttcttggcatcttctatcattagatccattaacgcatcataatcacatatcagcagccagggcct

SEQ ID NO: 447447 - DNA, 140 bp, Artificial Sequence
  Synthetic
atacgccatgctgggtctccgttccttctttgctgaagggaatgataaggctctgagattttcaaaaaacgctgaagagtgttccttggcagtagagagagccttaaatcagtatagagccgtacttgggagtcggccat

SEQ ID NO: 447448 - DNA, 140 bp, Artificial Sequence
  Synthetic
atggccgactcccaagtacggctctatactgatttaaggctctctctactgccaaggaacactcttcagcgttttttgaaaatctcagagccttatcattcccttcagcaaagaaggaacggagacccagcatggcgtat

SEQ ID NO: 447449 - DNA, 140 bp, Artificial Sequence
  Synthetic
aggccctggctgctgatatgtatatatcttggaagaacaggcctctctaaaatgtggcttgccgctactaagaaggcctcatagttcagtacgtatagaagcaatatgtagaagtaagtagaccttttgggacagcggtg

SEQ ID NO: 447450 - DNA, 140 bp, Artificial Sequence
  Synthetic
caccgctgtcccaaaaggtctacttacttctacatattgcttctatacgtactgaactatgaggccttcttagtagcggcaagccacattttagagaggcctgttcttccaagatatatacatatcagcagccagggcct

SEQ ID NO: 447451 - DNA, 140 bp, Artificial Sequence
  Synthetic
aggccctggctgctgatatggagagaaaccatggcagggattgcaatgacagtccttccagccttagcagtttttgctttggcacctgttgtttttgctgaagacccccatctcagaaacgaccttttgggacagcggtg

SEQ ID NO: 447452 - DNA, 140 bp, Artificial Sequence
  Synthetic
caccgctgtcccaaaaggtcgtttctgagatgggggtcttcagcaaaaacaacaggtgccaaagcaaaaactgctaaggctggaaggactgtcattgcaatccctgccatggtttctctccatatcagcagccagggcct

SEQ ID NO: 447453 - DNA, 140 bp, Artificial Sequence
  Synthetic
aggccctggctgctgatatgttgttctgtatactacagggtccatacagtgagagctataagctacagctaatctacagagtcctaagctcagtatcaaacgttgagataaaggaatcaggaccttttgggacagcggtg

SEQ ID NO: 447454 - DNA, 140 bp, Artificial Sequence
  Synthetic
caccgctgtcccaaaaggtcctgattcctttatctcaacgtttgatactgagcttaggactctgtagattagctgtagcttatagctctcactgtatggaccctgtagtatacagaacaacatatcagcagccagggcct

SEQ ID NO: 447455 - DNA, 140 bp, Artificial Sequence
  Synthetic
aggccctggctgctgatatgtagctgtgaccttcagagtgctcatgggaacccctgcatgaaagagaaactcgtgatgaagacacactgtccaaatgactaccagtcagctcattacctcgaccttttgggacagcggtg

SEQ ID NO: 447456 - DNA, 140 bp, Artificial Sequence
  Synthetic
caccgctgtcccaaaaggtcgaggtaatgagctgactggtagtcatttggacagtgtgtcttcatcacgagtttctctttcatgcaggggttcccatgagcactctgaaggtcacagctacatatcagcagccagggcct

SEQ ID NO: 447457 - DNA, 140 bp, Artificial Sequence
  Synthetic
atacgccatgctgggtctccaacaatgacgggaaaatggcttcagtcaagtgccctcctaagtatgagctcactgaggactgcaacttttgtaggcagatgacaggtgctagcctgaagacgtacttgggagtcggccat

SEQ ID NO: 447458 - DNA, 140 bp, Artificial Sequence
  Synthetic
atggccgactcccaagtacgtcttcaggctagcacctgtcatctgcctacaaaagttgcagtcctcagtgagctcatacttaggagggcacttgactgaagccattttcccgtcattgttggagacccagcatggcgtat

SEQ ID NO: 447459 - DNA, 140 bp, Artificial Sequence
  Synthetic
aggccctggctgctgatatgagtgtgatggatgagctaaggaccttgttcccagaactgtcatccacagatgaggaattagggaagactgagagagagttgctagccatggtctcctccagaccttttgggacagcggtg

SEQ ID NO: 447460 - DNA, 140 bp, Artificial Sequence
  Synthetic
caccgctgtcccaaaaggtctggaggagaccatggctagcaactctctctcagtcttccctaattcctcatctgtggatgacagttctgggaacaaggtccttagctcatccatcacactcatatcagcagccagggcct

SEQ ID NO: 447461 - DNA, 140 bp, Artificial Sequence
  Synthetic
aggccctggctgctgatatggacataagcaaacctaattatgtaaatattgtacagataggtcaaattattgggatatccaagcttagaaacttatgcaataatactttagatgtaagctgaccttttgggacagcggtg

SEQ ID NO: 447462 - DNA, 140 bp, Artificial Sequence
  Synthetic
caccgctgtcccaaaaggtcagcttacatctaaagtattattgcataagtttctaagcttggatatcccaataatttgacctatctgtacaatatttacataattaggtttgcttatgtccatatcagcagccagggcct

SEQ ID NO: 447463 - DNA, 140 bp, Artificial Sequence
  Synthetic
aggccctggctgctgatatgtcaaaagctttgatatctctcagtgccccaagattggaggacatggtagtaagaagtgcactggggacgcagcattttgctctgcttatgagtgcactgcgaccttttgggacagcggtg

SEQ ID NO: 447464 - DNA, 140 bp, Artificial Sequence
  Synthetic
caccgctgtcccaaaaggtcgcagtgcactcataagcagagcaaaatgctgcgtccccagtgcacttcttactaccatgtcctccaatcttggggcactgagagatatcaaagcttttgacatatcagcagccagggcct

SEQ ID NO: 447465 - DNA, 140 bp, Artificial Sequence
  Synthetic
aggccctggctgctgatatgaagaagtgcactggggacgcagcattttgctctgcttatgagtgcactgctcagtacgccaatgcctattgttcacatgctaatgggtcagggattgtgcgaccttttgggacagcggtg

SEQ ID NO: 447466 - DNA, 140 bp, Artificial Sequence
  Synthetic
caccgctgtcccaaaaggtcgcacaatccctgacccattagcatgtgaacaataggcattggcgtactgagcagtgcactcataagcagagcaaaatgctgcgtccccagtgcacttcttcatatcagcagccagggcct

SEQ ID NO: 447467 - DNA, 140 bp, Artificial Sequence
  Synthetic
atacgccatgctgggtctccagatacaagtatcaggggtctggaagaagcctttatgtgtagggtatgagagagtggttgtgaagagagaactctctgccaagcccatccagagagttgacgtacttgggagtcggccat

SEQ ID NO: 447468 - DNA, 140 bp, Artificial Sequence
  Synthetic
atggccgactcccaagtacgtcaactctctggatgggcttggcagagagttctctcttcacaaccactctctcataccctacacataaaggcttcttccagacccctgatacttgtatctggagacccagcatggcgtat

SEQ ID NO: 447469 - DNA, 140 bp, Artificial Sequence
  Synthetic
aggccctggctgctgatatgccactgcttgatatgcaaccactcatcagctgttgttacaatggttactttaaaaataaagaagaagagactgagccttcgtccctttctgggatgtatagaccttttgggacagcggtg

SEQ ID NO: 447470 - DNA, 140 bp, Artificial Sequence
  Synthetic
caccgctgtcccaaaaggtctatacatcccagaaagggacgaaggctcagtctcttcttctttatttttaaagtaaccattgtaacaacagctgatgagtggttgcatatcaagcagtggcatatcagcagccagggcct

SEQ ID NO: 447471 - DNA, 140 bp, Artificial Sequence
  Synthetic
aggccctggctgctgatatgcattcagtcacgttgttaactgcatagagttggatgttagtggtccttacgagatggagtcttttgacacctctgatgtcaatctctttgggccagcccagaccttttgggacagcggtg

SEQ ID NO: 447472 - DNA, 140 bp, Artificial Sequence
  Synthetic
caccgctgtcccaaaaggtctgggctggcccaaagagattgacatcagaggtgtcaaaagactccatctcgtaaggaccactaacatccaactctatgcagttaacaacgtgactgaatgcatatcagcagccagggcct

SEQ ID NO: 447473 - DNA, 140 bp, Artificial Sequence
  Synthetic
atacgccatgctgggtctccccagtgtcacactgctctcagtgcctttgttgttgtgtttgtattcagttctattgcaataatttgtttagctgttctttatagggtgcttaagtgcctgcgtacttgggagtcggccat

SEQ ID NO: 447474 - DNA, 140 bp, Artificial Sequence
  Synthetic
atggccgactcccaagtacgcaggcacttaagcaccctataaagaacagctaaacaaattattgcaatagaactgaatacaaacacaacaacaaaggcactgagagcagtgtgacactggggagacccagcatggcgtat

SEQ ID NO: 447475 - DNA, 140 bp, Artificial Sequence
  Synthetic
aggccctggctgctgatatgcagtctaaagtacttgtgaatattctagttggcatgattgtctcttgccagattggctgggaattaaactaactctttgaagttgcaccggtctttgtgtgaccttttgggacagcggtg

SEQ ID NO: 447476 - DNA, 140 bp, Artificial Sequence
  Synthetic
caccgctgtcccaaaaggtcacacaaagaccggtgcaacttcaaagagttagtttaattcccagccaatctggcaagagacaatcatgccaactagaatattcacaagtactttagactgcatatcagcagccagggcct

SEQ ID NO: 447477 - DNA, 140 bp, Artificial Sequence
  Synthetic
atacgccatgctgggtctccaagattgccccaaggaaagttctgaatccactaatgtggatcacagccttcatcagatggatatataagaagatggttgccagagtggcagacaacattacgtacttgggagtcggccat

SEQ ID NO: 447478 - DNA, 140 bp, Artificial Sequence
  Synthetic
atggccgactcccaagtacgtaatgttgtctgccactctggcaaccatcttcttatatatccatctgatgaaggctgtgatccacattagtggattcagaactttccttggggcaatcttggagacccagcatggcgtat

SEQ ID NO: 447479 - DNA, 140 bp, Artificial Sequence
  Synthetic
atacgccatgctgggtctccatacctgatgttattattgattgtctcatatgcatcagcatgttcagaactgattcaggcaagctccagaatcaccacttgctctacagagggtgttaaccgtacttgggagtcggccat

SEQ ID NO: 447480 - DNA, 140 bp, Artificial Sequence
  Synthetic
atggccgactcccaagtacggttaacaccctctgtagagcaagtggtgattctggagcttgcctgaatcagttctgaacatgctgatgcatatgagacaatcaataataacatcaggtatggagacccagcatggcgtat

SEQ ID NO: 447481 - DNA, 140 bp, Artificial Sequence
  Synthetic
atacgccatgctgggtctcctgacagccgctgacggcttcccgttggaatccacgagcccaaaagctttcaagaattctcttctcttctcatggcttataaagttgctattcactgctgccgtacttgggagtcggccat

SEQ ID NO: 447482 - DNA, 140 bp, Artificial Sequence
  Synthetic
atggccgactcccaagtacggcagcagtgaatagcaactttataagccatgagaagagaagagaattcttgaaagcttttgggctcgtggattccaacgggaagccgtcagcggctgtcaggagacccagcatggcgtat

SEQ ID NO: 447483 - DNA, 140 bp, Artificial Sequence
  Synthetic
atacgccatgctgggtctcctcttaaagataaaaactgtctcaagtgagctatcatgcagggagggccagagttattggactgggtcctttagccctaaatgtttgagctcaaggagatgcgtacttgggagtcggccat

SEQ ID NO: 447484 - DNA, 140 bp, Artificial Sequence
  Synthetic
atggccgactcccaagtacgcatctccttgagctcaaacatttagggctaaaggacccagtccaataactctggccctccctgcatgatagctcacttgagacagtttttatctttaagaggagacccagcatggcgtat

SEQ ID NO: 447485 - DNA, 140 bp, Artificial Sequence
  Synthetic
aggccctggctgctgatatggcctggcatgtccagccagccagggcggcagcaactcgtgacagagttaactcatcccgggaaggattcccctccttcagcttatacttgttgatgaggggaccttttgggacagcggtg

SEQ ID NO: 447486 - DNA, 140 bp, Artificial Sequence
  Synthetic
caccgctgtcccaaaaggtcccctcatcaacaagtataagctgaaggaggggaatccttcccgggatgagttaactctgtcacgagttgctgccgccctggctggctggacatgccaggccatatcagcagccagggcct

SEQ ID NO: 447487 - DNA, 140 bp, Artificial Sequence
  Synthetic
aggccctggctgctgatatgctagagatcacagactttgatggctctgtttcaacaatagacttgggagcatcatctagccgtttcacaaactggggttcagttagcctctcactggacggaccttttgggacagcggtg

SEQ ID NO: 447488 - DNA, 140 bp, Artificial Sequence
  Synthetic
caccgctgtcccaaaaggtccgtccagtgagaggctaactgaaccccagtttgtgaaacggctagatgatgctcccaagtctattgttgaaacagagccatcaaagtctgtgatctctagcatatcagcagccagggcct

SEQ ID NO: 447489 - DNA, 140 bp, Artificial Sequence
  Synthetic
aggccctggctgctgatatgcaggggccagggtctgcctgtctatcacatccacaggaactggatctctctctgcccacaataaggatgggtctctgcatatagtccttccatcagagaagaccttttgggacagcggtg

SEQ ID NO: 447490 - DNA, 140 bp, Artificial Sequence
  Synthetic
caccgctgtcccaaaaggtcttctctgatggaaggactatatgcagagacccatccttattgtgggcagagagagatccagttcctgtggatgtgatagacaggcagaccctggcccctgcatatcagcagccagggcct

SEQ ID NO: 447491 - DNA, 140 bp, Artificial Sequence
  Synthetic
atacgccatgctgggtctccactctactagaggcagttcacgacactatcattgcaaaggctgacccacctagctgtgaccttcagagtgctcatgggaatccctgcatgaaagagaagccgtacttgggagtcggccat

SEQ ID NO: 447492 - DNA, 140 bp, Artificial Sequence
  Synthetic
atggccgactcccaagtacggcttctctttcatgcagggattcccatgagcactctgaaggtcacagctaggtgggtcagcctttgcaatgatagtgtcgtgaactgcctctagtagagtggagacccagcatggcgtat

SEQ ID NO: 447493 - DNA, 140 bp, Artificial Sequence
  Synthetic
aggccctggctgctgatatgtagctgtgaccttcagagtgctcatgggaatccctgcatgaaagagaagctcgtgatgaagacacactgtccaaatgactaccaatcagctcattaccttgaccttttgggacagcggtg

SEQ ID NO: 447494 - DNA, 140 bp, Artificial Sequence
  Synthetic
caccgctgtcccaaaaggtcaaggtaatgagctgattggtagtcatttggacagtgtgtcttcatcacgagcttctctttcatgcagggattcccatgagcactctgaaggtcacagctacatatcagcagccagggcct

SEQ ID NO: 447495 - DNA, 140 bp, Artificial Sequence
  Synthetic
aggccctggctgctgatatgaggaggagtttatgtactcttgtgatggagatgagcggcctctgttggtgaaggggaccctgatagccattgatccatttgatgataggcgggaagcagggaccttttgggacagcggtg

SEQ ID NO: 447496 - DNA, 140 bp, Artificial Sequence
  Synthetic
caccgctgtcccaaaaggtccctgcttcccgcctatcatcaaatggatcaatggctatcagggtccccttcaccaacagaggccgctcatctccatcacaagagtacataaactcctcctcatatcagcagccagggcct

SEQ ID NO: 447497 - DNA, 140 bp, Artificial Sequence
  Synthetic
atacgccatgctgggtctccgggggaatcaacagttgtgaatccaaaatctggatcttggaatttctttgactggttttctggactcatgagttggtttggagggcctcttaaaactatacgtacttgggagtcggccat

SEQ ID NO: 447498 - DNA, 140 bp, Artificial Sequence
  Synthetic
atggccgactcccaagtacgtatagttttaagaggccctccaaaccaactcatgagtccagaaaaccagtcaaagaaattccaagatccagattttggattcacaactgttgattcccccggagacccagcatggcgtat

SEQ ID NO: 447499 - DNA, 140 bp, Artificial Sequence
  Synthetic
atacgccatgctgggtctccctcctcatttgcctgtatgttgcattatcaattgggctctttttcctccttatatatcttggaagaacaggcctctctaaaatgtggcttgctgccactacgtacttgggagtcggccat

SEQ ID NO: 447500 - DNA, 140 bp, Artificial Sequence
  Synthetic
atggccgactcccaagtacgtagtggcagcaagccacattttagagaggcctgttcttccaagatatataaggaggaaaaagagcccaattgataatgcaacatacaggcaaatgaggagggagacccagcatggcgtat

SEQ ID NO: 447501 - DNA, 140 bp, Artificial Sequence
  Synthetic
aggccctggctgctgatatggggttgactctagaaaggctagccacacttaaggccacaagcaactttaatgagaattggtatgtctataaggatgtggcagacaagaactacacaaggggaccttttgggacagcggtg

SEQ ID NO: 447502 - DNA, 140 bp, Artificial Sequence
  Synthetic
caccgctgtcccaaaaggtccccttgtgtagttcttgtctgccacatccttatagacataccaattctcattaaagttgcttgtggccttaagtgtggctagcctttctagagtcaaccccatatcagcagccagggcct

SEQ ID NO: 447503 - DNA, 140 bp, Artificial Sequence
  Synthetic
atacgccatgctgggtctcccttaagactgaggaaaatctgctaccagactcatttgtctgcttcgagcataaaggacaacataaaggaacaatggactctggtcagaccaagagggagccgtacttgggagtcggccat

SEQ ID NO: 447504 - DNA, 140 bp, Artificial Sequence
  Synthetic
atggccgactcccaagtacggctccctcttggtctgaccagagtccattgttcctttatgttgtcctttatgctcgaagcagacaaatgagtctggtagcagattttcctcagtcttaagggagacccagcatggcgtat

SEQ ID NO: 447505 - DNA, 140 bp, Artificial Sequence
  Synthetic
aggccctggctgctgatatgcgggtggggatagtccggtgtgagagacgaagagatgctaagcaaatagggagagaaaccatggcagggattgcaatgacagtccttccagccttagcaggaccttttgggacagcggtg

SEQ ID NO: 447506 - DNA, 140 bp, Artificial Sequence
  Synthetic
caccgctgtcccaaaaggtcctgctaaggctggaaggactgtcattgcaatccctgccatggtttctctccctatttgcttagcatctcttcgtctctcacaccggactatccccacccgcatatcagcagccagggcct

SEQ ID NO: 447507 - DNA, 140 bp, Artificial Sequence
  Synthetic
aggccctggctgctgatatgcacatgtaaacctgtgacatatgctggggcatgtagcagttttgatgtcttgctcgaaaagggaaaatttcccctcttccagtcgtatgctcatcatagagaccttttgggacagcggtg

SEQ ID NO: 447508 - DNA, 140 bp, Artificial Sequence
  Synthetic
caccgctgtcccaaaaggtctctatgatgagcatacgactggaagaggggaaattttcccttttcgagcaagacatcaaaactgctacatgccccagcatatgtcacaggtttacatgtgcatatcagcagccagggcct

SEQ ID NO: 447509 - DNA, 140 bp, Artificial Sequence
  Synthetic
aggccctggctgctgatatgcagtctcaagtgcttgtgaatattctagttggtgtaatcgtcttttgccagattagctgggaattaaactaactctttgaagttgcaccggtctttgtgtgaccttttgggacagcggtg

SEQ ID NO: 447510 - DNA, 140 bp, Artificial Sequence
  Synthetic
caccgctgtcccaaaaggtcacacaaagaccggtgcaacttcaaagagttagtttaattcccagctaatctggcaaaagacgattacaccaactagaatattcacaagcacttgagactgcatatcagcagccagggcct

SEQ ID NO: 447511 - DNA, 140 bp, Artificial Sequence
  Synthetic
aggccctggctgctgatatgtagctgtgaccttcagagtgctcatgggaatccctgtatgaaagagaaactcgtgatgaagacacattgtccaaatgactaccagtcagctcattacctcgaccttttgggacagcggtg

SEQ ID NO: 447512 - DNA, 140 bp, Artificial Sequence
  Synthetic
caccgctgtcccaaaaggtcgaggtaatgagctgactggtagtcatttggacaatgtgtcttcatcacgagtttctctttcatacagggattcccatgagcactctgaaggtcacagctacatatcagcagccagggcct

SEQ ID NO: 447513 - DNA, 140 bp, Artificial Sequence
  Synthetic
atacgccatgctgggtctcctaactctggcacttccaacatttgatgtttccaagatggtagatagaattaccatagacttcaatctggatgatatacaaggagcatctgaaataggctccgtacttgggagtcggccat

SEQ ID NO: 447514 - DNA, 140 bp, Artificial Sequence
  Synthetic
atggccgactcccaagtacggagcctatttcagatgctccttgtatatcatccagattgaagtctatggtaattctatctaccatcttggaaacatcaaatgttggaagtgccagagttaggagacccagcatggcgtat

SEQ ID NO: 447515 - DNA, 140 bp, Artificial Sequence
  Synthetic
aggccctggctgctgatatgatgcgtgagtttcccatgatgaatgacgggtttgatcatttgagccctgacatgatcattaaaactacatctggcatgtacaacatcgttgagttcaccagaccttttgggacagcggtg

SEQ ID NO: 447516 - DNA, 140 bp, Artificial Sequence
  Synthetic
caccgctgtcccaaaaggtctggtgaactcaacgatgttgtacatgccagatgtagttttaatgatcatgtcagggctcaaatgatcaaacccgtcattcatcatgggaaactcacgcatcatatcagcagccagggcct

SEQ ID NO: 447517 - DNA, 140 bp, Artificial Sequence
  Synthetic
aggccctggctgctgatatggctaagtatgaggttccttgtgagaacagatctcagggcaggactgttgttctttatgttgttagtgcttatcggcatggtgtatggtctaatctggagcgaccttttgggacagcggtg

SEQ ID NO: 447518 - DNA, 140 bp, Artificial Sequence
  Synthetic
caccgctgtcccaaaaggtcgctccagattagaccatacaccatgccgataagcactaacaacataaagaacaacagtcctgccctgagatctgttctcacaaggaacctcatacttagccatatcagcagccagggcct

SEQ ID NO: 447519 - DNA, 140 bp, Artificial Sequence
  Synthetic
atacgccatgctgggtctccaagattgccccaaagaaagttctgaatccgctaatgtggattactgccttcatcagatgggtatataagaagatggttgccagagtggcagataatataacgtacttgggagtcggccat

SEQ ID NO: 447520 - DNA, 140 bp, Artificial Sequence
  Synthetic
atggccgactcccaagtacgttatattatctgccactctggcaaccatcttcttatatacccatctgatgaaggcagtaatccacattagcggattcagaactttctttggggcaatcttggagacccagcatggcgtat

SEQ ID NO: 447521 - DNA, 140 bp, Artificial Sequence
  Synthetic
aggccctggctgctgatatgtagaggactctgaagcagaggagatggtttataggtacagacttgctcttagtgtgatggatgagctaaggaccttgttcccagaactgtcatccacagagaccttttgggacagcggtg

SEQ ID NO: 447522 - DNA, 140 bp, Artificial Sequence
  Synthetic
caccgctgtcccaaaaggtctctgtggatgacagttctgggaacaaggtccttagctcatccatcacactaagagcaagtctgtacctataaaccatctcctctgcttcagagtcctctacatatcagcagccagggcct

SEQ ID NO: 447523 - DNA, 140 bp, Artificial Sequence
  Synthetic
atacgccatgctgggtctccatcaagtgaacagggaaataggatggatggaaggaggtcagttggctctagggaaccctgcccctattcctcgtcacgctccaatcccacgctatagcaccgtacttgggagtcggccat

SEQ ID NO: 447524 - DNA, 140 bp, Artificial Sequence
  Synthetic
atggccgactcccaagtacggtgctatagcgtgggattggagcgtgacgaggaataggggcagggttccctagagccaactgacctccttccatccatcctatttccctgttcacttgatggagacccagcatggcgtat

SEQ ID NO: 447525 - DNA, 140 bp, Artificial Sequence
  Synthetic
aggccctggctgctgatatggatcaacagggttcaagatatcatctgcagttgcttgtgctagcggggtttgcgtcacaggatcgcagagtccttctactgagattacactcaagtatccgaccttttgggacagcggtg

SEQ ID NO: 447526 - DNA, 140 bp, Artificial Sequence
  Synthetic
caccgctgtcccaaaaggtcggatacttgagtgtaatctcagtagaaggactctgcgatcctgtgacgcaaaccccgctagcacaagcaactgcagatgatatcttgaaccctgttgatccatatcagcagccagggcct

SEQ ID NO: 447527 - DNA, 140 bp, Artificial Sequence
  Synthetic
atacgccatgctgggtctccatacctaatgctactactgattgtctcatatgcgtcagcatgttcagaactgattcaggcaagctctaggattaccacttgctccacagaaggtgtcaaccgtacttgggagtcggccat

SEQ ID NO: 447528 - DNA, 140 bp, Artificial Sequence
  Synthetic
atggccgactcccaagtacggttgacaccttctgtggagcaagtggtaatcctagagcttgcctgaatcagttctgaacatgctgacgcatatgagacaatcagtagtagcattaggtatggagacccagcatggcgtat

SEQ ID NO: 447529 - DNA, 140 bp, Artificial Sequence
  Synthetic
aggccctggctgctgatatgggcagaggcttgtttgatgttaaagggggtcaaggaagaccaaaccaagttcttgaagataaaaactgtctcaagtgagctatcgtgcagggagggccaggaccttttgggacagcggtg

SEQ ID NO: 447530 - DNA, 140 bp, Artificial Sequence
  Synthetic
caccgctgtcccaaaaggtcctggccctccctgcacgatagctcacttgagacagtttttatcttcaagaacttggtttggtcttccttgaccccctttaacatcaaacaagcctctgcccatatcagcagccagggcct

SEQ ID NO: 447531 - DNA, 140 bp, Artificial Sequence
  Synthetic
aggccctggctgctgatatgctccctggctgtcctatcatgatgtcgatggcaaagatctgtgccctcttcagggattagatgtgagaggggaccatcccatgtgcaacttgtggagggagaccttttgggacagcggtg

SEQ ID NO: 447532 - DNA, 140 bp, Artificial Sequence
  Synthetic
caccgctgtcccaaaaggtctccctccacaagttgcacatgggatggtcccctctcacatctaatccctgaagagggcacagatctttgccatcgacatcatgataggacagccagggagcatatcagcagccagggcct

SEQ ID NO: 447533 - DNA, 140 bp, Artificial Sequence
  Synthetic
atacgccatgctgggtctccaagaggcccttagagtttttaactgtatcgattgggtgcataaactcactctagagatcacagactttgatggctctgtttcaacaatagacttgggagccgtacttgggagtcggccat

SEQ ID NO: 447534 - DNA, 140 bp, Artificial Sequence
  Synthetic
atggccgactcccaagtacggctcccaagtctattgttgaaacagagccatcaaagtctgtgatctctagagtgagtttatgcacccaatcgatacagttaaaaactctaagggcctcttggagacccagcatggcgtat

SEQ ID NO: 447535 - DNA, 140 bp, Artificial Sequence
  Synthetic
atacgccatgctgggtctccccatcttgtcggggaatgtcatgtgaataggtgtctgtcttggagggacaatgaaacttcagcagagttttcatttgttggggaaagcacaaccatgcgacgtacttgggagtcggccat

SEQ ID NO: 447536 - DNA, 140 bp, Artificial Sequence
  Synthetic
atggccgactcccaagtacgtcgcatggttgtgctttccccaacaaatgaaaactctgctgaagtttcattgtccctccaagacagacacctattcacatgacattccccgacaagatggggagacccagcatggcgtat

SEQ ID NO: 447537 - DNA, 140 bp, Artificial Sequence
  Synthetic
aggccctggctgctgatatggatcagttggagtgcacaacaaatctgattgatccctttgttgtctttgagaggggttctctgccacagacaagaaatgacaaaacttttgcagcttcaagaccttttgggacagcggtg

SEQ ID NO: 447538 - DNA, 140 bp, Artificial Sequence
  Synthetic
caccgctgtcccaaaaggtcttgaagctgcaaaagttttgtcatttcttgtctgtggcagagaacccctctcaaagacaacaaagggatcaatcagatttgttgtgcactccaactgatccatatcagcagccagggcct

SEQ ID NO: 447539 - DNA, 140 bp, Artificial Sequence
  Synthetic
atacgccatgctgggtctccttcaatgagatcataacagagcactacaaattcatgggaagtaggataggttcatggtgccaaatggtcagcttgataggagctgagctatcagcttctgcgtacttgggagtcggccat

SEQ ID NO: 447540 - DNA, 140 bp, Artificial Sequence
  Synthetic
atggccgactcccaagtacgcagaagctgatagctcagctcctatcaagctgaccatttggcaccatgaacctatcctacttcccatgaatttgtagtgctctgttatgatctcattgaaggagacccagcatggcgtat

SEQ ID NO: 447541 - DNA, 140 bp, Artificial Sequence
  Synthetic
atacgccatgctgggtctccctaactctgatgtttgacaattttgaggtggactttgtgggagcagccgtgtcttgtgatgccgccttcttaaatttgacaggttgctattcttgcaatgcgtacttgggagtcggccat

SEQ ID NO: 447542 - DNA, 140 bp, Artificial Sequence
  Synthetic
atggccgactcccaagtacgcattgcaagaatagcaacctgtcaaatttaagaaggcggcatcacaagacacggctgctcccacaaagtccacctcaaaattgtcaaacatcagagttagggagacccagcatggcgtat

SEQ ID NO: 447543 - DNA, 140 bp, Artificial Sequence
  Synthetic
aggccctggctgctgatatgaaggaaatagaggtgttcaggctttctctaagggctctgtacaagctgatctgactctgatgtttgacaattttgaggtggactttgtgggagcagccgtgaccttttgggacagcggtg

SEQ ID NO: 447544 - DNA, 140 bp, Artificial Sequence
  Synthetic
caccgctgtcccaaaaggtcacggctgctcccacaaagtccacctcaaaattgtcaaacatcagagtcagatcagcttgtacagagcccttagagaaagcctgaacacctctatttccttcatatcagcagccagggcct

SEQ ID NO: 447545 - DNA, 140 bp, Artificial Sequence
  Synthetic
aggccctggctgctgatatgtctgcccacaacaaggatgggtctctgcatatagttctcccatcagaaaatggaacaaaagatcagtgtcagatactacacttcactgtgcctgaggtaggaccttttgggacagcggtg

SEQ ID NO: 447546 - DNA, 140 bp, Artificial Sequence
  Synthetic
caccgctgtcccaaaaggtcctacctcaggcacagtgaagtgtagtatctgacactgatcttttgttccattttctgatgggagaactatatgcagagacccatccttgttgtgggcagacatatcagcagccagggcct

SEQ ID NO: 447547 - DNA, 140 bp, Artificial Sequence
  Synthetic
atacgccatgctgggtctccgctggaactttgttggtgacttgttcaggtcttcagactctgcagcaatggatgcctcatacatgggcaaactttctttattaacccttttggaagacaacgtacttgggagtcggccat

SEQ ID NO: 447548 - DNA, 140 bp, Artificial Sequence
  Synthetic
atggccgactcccaagtacgttgtcttccaaaagggttaataaagaaagtttgcccatgtatgaggcatccattgctgcagagtctgaagacctgaacaagtcaccaacaaagttccagcggagacccagcatggcgtat

SEQ ID NO: 447549 - DNA, 140 bp, Artificial Sequence
  Synthetic
atacgccatgctgggtctccagaaggcttcatagatcagtgcgtgtagaagcaatatatagaaataagtagacataaacaaacccaatcatgtaaatattgtacagatagatcaaactatcgtacttgggagtcggccat

SEQ ID NO: 447550 - DNA, 140 bp, Artificial Sequence
  Synthetic
atggccgactcccaagtacgatagtttgatctatctgtacaatatttacatgattgggtttgtttatgtctacttatttctatatattgcttctacacgcactgatctatgaagccttctggagacccagcatggcgtat

SEQ ID NO: 447551 - DNA, 140 bp, Artificial Sequence
  Synthetic
atacgccatgctgggtctccaggatgggtctatatcctggggtggcatgttcaatcctttttcagggcgtccactgcttgatatgcaaccactcatcagctgttgttacaatggttacttcgtacttgggagtcggccat

SEQ ID NO: 447552 - DNA, 140 bp, Artificial Sequence
  Synthetic
atggccgactcccaagtacgaagtaaccattgtaacaacagctgatgagtggttgcatatcaagcagtggacgccctgaaaaaggattgaacatgccaccccaggatatagacccatcctggagacccagcatggcgtat

SEQ ID NO: 447553 - DNA, 140 bp, Artificial Sequence
  Synthetic
atacgccatgctgggtctcctgggatatccaagcttagaaacttatgcaataatactttagatgtaagcttagttgtaatttggggtggtggggtgaggcagcagcagtctcaagtgctccgtacttgggagtcggccat

SEQ ID NO: 447554 - DNA, 140 bp, Artificial Sequence
  Synthetic
atggccgactcccaagtacggagcacttgagactgctgctgcctcaccccaccaccccaaattacaactaagcttacatctaaagtattattgcataagtttctaagcttggatatcccaggagacccagcatggcgtat

SEQ ID NO: 447555 - DNA, 140 bp, Artificial Sequence
  Synthetic
atacgccatgctgggtctcctaaaaataaagaagaagagactgagccttcgtccctttctgggatgtataagaaaatcatagaacttgagcaccttagaccacagtcagatgccttcttgcgtacttgggagtcggccat

SEQ ID NO: 447556 - DNA, 140 bp, Artificial Sequence
  Synthetic
atggccgactcccaagtacgcaagaaggcatctgactgtggtctaaggtgctcaagttctatgattttcttatacatcccagaaagggacgaaggctcagtctcttcttctttatttttaggagacccagcatggcgtat

SEQ ID NO: 447557 - DNA, 140 bp, Artificial Sequence
  Synthetic
aggccctggctgctgatatgagaaaatcatagaacttgagcaccttagaccacagtcagatgccttcttgggttacaaagatccagaacttcccagaatgcatgagttcagtgtttcctagaccttttgggacagcggtg

SEQ ID NO: 447558 - DNA, 140 bp, Artificial Sequence
  Synthetic
caccgctgtcccaaaaggtctaggaaacactgaactcatgcattctgggaagttctggatctttgtaacccaagaaggcatctgactgtggtctaaggtgctcaagttctatgattttctcatatcagcagccagggcct

SEQ ID NO: 447559 - DNA, 140 bp, Artificial Sequence
  Synthetic
aggccctggctgctgatatggagatgtttgacaggtttagatcctcccctcccgattcagagtatatcacgaggatagtgagcagatgcctcataaattctcaagagaaactcatcaatagaccttttgggacagcggtg

SEQ ID NO: 447560 - DNA, 140 bp, Artificial Sequence
  Synthetic
caccgctgtcccaaaaggtctattgatgagtttctcttgagaatttatgaggcatctgctcactatcctcgtgatatactctgaatcgggaggggaggatctaaacctgtcaaacatctccatatcagcagccagggcct

SEQ ID NO: 447561 - DNA, 140 bp, Artificial Sequence
  Synthetic
atacgccatgctgggtctcctagaggactctgaagcagaggagatggtttataggtacagacttgctctgagtgtgatggatgagctacggaccttgtttccagaactgtcatccacagacgtacttgggagtcggccat

SEQ ID NO: 447562 - DNA, 140 bp, Artificial Sequence
  Synthetic
atggccgactcccaagtacgtctgtggatgacagttctggaaacaaggtccgtagctcatccatcacactcagagcaagtctgtacctataaaccatctcctctgcttcagagtcctctaggagacccagcatggcgtat

SEQ ID NO: 447563 - DNA, 140 bp, Artificial Sequence
  Synthetic
aggccctggctgctgatatgtccaaataaattggtcagttacagaatctgtgtttccaccctttagcagagaaatgtttgacaggtttagatcttctccccctgactcagagtatatcacgaccttttgggacagcggtg

SEQ ID NO: 447564 - DNA, 140 bp, Artificial Sequence
  Synthetic
caccgctgtcccaaaaggtcgtgatatactctgagtcagggggagaagatctaaacctgtcaaacatttctctgctaaagggtggaaacacagattctgtaactgaccaatttatttggacatatcagcagccagggcct

SEQ ID NO: 447565 - DNA, 140 bp, Artificial Sequence
  Synthetic
aggccctggctgctgatatgtggaaccaaggccattttgttacaaagtttgccctcatgctgtgtgagttcacctctcctaaatggtggccgctgatcattaggggatgctcaatgtttagaccttttgggacagcggtg

SEQ ID NO: 447566 - DNA, 140 bp, Artificial Sequence
  Synthetic
caccgctgtcccaaaaggtctaaacattgagcatcccctaatgatcagcggccaccatttaggagaggtgaactcacacagcatgagggcaaactttgtaacaaaatggccttggttccacatatcagcagccagggcct

SEQ ID NO: 447567 - DNA, 140 bp, Artificial Sequence
  Synthetic
aggccctggctgctgatatgattccttctttgctgaagggaatgataaagctctgagattttcaaaaaacgctgaagagtgttccttggcaatagaaagagccttaaatcagtatagggcgaccttttgggacagcggtg

SEQ ID NO: 447568 - DNA, 140 bp, Artificial Sequence
  Synthetic
caccgctgtcccaaaaggtcgccctatactgatttaaggctctttctattgccaaggaacactcttcagcgttttttgaaaatctcagagctttatcattcccttcagcaaagaaggaatcatatcagcagccagggcct

SEQ ID NO: 447569 - DNA, 140 bp, Artificial Sequence
  Synthetic
atacgccatgctgggtctcctggaaaccacaacagggatgatgcagggaatactgcattatacttcctcactattacacaccattcaccaagaatacatccggtccttgtcctttaagatcgtacttgggagtcggccat

SEQ ID NO: 447570 - DNA, 140 bp, Artificial Sequence
  Synthetic
atggccgactcccaagtacgatcttaaaggacaaggaccggatgtattcttggtgaatggtgtgtaatagtgaggaagtataatgcagtattccctgcatcatccctgttgtggtttccaggagacccagcatggcgtat

SEQ ID NO: 447571 - DNA, 140 bp, Artificial Sequence
  Synthetic
aggccctggctgctgatatgatgcagaactatccagagaatagcaggtgagcccttcattcttaagaagaaggatggatctatatcctggggtggcatgttcaatcctttttcagggcgtgaccttttgggacagcggtg

SEQ ID NO: 447572 - DNA, 140 bp, Artificial Sequence
  Synthetic
caccgctgtcccaaaaggtcacgccctgaaaaaggattgaacatgccaccccaggatatagatccatccttcttcttaagaatgaagggctcacctgctattctctggatagttctgcatcatatcagcagccagggcct

SEQ ID NO: 447573 - DNA, 140 bp, Artificial Sequence
  Synthetic
aggccctggctgctgatatgcatgaagaaggagctgggagtgtaccttgccatttacccctcagagaagtccacagcaaacacagattttgtgatggagtacaattctgaattttatttcgaccttttgggacagcggtg

SEQ ID NO: 447574 - DNA, 140 bp, Artificial Sequence
  Synthetic
caccgctgtcccaaaaggtcgaaataaaattcagaattgtactccatcacaaaatctgtgtttgctgtggacttctctgaggggtaaatggcaaggtacactcccagctccttcttcatgcatatcagcagccagggcct

SEQ ID NO: 447575 - DNA, 140 bp, Artificial Sequence
  Synthetic
aggccctggctgctgatatgcctgccagaagtggaaacactagtagcccgccaggaagaggcctctaacctaatgacttcagttactgagggaggtgggtcattctccttagctgcaatggaccttttgggacagcggtg

SEQ ID NO: 447576 - DNA, 140 bp, Artificial Sequence
  Synthetic
caccgctgtcccaaaaggtccattgcagctaaggagaatgacccacctccctcagtaactgaagtcattaggttagaggcctcttcctggcgggctactagtgtttccacttctggcaggcatatcagcagccagggcct

SEQ ID NO: 447577 - DNA, 140 bp, Artificial Sequence
  Synthetic
atacgccatgctgggtctcctaatgacttcagttactgagggaggtgggtcattctccttagctgcaatgattcagcaagctcagtgcactctccattacatgctgatgggcatgggagtcgtacttgggagtcggccat

SEQ ID NO: 447578 - DNA, 140 bp, Artificial Sequence
  Synthetic
atggccgactcccaagtacgactcccatgcccatcagcatgtaatggagagtgcactgagcttgctgaatcattgcagctaaggagaatgacccacctccctcagtaactgaagtcattaggagacccagcatggcgtat

SEQ ID NO: 447579 - DNA, 140 bp, Artificial Sequence
  Synthetic
atacgccatgctgggtctcccatgcatatttgtttgtttaagaaacaacagcatggaggtctgagagaaatctatgtgatgggtgcagaggaaagaattgttcaatcggtggtggagacacgtacttgggagtcggccat

SEQ ID NO: 447580 - DNA, 140 bp, Artificial Sequence
  Synthetic
atggccgactcccaagtacgtgtctccaccaccgattgaacaattctttcctctgcacccatcacatagatttctctcagacctccatgctgttgtttcttaaacaaacaaatatgcatgggagacccagcatggcgtat

SEQ ID NO: 447581 - DNA, 140 bp, Artificial Sequence
  Synthetic
aggccctggctgctgatatgctccctggctgtcctatcatgatgtcgatggcaaagatctgtgccctcttcaagggttagatgtgaaaggggaccatcccatgtgcaacctgtggagagagaccttttgggacagcggtg

SEQ ID NO: 447582 - DNA, 140 bp, Artificial Sequence
  Synthetic
caccgctgtcccaaaaggtctctctccacaggttgcacatgggatggtcccctttcacatctaacccttgaagagggcacagatctttgccatcgacatcatgataggacagccagggagcatatcagcagccagggcct

SEQ ID NO: 447583 - DNA, 140 bp, Artificial Sequence
  Synthetic
atacgccatgctgggtctccgggcagatgaagatgtcaccatcccagaaacgtgtagcgtgagcccaggtggcgctctaattcttagctcctctctaaagtggggatctaggaagaagttcgtacttgggagtcggccat

SEQ ID NO: 447584 - DNA, 140 bp, Artificial Sequence
  Synthetic
atggccgactcccaagtacgaacttcttcctagatccccactttagagaggagctaagaattagagcgccacctgggctcacgctacacgtttctgggatggtgacatcttcatctgcccggagacccagcatggcgtat

SEQ ID NO: 447585 - DNA, 140 bp, Artificial Sequence
  Synthetic
aggccctggctgctgatatgggcgctctaattcttagctcctctctaaagtggggatctaggaagaagtttcagaaattgagagaccgtttgaacataccagagaactggattgaactaagaccttttgggacagcggtg

SEQ ID NO: 447586 - DNA, 140 bp, Artificial Sequence
  Synthetic
caccgctgtcccaaaaggtcttagttcaatccagttctctggtatgttcaaacggtctctcaatttctgaaacttcttcctagatccccactttagagaggagctaagaattagagcgcccatatcagcagccagggcct

SEQ ID NO: 447587 - DNA, 140 bp, Artificial Sequence
  Synthetic
atacgccatgctgggtctcctaaatgagaatccagaggtgctctatcgggctcccagaacaggcccagaaatattgttgcgcattgcagagaaagtccacagcccaggtgttgtgtcatccgtacttgggagtcggccat

SEQ ID NO: 447588 - DNA, 140 bp, Artificial Sequence
  Synthetic
atggccgactcccaagtacggatgacacaacacctgggctgtggactttctctgcaatgcgcaacaatatttctgggcctgttctgggagcccgatagagcacctctggattctcatttaggagacccagcatggcgtat

SEQ ID NO: 447589 - DNA, 140 bp, Artificial Sequence
  Synthetic
atacgccatgctgggtctccgacagaatttcatggagcaaatagacaaccagatcattcgagaactcagtgggttgactctagaaagattagccacacttaaggccacaagcaacttcaacgtacttgggagtcggccat

SEQ ID NO: 447590 - DNA, 140 bp, Artificial Sequence
  Synthetic
atggccgactcccaagtacgttgaagttgcttgtggccttaagtgtggctaatctttctagagtcaacccactgagttctcgaatgatctggttgtctatttgctccatgaaattctgtcggagacccagcatggcgtat

SEQ ID NO: 447591 - DNA, 140 bp, Artificial Sequence
  Synthetic
atacgccatgctgggtctcctgaaaattggtatgtttacaaggatgtggcagacaagaactacacaagggacaaattattagtgaagatgtcaaaatatgcctctgagggaaagagcctacgtacttgggagtcggccat

SEQ ID NO: 447592 - DNA, 140 bp, Artificial Sequence
  Synthetic
atggccgactcccaagtacgtaggctctttccctcagaggcatattttgacatcttcactaataatttgtcccttgtgtagttcttgtctgccacatccttgtaaacataccaattttcaggagacccagcatggcgtat

SEQ ID NO: 447593 - DNA, 140 bp, Artificial Sequence
  Synthetic
atacgccatgctgggtctccatggtaagactaaaacaaatttgattgggatccttcagagatttctagatggtgatcacgttgtccccataattgaagagatgggagccggaacagtgggcgtacttgggagtcggccat

SEQ ID NO: 447594 - DNA, 140 bp, Artificial Sequence
  Synthetic
atggccgactcccaagtacgcccactgttccggctcccatctcttcaattatggggacaacgtgatcaccatctagaaatctctgaaggatcccaatcaaatttgttttagtcttaccatggagacccagcatggcgtat

SEQ ID NO: 447595 - DNA, 140 bp, Artificial Sequence
  Synthetic
atacgccatgctgggtctccctattctgtatactacaaggtccatacagtgagagctataagctacagctaatctacagagtcctaagctcagtgtcaaacgttgagataaaggaatcagcgtacttgggagtcggccat

SEQ ID NO: 447596 - DNA, 140 bp, Artificial Sequence
  Synthetic
atggccgactcccaagtacgctgattcctttatctcaacgtttgacactgagcttaggactctgtagattagctgtagcttatagctctcactgtatggaccttgtagtatacagaatagggagacccagcatggcgtat

SEQ ID NO: 447597 - DNA, 140 bp, Artificial Sequence
  Synthetic
atacgccatgctgggtctccatagccaggtctatagggaagttctttgcttctgacaccctctgtaacccccccaacaaggtgagaattcctgagacacatggcatcagggctcggaagccgtacttgggagtcggccat

SEQ ID NO: 447598 - DNA, 140 bp, Artificial Sequence
  Synthetic
atggccgactcccaagtacggcttccgagccctgatgccatgtgtctcaggaattctcaccttgttgggggggttacagagggtgtcagaagcaaagaacttccctatagacctggctatggagacccagcatggcgtat

SEQ ID NO: 447599 - DNA, 140 bp, Artificial Sequence
  Synthetic
atacgccatgctgggtctcccatttagtcatgttgttaattgcatagagttggatgttagtggtccttacgagatggagtcttttgatacatctgatgtcaatctctttgggccagcccacgtacttgggagtcggccat

SEQ ID NO: 447600 - DNA, 140 bp, Artificial Sequence
  Synthetic
atggccgactcccaagtacgtgggctggcccaaagagattgacatcagatgtatcaaaagactccatctcgtaaggaccactaacatccaactctatgcaattaacaacatgactaaatgggagacccagcatggcgtat

SEQ ID NO: 447601 - DNA, 140 bp, Artificial Sequence
  Synthetic
atacgccatgctgggtctccagaaaattatagaacttgagcaccttagaccacagtcagatgccttcttgggttataaagatccagaactgcctagaatgcatgagttcagtgtttcttacgtacttgggagtcggccat

SEQ ID NO: 447602 - DNA, 140 bp, Artificial Sequence
  Synthetic
atggccgactcccaagtacgtaagaaacactgaactcatgcattctaggcagttctggatctttataacccaagaaggcatctgactgtggtctaaggtgctcaagttctataattttctggagacccagcatggcgtat

SEQ ID NO: 447603 - DNA, 140 bp, Artificial Sequence
  Synthetic
aggccctggctgctgatatgagcagtctcaagtgctcgtgaatatactagttagcgtgattgtcttttgccagattagttgggaattaaactaactctttgaagttgcaccggtctttgtgaccttttgggacagcggtg

SEQ ID NO: 447604 - DNA, 140 bp, Artificial Sequence
  Synthetic
caccgctgtcccaaaaggtcacaaagaccggtgcaacttcaaagagttagtttaattcccaactaatctggcaaaagacaatcacgctaactagtatattcacgagcacttgagactgctcatatcagcagccagggcct

SEQ ID NO: 447605 - DNA, 140 bp, Artificial Sequence
  Synthetic
atacgccatgctgggtctccgggcagatgaagacatcaccatcccagaaacgtgtagtgtgagcccaggtggcgctctaattcttagctcctctctaaagtggggatctagaaaaaagttcgtacttgggagtcggccat

SEQ ID NO: 447606 - DNA, 140 bp, Artificial Sequence
  Synthetic
atggccgactcccaagtacgaacttttttctagatccccactttagagaggagctaagaattagagcgccacctgggctcacactacacgtttctgggatggtgatgtcttcatctgcccggagacccagcatggcgtat

SEQ ID NO: 447607 - DNA, 140 bp, Artificial Sequence
  Synthetic
atacgccatgctgggtctccttacaaggacatcagttcattatctatgattgctcatcccttaatggataagtttgttgattatgctatttctaagatggggagagcctcagttaggaaacgtacttgggagtcggccat

SEQ ID NO: 447608 - DNA, 140 bp, Artificial Sequence
  Synthetic
atggccgactcccaagtacgtttcctaactgaggctctccccatcttagaaatagcataatcaacaaacttatccattaagggatgagcaatcatagataatgaactgatgtccttgtaaggagacccagcatggcgtat

SEQ ID NO: 447609 - DNA, 140 bp, Artificial Sequence
  Synthetic
aggccctggctgctgatatggttctagaaacaggtcggtgctccagcaaagactatgatttatcaaaggttctcttcagaactctacagagaccagaagaaagcattaggatagatgatcgaccttttgggacagcggtg

SEQ ID NO: 447610 - DNA, 140 bp, Artificial Sequence
  Synthetic
caccgctgtcccaaaaggtcgatcatctatcctaatgctttcttctggtctctgtagagttctgaagagaacctttgataaatcatagtctttgctggagcaccgacctgtttctagaaccatatcagcagccagggcct

SEQ ID NO: 447611 - DNA, 140 bp, Artificial Sequence
  Synthetic
atacgccatgctgggtctccttcaatgagatcataacagagcattacaaattcatgggaagtaggataggttcatggtgccaaatggtcagtttgataggagcagagctatcagcttctgcgtacttgggagtcggccat

SEQ ID NO: 447612 - DNA, 140 bp, Artificial Sequence
  Synthetic
atggccgactcccaagtacgcagaagctgatagctctgctcctatcaaactgaccatttggcaccatgaacctatcctacttcccatgaatttgtaatgctctgttatgatctcattgaaggagacccagcatggcgtat

SEQ ID NO: 447613 - DNA, 140 bp, Artificial Sequence
  Synthetic
aggccctggctgctgatatgttggaggattctaagtacagcttgctacagaagatggccgcatattctggctttcatggtttcaatgatatggaaccggaagatatattattcctattccgaccttttgggacagcggtg

SEQ ID NO: 447614 - DNA, 140 bp, Artificial Sequence
  Synthetic
caccgctgtcccaaaaggtcggaataggaataatatatcttccggttccatatcattgaaaccatgaaagccagaatatgcggccatcttctgtagcaagctgtacttagaatcctccaacatatcagcagccagggcct

SEQ ID NO: 447615 - DNA, 140 bp, Artificial Sequence
  Synthetic
aggccctggctgctgatatgatctgaaagaagccatatcctggcctcttggagaaccctcattggctttctttgatcttagctctactagagtgcacaggaatgatgatattagaagggagaccttttgggacagcggtg

SEQ ID NO: 447616 - DNA, 140 bp, Artificial Sequence
  Synthetic
caccgctgtcccaaaaggtctcccttctaatatcatcattcctgtgcactctagtagagctaagatcaaagaaagccaatgagggttctccaagaggccaggatatggcttctttcagatcatatcagcagccagggcct

SEQ ID NO: 447617 - DNA, 140 bp, Artificial Sequence
  Synthetic
atacgccatgctgggtctcctcagattgccactctagcaatgaggagctgcaagattaccaatgatctagaggactcctttgttggcttacacaggatgatagtgaccgaggctatcctccgtacttgggagtcggccat

SEQ ID NO: 447618 - DNA, 140 bp, Artificial Sequence
  Synthetic
atggccgactcccaagtacggaggatagcctcggtcactatcatcctgtgtaagccaacaaaggagtcctctagatcattggtaatcttgcagctcctcattgctagagtggcaatctgaggagacccagcatggcgtat

SEQ ID NO: 447619 - DNA, 140 bp, Artificial Sequence
  Synthetic
atacgccatgctgggtctccaggactcctttgttggcttacacaggatgatagtgaccgaggctatcctcagagggattgacctgtgcctgttgccaggctttgacctcatgtatgaggtcgtacttgggagtcggccat

SEQ ID NO: 447620 - DNA, 140 bp, Artificial Sequence
  Synthetic
atggccgactcccaagtacgacctcatacatgaggtcaaagcctggcaacaggcacaggtcaatccctctgaggatagcctcggtcactatcatcctgtgtaagccaacaaaggagtcctggagacccagcatggcgtat

SEQ ID NO: 447621 - DNA, 140 bp, Artificial Sequence
  Synthetic
atacgccatgctgggtctcccccccaccccccaatcccgaccgttaccccaaccaccccctttcccccaaacccctgggcagccactcaggctgctgtcttgtacgcctgagcagctgcccgtacttgggagtcggccat

SEQ ID NO: 447622 - DNA, 140 bp, Artificial Sequence
  Synthetic
atggccgactcccaagtacgggcagctgctcaggcgtacaagacagcagcctgagtggctgcccaggggtttgggggaaagggggtggttggggtaacggtcgggattggggggtgggggggagacccagcatggcgtat

SEQ ID NO: 447623 - DNA, 140 bp, Artificial Sequence
  Synthetic
atacgccatgctgggtctccctgatgctgcgctcatcacttcctagcatgatggggagaaacaactggattccagttgttcctccaatcccagatgttgagatggaatcagaggaagagacgtacttgggagtcggccat

SEQ ID NO: 447624 - DNA, 140 bp, Artificial Sequence
  Synthetic
atggccgactcccaagtacgtctcttcctctgattccatctcaacatctgggattggaggaacaactggaatccagttgtttctccccatcatgctaggaagtgatgagcgcagcatcagggagacccagcatggcgtat

SEQ ID NO: 447625 - DNA, 140 bp, Artificial Sequence
  Synthetic
aggccctggctgctgatatgtccagttgttcctccaatcccagatgttgagatggaatcagaggaagagagtgatgatgatggatttgttgaagttgattagaggttaaggctgccccacgaccttttgggacagcggtg

SEQ ID NO: 447626 - DNA, 140 bp, Artificial Sequence
  Synthetic
caccgctgtcccaaaaggtcgtggggcagccttaacctctaatcaacttcaacaaatccatcatcatcactctcttcctctgattccatctcaacatctgggattggaggaacaactggacatatcagcagccagggcct

SEQ ID NO: 447627 - DNA, 140 bp, Artificial Sequence
  Synthetic
atacgccatgctgggtctccacctcgctggcttcactcgtagtgtgtcagctgaaatcctcaagcactttctgttctgtatactacagggtccatatagtgagagctataagctacagctcgtacttgggagtcggccat

SEQ ID NO: 447628 - DNA, 140 bp, Artificial Sequence
  Synthetic
atggccgactcccaagtacgagctgtagcttatagctctcactatatggaccctgtagtatacagaacagaaagtgcttgaggatttcagctgacacactacgagtgaagccagcgaggtggagacccagcatggcgtat

SEQ ID NO: 447629 - DNA, 140 bp, Artificial Sequence
  Synthetic
atacgccatgctgggtctcctaaagcaacatgtcaagcctaattattttgtgattaaacgactactaggttctgggatatacttactgatcaaacccacttccagcaaaagccatatattcgtacttgggagtcggccat

SEQ ID NO: 447630 - DNA, 140 bp, Artificial Sequence
  Synthetic
atggccgactcccaagtacgaatatatggcttttgctggaagtgggtttgatcagtaagtatatcccagaacctagtagtcgtttaatcacaaaataattaggcttgacatgttgctttaggagacccagcatggcgtat

SEQ ID NO: 447631 - DNA, 140 bp, Artificial Sequence
  Synthetic
aggccctggctgctgatatggagatggagtcttttgatacatctgatgtcaacctctttgggccagcccattacaaggatattagttcattatccatgattgctcatcccttaatggatagaccttttgggacagcggtg

SEQ ID NO: 447632 - DNA, 140 bp, Artificial Sequence
  Synthetic
caccgctgtcccaaaaggtctatccattaagggatgagcaatcatggataatgaactaatatccttgtaatgggctggcccaaagaggttgacatcagatgtatcaaaagactccatctccatatcagcagccagggcct

SEQ ID NO: 447633 - DNA, 140 bp, Artificial Sequence
  Synthetic
atacgccatgctgggtctccagaaggcctcatagatcagtacgtgtaggagcaatatgtagaaataagtagacataagcaaactaaattatgtaaatattgtacagacaggtcaaattatcgtacttgggagtcggccat

SEQ ID NO: 447634 - DNA, 140 bp, Artificial Sequence
  Synthetic
atggccgactcccaagtacgataatttgacctgtctgtacaatatttacataatttagtttgcttatgtctacttatttctacatattgctcctacacgtactgatctatgaggccttctggagacccagcatggcgtat

SEQ ID NO: 447635 - DNA, 140 bp, Artificial Sequence
  Synthetic
aggccctggctgctgatatggttctggtgtgtgaagcggttattagagtgtctctaagctccacaagagaagagacctgttttggtgactccaccaacccagagatgattgaaggagcttgaccttttgggacagcggtg

SEQ ID NO: 447636 - DNA, 140 bp, Artificial Sequence
  Synthetic
caccgctgtcccaaaaggtcaagctccttcaatcatctctgggttggtggagtcaccaaaacaggtctcttctcttgtggagcttagagacactctaataaccgcttcacacaccagaaccatatcagcagccagggcct

SEQ ID NO: 447637 - DNA, 140 bp, Artificial Sequence
  Synthetic
atacgccatgctgggtctccagagacctgttttggtgactccaccaacccagagatgattgaaggagcttgggattcactcagagaggaggagatgccagaggagctctcctgttctatacgtacttgggagtcggccat

SEQ ID NO: 447638 - DNA, 140 bp, Artificial Sequence
  Synthetic
atggccgactcccaagtacgtatagaacaggagagctcctctggcatctcctcctctctgagtgaatcccaagctccttcaatcatctctgggttggtggagtcaccaaaacaggtctctggagacccagcatggcgtat

SEQ ID NO: 447639 - DNA, 140 bp, Artificial Sequence
  Synthetic
aggccctggctgctgatatgtcaggcataagggaggttaagacctcaagccaggagttatacagggcattaaaagccatcattgctgctgatggcttgaacaacatcacctgccatggtagaccttttgggacagcggtg

SEQ ID NO: 447640 - DNA, 140 bp, Artificial Sequence
  Synthetic
caccgctgtcccaaaaggtctaccatggcaggtgatgttgttcaagccatcagcagcaatgatggcttttaatgccctgtataactcctggcttgaggtcttaacctcccttatgcctgacatatcagcagccagggcct

SEQ ID NO: 447641 - DNA, 140 bp, Artificial Sequence
  Synthetic
aggccctggctgctgatatgaacaatgacgggaaaatggcttcagtcaagtgcccacctaagtatgagctcactgaggactgcaacttttgtagacagatgacaggtgctagcctaaagagaccttttgggacagcggtg

SEQ ID NO: 447642 - DNA, 140 bp, Artificial Sequence
  Synthetic
caccgctgtcccaaaaggtctctttaggctagcacctgtcatctgtctacaaaagttgcagtcctcagtgagctcatacttaggtgggcacttgactgaagccattttcccgtcattgttcatatcagcagccagggcct

SEQ ID NO: 447643 - DNA, 140 bp, Artificial Sequence
  Synthetic
atacgccatgctgggtctccacacaaagaccccctagtgcttatcaagtatatcatggattactttcctgtgatatctgttgatttgcagagtggtcgtcaggcagcaaaagaggacattcgtacttgggagtcggccat

SEQ ID NO: 447644 - DNA, 140 bp, Artificial Sequence
  Synthetic
atggccgactcccaagtacgaatgtcctcttttgctgcctgacgaccactctgcaaatcaacagatatcacaggaaagtaatccatgatatacttgataagcactagggggtctttgtgtggagacccagcatggcgtat

SEQ ID NO: 447645 - DNA, 140 bp, Artificial Sequence
  Synthetic
aggccctggctgctgatatgtgatatctgttgatttgcagagtggtcgtcaggcagcaaaagaggacatttctaatgctgtagttccaaactcagccctcattgctcttatggaggagaggaccttttgggacagcggtg

SEQ ID NO: 447646 - DNA, 140 bp, Artificial Sequence
  Synthetic
caccgctgtcccaaaaggtcctctcctccataagagcaatgagggctgagtttggaactacagcattagaaatgtcctcttttgctgcctgacgaccactctgcaaatcaacagatatcacatatcagcagccagggcct

SEQ ID NO: 447647 - DNA, 140 bp, Artificial Sequence
  Synthetic
atacgccatgctgggtctccaggggtcttatcctctccaggacttattttgtcagtcaagtgaggatgatggatcaaaattaaaaacaaaaatgaaaggggtctgcgaagtgggggttcacgtacttgggagtcggccat

SEQ ID NO: 447648 - DNA, 140 bp, Artificial Sequence
  Synthetic
atggccgactcccaagtacgtgaacccccacttcgcagacccctttcatttttgtttttaattttgatccatcatcctcacttgactgacaaaataagtcctggagaggataagacccctggagacccagcatggcgtat

SEQ ID NO: 447649 - DNA, 140 bp, Artificial Sequence
  Synthetic
atacgccatgctgggtctccaagaattctctcctcttctcatggcttataaagttgctattcactgctgcattcattggctgcgtgaatgttgcagcaacctcctcctttgttctgcctccgtacttgggagtcggccat

SEQ ID NO: 447650 - DNA, 140 bp, Artificial Sequence
  Synthetic
atggccgactcccaagtacggaggcagaacaaaggaggaggttgctgcaacattcacgcagccaatgaatgcagcagtgaatagcaactttataagccatgagaagaggagagaattcttggagacccagcatggcgtat

SEQ ID NO: 447651 - DNA, 140 bp, Artificial Sequence
  Synthetic
atacgccatgctgggtctccgccttgcacaacttgtataaccaaatgtgagcctcatgggttggttgtccgatcaacagggttcaagatatcatctgcagttgcttgtgctagcggagttcgtacttgggagtcggccat

SEQ ID NO: 447652 - DNA, 140 bp, Artificial Sequence
  Synthetic
atggccgactcccaagtacgaactccgctagcacaagcaactgcagatgatatcttgaaccctgttgatcggacaaccaacccatgaggctcacatttggttatacaagttgtgcaaggcggagacccagcatggcgtat

SEQ ID NO: 447653 - DNA, 140 bp, Artificial Sequence
  Synthetic
aggccctggctgctgatatggatcaacagggttcaagatatcatctgcagttgcttgtgctagcggagtttgcgtcacaggatcgcagagtccttccaccgagattacactcaagtatccgaccttttgggacagcggtg

SEQ ID NO: 447654 - DNA, 140 bp, Artificial Sequence
  Synthetic
caccgctgtcccaaaaggtcggatacttgagtgtaatctcggtggaaggactctgcgatcctgtgacgcaaactccgctagcacaagcaactgcagatgatatcttgaaccctgttgatccatatcagcagccagggcct

SEQ ID NO: 447655 - DNA, 140 bp, Artificial Sequence
  Synthetic
aggccctggctgctgatatgccagtgtcacactgctctcagtgcctttgttgttgtgtttgtattcagttctattgcaataatttgtttagctattctttatagggtgctcaagtgcctagaccttttgggacagcggtg

SEQ ID NO: 447656 - DNA, 140 bp, Artificial Sequence
  Synthetic
caccgctgtcccaaaaggtctaggcacttgagcaccctataaagaatagctaaacaaattattgcaatagaactgaatacaaacacaacaacaaaggcactgagagcagtgtgacactggcatatcagcagccagggcct

SEQ ID NO: 447657 - DNA, 140 bp, Artificial Sequence
  Synthetic
aggccctggctgctgatatgccgtgcttagtgcatggctgcatagtgtgtgctcatggcctgataaattaccagtgtcacactgctctcagtgcctttgttgttgtgtttgtgttcagttgaccttttgggacagcggtg

SEQ ID NO: 447658 - DNA, 140 bp, Artificial Sequence
  Synthetic
caccgctgtcccaaaaggtcaactgaacacaaacacaacaacaaaggcactgagagcagtgtgacactggtaatttatcaggccatgagcacacactatgcagccatgcactaagcacggcatatcagcagccagggcct

SEQ ID NO: 447659 - DNA, 140 bp, Artificial Sequence
  Synthetic
aggccctggctgctgatatgcatcagatgggtgtataagaagatggttgccagagtggcagacaatattaatcaagtgaacagggaaataggatggatggaaggaggtcagttggttctagaccttttgggacagcggtg

SEQ ID NO: 447660 - DNA, 140 bp, Artificial Sequence
  Synthetic
caccgctgtcccaaaaggtctagaaccaactgacctccttccatccatcctatttccctgttcacttgattaatattgtctgccactctggcaaccatcttcttatacacccatctgatgcatatcagcagccagggcct

SEQ ID NO: 447661 - DNA, 140 bp, Artificial Sequence
  Synthetic
atacgccatgctgggtctccatcatctagccgtttcacaaactggggttcagttagcctctcactggacgcagagggcatttcaggctcaaatagcttttctttcattgagagcccaggccgtacttgggagtcggccat

SEQ ID NO: 447662 - DNA, 140 bp, Artificial Sequence
  Synthetic
atggccgactcccaagtacggcctgggctctcaatgaaagaaaagctatttgagcctgaaatgccctctgcgtccagtgagaggctaactgaaccccagtttgtgaaacggctagatgatggagacccagcatggcgtat

SEQ ID NO: 447663 - DNA, 140 bp, Artificial Sequence
  Synthetic
aggccctggctgctgatatgcctccacagttgctttgccttctttcgacattttcatcatcatcctccggggcttgttgccacgagttagagccagaacaatcattttcttggcatccttgaccttttgggacagcggtg

SEQ ID NO: 447664 - DNA, 140 bp, Artificial Sequence
  Synthetic
caccgctgtcccaaaaggtcaaggatgccaagaaaatgattgttctggctctaactcgtggcaacaagccccggaggatgatgatgaaaatgtcgaaagaaggcaaagcaactgtggaggcatatcagcagccagggcct

SEQ ID NO: 447665 - DNA, 140 bp, Artificial Sequence
  Synthetic
atacgccatgctgggtctccgatcaattggagtgcacaacaaatctgattgacccctttgttgtatttgagaggggttctctgccacagacaaggaatgacaaaacctttgctgcttcaacgtacttgggagtcggccat

SEQ ID NO: 447666 - DNA, 140 bp, Artificial Sequence
  Synthetic
atggccgactcccaagtacgttgaagcagcaaaggttttgtcattccttgtctgtggcagagaacccctctcaaatacaacaaaggggtcaatcagatttgttgtgcactccaattgatcggagacccagcatggcgtat

SEQ ID NO: 447667 - DNA, 140 bp, Artificial Sequence
  Synthetic
aggccctggctgctgatatgtcaggcataagggaggttaagacctcaagccaggaattatacagggcattaaaagccatcattgctgctgatggcttgaacaacatcacctgccatggtagaccttttgggacagcggtg

SEQ ID NO: 447668 - DNA, 140 bp, Artificial Sequence
  Synthetic
caccgctgtcccaaaaggtctaccatggcaggtgatgttgttcaagccatcagcagcaatgatggcttttaatgccctgtataattcctggcttgaggtcttaacctcccttatgcctgacatatcagcagccagggcct

SEQ ID NO: 447669 - DNA, 140 bp, Artificial Sequence
  Synthetic
atacgccatgctgggtctcccaggggccagggtctgcctgtctatcacatccacaggaactggaactctctctgcccacaataaggatgggtctctgcatatagttcttccatcagagaacgtacttgggagtcggccat

SEQ ID NO: 447670 - DNA, 140 bp, Artificial Sequence
  Synthetic
atggccgactcccaagtacgttctctgatggaagaactatatgcagagacccatccttattgtgggcagagagagttccagttcctgtggatgtgatagacaggcagaccctggcccctgggagacccagcatggcgtat

SEQ ID NO: 447671 - DNA, 140 bp, Artificial Sequence
  Synthetic
aggccctggctgctgatatgcgggtggggatagttcggtgtgagagacgaagagacgctaagcaaatagggagagaaaccatggcagggattgcaatgacagtccttccagccttagcaggaccttttgggacagcggtg

SEQ ID NO: 447672 - DNA, 140 bp, Artificial Sequence
  Synthetic
caccgctgtcccaaaaggtcctgctaaggctggaaggactgtcattgcaatccctgccatggtttctctccctatttgcttagcgtctcttcgtctctcacaccgaactatccccacccgcatatcagcagccagggcct

SEQ ID NO: 447673 - DNA, 140 bp, Artificial Sequence
  Synthetic
aggccctggctgctgatatgcatatatcttggaagaacaggcctctctaaaatgtggcttgctgctactaagaaggcctcatagatcagtacgtgtagaagcaatatgtagaaataagtagaccttttgggacagcggtg

SEQ ID NO: 447674 - DNA, 140 bp, Artificial Sequence
  Synthetic
caccgctgtcccaaaaggtctacttatttctacatattgcttctacacgtactgatctatgaggccttcttagtagcagcaagccacattttagagaggcctgttcttccaagatatatgcatatcagcagccagggcct

SEQ ID NO: 447675 - DNA, 140 bp, Artificial Sequence
  Synthetic
aggccctggctgctgatatggacataagcaaacctaattatgtaaatattgtacagataggtcaaattattggaacatccaagcttagaaacttctgcaatgatactttagatgtaagctgaccttttgggacagcggtg

SEQ ID NO: 447676 - DNA, 140 bp, Artificial Sequence
  Synthetic
caccgctgtcccaaaaggtcagcttacatctaaagtatcattgcagaagtttctaagcttggatgttccaataatttgacctatctgtacaatatttacataattaggtttgcttatgtccatatcagcagccagggcct

SEQ ID NO: 447677 - DNA, 140 bp, Artificial Sequence
  Synthetic
aggccctggctgctgatatgtagttgtaatttggggtggtggggtgaggcagcagcagtctcaagtgcttgtgaatattctagttggcgtgattgtcttttgccagattagctgggaattgaccttttgggacagcggtg

SEQ ID NO: 447678 - DNA, 140 bp, Artificial Sequence
  Synthetic
caccgctgtcccaaaaggtcaattcccagctaatctggcaaaagacaatcacgccaactagaatattcacaagcacttgagactgctgctgcctcaccccaccaccccaaattacaactacatatcagcagccagggcct

SEQ ID NO: 447679 - DNA, 140 bp, Artificial Sequence
  Synthetic
aggccctggctgctgatatgcagtctcaagtgcttgtgaatattctagttggcgtgattgtcttttgccagattagctgggaattaaactaactctttgaagttgcaccggtctttgtgtgaccttttgggacagcggtg

SEQ ID NO: 447680 - DNA, 140 bp, Artificial Sequence
  Synthetic
caccgctgtcccaaaaggtcacacaaagaccggtgcaacttcaaagagttagtttaattcccagctaatctggcaaaagacaatcacgccaactagaatattcacaagcacttgagactgcatatcagcagccagggcct

SEQ ID NO: 447681 - DNA, 140 bp, Artificial Sequence
  Synthetic
aggccctggctgctgatatgaagattgccccaaggaaagttctgaatccactaatgtggattactgccttcatcagatgggtgtataagaagatggttgccagagtggcagacaatattagaccttttgggacagcggtg

SEQ ID NO: 447682 - DNA, 140 bp, Artificial Sequence
  Synthetic
caccgctgtcccaaaaggtctaatattgtctgccactctggcaaccatcttcttatacacccatctgatgaaggcagtaatccacattagtggattcagaactttccttggggcaatcttcatatcagcagccagggcct

SEQ ID NO: 447683 - DNA, 140 bp, Artificial Sequence
  Synthetic
atacgccatgctgggtctcctgattcaggcaagctccagaatcaccacttgctctacagaaggtgtcaacaccaagtgtaggctgtctggcacagcattaatcagggcagggtcagttggcgtacttgggagtcggccat

SEQ ID NO: 447684 - DNA, 140 bp, Artificial Sequence
  Synthetic
atggccgactcccaagtacgccaactgaccctgccctgattaatgctgtgccagacagcctacacttggtgttgacaccttctgtagagcaagtggtgattctggagcttgcctgaatcaggagacccagcatggcgtat

SEQ ID NO: 447685 - DNA, 140 bp, Artificial Sequence
  Synthetic
atacgccatgctgggtctccaccaagtgtaggctgtctggcacagcattaatcagggcagggtcagttggggcagaggcttgtttgatgttgaagggggtcaaggaagaccaaaccaagtcgtacttgggagtcggccat

SEQ ID NO: 447686 - DNA, 140 bp, Artificial Sequence
  Synthetic
atggccgactcccaagtacgacttggtttggtcttccttgacccccttcaacatcaaacaagcctctgccccaactgaccctgccctgattaatgctgtgccagacagcctacacttggtggagacccagcatggcgtat

SEQ ID NO: 447687 - DNA, 140 bp, Artificial Sequence
  Synthetic
aggccctggctgctgatatgctttagtgcaacaaatgagagacaggagtaaacagcctttctccccagatcatgatgtggatcacatatctgaatttctctctgcatgctctagtgacttgaccttttgggacagcggtg

SEQ ID NO: 447688 - DNA, 140 bp, Artificial Sequence
  Synthetic
caccgctgtcccaaaaggtcaagtcactagagcatgcagagagaaattcagatatgtgatccacatcatgatctggggagaaaggctgtttactcctgtctctcatttgttgcactaaagcatatcagcagccagggcct

SEQ ID NO: 447689 - DNA, 140 bp, Artificial Sequence
  Synthetic
aggccctggctgctgatatgccaggaaaaggatgatgatgaatttgaattatctcaagatcctggatggtcatcgggagcttgatattagagatgactttgtgatggatctcttcaaagcgaccttttgggacagcggtg

SEQ ID NO: 447690 - DNA, 140 bp, Artificial Sequence
  Synthetic
caccgctgtcccaaaaggtcgctttgaagagatccatcacaaagtcatctctaatatcaagctcccgatgaccatccaggatcttgagataattcaaattcatcatcatccttttcctggcatatcagcagccagggcct

SEQ ID NO: 447691 - DNA, 140 bp, Artificial Sequence
  Synthetic
aggccctggctgctgatatgggttatccgtgacaatttctcccggatgggccatcttcgaggtgtagaagaccttgctggcttcactcgtagtgtgtcagctgaaattctcaagcactttgaccttttgggacagcggtg

SEQ ID NO: 447692 - DNA, 140 bp, Artificial Sequence
  Synthetic
caccgctgtcccaaaaggtcaaagtgcttgagaatttcagctgacacactacgagtgaagccagcaaggtcttctacacctcgaagatggcccatccgggagaaattgtcacggataacccatatcagcagccagggcct

SEQ ID NO: 447693 - DNA, 140 bp, Artificial Sequence
  Synthetic
atacgccatgctgggtctccagggatgtcccagtcctctgggggggacataggggttcatatggcacatgatgatcagtcagttagctccaaaatagtagctcactgccctccccaggatcgtacttgggagtcggccat

SEQ ID NO: 447694 - DNA, 140 bp, Artificial Sequence
  Synthetic
atggccgactcccaagtacgatcctggggagggcagtgagctactattttggagctaactgactgatcatcatgtgccatatgaacccctatgtcccccccagaggactgggacatccctggagacccagcatggcgtat

SEQ ID NO: 447695 - DNA, 140 bp, Artificial Sequence
  Synthetic
atacgccatgctgggtctcccgtatctttcgcaattaagcgctcttgctgggcctttgacctctccacttccagggttttcaagccttatatagatgctggggatctgttagttactgaccgtacttgggagtcggccat

SEQ ID NO: 447696 - DNA, 140 bp, Artificial Sequence
  Synthetic
atggccgactcccaagtacggtcagtaactaacagatccccagcatctatataaggcttgaaaaccctggaagtggagaggtcaaaggcccagcaagagcgcttaattgcgaaagatacgggagacccagcatggcgtat

SEQ ID NO: 447697 - DNA, 140 bp, Artificial Sequence
  Synthetic
aggccctggctgctgatatggctttgtctcgcccccagaaatcccaaaacctcacaagatgacctctaagtttcccaaggttctcaggtcagagctgcaggtttacttattaaactgcttgaccttttgggacagcggtg

SEQ ID NO: 447698 - DNA, 140 bp, Artificial Sequence
  Synthetic
caccgctgtcccaaaaggtcaagcagtttaataagtaaacctgcagctctgacctgagaaccttgggaaacttagaggtcatcttgtgaggttttgggatttctgggggcgagacaaagccatatcagcagccagggcct

SEQ ID NO: 447699 - DNA, 140 bp, Artificial Sequence
  Synthetic
aggccctggctgctgatatgctcctcatttgcctgtatgttgcattatcaattgggctctttttccttcttatatatcttggaagaacaggtctttctaaaatgtggcttgctgctactagaccttttgggacagcggtg

SEQ ID NO: 447700 - DNA, 140 bp, Artificial Sequence
  Synthetic
caccgctgtcccaaaaggtctagtagcagcaagccacattttagaaagacctgttcttccaagatatataagaaggaaaaagagcccaattgataatgcaacatacaggcaaatgaggagcatatcagcagccagggcct

SEQ ID NO: 447701 - DNA, 140 bp, Artificial Sequence
  Synthetic
aggccctggctgctgatatgggtcactatctttaatgagcagaagaccctccgaacatccccagagaagttggtgtcagacaagtggtttgggactcagaaaagtagaataggcaaaacagaccttttgggacagcggtg

SEQ ID NO: 447702 - DNA, 140 bp, Artificial Sequence
  Synthetic
caccgctgtcccaaaaggtctgttttgcctattctacttttctgagtcccaaaccacttgtctgacaccaacttctctggggatgttcggagggtcttctgctcattaaagatagtgacccatatcagcagccagggcct

SEQ ID NO: 447703 - DNA, 140 bp, Artificial Sequence
  Synthetic
aggccctggctgctgatatgagaaaattatagaacttgagcaccttagaccacagtcagatgccttcttgggttataaagatccagaactgcctagaatgcatgagttcagtgtttcctagaccttttgggacagcggtg

SEQ ID NO: 447704 - DNA, 140 bp, Artificial Sequence
  Synthetic
caccgctgtcccaaaaggtctaggaaacactgaactcatgcattctaggcagttctggatctttataacccaagaaggcatctgactgtggtctaaggtgctcaagttctataattttctcatatcagcagccagggcct

SEQ ID NO: 447705 - DNA, 140 bp, Artificial Sequence
  Synthetic
atacgccatgctgggtctccggttataaagatccagaactgcctagaatgcatgagttcagtgtttcctacttgaaggaggcttgcaatcatgctaagctagtcttaaggagcctctatgcgtacttgggagtcggccat

SEQ ID NO: 447706 - DNA, 140 bp, Artificial Sequence
  Synthetic
atggccgactcccaagtacgcatagaggctccttaagactagcttagcatgattgcaagcctccttcaagtaggaaacactgaactcatgcattctaggcagttctggatctttataaccggagacccagcatggcgtat

SEQ ID NO: 447707 - DNA, 140 bp, Artificial Sequence
  Synthetic
aggccctggctgctgatatgcttgaaggaggcttgcaatcatgctaagctagtcttaaggagcctctatggacagaatttcatggagcaaatagacaaccagattattcgagagctcagtgaccttttgggacagcggtg

SEQ ID NO: 447708 - DNA, 140 bp, Artificial Sequence
  Synthetic
caccgctgtcccaaaaggtcactgagctctcgaataatctggttgtctatttgctccatgaaattctgtccatagaggctccttaagactagcttagcatgattgcaagcctccttcaagcatatcagcagccagggcct

SEQ ID NO: 447709 - DNA, 140 bp, Artificial Sequence
  Synthetic
aggccctggctgctgatatgcagtctcaagtacttgtgaatattctagttggcgtgattgtcttttgccagattagctgaaaattaaactaactctttgaggttgcaccggtctttgtgtgaccttttgggacagcggtg

SEQ ID NO: 447710 - DNA, 140 bp, Artificial Sequence
  Synthetic
caccgctgtcccaaaaggtcacacaaagaccggtgcaacctcaaagagttagtttaattttcagctaatctggcaaaagacaatcacgccaactagaatattcacaagtacttgagactgcatatcagcagccagggcct

SEQ ID NO: 447711 - DNA, 140 bp, Artificial Sequence
  Synthetic
atacgccatgctgggtctcctatgcatatttgtttgtttaagaaacaacagcatggaggtctgagagagatctatgtgatgggtgcagaggaaagaattgttcaatcggtggtggagacacgtacttgggagtcggccat

SEQ ID NO: 447712 - DNA, 140 bp, Artificial Sequence
  Synthetic
atggccgactcccaagtacgtgtctccaccaccgattgaacaattctttcctctgcacccatcacatagatctctctcagacctccatgctgttgtttcttaaacaaacaaatatgcataggagacccagcatggcgtat

SEQ ID NO: 447713 - DNA, 140 bp, Artificial Sequence
  Synthetic
atacgccatgctgggtctcccatcgggagcttgatattagagatgactttgtgatggatctcttcaaagcttatcatggtgaggcagaagttccatgggcctttaaaggcaaaacatattcgtacttgggagtcggccat

SEQ ID NO: 447714 - DNA, 140 bp, Artificial Sequence
  Synthetic
atggccgactcccaagtacgaatatgttttgcctttaaaggcccatggaacttctgcctcaccatgataagctttgaagagatccatcacaaagtcatctctaatatcaagctcccgatgggagacccagcatggcgtat

SEQ ID NO: 447715 - DNA, 140 bp, Artificial Sequence
  Synthetic
atacgccatgctgggtctccacacaaagctccctagagatacaaacactattacaataatggacaactatcaagagcttgcgatccagtttgctgctcaagcagtggaccgcaatgagatcgtacttgggagtcggccat

SEQ ID NO: 447716 - DNA, 140 bp, Artificial Sequence
  Synthetic
atggccgactcccaagtacgatctcattgcggtccactgcttgagcagcaaactggatcgcaagctcttgatagttgtccattattgtaatagtgtttgtatctctagggagctttgtgtggagacccagcatggcgtat

SEQ ID NO: 447717 - DNA, 140 bp, Artificial Sequence
  Synthetic
aggccctggctgctgatatgctattacacaccattcatcaagaatacatccggtccttgtcctttaaaatattcaacctgaaggttgctcctgagatgagcaagagcctggtttgtgacagaccttttgggacagcggtg

SEQ ID NO: 447718 - DNA, 140 bp, Artificial Sequence
  Synthetic
caccgctgtcccaaaaggtctgtcacaaaccaggctcttgctcatctcaggagcaaccttcaggttgaatattttaaaggacaaggaccggatgtattcttgatgaatggtgtgtaatagcatatcagcagccagggcct

SEQ ID NO: 447719 - DNA, 140 bp, Artificial Sequence
  Synthetic
aggccctggctgctgatatgtgatgcaaggatcagatgatagtagcatgctaatcagcttcccagctgatgatgagaaggttcttaccagatgcaaagtggccgcagccatatgcttccggaccttttgggacagcggtg

SEQ ID NO: 447720 - DNA, 140 bp, Artificial Sequence
  Synthetic
caccgctgtcccaaaaggtccggaagcatatggctgcggccactttgcatctggtaagaaccttctcatcatcagctgggaagctgattagcatgctactatcatctgatccttgcatcacatatcagcagccagggcct

SEQ ID NO: 447721 - DNA, 140 bp, Artificial Sequence
  Synthetic
atacgccatgctgggtctccgatgatgaaaatgtcaaaagagggcaaggcaactgtggaggccctcatcaacaagtacaagctaaaggaggggaatccttcccgggatgagttgactctacgtacttgggagtcggccat

SEQ ID NO: 447722 - DNA, 140 bp, Artificial Sequence
  Synthetic
atggccgactcccaagtacgtagagtcaactcatcccgggaaggattcccctcctttagcttgtacttgttgatgagggcctccacagttgccttgccctcttttgacattttcatcatcggagacccagcatggcgtat

SEQ ID NO: 447723 - DNA, 140 bp, Artificial Sequence
  Synthetic
atacgccatgctgggtctccccacagcaaacacagattttgtgatggagtacaattctgaattttatttccacacccagcatgttagaccaacgatcaggtggattgcagcatgttgcagcgtacttgggagtcggccat

SEQ ID NO: 447724 - DNA, 140 bp, Artificial Sequence
  Synthetic
atggccgactcccaagtacgctgcaacatgctgcaatccacctgatcgttggtctaacatgctgggtgtggaaataaaattcagaattgtactccatcacaaaatctgtgtttgctgtggggagacccagcatggcgtat

SEQ ID NO: 447725 - DNA, 140 bp, Artificial Sequence
  Synthetic
aggccctggctgctgatatgcacacccagcatgttagaccaacgatcaggtggattgcagcatgttgcagcctgccagaagtggaaacactagtagcccgtcaggaagaggcctctaaccgaccttttgggacagcggtg

SEQ ID NO: 447726 - DNA, 140 bp, Artificial Sequence
  Synthetic
caccgctgtcccaaaaggtcggttagaggcctcttcctgacgggctactagtgtttccacttctggcaggctgcaacatgctgcaatccacctgatcgttggtctaacatgctgggtgtgcatatcagcagccagggcct

SEQ ID NO: 447727 - DNA, 140 bp, Artificial Sequence
  Synthetic
aggccctggctgctgatatgctgcatacccaaggcatatgatgcaccctagctttgctggcatggtggacccttctctgccagaagactatctgagggcaatattggatgctcactctctgaccttttgggacagcggtg

SEQ ID NO: 447728 - DNA, 140 bp, Artificial Sequence
  Synthetic
caccgctgtcccaaaaggtcagagagtgagcatccaatattgccctcagatagtcttctggcagagaagggtccaccatgccagcaaagctagggtgcatcatatgccttgggtatgcagcatatcagcagccagggcct

SEQ ID NO: 447729 - DNA, 140 bp, Artificial Sequence
  Synthetic
aggccctggctgctgatatgaccttcctggctgaatgggaaaagctaaagaaaattgtgaagtggttggaagacactccagaagcaactctagctcacaccccactgaataaccatattcgaccttttgggacagcggtg

SEQ ID NO: 447730 - DNA, 140 bp, Artificial Sequence
  Synthetic
caccgctgtcccaaaaggtcgaatatggttattcagtggggtgtgagctagagttgcttctggagtgtcttccaaccacttcacaattttctttagcttttcccattcagccaggaaggtcatatcagcagccagggcct

SEQ ID NO: 447731 - DNA, 140 bp, Artificial Sequence
  Synthetic
aggccctggctgctgatatgggttttagatttaatctcttcaaagctatcaccagaactgatttgcagaagctatatgctttcttcatgaagaaggtcaagggctcagctgctagggactgaccttttgggacagcggtg

SEQ ID NO: 447732 - DNA, 140 bp, Artificial Sequence
  Synthetic
caccgctgtcccaaaaggtcagtccctagcagctgagcccttgaccttcttcatgaagaaagcatatagcttctgcaaatcagttctggtgatagctttgaagagattaaatctaaaacccatatcagcagccagggcct

SEQ ID NO: 447733 - DNA, 140 bp, Artificial Sequence
  Synthetic
aggccctggctgctgatatggggcagatgaagatatcaccatcccagaaacgtgtagcgtgagcccaggtggtgctctaattcttagctcctctctaaagtggggatctaggaagaagttgaccttttgggacagcggtg

SEQ ID NO: 447734 - DNA, 140 bp, Artificial Sequence
  Synthetic
caccgctgtcccaaaaggtcaacttcttcctagatccccactttagagaggagctaagaattagagcaccacctgggctcacgctacacgtttctgggatggtgatatcttcatctgccccatatcagcagccagggcct

SEQ ID NO: 447735 - DNA, 140 bp, Artificial Sequence
  Synthetic
aggccctggctgctgatatgattatggagttgggatttggagaggcttcatggatggatatcaggtccatctagagatagaaaatgacataggacagcccccaaggcttaggaatgtcacgaccttttgggacagcggtg

SEQ ID NO: 447736 - DNA, 140 bp, Artificial Sequence
  Synthetic
caccgctgtcccaaaaggtcgtgacattcctaagccttgggggctgtcctatgtcattttctatctctagatggacctgatatccatccatgaagcctctccaaatcccaactccataatcatatcagcagccagggcct

SEQ ID NO: 447737 - DNA, 140 bp, Artificial Sequence
  Synthetic
atacgccatgctgggtctccccttaacctctagtcaacctcaacaaatccatcatcatcactctcctcctctgattccatctcaacatctgggattggaggaacaactggaatccagttgcgtacttgggagtcggccat

SEQ ID NO: 447738 - DNA, 140 bp, Artificial Sequence
  Synthetic
atggccgactcccaagtacgcaactggattccagttgttcctccaatcccagatgttgagatggaatcagaggaggagagtgatgatgatggatttgttgaggttgactagaggttaaggggagacccagcatggcgtat

SEQ ID NO: 447739 - DNA, 140 bp, Artificial Sequence
  Synthetic
atacgccatgctgggtctcctttctccccatcatgctaggaagtgatgagcgcagcatcaggctctcctccataagagcaatgagggctgagtttggaactacagcattagaaatgtcctcgtacttgggagtcggccat

SEQ ID NO: 447740 - DNA, 140 bp, Artificial Sequence
  Synthetic
atggccgactcccaagtacgaggacatttctaatgctgtagttccaaactcagccctcattgctcttatggaggagagcctgatgctgcgctcatcacttcctagcatgatggggagaaaggagacccagcatggcgtat

SEQ ID NO: 447741 - DNA, 140 bp, Artificial Sequence
  Synthetic
atacgccatgctgggtctcccttttgctgcctgcagaagccgaacacactggacgtgagcaacctcatacatgaggtcaaagcctggcaacaggcacagatcaatccctctgagaatagccgtacttgggagtcggccat

SEQ ID NO: 447742 - DNA, 140 bp, Artificial Sequence
  Synthetic
atggccgactcccaagtacggctattctcagagggattgatctgtgcctgttgccaggctttgacctcatgtatgaggttgctcacgtccagtgtgttcggcttctgcaggcagcaaaagggagacccagcatggcgtat

SEQ ID NO: 447743 - DNA, 140 bp, Artificial Sequence
  Synthetic
atacgccatgctgggtctccctcggtcactatcatcctgtgtaggccaacaaaggagtcttccagatcattggtgatcttgcagctcctcattgctagagtggcaatctgatcccttctacgtacttgggagtcggccat

SEQ ID NO: 447744 - DNA, 140 bp, Artificial Sequence
  Synthetic
atggccgactcccaagtacgtagaagggatcagattgccactctagcaatgaggagctgcaagatcaccaatgatctggaagactcctttgttggcctacacaggatgatagtgaccgagggagacccagcatggcgtat

SEQ ID NO: 447745 - DNA, 140 bp, Artificial Sequence
  Synthetic
atacgccatgctgggtctccatgtcatcatttctgtgcactctagtagagcttaggtcaaagaaagccagagagggttctccaagaggccaggatatggcttctttcagattggggaacccgtacttgggagtcggccat

SEQ ID NO: 447746 - DNA, 140 bp, Artificial Sequence
  Synthetic
atggccgactcccaagtacgggttccccaatctgaaagaagccatatcctggcctcttggagaaccctctctggctttctttgacctaagctctactagagtgcacagaaatgatgacatggagacccagcatggcgtat

SEQ ID NO: 447747 - DNA, 140 bp, Artificial Sequence
  Synthetic
aggccctggctgctgatatgggtgatcacgttgtccccataattgaagagatgggagccggaacagtgggtggattcatcaagagacaacaatctaaagttgtgcagaacaaagtggtctgaccttttgggacagcggtg

SEQ ID NO: 447748 - DNA, 140 bp, Artificial Sequence
  Synthetic
caccgctgtcccaaaaggtcagaccactttgttctgcacaactttagattgttgtctcttgatgaatccacccactgttccggctcccatctcttcaattatggggacaacgtgatcacccatatcagcagccagggcct

SEQ ID NO: 447749 - DNA, 140 bp, Artificial Sequence
  Synthetic
atacgccatgctgggtctccttgtgaaatcactaagagtcatatggcctattagatcaataagtctctgaaaaggctttgctggtggaggtgcaacgtttgatgcaaagtctccaagtcccgtacttgggagtcggccat

SEQ ID NO: 447750 - DNA, 140 bp, Artificial Sequence
  Synthetic
atggccgactcccaagtacgggacttggagactttgcatcaaacgttgcacctccaccagcaaagccttttcagagacttattgatctaataggccatatgactcttagtgatttcacaaggagacccagcatggcgtat

SEQ ID NO: 447751 - DNA, 140 bp, Artificial Sequence
  Synthetic
aggccctggctgctgatatgggtgatcacgttgtccccataattgaagagatgggagccggaacagtgggtggatttatcaagagacaacaatctaaagtcgtgcaaaacaaagtggtctgaccttttgggacagcggtg

SEQ ID NO: 447752 - DNA, 140 bp, Artificial Sequence
  Synthetic
caccgctgtcccaaaaggtcagaccactttgttttgcacgactttagattgttgtctcttgataaatccacccactgttccggctcccatctcttcaattatggggacaacgtgatcacccatatcagcagccagggcct

SEQ ID NO: 447753 - DNA, 140 bp, Artificial Sequence
  Synthetic
atacgccatgctgggtctccgactcggtacgggaattctccgacattgtagaaatcagagaatcgcaagcgaacctcgtgactaggacgatggtgcatgagaaagacacaacagggcccacgtacttgggagtcggccat

SEQ ID NO: 447754 - DNA, 140 bp, Artificial Sequence
  Synthetic
atggccgactcccaagtacgtgggccctgttgtgtctttctcatgcaccatcgtcctagtcacgaggttcgcttgcgattctctgatttctacaatgtcggagaattcccgtaccgagtcggagacccagcatggcgtat

SEQ ID NO: 447755 - DNA, 140 bp, Artificial Sequence
  Synthetic
atacgccatgctgggtctccgacagaatttcatggagcagatagacaaccaaattattcgagagctcagtgggctaactctagaaaggctagccacacttaaggccacaagcaactttaacgtacttgggagtcggccat

SEQ ID NO: 447756 - DNA, 140 bp, Artificial Sequence
  Synthetic
atggccgactcccaagtacgttaaagttgcttgtggccttaagtgtggctagcctttctagagttagcccactgagctctcgaataatttggttgtctatctgctccatgaaattctgtcggagacccagcatggcgtat

SEQ ID NO: 447757 - DNA, 140 bp, Artificial Sequence
  Synthetic
aggccctggctgctgatatgatactccactgacacaacacgacgaccactctgcaaatcaacagatatcacaggaaagtaatccatgatatacttgataagcactagggggtctttgtgtgaccttttgggacagcggtg

SEQ ID NO: 447758 - DNA, 140 bp, Artificial Sequence
  Synthetic
caccgctgtcccaaaaggtcacacaaagaccccctagtgcttatcaagtatatcatggattactttcctgtgatatctgttgatttgcagagtggtcgtcgtgttgtgtcagtggagtatcatatcagcagccagggcct

SEQ ID NO: 447759 - DNA, 140 bp, Artificial Sequence
  Synthetic
aggccctggctgctgatatgcaagccatttggatgcccagtttatattattaagggtgacatgtcagatgtcatcagactgagaaaagaggaggtggagatgaaagtacggggctctactgaccttttgggacagcggtg

SEQ ID NO: 447760 - DNA, 140 bp, Artificial Sequence
  Synthetic
caccgctgtcccaaaaggtcagtagagccccgtactttcatctccacctcctcttttctcagtctgatgacatctgacatgtcacccttaataatataaactgggcatccaaatggcttgcatatcagcagccagggcct

SEQ ID NO: 447761 - DNA, 140 bp, Artificial Sequence
  Synthetic
aggccctggctgctgatatgtcatcagactgagaaaagaggaggtggagatgaaagtacggggctctactctcaacttgtacaccaagcaccattctcatcaggacctacacattttatcgaccttttgggacagcggtg

SEQ ID NO: 447762 - DNA, 140 bp, Artificial Sequence
  Synthetic
caccgctgtcccaaaaggtcgataaaatgtgtaggtcctgatgagaatggtgcttggtgtacaagttgagagtagagccccgtactttcatctccacctcctcttttctcagtctgatgacatatcagcagccagggcct

SEQ ID NO: 447763 - DNA, 140 bp, Artificial Sequence
  Synthetic
atacgccatgctgggtctccctcaacttgtacaccaagcaccattctcatcaggacctacacattttatcttacactgcatcagacaatgatctcagcccaggcattttcaagtcaatatcgtacttgggagtcggccat

SEQ ID NO: 447764 - DNA, 140 bp, Artificial Sequence
  Synthetic
atggccgactcccaagtacgatattgacttgaaaatgcctgggctgagatcattgtctgatgcagtgtaagataaaatgtgtaggtcctgatgagaatggtgcttggtgtacaagttgagggagacccagcatggcgtat

SEQ ID NO: 447765 - DNA, 140 bp, Artificial Sequence
  Synthetic
atacgccatgctgggtctccgtcggatctatgttctcatttgtcgccaatgtcgaggaggcccatgatgttgactatgatgcattaatggatctaatgatagaagatgctaagaacaatgcgtacttgggagtcggccat

SEQ ID NO: 447766 - DNA, 140 bp, Artificial Sequence
  Synthetic
atggccgactcccaagtacgcattgttcttagcatcttctatcattagatccattaatgcatcatagtcaacatcatgggcctcctcgacattggcgacaaatgagaacatagatccgacggagacccagcatggcgtat

SEQ ID NO: 447767 - DNA, 140 bp, Artificial Sequence
  Synthetic
atacgccatgctgggtctcccattcagtcatgttgttaactgcatagagttggatgttagtggtccttacgagatggagtcttttgatacatctgatgtcaatctctttgggccagcccacgtacttgggagtcggccat

SEQ ID NO: 447768 - DNA, 140 bp, Artificial Sequence
  Synthetic
atggccgactcccaagtacgtgggctggcccaaagagattgacatcagatgtatcaaaagactccatctcgtaaggaccactaacatccaactctatgcagttaacaacatgactgaatgggagacccagcatggcgtat

SEQ ID NO: 447769 - DNA, 140 bp, Artificial Sequence
  Synthetic
atacgccatgctgggtctccatggtaagacaaaaactaatttgattgggatccttcagaggtttctagatggtgatcacgttgtccccataattgaagagatgggagcagggacagtgggcgtacttgggagtcggccat

SEQ ID NO: 447770 - DNA, 140 bp, Artificial Sequence
  Synthetic
atggccgactcccaagtacgcccactgtccctgctcccatctcttcaattatggggacaacgtgatcaccatctagaaacctctgaaggatcccaatcaaattagtttttgtcttaccatggagacccagcatggcgtat

SEQ ID NO: 447771 - DNA, 140 bp, Artificial Sequence
  Synthetic
aggccctggctgctgatatggtctgagctattcttagagtataagaaggcagtgctgaagtggaatgaccctggcctgggtttctttctgcttgacaacccttatgcgtgcgggttaggagaccttttgggacagcggtg

SEQ ID NO: 447772 - DNA, 140 bp, Artificial Sequence
  Synthetic
caccgctgtcccaaaaggtctcctaacccgcacgcataagggttgtcaagcagaaagaaacccaggccagggtcattccacttcagcactgccttcttatactctaagaatagctcagaccatatcagcagccagggcct

SEQ ID NO: 447773 - DNA, 140 bp, Artificial Sequence
  Synthetic
aggccctggctgctgatatgggtgatcacgttgtccccataattgaagagatgggagcagggacagtgggtggattcatcaagagacaacagtctaaagttgtacaaaacaaagtggtctgaccttttgggacagcggtg

SEQ ID NO: 447774 - DNA, 140 bp, Artificial Sequence
  Synthetic
caccgctgtcccaaaaggtcagaccactttgttttgtacaactttagactgttgtctcttgatgaatccacccactgtccctgctcccatctcttcaattatggggacaacgtgatcacccatatcagcagccagggcct

SEQ ID NO: 447775 - DNA, 140 bp, Artificial Sequence
  Synthetic
atacgccatgctgggtctccatctgaaagaagccatatcctggcctcttggagaaccctccctggctttctttgacctaagctctaccagagtgcacaggtctgatgatattagaagggacgtacttgggagtcggccat

SEQ ID NO: 447776 - DNA, 140 bp, Artificial Sequence
  Synthetic
atggccgactcccaagtacgtcccttctaatatcatcagacctgtgcactctggtagagcttaggtcaaagaaagccagggagggttctccaagaggccaggatatggcttctttcagatggagacccagcatggcgtat

SEQ ID NO: 447777 - DNA, 140 bp, Artificial Sequence
  Synthetic
atacgccatgctgggtctccctcaagactgaagaaaatctgctaccagactcatttgtctgctttgagcataaaggacagtataaaggaacaatagactctggtcagactaagagagagccgtacttgggagtcggccat

SEQ ID NO: 447778 - DNA, 140 bp, Artificial Sequence
  Synthetic
atggccgactcccaagtacggctctctcttagtctgaccagagtctattgttcctttatactgtcctttatgctcaaagcagacaaatgagtctggtagcagattttcttcagtcttgagggagacccagcatggcgtat

SEQ ID NO: 447779 - DNA, 140 bp, Artificial Sequence
  Synthetic
atacgccatgctgggtctcctcagtatgccaatgcctattgttcacatgctaatgggtctgggattgtacagatacaagtgtccggggtctggaagaagcctctgtgtgtaggatatgagcgtacttgggagtcggccat

SEQ ID NO: 447780 - DNA, 140 bp, Artificial Sequence
  Synthetic
atggccgactcccaagtacgctcatatcctacacacagaggcttcttccagaccccggacacttgtatctgtacaatcccagacccattagcatgtgaacaataggcattggcatactgaggagacccagcatggcgtat

SEQ ID NO: 447781 - DNA, 140 bp, Artificial Sequence
  Synthetic
atacgccatgctgggtctcctgctcacgttcagtgtgttcggctcctgcaggcagcaaaagaggatatttctaatgctgtagttccaaactcagctctcattgctcttatggaggagagccgtacttgggagtcggccat

SEQ ID NO: 447782 - DNA, 140 bp, Artificial Sequence
  Synthetic
atggccgactcccaagtacggctctcctccataagagcaatgagagctgagtttggaactacagcattagaaatatcctcttttgctgcctgcaggagccgaacacactgaacgtgagcaggagacccagcatggcgtat

SEQ ID NO: 447783 - DNA, 140 bp, Artificial Sequence
  Synthetic
aggccctggctgctgatatgctaatgctgtagttccaaactcagctctcattgctcttatggaggagagcctgatgctgcgttcatcactccctagcatgatggggagaaacaactgggtgaccttttgggacagcggtg

SEQ ID NO: 447784 - DNA, 140 bp, Artificial Sequence
  Synthetic
caccgctgtcccaaaaggtcacccagttgtttctccccatcatgctagggagtgatgaacgcagcatcaggctctcctccataagagcaatgagagctgagtttggaactacagcattagcatatcagcagccagggcct

SEQ ID NO: 447785 - DNA, 140 bp, Artificial Sequence
  Synthetic
atacgccatgctgggtctccgatcaacagggtttaagatatcatctgcagttgcttgtgctagcggggtttgcgtcacaggatcgcagagcccttctactgagatcactcttaagtatcccgtacttgggagtcggccat

SEQ ID NO: 447786 - DNA, 140 bp, Artificial Sequence
  Synthetic
atggccgactcccaagtacgggatacttaagagtgatctcagtagaagggctctgcgatcctgtgacgcaaaccccgctagcacaagcaactgcagatgatatcttaaaccctgttgatcggagacccagcatggcgtat

SEQ ID NO: 447787 - DNA, 140 bp, Artificial Sequence
  Synthetic
atacgccatgctgggtctcctccagttgtttctccaatcccagatgttgagatggaatcagaggaagagagtgatgacgatggatttgttgaggttgattagagattaaggctgccccaccgtacttgggagtcggccat

SEQ ID NO: 447788 - DNA, 140 bp, Artificial Sequence
  Synthetic
atggccgactcccaagtacggtggggcagccttaatctctaatcaacctcaacaaatccatcgtcatcactctcttcctctgattccatctcaacatctgggattggagaaacaactggaggagacccagcatggcgtat

SEQ ID NO: 447789 - DNA, 140 bp, Artificial Sequence
  Synthetic
aggccctggctgctgatatggtgatgacgatggatttgttgaggttgattagagattaaggctgccccaccccccacccccaatcccgaccgtaaccccaaccaccctttttccccaaacgaccttttgggacagcggtg

SEQ ID NO: 447790 - DNA, 140 bp, Artificial Sequence
  Synthetic
caccgctgtcccaaaaggtcgtttggggaaaaagggtggttggggttacggtcgggattgggggtggggggtggggcagccttaatctctaatcaacctcaacaaatccatcgtcatcaccatatcagcagccagggcct

SEQ ID NO: 447791 - DNA, 140 bp, Artificial Sequence
  Synthetic
aggccctggctgctgatatgggttatccgtgacaatttctcccggatgggccatcttcgaggtgtggaagacctcgctggcttcactcgtagtgtgtcagctgaaatcctcaagcactttgaccttttgggacagcggtg

SEQ ID NO: 447792 - DNA, 140 bp, Artificial Sequence
  Synthetic
caccgctgtcccaaaaggtcaaagtgcttgaggatttcagctgacacactacgagtgaagccagcgaggtcttccacacctcgaagatggcccatccgggagaaattgtcacggataacccatatcagcagccagggcct

SEQ ID NO: 447793 - DNA, 140 bp, Artificial Sequence
  Synthetic
atacgccatgctgggtctccctgttgcaataatttgtctggccatcctttataaggtgctcaggtgcctaaagattgccccaaagaaagttctgaatccactaatgtggatcactgccttcgtacttgggagtcggccat

SEQ ID NO: 447794 - DNA, 140 bp, Artificial Sequence
  Synthetic
atggccgactcccaagtacgaaggcagtgatccacattagtggattcagaactttctttggggcaatctttaggcacctgagcaccttataaaggatggccagacaaattattgcaacagggagacccagcatggcgtat

SEQ ID NO: 447795 - DNA, 140 bp, Artificial Sequence
  Synthetic
atacgccatgctgggtctccgggaaccctgctcctattcctcgtcatgctccaattccacgttatagcacgtatctaatgctactattgattatctcatatgcatcagcatgttcagaaccgtacttgggagtcggccat

SEQ ID NO: 447796 - DNA, 140 bp, Artificial Sequence
  Synthetic
atggccgactcccaagtacggttctgaacatgctgatgcatatgagataatcaatagtagcattagatacgtgctataacgtggaattggagcatgacgaggaataggagcagggttcccggagacccagcatggcgtat

SEQ ID NO: 447797 - DNA, 140 bp, Artificial Sequence
  Synthetic
aggccctggctgctgatatggggcagaagacatgggggtcacaaacaaccaggattattcctctaaatctagcagaggagccagatattggatgcattcattcaggatgcaaggacctaggaccttttgggacagcggtg

SEQ ID NO: 447798 - DNA, 140 bp, Artificial Sequence
  Synthetic
caccgctgtcccaaaaggtcctaggtccttgcatcctgaatgaatgcatccaatatctggctcctctgctagatttagaggaataatcctggttgtttgtgacccccatgtcttctgccccatatcagcagccagggcct

SEQ ID NO: 447799 - DNA, 140 bp, Artificial Sequence
  Synthetic
aggccctggctgctgatatgacacaaagacggtgcattaaatgtatgttttactaacaattctgatcacggttctggtgtgtgaagcggttatcagagtgtctctaagttccacaagagagaccttttgggacagcggtg

SEQ ID NO: 447800 - DNA, 140 bp, Artificial Sequence
  Synthetic
caccgctgtcccaaaaggtctctcttgtggaacttagagacactctgataaccgcttcacacaccagaaccgtgatcagaattgttagtaaaacatacatttaatgcaccgtctttgtgtcatatcagcagccagggcct

SEQ ID NO: 447801 - DNA, 140 bp, Artificial Sequence
  Synthetic
aggccctggctgctgatatgagagacctgctttggtgactccaccagcccagagatgattgaaggagcttgggattcactcagagaggaggagatgccagaagagctctcctgttccatagaccttttgggacagcggtg

SEQ ID NO: 447802 - DNA, 140 bp, Artificial Sequence
  Synthetic
caccgctgtcccaaaaggtctatggaacaggagagctcttctggcatctcctcctctctgagtgaatcccaagctccttcaatcatctctgggctggtggagtcaccaaagcaggtctctcatatcagcagccagggcct

SEQ ID NO: 447803 - DNA, 140 bp, Artificial Sequence
  Synthetic
aggccctggctgctgatatgagtttgttgattatgctatttctaagatggggagagcctcagttaggaaagttctagagacaggtcggtgctccagcaaagactatgatttatcaaaggtgaccttttgggacagcggtg

SEQ ID NO: 447804 - DNA, 140 bp, Artificial Sequence
  Synthetic
caccgctgtcccaaaaggtcacctttgataaatcatagtctttgctggagcaccgacctgtctctagaactttcctaactgaggctctccccatcttagaaatagcataatcaacaaactcatatcagcagccagggcct

SEQ ID NO: 447805 - DNA, 140 bp, Artificial Sequence
  Synthetic
atacgccatgctgggtctcctctcttcagaactctacagagaccagaagagagcatcaggatagatgacctggagttgtatgaggagacagatgtggcggatgacatgctaggctaagaccgtacttgggagtcggccat

SEQ ID NO: 447806 - DNA, 140 bp, Artificial Sequence
  Synthetic
atggccgactcccaagtacggtcttagcctagcatgtcatccgccacatctgtctcctcatacaactccaggtcatctatcctgatgctctcttctggtctctgtagagttctgaagagaggagacccagcatggcgtat

SEQ ID NO: 447807 - DNA, 140 bp, Artificial Sequence
  Synthetic
atacgccatgctgggtctccgtcttgtgatgccgccttcttaaatttgacaggttgctattcctgcaatgctggagccagagtctgcctgtctatcacatccacaggaactggaactcttcgtacttgggagtcggccat

SEQ ID NO: 447808 - DNA, 140 bp, Artificial Sequence
  Synthetic
atggccgactcccaagtacgaagagttccagttcctgtggatgtgatagacaggcagactctggctccagcattgcaggaatagcaacctgtcaaatttaagaaggcggcatcacaagacggagacccagcatggcgtat

SEQ ID NO: 447809 - DNA, 140 bp, Artificial Sequence
  Synthetic
aggccctggctgctgatatgtgctcgaaaagggaaaattccccctcttccagtcgtatgcccatcacagaaccctactagaagcagttcacgacaccatcattgcaaaggctgatccaccgaccttttgggacagcggtg

SEQ ID NO: 447810 - DNA, 140 bp, Artificial Sequence
  Synthetic
caccgctgtcccaaaaggtcggtggatcagcctttgcaatgatggtgtcgtgaactgcttctagtagggttctgtgatgggcatacgactggaagagggggaattttcccttttcgagcacatatcagcagccagggcct

SEQ ID NO: 447811 - DNA, 140 bp, Artificial Sequence
  Synthetic
aggccctggctgctgatatgtagctgtgaccttcagagtgctcatgggaatccttgcatgaaggagaaactcgtgatgaagacacactgtccaaaagactaccagtcagctcattacctcgaccttttgggacagcggtg

SEQ ID NO: 447812 - DNA, 140 bp, Artificial Sequence
  Synthetic
caccgctgtcccaaaaggtcgaggtaatgagctgactggtagtcttttggacagtgtgtcttcatcacgagtttctccttcatgcaaggattcccatgagcactctgaaggtcacagctacatatcagcagccagggcct

SEQ ID NO: 447813 - DNA, 140 bp, Artificial Sequence
  Synthetic
aggccctggctgctgatatgaacaatgacgggaaaatggcttcagtcaagtgccctcctaaatatgagctcactgaggactgcaatttttgcaggcagatgacaggtgccagcttgaagagaccttttgggacagcggtg

SEQ ID NO: 447814 - DNA, 140 bp, Artificial Sequence
  Synthetic
caccgctgtcccaaaaggtctcttcaagctggcacctgtcatctgcctgcaaaaattgcagtcctcagtgagctcatatttaggagggcacttgactgaagccattttcccgtcattgttcatatcagcagccagggcct

SEQ ID NO: 447815 - DNA, 140 bp, Artificial Sequence
  Synthetic
aggccctggctgctgatatgctcaagactgaggaaaatctgttgccagactcatttgtctgcttcgagcataagggacagtataaaggaacaatggactctggtcagaccaagagggagcgaccttttgggacagcggtg

SEQ ID NO: 447816 - DNA, 140 bp, Artificial Sequence
  Synthetic
caccgctgtcccaaaaggtcgctccctcttggtctgaccagagtccattgttcctttatactgtcccttatgctcgaagcagacaaatgagtctggcaacagattttcctcagtcttgagcatatcagcagccagggcct

SEQ ID NO: 447817 - DNA, 140 bp, Artificial Sequence
  Synthetic
atacgccatgctgggtctccaagaagtgcactggggacgcagctttttgctctgcttatgagtgcactgctcaatacgccaatgcttattgttcacatgctaatgggtcaggaattgtaccgtacttgggagtcggccat

SEQ ID NO: 447818 - DNA, 140 bp, Artificial Sequence
  Synthetic
atggccgactcccaagtacggtacaattcctgacccattagcatgtgaacaataagcattggcgtattgagcagtgcactcataagcagagcaaaaagctgcgtccccagtgcacttcttggagacccagcatggcgtat

SEQ ID NO: 447819 - DNA, 140 bp, Artificial Sequence
  Synthetic
aggccctggctgctgatatgagatacaagtatccggggtctggaagaggcctttgtgtgtagggtatgagagggtggttgtgaagagagaactctctgctaagcccatccagagagttgagaccttttgggacagcggtg

SEQ ID NO: 447820 - DNA, 140 bp, Artificial Sequence
  Synthetic
caccgctgtcccaaaaggtctcaactctctggatgggcttagcagagagttctctcttcacaaccaccctctcataccctacacacaaaggcctcttccagaccccggatacttgtatctcatatcagcagccagggcct

SEQ ID NO: 447821 - DNA, 140 bp, Artificial Sequence
  Synthetic
atacgccatgctgggtctcctggaggactctgaagcagaggagatagtttataggtatagacttgctctcagtgtaatggatgagctaaggaccttgtttcctgaactgtcatccacagacgtacttgggagtcggccat

SEQ ID NO: 447822 - DNA, 140 bp, Artificial Sequence
  Synthetic
atggccgactcccaagtacgtctgtggatgacagttcaggaaacaaggtccttagctcatccattacactgagagcaagtctatacctataaactatctcctctgcttcagagtcctccaggagacccagcatggcgtat

SEQ ID NO: 447823 - DNA, 140 bp, Artificial Sequence
  Synthetic
aggccctggctgctgatatgccatgcctagtgcatggctgcatagtgtgtgctcatggcctgataaattaccagtgtcacactgctctcagtgcctttgttgttgtgttcgtatttagctgaccttttgggacagcggtg

SEQ ID NO: 447824 - DNA, 140 bp, Artificial Sequence
  Synthetic
caccgctgtcccaaaaggtcagctaaatacgaacacaacaacaaaggcactgagagcagtgtgacactggtaatttatcaggccatgagcacacactatgcagccatgcactaggcatggcatatcagcagccagggcct

SEQ ID NO: 447825 - DNA, 140 bp, Artificial Sequence
  Synthetic
aggccctggctgctgatatgctgtcgcaataatttgtttggccattctttataaagttctcaagtgcctaaagattgccccaaggaaagttctgaatccactaatgtggattactgctttgaccttttgggacagcggtg

SEQ ID NO: 447826 - DNA, 140 bp, Artificial Sequence
  Synthetic
caccgctgtcccaaaaggtcaaagcagtaatccacattagtggattcagaactttccttggggcaatctttaggcacttgagaactttataaagaatggccaaacaaattattgcgacagcatatcagcagccagggcct

SEQ ID NO: 447827 - DNA, 140 bp, Artificial Sequence
  Synthetic
aggccctggctgctgatatgcatcagatgggtgtataagaagatggttgccagagtggcagacaatatcaatcaggtgaacagggaaataggatggatggaaggaggccagccggctctagaccttttgggacagcggtg

SEQ ID NO: 447828 - DNA, 140 bp, Artificial Sequence
  Synthetic
caccgctgtcccaaaaggtctagagccggctggcctccttccatccatcctatttccctgttcacctgattgatattgtctgccactctggcaaccatcttcttatacacccatctgatgcatatcagcagccagggcct

SEQ ID NO: 447829 - DNA, 140 bp, Artificial Sequence
  Synthetic
aggccctggctgctgatatggggaaccctgcccctattcctcgtcatgctccaattccacgttatagcacatacctaatgctactattgattgtctcatatgcatcagcatgttcagaacgaccttttgggacagcggtg

SEQ ID NO: 447830 - DNA, 140 bp, Artificial Sequence
  Synthetic
caccgctgtcccaaaaggtcgttctgaacatgctgatgcatatgagacaatcaatagtagcattaggtatgtgctataacgtggaattggagcatgacgaggaataggggcagggttccccatatcagcagccagggcct

SEQ ID NO: 447831 - DNA, 140 bp, Artificial Sequence
  Synthetic
aggccctggctgctgatatgagtggttacctctgcaaatctagaggagattgagaggatgcacgatgatgcagcagcagagcttgagtttgccctttcaggagtaaaggacagaccagatgaccttttgggacagcggtg

SEQ ID NO: 447832 - DNA, 140 bp, Artificial Sequence
  Synthetic
caccgctgtcccaaaaggtcatctggtctgtcctttactcctgaaagggcaaactcaagctctgctgctgcatcatcgtgcatcctctcaatctcctctagatttgcagaggtaaccactcatatcagcagccagggcct

SEQ ID NO: 447833 - DNA, 140 bp, Artificial Sequence
  Synthetic
atacgccatgctgggtctcctgattcaggcaagctccagaatcaccacttgctccacagaaggtgtcaacaccaagtgtaggctgtctggcacagcattaatcagggcagggtcagttggcgtacttgggagtcggccat

SEQ ID NO: 447834 - DNA, 140 bp, Artificial Sequence
  Synthetic
atggccgactcccaagtacgccaactgaccctgccctgattaatgctgtgccagacagcctacacttggtgttgacaccttctgtggagcaagtggtgattctggagcttgcctgaatcaggagacccagcatggcgtat

SEQ ID NO: 447835 - DNA, 140 bp, Artificial Sequence
  Synthetic
aggccctggctgctgatatgtgtttacatagctgctttaggagttaatggaaagaagcataaagcagacactttggtgcaacaaatgagagacaggagtaaacagtccttctctccagatgaccttttgggacagcggtg

SEQ ID NO: 447836 - DNA, 140 bp, Artificial Sequence
  Synthetic
caccgctgtcccaaaaggtcatctggagagaaggactgtttactcctgtctctcatttgttgcaccaaagtgtctgctttatgcttctttccattaactcctaaagcagctatgtaaacacatatcagcagccagggcct

SEQ ID NO: 447837 - DNA, 140 bp, Artificial Sequence
  Synthetic
atacgccatgctgggtctccagctattggactgggtcctttagccctaaatgtctgagctcaaggaggtgccatcttgtcggggaatgtcatgtgaataggtgtctgtcttggagagacacgtacttgggagtcggccat

SEQ ID NO: 447838 - DNA, 140 bp, Artificial Sequence
  Synthetic
atggccgactcccaagtacgtgtctctccaagacagacacctattcacatgacattccccgacaagatggcacctccttgagctcagacatttagggctaaaggacccagtccaatagctggagacccagcatggcgtat

SEQ ID NO: 447839 - DNA, 140 bp, Artificial Sequence
  Synthetic
atacgccatgctgggtctccaactgctgggtgagatgtgagtctgtggctccaaagtttatatcagctatccttgagatatgtgaggggaagagacagataaaagggattaacagaaccacgtacttgggagtcggccat

SEQ ID NO: 447840 - DNA, 140 bp, Artificial Sequence
  Synthetic
atggccgactcccaagtacgtggttctgttaatcccttttatctgtctcttcccctcacatatctcaaggatagctgatataaactttggagccacagactcacatctcacccagcagttggagacccagcatggcgtat

SEQ ID NO: 447841 - DNA, 140 bp, Artificial Sequence
  Synthetic
aggccctggctgctgatatgatgaaacttcagcagaattttcatttgttggggaaagcacgaccatgcgggagaataagtgttttgagcagtgtggaggatggggatgtgggtgtttcaagaccttttgggacagcggtg

SEQ ID NO: 447842 - DNA, 140 bp, Artificial Sequence
  Synthetic
caccgctgtcccaaaaggtcttgaaacacccacatccccatcctccacactgctcaaaacacttattctcccgcatggtcgtgctttccccaacaaatgaaaattctgctgaagtttcatcatatcagcagccagggcct

SEQ ID NO: 447843 - DNA, 140 bp, Artificial Sequence
  Synthetic
atacgccatgctgggtctccaagaggcccttagagttttcaactgtatcgattgggtgcataaactcactctagagattactgactttgatggctctgtttcaacaatagacctgggagccgtacttgggagtcggccat

SEQ ID NO: 447844 - DNA, 140 bp, Artificial Sequence
  Synthetic
atggccgactcccaagtacggctcccaggtctattgttgaaacagagccatcaaagtcagtaatctctagagtgagtttatgcacccaatcgatacagttgaaaactctaagggcctcttggagacccagcatggcgtat

SEQ ID NO: 447845 - DNA, 140 bp, Artificial Sequence
  Synthetic
atacgccatgctgggtctccaaagggtatgcaattgttgatgagccattctcagaaattcctcggcaagggttcttgggggagatcaggtgcaattcagaatcttcagtcctgagtgctccgtacttgggagtcggccat

SEQ ID NO: 447846 - DNA, 140 bp, Artificial Sequence
  Synthetic
atggccgactcccaagtacggagcactcaggactgaagattctgaattgcacctgatctcccccaagaacccttgccgaggaatttctgagaatggctcatcaacaattgcataccctttggagacccagcatggcgtat

SEQ ID NO: 447847 - DNA, 140 bp, Artificial Sequence
  Synthetic
aggccctggctgctgatatggcctggcatgtccagccagccagggcggcagcaactcgtgatagagtcaactcatcccgggagggatttccctcctttagcttatacttgttgatgagaggaccttttgggacagcggtg

SEQ ID NO: 447848 - DNA, 140 bp, Artificial Sequence
  Synthetic
caccgctgtcccaaaaggtcctctcatcaacaagtataagctaaaggagggaaatccctcccgggatgagttgactctatcacgagttgctgccgccctggctggctggacatgccaggccatatcagcagccagggcct

SEQ ID NO: 447849 - DNA, 140 bp, Artificial Sequence
  Synthetic
atacgccatgctgggtctccgatcagttggagtgcacaacaaatctgattgatccctttgttgcctttgagaggggctctctgccacagacaaggaatgacaaaacctttgcagcttcaacgtacttgggagtcggccat

SEQ ID NO: 447850 - DNA, 140 bp, Artificial Sequence
  Synthetic
atggccgactcccaagtacgttgaagctgcaaaggttttgtcattccttgtctgtggcagagagcccctctcaaaggcaacaaagggatcaatcagatttgttgtgcactccaactgatcggagacccagcatggcgtat

SEQ ID NO: 447851 - DNA, 140 bp, Artificial Sequence
  Synthetic
aggccctggctgctgatatgtaaaaataaagaagaagagactgagccttcgtccctttctggaatgtataagaagattatagaactcgagcaccttagaccacagtctgatgccttcttggaccttttgggacagcggtg

SEQ ID NO: 447852 - DNA, 140 bp, Artificial Sequence
  Synthetic
caccgctgtcccaaaaggtccaagaaggcatcagactgtggtctaaggtgctcgagttctataatcttcttatacattccagaaagggacgaaggctcagtctcttcttctttatttttacatatcagcagccagggcct

SEQ ID NO: 447853 - DNA, 140 bp, Artificial Sequence
  Synthetic
atacgccatgctgggtctccgggctgactctagaaaggctagccacactcaaggccacaagcaacttcaatgagaattggtatgtttataaagatgtggcagacaagaactacacaagagcgtacttgggagtcggccat

SEQ ID NO: 447854 - DNA, 140 bp, Artificial Sequence
  Synthetic
atggccgactcccaagtacgctcttgtgtagttcttgtctgccacatctttataaacataccaattctcattgaagttgcttgtggccttgagtgtggctagcctttctagagtcagcccggagacccagcatggcgtat

SEQ ID NO: 447855 - DNA, 140 bp, Artificial Sequence
  Synthetic
aggccctggctgctgatatgcccctgggcagccacttaggctgctgttttgtacgcctgagcagctgccatgacagccgctgatggcttcccattagaatccacaagcccaaaagctctcgaccttttgggacagcggtg

SEQ ID NO: 447856 - DNA, 140 bp, Artificial Sequence
  Synthetic
caccgctgtcccaaaaggtcgagagcttttgggcttgtggattctaatgggaagccatcagcggctgtcatggcagctgctcaggcgtacaaaacagcagcctaagtggctgcccaggggcatatcagcagccagggcct

SEQ ID NO: 447857 - DNA, 140 bp, Artificial Sequence
  Synthetic
atacgccatgctgggtctccataaattgttagtaaagatgtcaaaatatgcctcagagggaaagagcctagccatccagaagtttgaggattgtatgaggcagatagagtcacagggatgcgtacttgggagtcggccat

SEQ ID NO: 447858 - DNA, 140 bp, Artificial Sequence
  Synthetic
atggccgactcccaagtacgcatccctgtgactctatctgcctcatacaatcctcaaacttctggatggctaggctctttccctctgaggcatattttgacatctttactaacaatttatggagacccagcatggcgtat

SEQ ID NO: 447859 - DNA, 140 bp, Artificial Sequence
  Synthetic
atacgccatgctgggtctccatagctaggtctatagggaagttctttgcatctgataccctctgtaatccccccaataaggtaaaaattcctgagacacatggcattagggctcggaggccgtacttgggagtcggccat

SEQ ID NO: 447860 - DNA, 140 bp, Artificial Sequence
  Synthetic
atggccgactcccaagtacggcctccgagccctaatgccatgtgtctcaggaatttttaccttattggggggattacagagggtatcagatgcaaagaacttccctatagacctagctatggagacccagcatggcgtat

SEQ ID NO: 447861 - DNA, 140 bp, Artificial Sequence
  Synthetic
aggccctggctgctgatatgtatatatcttggaagaacaggcctctctaaaatgtggcttgctgccaccaagaaagcctcatagatcagtacgtgtagaagcaatatgtagaaataagtagaccttttgggacagcggtg

SEQ ID NO: 447862 - DNA, 140 bp, Artificial Sequence
  Synthetic
caccgctgtcccaaaaggtctacttatttctacatattgcttctacacgtactgatctatgaggctttcttggtggcagcaagccacattttagagaggcctgttcttccaagatatatacatatcagcagccagggcct

SEQ ID NO: 447863 - DNA, 140 bp, Artificial Sequence
  Synthetic
aggccctggctgctgatatgaacataagcaaatctaattatgtaaatattgtacagatgggtcaaactattgggatatccaagtttagaatcttatacaatagtactttagatgtaagctgaccttttgggacagcggtg

SEQ ID NO: 447864 - DNA, 140 bp, Artificial Sequence
  Synthetic
caccgctgtcccaaaaggtcagcttacatctaaagtactattgtataagattctaaacttggatatcccaatagtttgacccatctgtacaatatttacataattagatttgcttatgttcatatcagcagccagggcct

SEQ ID NO: 447865 - DNA, 140 bp, Artificial Sequence
  Synthetic
aggccctggctgctgatatgtagttgtgatttggggtggtggggtgaggcagcagtagtctcaagtacatgtggatattctagttggcgtgattgtcttttgccagattagctgggaattgaccttttgggacagcggtg

SEQ ID NO: 447866 - DNA, 140 bp, Artificial Sequence
  Synthetic
caccgctgtcccaaaaggtcaattcccagctaatctggcaaaagacaatcacgccaactagaatatccacatgtacttgagactactgctgcctcaccccaccaccccaaatcacaactacatatcagcagccagggcct

SEQ ID NO: 447867 - DNA, 140 bp, Artificial Sequence
  Synthetic
atacgccatgctgggtctcctagtctcaagtacatgtggatattctagttggcgtgattgtcttttgccagattagctgggaattaaactaactctttgaagttgcaccggtctttgtgtcgtacttgggagtcggccat

SEQ ID NO: 447868 - DNA, 140 bp, Artificial Sequence
  Synthetic
atggccgactcccaagtacgacacaaagaccggtgcaacttcaaagagttagtttaattcccagctaatctggcaaaagacaatcacgccaactagaatatccacatgtacttgagactaggagacccagcatggcgtat

SEQ ID NO: 447869 - DNA, 140 bp, Artificial Sequence
  Synthetic
atacgccatgctgggtctccaagattgccccaaggaaagttctgaatccactaatgtggattacagccttcatcagatgggtgtataagaagatggttgctagagtggcagacaatattacgtacttgggagtcggccat

SEQ ID NO: 447870 - DNA, 140 bp, Artificial Sequence
  Synthetic
atggccgactcccaagtacgtaatattgtctgccactctagcaaccatcttcttatacacccatctgatgaaggctgtaatccacattagtggattcagaactttccttggggcaatcttggagacccagcatggcgtat

SEQ ID NO: 447871 - DNA, 140 bp, Artificial Sequence
  Synthetic
atacgccatgctgggtctcctaactctggcactcccaacatttgatgtctccaagatggtagatagaattaccatagacttcaatctggacgacatacaaggagcatctgaaataggctccgtacttgggagtcggccat

SEQ ID NO: 447872 - DNA, 140 bp, Artificial Sequence
  Synthetic
atggccgactcccaagtacggagcctatttcagatgctccttgtatgtcgtccagattgaagtctatggtaattctatctaccatcttggagacatcaaatgttgggagtgccagagttaggagacccagcatggcgtat

SEQ ID NO: 447873 - DNA, 140 bp, Artificial Sequence
  Synthetic
aggccctggctgctgatatgaactttgctaccctctatgtcgatagatgtggaagatatggccaattttgttcacgatttcacctttggccacttagctgacaagactgacagactcttagaccttttgggacagcggtg

SEQ ID NO: 447874 - DNA, 140 bp, Artificial Sequence
  Synthetic
caccgctgtcccaaaaggtctaagagtctgtcagtcttgtcagctaagtggccaaaggtgaaatcgtgaacaaaattggccatatcttccacatctatcgacatagagggtagcaaagttcatatcagcagccagggcct

SEQ ID NO: 447875 - DNA, 140 bp, Artificial Sequence
  Synthetic
aggccctggctgctgatatgtatgaagaaggagctgggagtgtaccttgccatttacccctcagagaagtccacagcaaacacagattttgtgatggagtacaattctgagttctatttcgaccttttgggacagcggtg

SEQ ID NO: 447876 - DNA, 140 bp, Artificial Sequence
  Synthetic
caccgctgtcccaaaaggtcgaaatagaactcagaattgtactccatcacaaaatctgtgtttgctgtggacttctctgaggggtaaatggcaaggtacactcccagctccttcttcatacatatcagcagccagggcct

SEQ ID NO: 447877 - DNA, 140 bp, Artificial Sequence
  Synthetic
aggccctggctgctgatatgatgcgtgagtttcccatgatgaatgacgggtttgatcatttgagccctgacatgatcatcaaaactacatctggcatgtacaacatcgttgagttcaccagaccttttgggacagcggtg

SEQ ID NO: 447878 - DNA, 140 bp, Artificial Sequence
  Synthetic
caccgctgtcccaaaaggtctggtgaactcaacgatgttgtacatgccagatgtagttttgatgatcatgtcagggctcaaatgatcaaacccgtcattcatcatgggaaactcacgcatcatatcagcagccagggcct

SEQ ID NO: 447879 - DNA, 140 bp, Artificial Sequence
  Synthetic
aggccctggctgctgatatgcatgatcatcaaaactacatctggcatgtacaacatcgttgagttcaccacctttaggggggatgaaagaggtgcattccaggctgccatgactaaactcgaccttttgggacagcggtg

SEQ ID NO: 447880 - DNA, 140 bp, Artificial Sequence
  Synthetic
caccgctgtcccaaaaggtcgagtttagtcatggcagcctggaatgcacctctttcatcccccctaaaggtggtgaactcaacgatgttgtacatgccagatgtagttttgatgatcatgcatatcagcagccagggcct

SEQ ID NO: 447881 - DNA, 140 bp, Artificial Sequence
  Synthetic
aggccctggctgctgatatgctggcctaggtttcttcctgcttgacaatccttatgcgtgcgggttgggaggtttcagatttaatctcttcaaagctatcaccagaactgatctgcaaaagaccttttgggacagcggtg

SEQ ID NO: 447882 - DNA, 140 bp, Artificial Sequence
  Synthetic
caccgctgtcccaaaaggtcttttgcagatcagttctggtgatagctttgaagagattaaatctgaaacctcccaacccgcacgcataaggattgtcaagcaggaagaaacctaggccagcatatcagcagccagggcct

SEQ ID NO: 447883 - DNA, 140 bp, Artificial Sequence
  Synthetic
atacgccatgctgggtctccggtcacaatctttaatgagcagaagacccttcgaacatctccagagaagttagtgtcagacaagtggtttggcactcagaagagtaggataggcaaaacacgtacttgggagtcggccat

SEQ ID NO: 447884 - DNA, 140 bp, Artificial Sequence
  Synthetic
atggccgactcccaagtacgtgttttgcctatcctactcttctgagtgccaaaccacttgtctgacactaacttctctggagatgttcgaagggtcttctgctcattaaagattgtgaccggagacccagcatggcgtat

SEQ ID NO: 447885 - DNA, 140 bp, Artificial Sequence
  Synthetic
aggccctggctgctgatatgtctttatgttgttagcgcctaccggcatggtgtttggtctaatttggagctagaggactctgaagcagaggagatggtatataggttcagacttgcccttgaccttttgggacagcggtg

SEQ ID NO: 447886 - DNA, 140 bp, Artificial Sequence
  Synthetic
caccgctgtcccaaaaggtcaagggcaagtctgaacctatataccatctcctctgcttcagagtcctctagctccaaattagaccaaacaccatgccggtaggcgctaacaacataaagacatatcagcagccagggcct

SEQ ID NO: 447887 - DNA, 140 bp, Artificial Sequence
  Synthetic
atacgccatgctgggtctccggcgccctaattcttagctcttctctaaagtggggatctaggaagaagtttcagaaattgagagaccgtttgaacataccagagaactgggtcgaactaacgtacttgggagtcggccat

SEQ ID NO: 447888 - DNA, 140 bp, Artificial Sequence
  Synthetic
atggccgactcccaagtacgttagttcgacccagttctctggtatgttcaaacggtctctcaatttctgaaacttcttcctagatccccactttagagaagagctaagaattagggcgccggagacccagcatggcgtat

SEQ ID NO: 447889 - DNA, 140 bp, Artificial Sequence
  Synthetic
aggccctggctgctgatatgtccaaataaattggtcagtcacagaatctgtgtttcctccctttagcagagaaatgtttgacaggttcagatcttctcctcccgattcagagtatatcacgaccttttgggacagcggtg

SEQ ID NO: 447890 - DNA, 140 bp, Artificial Sequence
  Synthetic
caccgctgtcccaaaaggtcgtgatatactctgaatcgggaggagaagatctgaacctgtcaaacatttctctgctaaagggaggaaacacagattctgtgactgaccaatttatttggacatatcagcagccagggcct

SEQ ID NO: 447891 - DNA, 140 bp, Artificial Sequence
  Synthetic
aggccctggctgctgatatgtagtgtcagacaagtggtttggcactcagaagagtaggataggcaaaacaaccttcctagctgaatgggaaaagctaaagaaaattgtgaagtggctggagaccttttgggacagcggtg

SEQ ID NO: 447892 - DNA, 140 bp, Artificial Sequence
  Synthetic
caccgctgtcccaaaaggtctccagccacttcacaattttctttagcttttcccattcagctaggaaggttgttttgcctatcctactcttctgagtgccaaaccacttgtctgacactacatatcagcagccagggcct

SEQ ID NO: 447893 - DNA, 140 bp, Artificial Sequence
  Synthetic
aggccctggctgctgatatgagaagacaaccttagggacctcaatgaccacaagtctactattcagctgcctccctggctgtcctatcacgatgccgatggcaaagatctgtgccctcttgaccttttgggacagcggtg

SEQ ID NO: 447894 - DNA, 140 bp, Artificial Sequence
  Synthetic
caccgctgtcccaaaaggtcaagagggcacagatctttgccatcggcatcgtgataggacagccagggaggcagctgaatagtagacttgtggtcattgaggtccctaaggttgtcttctcatatcagcagccagggcct

SEQ ID NO: 447895 - DNA, 140 bp, Artificial Sequence
  Synthetic
atacgccatgctgggtctccgaaatagatatcattccaagagtcaacatcagggatgcaacccaaactagggtcactatctttaatgagcagaagaccctccgaacatccccagagaagtcgtacttgggagtcggccat

SEQ ID NO: 447896 - DNA, 140 bp, Artificial Sequence
  Synthetic
atggccgactcccaagtacgacttctctggggatgttcggagggtcttctgctcattaaagatagtgaccctagtttgggttgcatccctgatgttgactcttggaatgatatctatttcggagacccagcatggcgtat

SEQ ID NO: 447897 - DNA, 140 bp, Artificial Sequence
  Synthetic
atacgccatgctgggtctcctcagattgccactctagcaatgaggagttgcaagatcaccaatgatctagaggactcctttgttggcttacacaggatgatagcgaccgaggccatcctccgtacttgggagtcggccat

SEQ ID NO: 447898 - DNA, 140 bp, Artificial Sequence
  Synthetic
atggccgactcccaagtacggaggatggcctcggtcgctatcatcctgtgtaagccaacaaaggagtcctctagatcattggtgatcttgcaactcctcattgctagagtggcaatctgaggagacccagcatggcgtat

SEQ ID NO: 447899 - DNA, 140 bp, Artificial Sequence
  Synthetic
atacgccatgctgggtctccgaaagaaacagataccatagagtccatctgaatatggactcagatgatagtgtctacatagctgctttaggggttaatggaaagaagcataaagcagacacgtacttgggagtcggccat

SEQ ID NO: 447900 - DNA, 140 bp, Artificial Sequence
  Synthetic
atggccgactcccaagtacgtgtctgctttatgcttctttccattaacccctaaagcagctatgtagacactatcatctgagtccatattcagatggactctatggtatctgtttctttcggagacccagcatggcgtat

SEQ ID NO: 447901 - DNA, 140 bp, Artificial Sequence
  Synthetic
atacgccatgctgggtctcccccccaccccccaatcccgaccgtaaccccaactccccttccccccaaccccctgggcagccacttaggctgctgtcttgtaagcctgagcagctgccatcgtacttgggagtcggccat

SEQ ID NO: 447902 - DNA, 140 bp, Artificial Sequence
  Synthetic
atggccgactcccaagtacgatggcagctgctcaggcttacaagacagcagcctaagtggctgcccagggggttggggggaaggggagttggggttacggtcgggattggggggtgggggggagacccagcatggcgtat

SEQ ID NO: 447903 - DNA, 140 bp, Artificial Sequence
  Synthetic
atacgccatgctgggtctccatgacagctgctgacggctttccattagaatccacaagcccaaaagctttcaagaatcctctcctcttctcatggcttatgaaattgctattcactgctgcgtacttgggagtcggccat

SEQ ID NO: 447904 - DNA, 140 bp, Artificial Sequence
  Synthetic
atggccgactcccaagtacgcagcagtgaatagcaatttcataagccatgagaagaggagaggattcttgaaagcttttgggcttgtggattctaatggaaagccgtcagcagctgtcatggagacccagcatggcgtat

SEQ ID NO: 447905 - DNA, 140 bp, Artificial Sequence
  Synthetic
atacgccatgctgggtctccttcaatgagattataacagagcactacaaatttatgggaagtaggataggatcatggtgccaaatggtcagtttaataggagctgagctatcagcttctgcgtacttgggagtcggccat

SEQ ID NO: 447906 - DNA, 140 bp, Artificial Sequence
  Synthetic
atggccgactcccaagtacgcagaagctgatagctcagctcctattaaactgaccatttggcaccatgatcctatcctacttcccataaatttgtagtgctctgttataatctcattgaaggagacccagcatggcgtat

SEQ ID NO: 447907 - DNA, 140 bp, Artificial Sequence
  Synthetic
atacgccatgctgggtctcctaaagcaacatgttaagcctaactattttgtgattaaacgactactaggttctgggattttcttgctgatcaagcctacttccagcaaaagccatatattcgtacttgggagtcggccat

SEQ ID NO: 447908 - DNA, 140 bp, Artificial Sequence
  Synthetic
atggccgactcccaagtacgaatatatggcttttgctggaagtaggcttgatcagcaagaaaatcccagaacctagtagtcgtttaatcacaaaatagttaggcttaacatgttgctttaggagacccagcatggcgtat

SEQ ID NO: 447909 - DNA, 140 bp, Artificial Sequence
  Synthetic
aggccctggctgctgatatgtctgggattttcttgctgatcaagcctacttccagcaaaagccatatattcgtgtctttcgcaattaagcgctcttgctgggcctttgatctctccacttgaccttttgggacagcggtg

SEQ ID NO: 447910 - DNA, 140 bp, Artificial Sequence
  Synthetic
caccgctgtcccaaaaggtcaagtggagagatcaaaggcccagcaagagcgcttaattgcgaaagacacgaatatatggcttttgctggaagtaggcttgatcagcaagaaaatcccagacatatcagcagccagggcct

SEQ ID NO: 447911 - DNA, 140 bp, Artificial Sequence
  Synthetic
aggccctggctgctgatatgactctactagaggcagttcacgacaccatcattgcaaaggctgacccacctagctgtgaccttcagagtgctcatgggaacccctgcatgaaagagaaacgaccttttgggacagcggtg

SEQ ID NO: 447912 - DNA, 140 bp, Artificial Sequence
  Synthetic
caccgctgtcccaaaaggtcgtttctctttcatgcaggggttcccatgagcactctgaaggtcacagctaggtgggtcagcctttgcaatgatggtgtcgtgaactgcctctagtagagtcatatcagcagccagggcct

SEQ ID NO: 447913 - DNA, 140 bp, Artificial Sequence
  Synthetic
aggccctggctgctgatatgtttgtttcttacaaactaagtaagcttactaacctctgcaagtgcgtttcgttaatggaatcctccttctcattttgggcagaagcatttgggattccaagaccttttgggacagcggtg

SEQ ID NO: 447914 - DNA, 140 bp, Artificial Sequence
  Synthetic
caccgctgtcccaaaaggtcttggaatcccaaatgcttctgcccaaaatgagaaggaggattccattaacgaaacgcacttgcagaggttagtaagcttacttagtttgtaagaaacaaacatatcagcagccagggcct

SEQ ID NO: 447915 - DNA, 140 bp, Artificial Sequence
  Synthetic
aggccctggctgctgatatgatgcagaactatccagagaatagcaggtgagccctttattcttaagaagaaggatgggtctatatcctggggtggcatgtttaatcctttttcagggcgtgaccttttgggacagcggtg

SEQ ID NO: 447916 - DNA, 140 bp, Artificial Sequence
  Synthetic
caccgctgtcccaaaaggtcacgccctgaaaaaggattaaacatgccaccccaggatatagacccatccttcttcttaagaataaagggctcacctgctattctctggatagttctgcatcatatcagcagccagggcct

SEQ ID NO: 447917 - DNA, 140 bp, Artificial Sequence
  Synthetic
aggccctggctgctgatatgaggatgggtctatatcctggggtggcatgtttaatcctttttcagggcgtccactgcttgatatgcaaccactcatcagctgttgttacaatggttacttgaccttttgggacagcggtg

SEQ ID NO: 447918 - DNA, 140 bp, Artificial Sequence
  Synthetic
caccgctgtcccaaaaggtcaagtaaccattgtaacaacagctgatgagtggttgcatatcaagcagtggacgccctgaaaaaggattaaacatgccaccccaggatatagacccatcctcatatcagcagccagggcct

SEQ ID NO: 447919 - DNA, 140 bp, Artificial Sequence
  Synthetic
atacgccatgctgggtctccctcaacttgtacactaagcaccactctcaccaggacctacacattttatcatacactgcatcagacaatgatctcagtccaggcattttcaagtcaatatcgtacttgggagtcggccat

SEQ ID NO: 447920 - DNA, 140 bp, Artificial Sequence
  Synthetic
atggccgactcccaagtacgatattgacttgaaaatgcctggactgagatcattgtctgatgcagtgtatgataaaatgtgtaggtcctggtgagagtggtgcttagtgtacaagttgagggagacccagcatggcgtat

SEQ ID NO: 447921 - DNA, 140 bp, Artificial Sequence
  Synthetic
aggccctggctgctgatatgcttgaaggaggcttgcaatcatgctaagctagtcttaaggagtctctatggacagaatttcatggagcaaatagacaaccaaattattcgagagctcagtgaccttttgggacagcggtg

SEQ ID NO: 447922 - DNA, 140 bp, Artificial Sequence
  Synthetic
caccgctgtcccaaaaggtcactgagctctcgaataatttggttgtctatttgctccatgaaattctgtccatagagactccttaagactagcttagcatgattgcaagcctccttcaagcatatcagcagccagggcct

SEQ ID NO: 447923 - DNA, 140 bp, Artificial Sequence
  Synthetic
atacgccatgctgggtctccgtcggatccatgttctcatttgttgctaatgtcgaggaggctcatgacgttgattatgatgcgttaatggatctaatgatagaagatgccaagaacaatgcgtacttgggagtcggccat

SEQ ID NO: 447924 - DNA, 140 bp, Artificial Sequence
  Synthetic
atggccgactcccaagtacgcattgttcttggcatcttctatcattagatccattaacgcatcataatcaacgtcatgagcctcctcgacattagcaacaaatgagaacatggatccgacggagacccagcatggcgtat

SEQ ID NO: 447925 - DNA, 140 bp, Artificial Sequence
  Synthetic
atacgccatgctgggtctccatagccaggtctatagggaagttctttgcttctgataccctctgtaacccccccaataaggtgaaaattcctgagacacatggcattagggctcggaagccgtacttgggagtcggccat

SEQ ID NO: 447926 - DNA, 140 bp, Artificial Sequence
  Synthetic
atggccgactcccaagtacggcttccgagccctaatgccatgtgtctcaggaattttcaccttattgggggggttacagagggtatcagaagcaaagaacttccctatagacctggctatggagacccagcatggcgtat

SEQ ID NO: 447927 - DNA, 140 bp, Artificial Sequence
  Synthetic
atacgccatgctgggtctcccgtccatggttgtcccagtgacaggaagccactcactcaagacgaccaaagcctggcatgtccagccagccagggcggcagcaactcgtgatagagtcaacgtacttgggagtcggccat

SEQ ID NO: 447928 - DNA, 140 bp, Artificial Sequence
  Synthetic
atggccgactcccaagtacgttgactctatcacgagttgctgccgccctggctggctggacatgccaggctttggtcgtcttgagtgagtggcttcctgtcactgggacaaccatggacgggagacccagcatggcgtat

SEQ ID NO: 447929 - DNA, 140 bp, Artificial Sequence
  Synthetic
aggccctggctgctgatatgcacacccagcatgttagaccgacgatcaggtggattgcagcatgttgcagcctgccagaagtggaaacactagtagcccgccaggaagaggcctctaatcgaccttttgggacagcggtg

SEQ ID NO: 447930 - DNA, 140 bp, Artificial Sequence
  Synthetic
caccgctgtcccaaaaggtcgattagaggcctcttcctggcgggctactagtgtttccacttctggcaggctgcaacatgctgcaatccacctgatcgtcggtctaacatgctgggtgtgcatatcagcagccagggcct

SEQ ID NO: 447931 - DNA, 140 bp, Artificial Sequence
  Synthetic
aggccctggctgctgatatgtaatgacttcagttactgaggggggtgggtcattctccttagctgcaatgattcagcaagctcagtgcactctccattacatgctaatgggcatgggagtgaccttttgggacagcggtg

SEQ ID NO: 447932 - DNA, 140 bp, Artificial Sequence
  Synthetic
caccgctgtcccaaaaggtcactcccatgcccattagcatgtaatggagagtgcactgagcttgctgaatcattgcagctaaggagaatgacccacccccctcagtaactgaagtcattacatatcagcagccagggcct

SEQ ID NO: 447933 - DNA, 140 bp, Artificial Sequence
  Synthetic
aggccctggctgctgatatgtcttatcagcaacaatttttgaagacactggacgccctgagttcaacttcttagaggattccaagtacagcttgctacaaaagatggccgcatattctgggaccttttgggacagcggtg

SEQ ID NO: 447934 - DNA, 140 bp, Artificial Sequence
  Synthetic
caccgctgtcccaaaaggtcccagaatatgcggccatcttttgtagcaagctgtacttggaatcctctaagaagttgaactcagggcgtccagtgtcttcaaaaattgttgctgataagacatatcagcagccagggcct

SEQ ID NO: 447935 - DNA, 140 bp, Artificial Sequence
  Synthetic
atacgccatgctgggtctcccactgaggactgcaacttttgtaggcagatgacaggtgctagcttgaagaaggggtcttatcctctccaggacttgttctgtcaatcaagtgaggatgatcgtacttgggagtcggccat

SEQ ID NO: 447936 - DNA, 140 bp, Artificial Sequence
  Synthetic
atggccgactcccaagtacgatcatcctcacttgattgacagaacaagtcctggagaggataagaccccttcttcaagctagcacctgtcatctgcctacaaaagttgcagtcctcagtgggagacccagcatggcgtat

SEQ ID NO: 447937 - DNA, 140 bp, Artificial Sequence
  Synthetic
aggccctggctgctgatatgcgaatattgaggaattagaatcactggattctatagtttacaacaagggagaaatagacatcatcccaagagttaatatcagggatgcaacccaaaccaggaccttttgggacagcggtg

SEQ ID NO: 447938 - DNA, 140 bp, Artificial Sequence
  Synthetic
caccgctgtcccaaaaggtcctggtttgggttgcatccctgatattaactcttgggatgatgtctatttctcccttgttgtaaactatagaatccagtgattctaattcctcaatattcgcatatcagcagccagggcct

SEQ ID NO: 447939 - DNA, 140 bp, Artificial Sequence
  Synthetic
atacgccatgctgggtctcctggtgtcagacaagtggtttgggactcagaagagtaggataggcaaaacaactttcctggctgaatgggagaagctaaagaaaattgtgaagtggttggacgtacttgggagtcggccat

SEQ ID NO: 447940 - DNA, 140 bp, Artificial Sequence
  Synthetic
atggccgactcccaagtacgtccaaccacttcacaattttctttagcttctcccattcagccaggaaagttgttttgcctatcctactcttctgagtcccaaaccacttgtctgacaccaggagacccagcatggcgtat

SEQ ID NO: 447941 - DNA, 140 bp, Artificial Sequence
  Synthetic
aggccctggctgctgatatgatggacaactatcaagagcttgcgatccagtttgctgctcaagcagtggaccgcaatgagattgaacagtgggtccgagagtttgcttatcaaggatttggaccttttgggacagcggtg

SEQ ID NO: 447942 - DNA, 140 bp, Artificial Sequence
  Synthetic
caccgctgtcccaaaaggtccaaatccttgataagcaaactctcggacccactgttcaatctcattgcggtccactgcttgagcagcaaactggatcgcaagctcttgatagttgtccatcatatcagcagccagggcct

SEQ ID NO: 447943 - DNA, 140 bp, Artificial Sequence
  Synthetic
aggccctggctgctgatatgctgttctgcatactacagggtccatacagtgagagctataagctacagctaatctacagagtcctaagctcagtgtcaaacgttgagataaaggaatcgggaccttttgggacagcggtg

SEQ ID NO: 447944 - DNA, 140 bp, Artificial Sequence
  Synthetic
caccgctgtcccaaaaggtcccgattcctttatctcaacgtttgacactgagcttaggactctgtagattagctgtagcttatagctctcactgtatggaccctgtagtatgcagaacagcatatcagcagccagggcct

SEQ ID NO: 447945 - DNA, 140 bp, Artificial Sequence
  Synthetic
atacgccatgctgggtctccatgcccgtagggttatcgaactcttaaagcagtatggtggggctgactgggagaaggatgccaagaaaatgattgttctggctctgactcgtggcaacaacgtacttgggagtcggccat

SEQ ID NO: 447946 - DNA, 140 bp, Artificial Sequence
  Synthetic
atggccgactcccaagtacgttgttgccacgagtcagagccagaacaatcattttcttggcatccttctcccagtcagccccaccatactgctttaagagttcgataaccctacgggcatggagacccagcatggcgtat

SEQ ID NO: 447947 - DNA, 140 bp, Artificial Sequence
  Synthetic
atacgccatgctgggtctccgccccggaggatgatgatgaaaatgtcgaaagaaggcaaagcaactgtggaggctctcatcaacaagtataagctaaaggaggggaatccttcccgggatcgtacttgggagtcggccat

SEQ ID NO: 447948 - DNA, 140 bp, Artificial Sequence
  Synthetic
atggccgactcccaagtacgatcccgggaaggattcccctcctttagcttatacttgttgatgagagcctccacagttgctttgccttctttcgacattttcatcatcatcctccggggcggagacccagcatggcgtat

SEQ ID NO: 447949 - DNA, 140 bp, Artificial Sequence
  Synthetic
atacgccatgctgggtctcctggattcatcaagagacaacagtctaaagttgtgcaaaacaaagtggtctattatggagttgggatctggagaggcttcatggatggatatcaggtccatcgtacttgggagtcggccat

SEQ ID NO: 447950 - DNA, 140 bp, Artificial Sequence
  Synthetic
atggccgactcccaagtacgatggacctgatatccatccatgaagcctctccagatcccaactccataatagaccactttgttttgcacaactttagactgttgtctcttgatgaatccaggagacccagcatggcgtat

SEQ ID NO: 447951 - DNA, 140 bp, Artificial Sequence
  Synthetic
atacgccatgctgggtctcccttgagatagaaaatgacataggacagcccccaaggcttaggaatgtcacaactaactgtcagagcagcccatgggacctgagtatcccaataaggcagtcgtacttgggagtcggccat

SEQ ID NO: 447952 - DNA, 140 bp, Artificial Sequence
  Synthetic
atggccgactcccaagtacgactgccttattgggatactcaggtcccatgggctgctctgacagttagttgtgacattcctaagccttgggggctgtcctatgtcattttctatctcaagggagacccagcatggcgtat

SEQ ID NO: 447953 - DNA, 140 bp, Artificial Sequence
  Synthetic
atacgccatgctgggtctccggctttggtcgtcttgagtgagtggcttcctgtcactgggaccaccatggatggcctatcccctgcatacccaaggcatatgatgcaccccagctttgctcgtacttgggagtcggccat

SEQ ID NO: 447954 - DNA, 140 bp, Artificial Sequence
  Synthetic
atggccgactcccaagtacgagcaaagctggggtgcatcatatgccttgggtatgcaggggataggccatccatggtggtcccagtgacaggaagccactcactcaagacgaccaaagccggagacccagcatggcgtat

SEQ ID NO: 447955 - DNA, 140 bp, Artificial Sequence
  Synthetic
aggccctggctgctgatatggggcagaagacatgggggtcacaaacaaccaggattattcctctaaatctagcagaggagccagatattggatgcattcatttaggatgcaaggacccaggaccttttgggacagcggtg

SEQ ID NO: 447956 - DNA, 140 bp, Artificial Sequence
  Synthetic
caccgctgtcccaaaaggtcctgggtccttgcatcctaaatgaatgcatccaatatctggctcctctgctagatttagaggaataatcctggttgtttgtgacccccatgtcttctgccccatatcagcagccagggcct

SEQ ID NO: 447957 - DNA, 140 bp, Artificial Sequence
  Synthetic
atacgccatgctgggtctcctgctcactctctgtatctgctgcagttctcccgggtcatcaacccaaacctccgaggtagaacaaaggaggaggttgccgcaacgttcacgcagccaatgcgtacttgggagtcggccat

SEQ ID NO: 447958 - DNA, 140 bp, Artificial Sequence
  Synthetic
atggccgactcccaagtacgcattggctgcgtgaacgttgcggcaacctcctcctttgttctacctcggaggtttgggttgatgacccgggagaactgcagcagatacagagagtgagcaggagacccagcatggcgtat

SEQ ID NO: 447959 - DNA, 140 bp, Artificial Sequence
  Synthetic
aggccctggctgctgatatgttatcagactgagaaaagaggaggtggagatgaaagtacggggctctactctcaacttgtacactaagcaccattctcatcaagacttacacattttatcgaccttttgggacagcggtg

SEQ ID NO: 447960 - DNA, 140 bp, Artificial Sequence
  Synthetic
caccgctgtcccaaaaggtcgataaaatgtgtaagtcttgatgagaatggtgcttagtgtacaagttgagagtagagccccgtactttcatctccacctcctcttttctcagtctgataacatatcagcagccagggcct

SEQ ID NO: 447961 - DNA, 140 bp, Artificial Sequence
  Synthetic
atacgccatgctgggtctccaatgcagcagtgaatagcaactttataagccatgagaagaggagagaattcttgaaagcttttgggcttgtggattccaatgggaagccgtcagcagctgcgtacttgggagtcggccat

SEQ ID NO: 447962 - DNA, 140 bp, Artificial Sequence
  Synthetic
atggccgactcccaagtacgcagctgctgacggcttcccattggaatccacaagcccaaaagctttcaagaattctctcctcttctcatggcttataaagttgctattcactgctgcattggagacccagcatggcgtat

SEQ ID NO: 447963 - DNA, 140 bp, Artificial Sequence
  Synthetic
aggccctggctgctgatatggaggagagaattcttgaaagcttttgggcttgtggattccaatgggaagccgtcagcagctgtcatggcagctgctcaggcgtacaagacagcagcctaagaccttttgggacagcggtg

SEQ ID NO: 447964 - DNA, 140 bp, Artificial Sequence
  Synthetic
caccgctgtcccaaaaggtcttaggctgctgtcttgtacgcctgagcagctgccatgacagctgctgacggcttcccattggaatccacaagcccaaaagctttcaagaattctctcctccatatcagcagccagggcct

SEQ ID NO: 447965 - DNA, 140 bp, Artificial Sequence
  Synthetic
aggccctggctgctgatatggactctcagagattgtgagaatttgttctgaatcttccctaagatcaaaggtcggatctatgttctcatttgtcgccaatgttgaggaggcccatgatgtgaccttttgggacagcggtg

SEQ ID NO: 447966 - DNA, 140 bp, Artificial Sequence
  Synthetic
caccgctgtcccaaaaggtcacatcatgggcctcctcaacattggcgacaaatgagaacatagatccgacctttgatcttagggaagattcagaacaaattctcacaatctctgagagtccatatcagcagccagggcct

SEQ ID NO: 447967 - DNA, 140 bp, Artificial Sequence
  Synthetic
atacgccatgctgggtctcctgattatgatgcgttaatggatctaatgatagaagatgctaagaacaatgcattcagtcatgttgtcgattgcatagagttggatgttaatggtccttaccgtacttgggagtcggccat

SEQ ID NO: 447968 - DNA, 140 bp, Artificial Sequence
  Synthetic
atggccgactcccaagtacggtaaggaccattaacatccaactctatgcaatcgacaacatgactgaatgcattgttcttagcatcttctatcattagatccattaacgcatcataatcaggagacccagcatggcgtat

SEQ ID NO: 447969 - DNA, 140 bp, Artificial Sequence
  Synthetic
atacgccatgctgggtctccttacaaggacatcagttcattatctatgattgctcatcccttaatggataagtttgttgattatgctatttccaagatggggagagcctcagttagaaaacgtacttgggagtcggccat

SEQ ID NO: 447970 - DNA, 140 bp, Artificial Sequence
  Synthetic
atggccgactcccaagtacgttttctaactgaggctctccccatcttggaaatagcataatcaacaaacttatccattaagggatgagcaatcatagataatgaactgatgtccttgtaaggagacccagcatggcgtat

SEQ ID NO: 447971 - DNA, 140 bp, Artificial Sequence
  Synthetic
aggccctggctgctgatatgcccccaccccccaatcccgaccgtaaccccaaccccccttttccccaacccccctgggcagccacttaggctgctgttctgtaagcctgagcagctgccagaccttttgggacagcggtg

SEQ ID NO: 447972 - DNA, 140 bp, Artificial Sequence
  Synthetic
caccgctgtcccaaaaggtctggcagctgctcaggcttacagaacagcagcctaagtggctgcccaggggggttggggaaaaggggggttggggttacggtcgggattggggggtgggggcatatcagcagccagggcct

SEQ ID NO: 447973 - DNA, 140 bp, Artificial Sequence
  Synthetic
aggccctggctgctgatatgtccagttgttcctccaatcccagatgttgagatggaatcagaggaagagagtgatgatgatggatttgttgaggttgattagaggttaaggctgccccacgaccttttgggacagcggtg

SEQ ID NO: 447974 - DNA, 140 bp, Artificial Sequence
  Synthetic
caccgctgtcccaaaaggtcgtggggcagccttaacctctaatcaacctcaacaaatccatcatcatcactctcttcctctgattccatctcaacatctgggattggaggaacaactggacatatcagcagccagggcct

SEQ ID NO: 447975 - DNA, 140 bp, Artificial Sequence
  Synthetic
atacgccatgctgggtctccgagagaaacagataccatagagtccatctgaatgtggactcagatgatagtgtctacatagctgctttaggagttaatggaaagaagcataaagcagatacgtacttgggagtcggccat

SEQ ID NO: 447976 - DNA, 140 bp, Artificial Sequence
  Synthetic
atggccgactcccaagtacgtatctgctttatgcttctttccattaactcctaaagcagctatgtagacactatcatctgagtccacattcagatggactctatggtatctgtttctctcggagacccagcatggcgtat

SEQ ID NO: 447977 - DNA, 140 bp, Artificial Sequence
  Synthetic
atacgccatgctgggtctccaaaagccatcattgctgctgatggcttgaacaacatcacctgccatggtaaggatcctgaggacaagatttctctcataaagggtcctcctcacaaaaagcgtacttgggagtcggccat

SEQ ID NO: 447978 - DNA, 140 bp, Artificial Sequence
  Synthetic
atggccgactcccaagtacgctttttgtgaggaggaccctttatgagagaaatcttgtcctcaggatccttaccatggcaggtgatgttgttcaagccatcagcagcaatgatggcttttggagacccagcatggcgtat

SEQ ID NO: 447979 - DNA, 140 bp, Artificial Sequence
  Synthetic
aggccctggctgctgatatgcatcagatgggtgtataagaagatggttgccagagtggcagacaatatcaatcaagtgaacagggaaataggatggatggaaggaggccagttggttctagaccttttgggacagcggtg

SEQ ID NO: 447980 - DNA, 140 bp, Artificial Sequence
  Synthetic
caccgctgtcccaaaaggtctagaaccaactggcctccttccatccatcctatttccctgttcacttgattgatattgtctgccactctggcaaccatcttcttatacacccatctgatgcatatcagcagccagggcct

SEQ ID NO: 447981 - DNA, 140 bp, Artificial Sequence
  Synthetic
aggccctggctgctgatatgagaaagcttcatagatcagtacgtgtagaagcaatatatagaaaaaatatatagaaaaataagtaaatataagaaaatctaattatgtaaatattgtacagaccttttgggacagcggtg

SEQ ID NO: 447982 - DNA, 140 bp, Artificial Sequence
  Synthetic
caccgctgtcccaaaaggtctgtacaatatttacataattagattttcttatatttacttatttttctatatattttttctatatattgcttctacacgtactgatctatgaagctttctcatatcagcagccagggcct

SEQ ID NO: 447983 - DNA, 140 bp, Artificial Sequence
  Synthetic
aggccctggctgctgatatggtgatgatgatggatttgttgaggttgattagaggttaaggctgccccacccccccaccccccaatcccgaccgtaaccccaaccacccccttcccccaagaccttttgggacagcggtg

SEQ ID NO: 447984 - DNA, 140 bp, Artificial Sequence
  Synthetic
caccgctgtcccaaaaggtcttgggggaagggggtggttggggttacggtcgggattggggggtgggggggtggggcagccttaacctctaatcaacctcaacaaatccatcatcatcaccatatcagcagccagggcct

SEQ ID NO: 447985 - DNA, 140 bp, Artificial Sequence
  Synthetic
aggccctggctgctgatatggctaagtatgaggttccttgtgagaacagatctcagggcaggactgttgttctttatgttgttagcgcctatcggcatggtgtttggtctaatttggagcgaccttttgggacagcggtg

SEQ ID NO: 447986 - DNA, 140 bp, Artificial Sequence
  Synthetic
caccgctgtcccaaaaggtcgctccaaattagaccaaacaccatgccgataggcgctaacaacataaagaacaacagtcctgccctgagatctgttctcacaaggaacctcatacttagccatatcagcagccagggcct

SEQ ID NO: 447987 - DNA, 140 bp, Artificial Sequence
  Synthetic
atacgccatgctgggtctcctctttatgttgttagcgcctatcggcatggtgtttggtctaatttggagctagaggactctgaagcagaggagatggtttacaggtataggcttgctcttcgtacttgggagtcggccat

SEQ ID NO: 447988 - DNA, 140 bp, Artificial Sequence
  Synthetic
atggccgactcccaagtacgaagagcaagcctatacctgtaaaccatctcctctgcttcagagtcctctagctccaaattagaccaaacaccatgccgataggcgctaacaacataaagaggagacccagcatggcgtat

SEQ ID NO: 447989 - DNA, 140 bp, Artificial Sequence
  Synthetic
atacgccatgctgggtctccgaaatgtttgacaggtttagatcttctcctcccgactcagagtatatcacgaggatagtgagcagatgcctcataaattctcaagagaaactcatcaatacgtacttgggagtcggccat

SEQ ID NO: 447990 - DNA, 140 bp, Artificial Sequence
  Synthetic
atggccgactcccaagtacgtattgatgagtttctcttgagaatttatgaggcatctgctcactatcctcgtgatatactctgagtcgggaggagaagatctaaacctgtcaaacatttcggagacccagcatggcgtat

SEQ ID NO: 447991 - DNA, 140 bp, Artificial Sequence
  Synthetic
aggccctggctgctgatatgagaagacaaccttagggacctcaatgaccacaagtcaactattcagctgcctccctggctgtcctatcacgatgtcgatggcaaagatctgtgccctcttgaccttttgggacagcggtg

SEQ ID NO: 447992 - DNA, 140 bp, Artificial Sequence
  Synthetic
caccgctgtcccaaaaggtcaagagggcacagatctttgccatcgacatcgtgataggacagccagggaggcagctgaatagttgacttgtggtcattgaggtccctaaggttgtcttctcatatcagcagccagggcct

SEQ ID NO: 447993 - DNA, 140 bp, Artificial Sequence
  Synthetic
atacgccatgctgggtctcccagggattagatgtgagaggggaccatcccatgtgcaacctgtggagagaagtggttacctctgcaaatctagaggagattgagaggatgcacgatgatgcgtacttgggagtcggccat

SEQ ID NO: 447994 - DNA, 140 bp, Artificial Sequence
  Synthetic
atggccgactcccaagtacgcatcatcgtgcatcctctcaatctcctctagatttgcagaggtaaccacttctctccacaggttgcacatgggatggtcccctctcacatctaatccctgggagacccagcatggcgtat

SEQ ID NO: 447995 - DNA, 140 bp, Artificial Sequence
  Synthetic
aggccctggctgctgatatgagtggttacctctgcaaatctagaggagattgagaggatgcacgatgatgcagcagcagaacttgagtttgccctttcaggggtaaaggacaggccagatgaccttttgggacagcggtg

SEQ ID NO: 447996 - DNA, 140 bp, Artificial Sequence
  Synthetic
caccgctgtcccaaaaggtcatctggcctgtcctttacccctgaaagggcaaactcaagttctgctgctgcatcatcgtgcatcctctcaatctcctctagatttgcagaggtaaccactcatatcagcagccagggcct

SEQ ID NO: 447997 - DNA, 140 bp, Artificial Sequence
  Synthetic
atacgccatgctgggtctccgaaatagacatcataccaagagtcaacatcagagatgcaacccagaccagggtcaccatctttaatgagcagaagaccctccgaacatctccagagaagtcgtacttgggagtcggccat

SEQ ID NO: 447998 - DNA, 140 bp, Artificial Sequence
  Synthetic
atggccgactcccaagtacgacttctctggagatgttcggagggtcttctgctcattaaagatggtgaccctggtctgggttgcatctctgatgttgactcttggtatgatgtctatttcggagacccagcatggcgtat

SEQ ID NO: 447999 - DNA, 140 bp, Artificial Sequence
  Synthetic
atacgccatgctgggtctcctcagattggcagcccaaagaattcatcagccatccttatcagaaaggggcttcaatgagatcataacagagcactacaaatttatgggcagtaggataggcgtacttgggagtcggccat

SEQ ID NO: 448000 - DNA, 140 bp, Artificial Sequence
  Synthetic
atggccgactcccaagtacgcctatcctactgcccataaatttgtagtgctctgttatgatctcattgaagcccctttctgataaggatggctgatgaattctttgggctgccaatctgaggagacccagcatggcgtat

SEQ ID NO: 448001 - DNA, 140 bp, Artificial Sequence
  Synthetic
atacgccatgctgggtctcccacttgtaaacctgtgacatatgctggggcatgtagcagttttgatgtcttgctcgaaaagggaaaattccccctcttccagtcgtatgctcatcatagacgtacttgggagtcggccat

SEQ ID NO: 448002 - DNA, 140 bp, Artificial Sequence
  Synthetic
atggccgactcccaagtacgtctatgatgagcatacgactggaagagggggaattttcccttttcgagcaagacatcaaaactgctacatgccccagcatatgtcacaggtttacaagtgggagacccagcatggcgtat

SEQ ID NO: 448003 - DNA, 140 bp, Artificial Sequence
  Synthetic
atacgccatgctgggtctccactctactagaggcagttcatgacaccatcattgcaaaggctgatccacctagttgtgatcttcagagtgctcatgggaatccttgcatgaaagagaaaccgtacttgggagtcggccat

SEQ ID NO: 448004 - DNA, 140 bp, Artificial Sequence
  Synthetic
atggccgactcccaagtacggtttctctttcatgcaaggattcccatgagcactctgaagatcacaactaggtggatcagcctttgcaatgatggtgtcatgaactgcctctagtagagtggagacccagcatggcgtat

SEQ ID NO: 448005 - DNA, 140 bp, Artificial Sequence
  Synthetic
aggccctggctgctgatatgagcagaggagccagatattggatgcattcatttaggatgcaaggacctagcaagccatttggatgcccagtttatattattaagggtgatatgtcagatggaccttttgggacagcggtg

SEQ ID NO: 448006 - DNA, 140 bp, Artificial Sequence
  Synthetic
caccgctgtcccaaaaggtccatctgacatatcacccttaataatataaactgggcatccaaatggcttgctaggtccttgcatcctaaatgaatgcatccaatatctggctcctctgctcatatcagcagccagggcct

SEQ ID NO: 448007 - DNA, 140 bp, Artificial Sequence
  Synthetic
aggccctggctgctgatatgggatcaaaattaaaaacaaaaatgaaaggggtctgcgaagtgggggttcaggcactcaagaagtgtgatggccagctcagcactgcacatgaggttgtgcgaccttttgggacagcggtg

SEQ ID NO: 448008 - DNA, 140 bp, Artificial Sequence
  Synthetic
caccgctgtcccaaaaggtcgcacaacctcatgtgcagtgctgagctggccatcacacttcttgagtgcctgaacccccacttcgcagacccctttcatttttgtttttaattttgatcccatatcagcagccagggcct

SEQ ID NO: 448009 - DNA, 140 bp, Artificial Sequence
  Synthetic
aggccctggctgctgatatgctcaaaactgaagaaaatctgctaccagactcatttgtctgcttcgagcataagggacagtataaaggaacaatggactctggtcaaactaagagggagcgaccttttgggacagcggtg

SEQ ID NO: 448010 - DNA, 140 bp, Artificial Sequence
  Synthetic
caccgctgtcccaaaaggtcgctccctcttagtttgaccagagtccattgttcctttatactgtcccttatgctcgaagcagacaaatgagtctggtagcagattttcttcagttttgagcatatcagcagccagggcct

SEQ ID NO: 448011 - DNA, 140 bp, Artificial Sequence
  Synthetic
aggccctggctgctgatatgtcaaaagctttgatatctctcagtgccccaagattggaggacatggtagcaagaagtgcactggggacgcagcattttgctctgcttatgagtgcactgcgaccttttgggacagcggtg

SEQ ID NO: 448012 - DNA, 140 bp, Artificial Sequence
  Synthetic
caccgctgtcccaaaaggtcgcagtgcactcataagcagagcaaaatgctgcgtccccagtgcacttcttgctaccatgtcctccaatcttggggcactgagagatatcaaagcttttgacatatcagcagccagggcct

SEQ ID NO: 448013 - DNA, 140 bp, Artificial Sequence
  Synthetic
atacgccatgctgggtctccataaattgttagtgaagatgtcaaaatatgcctctgagggaaagagcctagctattcagaaatttgaggattgcatgaggcagatagaatcacaaggatgcgtacttgggagtcggccat

SEQ ID NO: 448014 - DNA, 140 bp, Artificial Sequence
  Synthetic
atggccgactcccaagtacgcatccttgtgattctatctgcctcatgcaatcctcaaatttctgaatagctaggctctttccctcagaggcatattttgacatcttcactaacaatttatggagacccagcatggcgtat

SEQ ID NO: 448015 - DNA, 140 bp, Artificial Sequence
  Synthetic
aggccctggctgctgatatggatcaacagggttcaagatatcatctgcagttgcatgtgctagcggagtttgtgtcacaggatcgcagagtccttctaccgagatcacactcaagtatccgaccttttgggacagcggtg

SEQ ID NO: 448016 - DNA, 140 bp, Artificial Sequence
  Synthetic
caccgctgtcccaaaaggtcggatacttgagtgtgatctcggtagaaggactctgcgatcctgtgacacaaactccgctagcacatgcaactgcagatgatatcttgaaccctgttgatccatatcagcagccagggcct

SEQ ID NO: 448017 - DNA, 140 bp, Artificial Sequence
  Synthetic
atacgccatgctgggtctccatgatcagtcagttagctccaaaatagtagctcactgccctccccaggacccgtgcctagtgcatggctgcatagtgtgtgctcatggcctaataaattacgtacttgggagtcggccat

SEQ ID NO: 448018 - DNA, 140 bp, Artificial Sequence
  Synthetic
atggccgactcccaagtacgtaatttattaggccatgagcacacactatgcagccatgcactaggcacgggtcctggggagggcagtgagctactattttggagctaactgactgatcatggagacccagcatggcgtat

SEQ ID NO: 448019 - DNA, 140 bp, Artificial Sequence
  Synthetic
aggccctggctgctgatatgtcagattgccactctagcaatgaggagctgcaagatcaccaatgatctagaggactcctttgttggattacacaggatgatagtgactgaggccatcctcgaccttttgggacagcggtg

SEQ ID NO: 448020 - DNA, 140 bp, Artificial Sequence
  Synthetic
caccgctgtcccaaaaggtcgaggatggcctcagtcactatcatcctgtgtaatccaacaaaggagtcctctagatcattggtgatcttgcagctcctcattgctagagtggcaatctgacatatcagcagccagggcct

SEQ ID NO: 448021 - DNA, 140 bp, Artificial Sequence
  Synthetic
aggccctggctgctgatatgatcaagtgaacagagaaataggatggatggagggaggtcagttggctctagggaaccctgcccctattcctcgtcatgccccaattccacgttatagcacgaccttttgggacagcggtg

SEQ ID NO: 448022 - DNA, 140 bp, Artificial Sequence
  Synthetic
caccgctgtcccaaaaggtcgtgctataacgtggaattggggcatgacgaggaataggggcagggttccctagagccaactgacctccctccatccatcctatttctctgttcacttgatcatatcagcagccagggcct

SEQ ID NO: 448023 - DNA, 140 bp, Artificial Sequence
  Synthetic
aggccctggctgctgatatgttatcatggtgaggcagaagttccatgggcctttaagggcaaaacatatttggaaaccacaacagggatgatgcaggggatattgcattatacttcctcagaccttttgggacagcggtg

SEQ ID NO: 448024 - DNA, 140 bp, Artificial Sequence
  Synthetic
caccgctgtcccaaaaggtctgaggaagtataatgcaatatcccctgcatcatccctgttgtggtttccaaatatgttttgcccttaaaggcccatggaacttctgcctcaccatgataacatatcagcagccagggcct

SEQ ID NO: 448025 - DNA, 140 bp, Artificial Sequence
  Synthetic
atacgccatgctgggtctccggcagaggcttgcttgatgttaaagggagtcaaggaggaccaaacaaagttcttgaagataaaaactgtctcaagtgagctatcgtgcagggaaggccagcgtacttgggagtcggccat

SEQ ID NO: 448026 - DNA, 140 bp, Artificial Sequence
  Synthetic
atggccgactcccaagtacgctggccttccctgcacgatagctcacttgagacagtttttatcttcaagaactttgtttggtcctccttgactccctttaacatcaagcaagcctctgccggagacccagcatggcgtat

SEQ ID NO: 448027 - DNA, 140 bp, Artificial Sequence
  Synthetic
aggccctggctgctgatatgtcttgaagataaaaactgtctcaagtgagctatcgtgcagggaaggccagagctattggactggatcctttagtcccaaatgtctgagctcaaggagatggaccttttgggacagcggtg

SEQ ID NO: 448028 - DNA, 140 bp, Artificial Sequence
  Synthetic
caccgctgtcccaaaaggtccatctccttgagctcagacatttgggactaaaggatccagtccaatagctctggccttccctgcacgatagctcacttgagacagtttttatcttcaagacatatcagcagccagggcct

SEQ ID NO: 448029 - DNA, 140 bp, Artificial Sequence
  Synthetic
atacgccatgctgggtctccgagaataaatgttttgagcagtgtgggggatggggatgtgggtgcttcaatgtgaacccatcttgcttgtttgtgcacacgtatctgcagtcagttagaacgtacttgggagtcggccat

SEQ ID NO: 448030 - DNA, 140 bp, Artificial Sequence
  Synthetic
atggccgactcccaagtacgttctaactgactgcagatacgtgtgcacaaacaagcaagatgggttcacattgaagcacccacatccccatcccccacactgctcaaaacatttattctcggagacccagcatggcgtat

SEQ ID NO: 448031 - DNA, 140 bp, Artificial Sequence
  Synthetic
atacgccatgctgggtctccatgaatcatgccttcgggcaccaaacctcatctcatacaagcccatgatagaccagttggagtgcacaacaaatctgattgatccctttgttgtctttgacgtacttgggagtcggccat

SEQ ID NO: 448032 - DNA, 140 bp, Artificial Sequence
  Synthetic
atggccgactcccaagtacgtcaaagacaacaaagggatcaatcagatttgttgtgcactccaactggtctatcatgggcttgtatgagatgaggtttggtgcccgaaggcatgattcatggagacccagcatggcgtat

SEQ ID NO: 448033 - DNA, 140 bp, Artificial Sequence
  Synthetic
aggccctggctgctgatatggaccagttggagtgcacaacaaatctgattgatccctttgttgtctttgagaggggttctctgcctcagacaaggaatgataaaacttttgcagcttcaagaccttttgggacagcggtg

SEQ ID NO: 448034 - DNA, 140 bp, Artificial Sequence
  Synthetic
caccgctgtcccaaaaggtcttgaagctgcaaaagttttatcattccttgtctgaggcagagaacccctctcaaagacaacaaagggatcaatcagatttgttgtgcactccaactggtccatatcagcagccagggcct

SEQ ID NO: 448035 - DNA, 140 bp, Artificial Sequence
  Synthetic
atacgccatgctgggtctcctcttatcagcaacaatttttgaagacactgggcgtcctgagttcaacttcttggaggattccaagtacagcttgctacagaagatggccgcatattctggcgtacttgggagtcggccat

SEQ ID NO: 448036 - DNA, 140 bp, Artificial Sequence
  Synthetic
atggccgactcccaagtacgccagaatatgcggccatcttctgtagcaagctgtacttggaatcctccaagaagttgaactcaggacgcccagtgtcttcaaaaattgttgctgataagaggagacccagcatggcgtat

SEQ ID NO: 448037 - DNA, 140 bp, Artificial Sequence
  Synthetic
aggccctggctgctgatatgttaactctgatgtttgacaattttgaggtggactttgtgggagcagccgtgtcttgtgatgccgctttcttaaatctgacaggttgttattcttgtaatggaccttttgggacagcggtg

SEQ ID NO: 448038 - DNA, 140 bp, Artificial Sequence
  Synthetic
caccgctgtcccaaaaggtccattacaagaataacaacctgtcagatttaagaaagcggcatcacaagacacggctgctcccacaaagtccacctcaaaattgtcaaacatcagagttaacatatcagcagccagggcct

SEQ ID NO: 448039 - DNA, 140 bp, Artificial Sequence
  Synthetic
aggccctggctgctgatatgtctgcccacaataaggatgggtctctgcatatagttcttccatcagagaatggaacaaaagatcagtgtcagatactacacttcactgtacctgaggtaggaccttttgggacagcggtg

SEQ ID NO: 448040 - DNA, 140 bp, Artificial Sequence
  Synthetic
caccgctgtcccaaaaggtcctacctcaggtacagtgaagtgtagtatctgacactgatcttttgttccattctctgatggaagaactatatgcagagacccatccttattgtgggcagacatatcagcagccagggcct

SEQ ID NO: 448041 - DNA, 140 bp, Artificial Sequence
  Synthetic
atacgccatgctgggtctccataacaggagctcctgtaaagaagaggtcaggggttagcaagatagctatggttatccgtgacaatttctcccggatgggccatcttcgaggtgtagaagcgtacttgggagtcggccat

SEQ ID NO: 448042 - DNA, 140 bp, Artificial Sequence
  Synthetic
atggccgactcccaagtacgcttctacacctcgaagatggcccatccgggagaaattgtcacggataaccatagctatcttgctaacccctgacctcttctttacaggagctcctgttatggagacccagcatggcgtat

SEQ ID NO: 448043 - DNA, 140 bp, Artificial Sequence
  Synthetic
atacgccatgctgggtctccagaaggcctcataaatcagcacgtgtagaagcagtatgtagaaataaatagacacaagcaaacccaattatgtaaaaattgtacagataagccaaactatcgtacttgggagtcggccat

SEQ ID NO: 448044 - DNA, 140 bp, Artificial Sequence
  Synthetic
atggccgactcccaagtacgatagtttggcttatctgtacaatttttacataattgggtttgcttgtgtctatttatttctacatactgcttctacacgtgctgatttatgaggccttctggagacccagcatggcgtat

SEQ ID NO: 448045 - DNA, 140 bp, Artificial Sequence
  Synthetic
atacgccatgctgggtctcctgggatgtccaggtttagaaacttatacaatgatactttagatgtaagcttaatcacaatttggggtggtggggtgaggcagcagcagtctcaggttcatcgtacttgggagtcggccat

SEQ ID NO: 448046 - DNA, 140 bp, Artificial Sequence
  Synthetic
atggccgactcccaagtacgatgaacctgagactgctgctgcctcaccccaccaccccaaattgtgattaagcttacatctaaagtatcattgtataagtttctaaacctggacatcccaggagacccagcatggcgtat

SEQ ID NO: 448047 - DNA, 140 bp, Artificial Sequence
  Synthetic
aggccctggctgctgatatgcagtctcaggttcatgtggatattctagttggcgtgattgtcttttgccagattagctgggaattaaactaactctttgaagttgcaccggtctttgtgtgaccttttgggacagcggtg

SEQ ID NO: 448048 - DNA, 140 bp, Artificial Sequence
  Synthetic
caccgctgtcccaaaaggtcacacaaagaccggtgcaacttcaaagagttagtttaattcccagctaatctggcaaaagacaatcacgccaactagaatatccacatgaacctgagactgcatatcagcagccagggcct

SEQ ID NO: 448049 - DNA, 140 bp, Artificial Sequence
  Synthetic
atacgccatgctgggtctcctgactctggcactcccaacatttgatgtctccaagatggtggatagaattaccatagacttcaatctggatgacatacaaggagcatctgagataggctccgtacttgggagtcggccat

SEQ ID NO: 448050 - DNA, 140 bp, Artificial Sequence
  Synthetic
atggccgactcccaagtacggagcctatctcagatgctccttgtatgtcatccagattgaagtctatggtaattctatccaccatcttggagacatcaaatgttgggagtgccagagtcaggagacccagcatggcgtat

SEQ ID NO: 448051 - DNA, 140 bp, Artificial Sequence
  Synthetic
atacgccatgctgggtctcccagatgagggggtagctcaagccctgcaattatttgagagggagccaagcaactgctgggtgagatgtgagtctgtagctccaaaatttatatcagccatcgtacttgggagtcggccat

SEQ ID NO: 448052 - DNA, 140 bp, Artificial Sequence
  Synthetic
atggccgactcccaagtacgatggctgatataaattttggagctacagactcacatctcacccagcagttgcttggctccctctcaaataattgcagggcttgagctaccccctcatctgggagacccagcatggcgtat

SEQ ID NO: 448053 - DNA, 140 bp, Artificial Sequence
  Synthetic
atacgccatgctgggtctccgctgaggagtgctccttggcaatagagagagctttaaatcagtatagggcagaagacaaccttagggatcttaatgaccacaagtcaactatacagctgccgtacttgggagtcggccat

SEQ ID NO: 448054 - DNA, 140 bp, Artificial Sequence
  Synthetic
atggccgactcccaagtacggcagctgtatagttgacttgtggtcattaagatccctaaggttgtcttctgccctatactgatttaaagctctctctattgccaaggagcactcctcagcggagacccagcatggcgtat

SEQ ID NO: 448055 - DNA, 140 bp, Artificial Sequence
  Synthetic
aggccctggctgctgatatgagaagacaaccttagggatcttaatgaccacaagtcaactatacagctgcctccctggttgtcctaccacgatgccgatggcaaagatctgtgcccccttgaccttttgggacagcggtg

SEQ ID NO: 448056 - DNA, 140 bp, Artificial Sequence
  Synthetic
caccgctgtcccaaaaggtcaagggggcacagatctttgccatcggcatcgtggtaggacaaccagggaggcagctgtatagttgacttgtggtcattaagatccctaaggttgtcttctcatatcagcagccagggcct

SEQ ID NO: 448057 - DNA, 140 bp, Artificial Sequence
  Synthetic
atacgccatgctgggtctccgagagaaacagataccatagagttcatctgaatatggacccagatgatagtgtctatatagctgccttaggggttaatggaaagaagcacaaagcagatacgtacttgggagtcggccat

SEQ ID NO: 448058 - DNA, 140 bp, Artificial Sequence
  Synthetic
atggccgactcccaagtacgtatctgctttgtgcttctttccattaacccctaaggcagctatatagacactatcatctgggtccatattcagatgaactctatggtatctgtttctctcggagacccagcatggcgtat

SEQ ID NO: 448059 - DNA, 140 bp, Artificial Sequence
  Synthetic
atacgccatgctgggtctccagagggattgacctgtgcctgttgccaggctttgatctcatgtatgaggttgctcacgtacagtgcgttcggcttctgcaagcagcaaaagaggacatttcgtacttgggagtcggccat

SEQ ID NO: 448060 - DNA, 140 bp, Artificial Sequence
  Synthetic
atggccgactcccaagtacgaaatgtcctcttttgctgcttgcagaagccgaacgcactgtacgtgagcaacctcatacatgagatcaaagcctggcaacaggcacaggtcaatccctctggagacccagcatggcgtat

SEQ ID NO: 448061 - DNA, 140 bp, Artificial Sequence
  Synthetic
atacgccatgctgggtctccgtgggcaacagatgaggacctgtacaaccctctttcttgtgataaagagcttagattagcagcccagagaatccatcagccatccttatcagaaaggggccgtacttgggagtcggccat

SEQ ID NO: 448062 - DNA, 140 bp, Artificial Sequence
  Synthetic
atggccgactcccaagtacggcccctttctgataaggatggctgatggattctctgggctgctaatctaagctctttatcacaagaaagagggttgtacaggtcctcatctgttgcccacggagacccagcatggcgtat

SEQ ID NO: 448063 - DNA, 140 bp, Artificial Sequence
  Synthetic
aggccctggctgctgatatgtccagttattcctccaatcccagatgttgagatggaatcagaggaggagagtgatgatgatggatttgttgaggttgattagaggttaaggctgccccacgaccttttgggacagcggtg

SEQ ID NO: 448064 - DNA, 140 bp, Artificial Sequence
  Synthetic
caccgctgtcccaaaaggtcgtggggcagccttaacctctaatcaacctcaacaaatccatcatcatcactctcctcctctgattccatctcaacatctgggattggaggaataactggacatatcagcagccagggcct

SEQ ID NO: 448065 - DNA, 140 bp, Artificial Sequence
  Synthetic
aggccctggctgctgatatggtgatgatgatggatttgttgaggttgattagaggttaaggctgccccaccccccaccccccaatcccgaccgtaaccccaactccccttccccccaaccgaccttttgggacagcggtg

SEQ ID NO: 448066 - DNA, 140 bp, Artificial Sequence
  Synthetic
caccgctgtcccaaaaggtcggttggggggaaggggagttggggttacggtcgggattggggggtggggggtggggcagccttaacctctaatcaacctcaacaaatccatcatcatcaccatatcagcagccagggcct

SEQ ID NO: 448067 - DNA, 140 bp, Artificial Sequence
  Synthetic
atacgccatgctgggtctcctaaagcagcatgtcaagcctaactattttgtgattaaacgactactaggttctgggattttcttgctaatcaagcctacttccagcaaaagccatatattcgtacttgggagtcggccat

SEQ ID NO: 448068 - DNA, 140 bp, Artificial Sequence
  Synthetic
atggccgactcccaagtacgaatatatggcttttgctggaagtaggcttgattagcaagaaaatcccagaacctagtagtcgtttaatcacaaaatagttaggcttgacatgctgctttaggagacccagcatggcgtat

SEQ ID NO: 448069 - DNA, 140 bp, Artificial Sequence
  Synthetic
aggccctggctgctgatatggctggaactttgttggtgacttgttcaggtcatcagactccgcagcaatggacgcctcatacatgggcaaactttctttattaacccttctggaagacaagaccttttgggacagcggtg

SEQ ID NO: 448070 - DNA, 140 bp, Artificial Sequence
  Synthetic
caccgctgtcccaaaaggtcttgtcttccagaagggttaataaagaaagtttgcccatgtatgaggcgtccattgctgcggagtctgatgacctgaacaagtcaccaacaaagttccagccatatcagcagccagggcct

SEQ ID NO: 448071 - DNA, 140 bp, Artificial Sequence
  Synthetic
aggccctggctgctgatatgaggctctcatcaacaagtataagctaaaggaggggaatccttcccgggatgagttgactctatcacgagttgctgctgccctggctggctggacttgccagaccttttgggacagcggtg

SEQ ID NO: 448072 - DNA, 140 bp, Artificial Sequence
  Synthetic
caccgctgtcccaaaaggtctggcaagtccagccagccagggcagcagcaactcgtgatagagtcaactcatcccgggaaggattcccctcctttagcttatacttgttgatgagagcctcatatcagcagccagggcct

SEQ ID NO: 448073 - DNA, 140 bp, Artificial Sequence
  Synthetic
atacgccatgctgggtctccccactgcttgacatgcaaccactcatcagctgttgttacaatggttactttaaaaacaaagaagaagagactgagccttcttctctttctgggatgtatacgtacttgggagtcggccat

SEQ ID NO: 448074 - DNA, 140 bp, Artificial Sequence
  Synthetic
atggccgactcccaagtacgtatacatcccagaaagagaagaaggctcagtctcttcttctttgtttttaaagtaaccattgtaacaacagctgatgagtggttgcatgtcaagcagtggggagacccagcatggcgtat

SEQ ID NO: 448075 - DNA, 140 bp, Artificial Sequence
  Synthetic
atacgccatgctgggtctcccttgaaggaggcctgcaatcatgccaagctagtcttaaggagtctctatggacagaatttcatggagcaaatagacaaccagattattcgagagctcagtcgtacttgggagtcggccat

SEQ ID NO: 448076 - DNA, 140 bp, Artificial Sequence
  Synthetic
atggccgactcccaagtacgactgagctctcgaataatctggttgtctatttgctccatgaaattctgtccatagagactccttaagactagcttggcatgattgcaggcctccttcaagggagacccagcatggcgtat

SEQ ID NO: 448077 - DNA, 140 bp, Artificial Sequence
  Synthetic
atacgccatgctgggtctccgggttgactctagaaagactagccacactcaaggccacgagcaacttcaacgagaattggtatgtctataaggatgtggcagacaagaactacacaagggcgtacttgggagtcggccat

SEQ ID NO: 448078 - DNA, 140 bp, Artificial Sequence
  Synthetic
atggccgactcccaagtacgcccttgtgtagttcttgtctgccacatccttatagacataccaattctcgttgaagttgctcgtggccttgagtgtggctagtctttctagagtcaacccggagacccagcatggcgtat

SEQ ID NO: 448079 - DNA, 140 bp, Artificial Sequence
  Synthetic
atacgccatgctgggtctccgtgggcaacagatgaggacctgtacaaccctctctcttgtgataaagagcttagattggcagctcagagaattcatcagccatccttatcagaaaggggccgtacttgggagtcggccat

SEQ ID NO: 448080 - DNA, 140 bp, Artificial Sequence
  Synthetic
atggccgactcccaagtacggcccctttctgataaggatggctgatgaattctctgagctgccaatctaagctctttatcacaagagagagggttgtacaggtcctcatctgttgcccacggagacccagcatggcgtat

SEQ ID NO: 448081 - DNA, 140 bp, Artificial Sequence
  Synthetic
atacgccatgctgggtctccctattacacaccattcatcaagaatacatccggtctttgtcctttaagatatttaatctgaaggttgctcctgagatgagcaagagcctagtttgtgacacgtacttgggagtcggccat

SEQ ID NO: 448082 - DNA, 140 bp, Artificial Sequence
  Synthetic
atggccgactcccaagtacgtgtcacaaactaggctcttgctcatctcaggagcaaccttcagattaaatatcttaaaggacaaagaccggatgtattcttgatgaatggtgtgtaatagggagacccagcatggcgtat

SEQ ID NO: 448083 - DNA, 140 bp, Artificial Sequence
  Synthetic
aggccctggctgctgatatgatggcctatcccctgcatacccaaggcatatgatgcaccccagctttgctggcatggtggacccttctctaccagaagactatctaagggcaatattggagaccttttgggacagcggtg

SEQ ID NO: 448084 - DNA, 140 bp, Artificial Sequence
  Synthetic
caccgctgtcccaaaaggtctccaatattgcccttagatagtcttctggtagagaagggtccaccatgccagcaaagctggggtgcatcatatgccttgggtatgcaggggataggccatcatatcagcagccagggcct

SEQ ID NO: 448085 - DNA, 140 bp, Artificial Sequence
  Synthetic
atacgccatgctgggtctcccacacccagcatgttaggccgacaattagatggattgcagcatgttgcagcctgccagaagtggaaacactagtagctcgccaggaagaggcctctaatccgtacttgggagtcggccat

SEQ ID NO: 448086 - DNA, 140 bp, Artificial Sequence
  Synthetic
atggccgactcccaagtacggattagaggcctcttcctggcgagctactagtgtttccacttctggcaggctgcaacatgctgcaatccatctaattgtcggcctaacatgctgggtgtgggagacccagcatggcgtat

SEQ ID NO: 448087 - DNA, 140 bp, Artificial Sequence
  Synthetic
aggccctggctgctgatatgcatccaatattgcccttagatagtcttctggtagagaagggtccaccatgccagcaaagctggggtgcatcatatgccttgggtatgcaggggataggccgaccttttgggacagcggtg

SEQ ID NO: 448088 - DNA, 140 bp, Artificial Sequence
  Synthetic
caccgctgtcccaaaaggtcggcctatcccctgcatacccaaggcatatgatgcaccccagctttgctggcatggtggacccttctctaccagaagactatctaagggcaatattggatgcatatcagcagccagggcct

SEQ ID NO: 448089 - DNA, 140 bp, Artificial Sequence
  Synthetic
atacgccatgctgggtctccgtctgagctatttctagagtataagaaggcagtgctgaagtggaatgaccctggcctgggtttcttcctgcttgacaatccttatgcgtgcgggttgggacgtacttgggagtcggccat

SEQ ID NO: 448090 - DNA, 140 bp, Artificial Sequence
  Synthetic
atggccgactcccaagtacgtcccaacccgcacgcataaggattgtcaagcaggaagaaacccaggccagggtcattccacttcagcactgccttcttatactctagaaatagctcagacggagacccagcatggcgtat

SEQ ID NO: 448091 - DNA, 140 bp, Artificial Sequence
  Synthetic
atacgccatgctgggtctccggttttaggtttaatctctttaaagctatcaccagaactgatttgcagaagctatatgctttcttcatgaagaaggtcaagggctcagctgcaagggactcgtacttgggagtcggccat

SEQ ID NO: 448092 - DNA, 140 bp, Artificial Sequence
  Synthetic
atggccgactcccaagtacgagtcccttgcagctgagcccttgaccttcttcatgaagaaagcatatagcttctgcaaatcagttctggtgatagctttaaagagattaaacctaaaaccggagacccagcatggcgtat

SEQ ID NO: 448093 - DNA, 140 bp, Artificial Sequence
  Synthetic
aggccctggctgctgatatggctatatgctttcttcatgaagaaggtcaagggctcagctgcaagggactgggcagatgaggatgtcactatcccagaaacatgtagcgtgagcccgggtgaccttttgggacagcggtg

SEQ ID NO: 448094 - DNA, 140 bp, Artificial Sequence
  Synthetic
caccgctgtcccaaaaggtcacccgggctcacgctacatgtttctgggatagtgacatcctcatctgcccagtcccttgcagctgagcccttgaccttcttcatgaagaaagcatatagccatatcagcagccagggcct

SEQ ID NO: 448095 - DNA, 140 bp, Artificial Sequence
  Synthetic
aggccctggctgctgatatgtcagattgctactctagcaatgaggagctgcaagattaccaatgatttagaagactcctttgttggcttacacaggatgatagtgaccgaggctatcctcgaccttttgggacagcggtg

SEQ ID NO: 448096 - DNA, 140 bp, Artificial Sequence
  Synthetic
caccgctgtcccaaaaggtcgaggatagcctcggtcactatcatcctgtgtaagccaacaaaggagtcttctaaatcattggtaatcttgcagctcctcattgctagagtagcaatctgacatatcagcagccagggcct

SEQ ID NO: 448097 - DNA, 140 bp, Artificial Sequence
  Synthetic
atacgccatgctgggtctccgagatagatatcatcccaagagtcaatatcagggatgcaacccaaaccagggtcactatctttaatgagcagaagaccctccgtacatctccagagaagtcgtacttgggagtcggccat

SEQ ID NO: 448098 - DNA, 140 bp, Artificial Sequence
  Synthetic
atggccgactcccaagtacgacttctctggagatgtacggagggtcttctgctcattaaagatagtgaccctggtttgggttgcatccctgatattgactcttgggatgatatctatctcggagacccagcatggcgtat

SEQ ID NO: 448099 - DNA, 140 bp, Artificial Sequence
  Synthetic
aggccctggctgctgatatgaccttcctggctgaatgggagaagctaaagaaaattgtgaagtggttggaagatactccagaagcaactctagctcacactccactgaataaccatattcgaccttttgggacagcggtg

SEQ ID NO: 448100 - DNA, 140 bp, Artificial Sequence
  Synthetic
caccgctgtcccaaaaggtcgaatatggttattcagtggagtgtgagctagagttgcttctggagtatcttccaaccacttcacaattttctttagcttctcccattcagccaggaaggtcatatcagcagccagggcct

SEQ ID NO: 448101 - DNA, 140 bp, Artificial Sequence
  Synthetic
aggccctggctgctgatatgaatctacagagttctaagctcagtgtcaaacgttgagataaaggaatcagatggtaagacaaaaaccaatttgattggaatccttcagagatttctagatgaccttttgggacagcggtg

SEQ ID NO: 448102 - DNA, 140 bp, Artificial Sequence
  Synthetic
caccgctgtcccaaaaggtcatctagaaatctctgaaggattccaatcaaattggtttttgtcttaccatctgattcctttatctcaacgtttgacactgagcttagaactctgtagattcatatcagcagccagggcct

SEQ ID NO: 448103 - DNA, 140 bp, Artificial Sequence
  Synthetic
atacgccatgctgggtctccaaccaactgtcagagcagcccttgggacctgagtgttccaataaggcaatgggcagaagacatgggggtcacaaacaaccaggattattcttctaaatctcgtacttgggagtcggccat

SEQ ID NO: 448104 - DNA, 140 bp, Artificial Sequence
  Synthetic
atggccgactcccaagtacgagatttagaagaataatcctggttgtttgtgacccccatgtcttctgcccattgccttattggaacactcaggtcccaagggctgctctgacagttggttggagacccagcatggcgtat

SEQ ID NO: 448105 - DNA, 140 bp, Artificial Sequence
  Synthetic
aggccctggctgctgatatgtcatcagactaagaaaagaggaggtggagatgaaagtacggggctctactctcaacttgtacactaagcaccattctcaccaagacctacacattttatcgaccttttgggacagcggtg

SEQ ID NO: 448106 - DNA, 140 bp, Artificial Sequence
  Synthetic
caccgctgtcccaaaaggtcgataaaatgtgtaggtcttggtgagaatggtgcttagtgtacaagttgagagtagagccccgtactttcatctccacctcctcttttcttagtctgatgacatatcagcagccagggcct

SEQ ID NO: 448107 - DNA, 140 bp, Artificial Sequence
  Synthetic
aggccctggctgctgatatgtgcgttacaggatcgcagagcccttctaccgagattacactcaagtatccagggatatcccagtcctctgggggggacataggggttcacatggcacatggaccttttgggacagcggtg

SEQ ID NO: 448108 - DNA, 140 bp, Artificial Sequence
  Synthetic
caccgctgtcccaaaaggtccatgtgccatgtgaacccctatgtcccccccagaggactgggatatccctggatacttgagtgtaatctcggtagaagggctctgcgatcctgtaacgcacatatcagcagccagggcct

SEQ ID NO: 448109 - DNA, 140 bp, Artificial Sequence
  Synthetic
atacgccatgctgggtctcctgactatgatgcgttaatggatctaatgatagaagatgccaagaacaatgctttcagtcatgttgtcaattgcatagaattagatgttagtggtccttaccgtacttgggagtcggccat

SEQ ID NO: 448110 - DNA, 140 bp, Artificial Sequence
  Synthetic
atggccgactcccaagtacggtaaggaccactaacatctaattctatgcaattgacaacatgactgaaagcattgttcttggcatcttctatcattagatccattaacgcatcatagtcaggagacccagcatggcgtat

SEQ ID NO: 448111 - DNA, 140 bp, Artificial Sequence
  Synthetic
atacgccatgctgggtctccgagatggagtcttttgatacatctgatgtcaacctctttgggccagcccattacaaggacatcagttcattatccatgattgctcaccccttaatggacacgtacttgggagtcggccat

SEQ ID NO: 448112 - DNA, 140 bp, Artificial Sequence
  Synthetic
atggccgactcccaagtacgtgtccattaaggggtgagcaatcatggataatgaactgatgtccttgtaatgggctggcccaaagaggttgacatcagatgtatcaaaagactccatctcggagacccagcatggcgtat

SEQ ID NO: 448113 - DNA, 140 bp, Artificial Sequence
  Synthetic
atacgccatgctgggtctcctagagttgtatgaagagacagatgtggcggatgacatgctaggctaagaccagtaagcaaagtctggcttagatttagggatactatgctagcattggaacgtacttgggagtcggccat

SEQ ID NO: 448114 - DNA, 140 bp, Artificial Sequence
  Synthetic
atggccgactcccaagtacgttccaatgctagcatagtatccctaaatctaagccagactttgcttactggtcttagcctagcatgtcatccgccacatctgtctcttcatacaactctaggagacccagcatggcgtat

SEQ ID NO: 448115 - DNA, 140 bp, Artificial Sequence
  Synthetic
aggccctggctgctgatatgatgaatcatgccttagggcaccaaatcttatttcatacaagcccatgatagatcagttggagtgcacaacaaatctgattgatccctttgttgtctttgagaccttttgggacagcggtg

SEQ ID NO: 448116 - DNA, 140 bp, Artificial Sequence
  Synthetic
caccgctgtcccaaaaggtctcaaagacaacaaagggatcaatcagatttgttgtgcactccaactgatctatcatgggcttgtatgaaataagatttggtgccctaaggcatgattcatcatatcagcagccagggcct

SEQ ID NO: 448117 - DNA, 140 bp, Artificial Sequence
  Synthetic
atacgccatgctgggtctccactggttttctggactcatgagttggtttggagggcctcttaagactatactcctcatttgcctgtatgtagcattatcaattgggctctttttccttctcgtacttgggagtcggccat

SEQ ID NO: 448118 - DNA, 140 bp, Artificial Sequence
  Synthetic
atggccgactcccaagtacgagaaggaaaaagagcccaattgataatgctacatacaggcaaatgaggagtatagtcttaagaggccctccaaaccaactcatgagtccagaaaaccagtggagacccagcatggcgtat

SEQ ID NO: 448119 - DNA, 140 bp, Artificial Sequence
  Synthetic
aggccctggctgctgatatgtagttgtaatttggggtggtggggtgaggcagcagtagtctcaagtacatgtggatattctagttaatgtgaatgtcttttgccagattagctgggaattgaccttttgggacagcggtg

SEQ ID NO: 448120 - DNA, 140 bp, Artificial Sequence
  Synthetic
caccgctgtcccaaaaggtcaattcccagctaatctggcaaaagacattcacattaactagaatatccacatgtacttgagactactgctgcctcaccccaccaccccaaattacaactacatatcagcagccagggcct

SEQ ID NO: 448121 - DNA, 140 bp, Artificial Sequence
  Synthetic
atacgccatgctgggtctcctagtctcaagtacatgtggatattctagttaatgtgaatgtcttttgccagattagctgggaattaaactaactctttgaagttgcaccggtctttgtgtcgtacttgggagtcggccat

SEQ ID NO: 448122 - DNA, 140 bp, Artificial Sequence
  Synthetic
atggccgactcccaagtacgacacaaagaccggtgcaacttcaaagagttagtttaattcccagctaatctggcaaaagacattcacattaactagaatatccacatgtacttgagactaggagacccagcatggcgtat

SEQ ID NO: 448123 - DNA, 140 bp, Artificial Sequence
  Synthetic
aggccctggctgctgatatgagcatccaatattgcccttagatagtcttctggtagagaagggtccaccatgccagcaaagctggggtgcatcatatgccttgggtatgcaggggatagggaccttttgggacagcggtg

SEQ ID NO: 448124 - DNA, 140 bp, Artificial Sequence
  Synthetic
caccgctgtcccaaaaggtccctatcccctgcatacccaaggcatatgatgcaccccagctttgctggcatggtggacccttctctaccagaagactatctaagggcaatattggatgctcatatcagcagccagggcct

SEQ ID NO: 448125 - DNA, 140 bp, Artificial Sequence
  Synthetic
aggccctggctgctgatatgtgccagcaaagctggggtgcatcatatgccttgggtatgcaggggataggccatccatggtagtcccagtgacaggaagccactcactcaagacgaccaagaccttttgggacagcggtg

SEQ ID NO: 448126 - DNA, 140 bp, Artificial Sequence
  Synthetic
caccgctgtcccaaaaggtcttggtcgtcttgagtgagtggcttcctgtcactgggactaccatggatggcctatcccctgcatacccaaggcatatgatgcaccccagctttgctggcacatatcagcagccagggcct

SEQ ID NO: 448127 - DNA, 140 bp, Artificial Sequence
  Synthetic
aggccctggctgctgatatggcctccacagttgctttgccttcttttgacattttcatcatcatcctccggggcttgttgccacgagttagagccagaacaatcattttcttggcatcctgaccttttgggacagcggtg

SEQ ID NO: 448128 - DNA, 140 bp, Artificial Sequence
  Synthetic
caccgctgtcccaaaaggtcaggatgccaagaaaatgattgttctggctctaactcgtggcaacaagccccggaggatgatgatgaaaatgtcaaaagaaggcaaagcaactgtggaggccatatcagcagccagggcct

SEQ ID NO: 448129 - DNA, 140 bp, Artificial Sequence
  Synthetic
atacgccatgctgggtctcccatgatgtggatcacatatctgaatttctctctgcatgctctagtgacttgtgggcaacagatgaggacctatacaaccctctctcttgtgataaagagccgtacttgggagtcggccat

SEQ ID NO: 448130 - DNA, 140 bp, Artificial Sequence
  Synthetic
atggccgactcccaagtacggctctttatcacaagagagagggttgtataggtcctcatctgttgcccacaagtcactagagcatgcagagagaaattcagatatgtgatccacatcatgggagacccagcatggcgtat

SEQ ID NO: 448131 - DNA, 140 bp, Artificial Sequence
  Synthetic
atacgccatgctgggtctcccgggtgggggtagttcggtgtgagagacaaagagacgctaagcaaatagggagaggaaccatggcagggattgcaatgacagtctttccagccttagtagcgtacttgggagtcggccat

SEQ ID NO: 448132 - DNA, 140 bp, Artificial Sequence
  Synthetic
atggccgactcccaagtacgctactaaggctggaaagactgtcattgcaatccctgccatggttcctctccctatttgcttagcgtctctttgtctctcacaccgaactacccccacccgggagacccagcatggcgtat

SEQ ID NO: 448133 - DNA, 140 bp, Artificial Sequence
  Synthetic
atacgccatgctgggtctccagcaacaactgaagagttacagactattgcaagatatataatcatggagggctttgtctcgcccccagaaatcccaaaacctcacaagatgacctctaagcgtacttgggagtcggccat

SEQ ID NO: 448134 - DNA, 140 bp, Artificial Sequence
  Synthetic
atggccgactcccaagtacgcttagaggtcatcttgtgaggttttgggatttctgggggcgagacaaagccctccatgattatatatcttgcaatagtctgtaactcttcagttgttgctggagacccagcatggcgtat

SEQ ID NO: 448135 - DNA, 140 bp, Artificial Sequence
  Synthetic
atacgccatgctgggtctcccatcgagagcttgatattagagatgactttgtgatggatctcttcaaagcttatcatggtgaggcagaagttccatgggcttttaagggtaaaacatatccgtacttgggagtcggccat

SEQ ID NO: 448136 - DNA, 140 bp, Artificial Sequence
  Synthetic
atggccgactcccaagtacggatatgttttacccttaaaagcccatggaacttctgcctcaccatgataagctttgaagagatccatcacaaagtcatctctaatatcaagctctcgatgggagacccagcatggcgtat

SEQ ID NO: 448137 - DNA, 140 bp, Artificial Sequence
  Synthetic
atacgccatgctgggtctccccagtgtcacactgctttcagtgcctttgttgttgtgttcgtattcagctctgttgtgataatttgtttggccattctttataaggtgctcaagtgcctacgtacttgggagtcggccat

SEQ ID NO: 448138 - DNA, 140 bp, Artificial Sequence
  Synthetic
atggccgactcccaagtacgtaggcacttgagcaccttataaagaatggccaaacaaattatcacaacagagctgaatacgaacacaacaacaaaggcactgaaagcagtgtgacactggggagacccagcatggcgtat

SEQ ID NO: 448139 - DNA, 140 bp, Artificial Sequence
  Synthetic
atacgccatgctgggtctccagcactcaaaaagtgtgatggccaactcagcaccgcacatgaggttgtgccctttgcagtgttcaagaactcaaagaaggtttacctcgataagcttgaccgtacttgggagtcggccat

SEQ ID NO: 448140 - DNA, 140 bp, Artificial Sequence
  Synthetic
atggccgactcccaagtacggtcaagcttatcgaggtaaaccttctttgagttcttgaacactgcaaagggcacaacctcatgtgcggtgctgagttggccatcacactttttgagtgctggagacccagcatggcgtat

SEQ ID NO: 448141 - DNA, 140 bp, Artificial Sequence
  Synthetic
aggccctggctgctgatatgagctattggactgggtcctttagccccaaatgtctgagctcaaggagatgccatcttgtcggggaatgtcatgtgaataggtgtctgtcttggagggacagaccttttgggacagcggtg

SEQ ID NO: 448142 - DNA, 140 bp, Artificial Sequence
  Synthetic
caccgctgtcccaaaaggtctgtccctccaagacagacacctattcacatgacattccccgacaagatggcatctccttgagctcagacatttggggctaaaggacccagtccaatagctcatatcagcagccagggcct

SEQ ID NO: 448143 - DNA, 140 bp, Artificial Sequence
  Synthetic
atacgccatgctgggtctccaagaagcccttagagtttttaactgtattgattgggtgcataaactgactctagagattacagactttgatggctctgtttcaacagtagacttgggagccgtacttgggagtcggccat

SEQ ID NO: 448144 - DNA, 140 bp, Artificial Sequence
  Synthetic
atggccgactcccaagtacggctcccaagtctactgttgaaacagagccatcaaagtctgtaatctctagagtcagtttatgcacccaatcaatacagttaaaaactctaagggcttcttggagacccagcatggcgtat

SEQ ID NO: 448145 - DNA, 140 bp, Artificial Sequence
  Synthetic
atacgccatgctgggtctcctatatatcttggaagaacaggtctctctaaaatgtggcttgctgccactaagaaagcttcatagatcagtacgtgtagaagcaatatatagaaataagtacgtacttgggagtcggccat

SEQ ID NO: 448146 - DNA, 140 bp, Artificial Sequence
  Synthetic
atggccgactcccaagtacgtacttatttctatatattgcttctacacgtactgatctatgaagctttcttagtggcagcaagccacattttagagagacctgttcttccaagatatataggagacccagcatggcgtat

SEQ ID NO: 448147 - DNA, 140 bp, Artificial Sequence
  Synthetic
aggccctggctgctgatatgagaaagcttcatagatcagtacgtgtagaagcaatatatagaaataagtaaatataagcaaatctaattatgtaaacattgtacagataggtcaaactatgaccttttgggacagcggtg

SEQ ID NO: 448148 - DNA, 140 bp, Artificial Sequence
  Synthetic
caccgctgtcccaaaaggtcatagtttgacctatctgtacaatgtttacataattagatttgcttatatttacttatttctatatattgcttctacacgtactgatctatgaagctttctcatatcagcagccagggcct

SEQ ID NO: 448149 - DNA, 140 bp, Artificial Sequence
  Synthetic
aggccctggctgctgatatgactatagacttcaatctggatgacatacaaggagcatctgaaataggctcaactttgctaccctccatgtcgatagatgtggaagatatggctaattttggaccttttgggacagcggtg

SEQ ID NO: 448150 - DNA, 140 bp, Artificial Sequence
  Synthetic
caccgctgtcccaaaaggtccaaaattagccatatcttccacatctatcgacatggagggtagcaaagttgagcctatttcagatgctccttgtatgtcatccagattgaagtctatagtcatatcagcagccagggcct

SEQ ID NO: 448151 - DNA, 140 bp, Artificial Sequence
  Synthetic
aggccctggctgctgatatgatctaaaagaagccatatcctggcctcttggagaaccctcactggctttctttgacctaagctctactagagtgcacaggaatgatgacattagaagggagaccttttgggacagcggtg

SEQ ID NO: 448152 - DNA, 140 bp, Artificial Sequence
  Synthetic
caccgctgtcccaaaaggtctcccttctaatgtcatcattcctgtgcactctagtagagcttaggtcaaagaaagccagtgagggttctccaagaggccaggatatggcttcttttagatcatatcagcagccagggcct

SEQ ID NO: 448153 - DNA, 140 bp, Artificial Sequence
  Synthetic
aggccctggctgctgatatgcccccaccccccaatcccgaccgtaaccccaacccccattttccccaacccccctgggcagccacttaggctgctgtcttgtaggcctgagcagctgccagaccttttgggacagcggtg

SEQ ID NO: 448154 - DNA, 140 bp, Artificial Sequence
  Synthetic
caccgctgtcccaaaaggtctggcagctgctcaggcctacaagacagcagcctaagtggctgcccaggggggttggggaaaatgggggttggggttacggtcgggattggggggtgggggcatatcagcagccagggcct

SEQ ID NO: 448155 - DNA, 140 bp, Artificial Sequence
  Synthetic
aggccctggctgctgatatgtgacagcagctgacggcttcccattagaatccacaagcccaaaagctttcaagaattctctcctcttctcatggcttataaagttgctattcactgctgcgaccttttgggacagcggtg

SEQ ID NO: 448156 - DNA, 140 bp, Artificial Sequence
  Synthetic
caccgctgtcccaaaaggtcgcagcagtgaatagcaactttataagccatgagaagaggagagaattcttgaaagcttttgggcttgtggattctaatgggaagccgtcagctgctgtcacatatcagcagccagggcct

SEQ ID NO: 448157 - DNA, 140 bp, Artificial Sequence
  Synthetic
aggccctggctgctgatatggcatctaatattgcccttagatagtcttctggtagagaagggtccaccatgccagcaaagctgggatgcatcatatgccttgggtatgcaggggataggcgaccttttgggacagcggtg

SEQ ID NO: 448158 - DNA, 140 bp, Artificial Sequence
  Synthetic
caccgctgtcccaaaaggtcgcctatcccctgcatacccaaggcatatgatgcatcccagctttgctggcatggtggacccttctctaccagaagactatctaagggcaatattagatgccatatcagcagccagggcct

SEQ ID NO: 448159 - DNA, 140 bp, Artificial Sequence
  Synthetic
aggccctggctgctgatatggcctggcatgtccagccagccagggcagcagcaactcgtgatagagtcaactcatcccgggaaggattcccctcctttagcttatacttgttgatgagaggaccttttgggacagcggtg

SEQ ID NO: 448160 - DNA, 140 bp, Artificial Sequence
  Synthetic
caccgctgtcccaaaaggtcctctcatcaacaagtataagctaaaggaggggaatccttcccgggatgagttgactctatcacgagttgctgctgccctggctggctggacatgccaggccatatcagcagccagggcct

SEQ ID NO: 448161 - DNA, 140 bp, Artificial Sequence
  Synthetic
atacgccatgctgggtctcctgcgtcacaggatcacagagcccttctaccgagattacactcaagtatccagggatatcccagtcctctgggggggacataggggttcacatggcacacgcgtacttgggagtcggccat

SEQ ID NO: 448162 - DNA, 140 bp, Artificial Sequence
  Synthetic
atggccgactcccaagtacgcgtgtgccatgtgaacccctatgtcccccccagaggactgggatatccctggatacttgagtgtaatctcggtagaagggctctgtgatcctgtgacgcaggagacccagcatggcgtat

SEQ ID NO: 448163 - DNA, 140 bp, Artificial Sequence
  Synthetic
aggccctggctgctgatatggcttgttgccacgagttagagccagaacaatcattttcttggcatccttctcccagtcagccccaccatactgctttaagagttcgataaccctacgggcgaccttttgggacagcggtg

SEQ ID NO: 448164 - DNA, 140 bp, Artificial Sequence
  Synthetic
caccgctgtcccaaaaggtcgcccgtagggttatcgaactcttaaagcagtatggtggggctgactgggagaaggatgccaagaaaatgattgttctggctctaactcgtggcaacaagccatatcagcagccagggcct

SEQ ID NO: 448165 - DNA, 140 bp, Artificial Sequence
  Synthetic
atacgccatgctgggtctccagagacctgctttggtgactccaccaacccagagatgattgaaggagcttgggattcactcagagaggaggagatgccagaggagctctcctgttctatacgtacttgggagtcggccat

SEQ ID NO: 448166 - DNA, 140 bp, Artificial Sequence
  Synthetic
atggccgactcccaagtacgtatagaacaggagagctcctctggcatctcctcctctctgagtgaatcccaagctccttcaatcatctctgggttggtggagtcaccaaagcaggtctctggagacccagcatggcgtat

SEQ ID NO: 448167 - DNA, 140 bp, Artificial Sequence
  Synthetic
atacgccatgctgggtctcctatatatctcggaagaacaggtctctctaaaatgtggcttgctgccactaagaaagcctcatagatcagtacgtgtaaaagcaatatatagaagtaagtacgtacttgggagtcggccat

SEQ ID NO: 448168 - DNA, 140 bp, Artificial Sequence
  Synthetic
atggccgactcccaagtacgtacttacttctatatattgcttttacacgtactgatctatgaggctttcttagtggcagcaagccacattttagagagacctgttcttccgagatatataggagacccagcatggcgtat

SEQ ID NO: 448169 - DNA, 140 bp, Artificial Sequence
  Synthetic
atacgccatgctgggtctccttggaggattccaagtacagcttgctacaaaagatggccgcatattctggctttcatggtttcaatgacatggagccagaagatatattattcctattcccgtacttgggagtcggccat

SEQ ID NO: 448170 - DNA, 140 bp, Artificial Sequence
  Synthetic
atggccgactcccaagtacgggaataggaataatatatcttctggctccatgtcattgaaaccatgaaagccagaatatgcggccatcttttgtagcaagctgtacttggaatcctccaaggagacccagcatggcgtat

SEQ ID NO: 448171 - DNA, 140 bp, Artificial Sequence
  Synthetic
aggccctggctgctgatatgctttcatggtttcaatgacatggagccagaagatatattattcctattcccgaacattgaggaattagaatcactggattctatagtttacaacaagggtgaccttttgggacagcggtg

SEQ ID NO: 448172 - DNA, 140 bp, Artificial Sequence
  Synthetic
caccgctgtcccaaaaggtcacccttgttgtaaactatagaatccagtgattctaattcctcaatgttcgggaataggaataatatatcttctggctccatgtcattgaaaccatgaaagcatatcagcagccagggcct

SEQ ID NO: 448173 - DNA, 140 bp, Artificial Sequence
  Synthetic
aggccctggctgctgatatgatgcagaactatccagagaatagcaggggagccctttattcttaagaagaaggatgggtccatatcctggggtggcatgtttaatcctttctcagggcgcgaccttttgggacagcggtg

SEQ ID NO: 448174 - DNA, 140 bp, Artificial Sequence
  Synthetic
caccgctgtcccaaaaggtcgcgccctgagaaaggattaaacatgccaccccaggatatggacccatccttcttcttaagaataaagggctcccctgctattctctggatagttctgcatcatatcagcagccagggcct

SEQ ID NO: 448175 - DNA, 140 bp, Artificial Sequence
  Synthetic
atacgccatgctgggtctcccaagccgtttggatgcccagtttatatcattaagggtgacatgtcagatgttatcagattgagaaaagaggaggtggagatgaaagtacggggttctactcgtacttgggagtcggccat

SEQ ID NO: 448176 - DNA, 140 bp, Artificial Sequence
  Synthetic
atggccgactcccaagtacgagtagaaccccgtactttcatctccacctcctcttttctcaatctgataacatctgacatgtcacccttaatgatataaactgggcatccaaacggcttgggagacccagcatggcgtat

SEQ ID NO: 448177 - DNA, 140 bp, Artificial Sequence
  Synthetic
aggccctggctgctgatatgctgttctgtatactgcagggtccatatagtgagagctataagctacagctaatctacagagtcctaagctcagtgtcaaacgttgagataaaggaatcaggaccttttgggacagcggtg

SEQ ID NO: 448178 - DNA, 140 bp, Artificial Sequence
  Synthetic
caccgctgtcccaaaaggtcctgattcctttatctcaacgtttgacactgagcttaggactctgtagattagctgtagcttatagctctcactatatggaccctgcagtatacagaacagcatatcagcagccagggcct

SEQ ID NO: 448179 - DNA, 140 bp, Artificial Sequence
  Synthetic
atacgccatgctgggtctccatggtaagacaaaaaccaatttgattgggattcttcagaggtttctagatggtgatcacgttgtccccataattgaagagatgggagccgggacagtgggcgtacttgggagtcggccat

SEQ ID NO: 448180 - DNA, 140 bp, Artificial Sequence
  Synthetic
atggccgactcccaagtacgcccactgtcccggctcccatctcttcaattatggggacaacgtgatcaccatctagaaacctctgaagaatcccaatcaaattggtttttgtcttaccatggagacccagcatggcgtat

SEQ ID NO: 448181 - DNA, 140 bp, Artificial Sequence
  Synthetic
aggccctggctgctgatatgccatcttgtcggggaatgtcatgtgaataggtgtctgtcttggagggacaatgaaacttcagcagagttttcatttgttggggaaagcacgaccatgcgagaccttttgggacagcggtg

SEQ ID NO: 448182 - DNA, 140 bp, Artificial Sequence
  Synthetic
caccgctgtcccaaaaggtctcgcatggtcgtgctttccccaacaaatgaaaactctgctgaagtttcattgtccctccaagacagacacctattcacatgacattccccgacaagatggcatatcagcagccagggcct

SEQ ID NO: 448183 - DNA, 140 bp, Artificial Sequence
  Synthetic
atacgccatgctgggtctcccaagccatttggatgcccagtttatatcattaagggtgacatgtcagatgtcatcagattgagaaaagaggaggtggagatgaaagtacggggctctactcgtacttgggagtcggccat

SEQ ID NO: 448184 - DNA, 140 bp, Artificial Sequence
  Synthetic
atggccgactcccaagtacgagtagagccccgtactttcatctccacctcctcttttctcaatctgatgacatctgacatgtcacccttaatgatataaactgggcatccaaatggcttgggagacccagcatggcgtat

SEQ ID NO: 448185 - DNA, 140 bp, Artificial Sequence
  Synthetic
atacgccatgctgggtctccaagaggcccttagagtttttaactgtatcgactgggtgcataaactaacactagagatcacagactttgatggctctgtttcaacaatagacctaggagccgtacttgggagtcggccat

SEQ ID NO: 448186 - DNA, 140 bp, Artificial Sequence
  Synthetic
atggccgactcccaagtacggctcctaggtctattgttgaaacagagccatcaaagtctgtgatctctagtgttagtttatgcacccagtcgatacagttaaaaactctaagggcctcttggagacccagcatggcgtat

SEQ ID NO: 448187 - DNA, 140 bp, Artificial Sequence
  Synthetic
aggccctggctgctgatatgaaagggtatgcaattgttgatgagccattctcagaaattcctcggcaagggttcctgggggagatcaggtgcaattcagagtcctcagtcctgagtgctcgaccttttgggacagcggtg

SEQ ID NO: 448188 - DNA, 140 bp, Artificial Sequence
  Synthetic
caccgctgtcccaaaaggtcgagcactcaggactgaggactctgaattgcacctgatctcccccaggaacccttgccgaggaatttctgagaatggctcatcaacaattgcataccctttcatatcagcagccagggcct

SEQ ID NO: 448189 - DNA, 140 bp, Artificial Sequence
  Synthetic
atacgccatgctgggtctccatgaatcatgccttagggcaccaaaccttatctcatacaagcccatgatagaccaattggagtgcacaacgaatctgattgatccatttgttgtctttgacgtacttgggagtcggccat

SEQ ID NO: 448190 - DNA, 140 bp, Artificial Sequence
  Synthetic
atggccgactcccaagtacgtcaaagacaacaaatggatcaatcagattcgttgtgcactccaattggtctatcatgggcttgtatgagataaggtttggtgccctaaggcatgattcatggagacccagcatggcgtat

SEQ ID NO: 448191 - DNA, 140 bp, Artificial Sequence
  Synthetic
atacgccatgctgggtctccatcaagtgaacagggagataggatggatggaaggaggtcagttggttctagggaaccctgctcctattcctcgtcatgccccaattccacgttatagcaccgtacttgggagtcggccat

SEQ ID NO: 448192 - DNA, 140 bp, Artificial Sequence
  Synthetic
atggccgactcccaagtacggtgctataacgtggaattggggcatgacgaggaataggagcagggttccctagaaccaactgacctccttccatccatcctatctccctgttcacttgatggagacccagcatggcgtat

SEQ ID NO: 448193 - DNA, 140 bp, Artificial Sequence
  Synthetic
atacgccatgctgggtctccaaggggaccctgatagctattgatccatttgatgataggcgggaagcagggggggaatcaacagttgtgaatccaaaatctggatcttggaatttctttgcgtacttgggagtcggccat

SEQ ID NO: 448194 - DNA, 140 bp, Artificial Sequence
  Synthetic
atggccgactcccaagtacgcaaagaaattccaagatccagattttggattcacaactgttgattccccccctgcttcccgcctatcatcaaatggatcaatagctatcagggtccccttggagacccagcatggcgtat

SEQ ID NO: 448195 - DNA, 140 bp, Artificial Sequence
  Synthetic
atacgccatgctgggtctccagagggattgacctgtgcctgttgccaggctttgatctcatgtatgaggttgctcatgtacagtgtgttaggctcctgcaagcagcaaaagaggacatttcgtacttgggagtcggccat

SEQ ID NO: 448196 - DNA, 140 bp, Artificial Sequence
  Synthetic
atggccgactcccaagtacgaaatgtcctcttttgctgcttgcaggagcctaacacactgtacatgagcaacctcatacatgagatcaaagcctggcaacaggcacaggtcaatccctctggagacccagcatggcgtat

SEQ ID NO: 448197 - DNA, 140 bp, Artificial Sequence
  Synthetic
aggccctggctgctgatatgcatatatcttggaagaacaggcctctctaaaatgtggcttgctgctactaagaaggcctcatagatcagtacgtgtagaagcaatatgtaaaaataagtagaccttttgggacagcggtg

SEQ ID NO: 448198 - DNA, 140 bp, Artificial Sequence
  Synthetic
caccgctgtcccaaaaggtctacttatttttacatattgcttctacacgtactgatctatgaggccttcttagtagcagcaagccacattttagagaggcctgttcttccaagatatatgcatatcagcagccagggcct

SEQ ID NO: 448199 - DNA, 140 bp, Artificial Sequence
  Synthetic
atacgccatgctgggtctccgacataagcaaacctaattatgtaaatattgtacagataggtcaaattattgggatatctaagcttagaagcttatgcaataatactttagatgcaagctcgtacttgggagtcggccat

SEQ ID NO: 448200 - DNA, 140 bp, Artificial Sequence
  Synthetic
atggccgactcccaagtacgagcttgcatctaaagtattattgcataagcttctaagcttagatatcccaataatttgacctatctgtacaatatttacataattaggtttgcttatgtcggagacccagcatggcgtat

SEQ ID NO: 448201 - DNA, 140 bp, Artificial Sequence
  Synthetic
atacgccatgctgggtctccctccctggctgtcctatcacgatgttgatggcaaagatctatgccctcttcaaggactagatgtgagaggggaccatcccatgtgcaacctgtggagagacgtacttgggagtcggccat

SEQ ID NO: 448202 - DNA, 140 bp, Artificial Sequence
  Synthetic
atggccgactcccaagtacgtctctccacaggttgcacatgggatggtcccctctcacatctagtccttgaagagggcatagatctttgccatcaacatcgtgataggacagccagggagggagacccagcatggcgtat

SEQ ID NO: 448203 - DNA, 140 bp, Artificial Sequence
  Synthetic
atacgccatgctgggtctcccagggattagatgtgagaggggaccatcccatgtgcaacctgtggagggaagtggtcacctctgcaaatctagaggagattgagaggatgcacgatgatgcgtacttgggagtcggccat

SEQ ID NO: 448204 - DNA, 140 bp, Artificial Sequence
  Synthetic
atggccgactcccaagtacgcatcatcgtgcatcctctcaatctcctctagatttgcagaggtgaccacttccctccacaggttgcacatgggatggtcccctctcacatctaatccctgggagacccagcatggcgtat

SEQ ID NO: 448205 - DNA, 140 bp, Artificial Sequence
  Synthetic
aggccctggctgctgatatggagagaaacagataccatagagtccatctaaatatgggctcagatgatagtgtctacatagctgctttaggagttaatggaaagaagcataaagcagacagaccttttgggacagcggtg

SEQ ID NO: 448206 - DNA, 140 bp, Artificial Sequence
  Synthetic
caccgctgtcccaaaaggtctgtctgctttatgcttctttccattaactcctaaagcagctatgtagacactatcatctgagcccatatttagatggactctatggtatctgtttctctccatatcagcagccagggcct

SEQ ID NO: 448207 - DNA, 140 bp, Artificial Sequence
  Synthetic
aggccctggctgctgatatggtgggcaacagatgaggacctgtacaaccctctctcttgtgataaagagcttagattggcagcccagaggattcatcagccatccttgtcagaaaggggcgaccttttgggacagcggtg

SEQ ID NO: 448208 - DNA, 140 bp, Artificial Sequence
  Synthetic
caccgctgtcccaaaaggtcgcccctttctgacaaggatggctgatgaatcctctgggctgccaatctaagctctttatcacaagagagagggttgtacaggtcctcatctgttgcccaccatatcagcagccagggcct

SEQ ID NO: 448209 - DNA, 140 bp, Artificial Sequence
  Synthetic
aggccctggctgctgatatgttcaatgagatcataacagagcactacaaatttatgggaagtaggataggttcatggtgccaaatggtcagtttgataggagctgagctatcagcttctggaccttttgggacagcggtg

SEQ ID NO: 448210 - DNA, 140 bp, Artificial Sequence
  Synthetic
caccgctgtcccaaaaggtccagaagctgatagctcagctcctatcaaactgaccatttggcaccatgaacctatcctacttcccataaatttgtagtgctctgttatgatctcattgaacatatcagcagccagggcct

SEQ ID NO: 448211 - DNA, 140 bp, Artificial Sequence
  Synthetic
aggccctggctgctgatatgcaagactggttttgttagagtgccaatcaagcattatgactgtacaatgctaactctagcactcccaacatttgatgtctctaagatggtagatagaattgaccttttgggacagcggtg

SEQ ID NO: 448212 - DNA, 140 bp, Artificial Sequence
  Synthetic
caccgctgtcccaaaaggtcaattctatctaccatcttagagacatcaaatgttgggagtgctagagttagcattgtacagtcataatgcttgattggcactctaacaaaaccagtcttgcatatcagcagccagggcct

SEQ ID NO: 448213 - DNA, 140 bp, Artificial Sequence
  Synthetic
atacgccatgctgggtctcctcttaaagataaaaactgtctcaagtgagctatcgtgcagggagggccagagctattggactgggtcctttagccccaagtgtctgagctcaaggagatgcgtacttgggagtcggccat

SEQ ID NO: 448214 - DNA, 140 bp, Artificial Sequence
  Synthetic
atggccgactcccaagtacgcatctccttgagctcagacacttggggctaaaggacccagtccaatagctctggccctccctgcacgatagctcacttgagacagtttttatctttaagaggagacccagcatggcgtat

SEQ ID NO: 448215 - DNA, 140 bp, Artificial Sequence
  Synthetic
atacgccatgctgggtctccaagaggagtttatgtactcttgtgatggagatgagcggcctctgttagtgaaagggaccctgatagctattgacccatttgatgataggcgggaagcaggcgtacttgggagtcggccat

SEQ ID NO: 448216 - DNA, 140 bp, Artificial Sequence
  Synthetic
atggccgactcccaagtacgcctgcttcccgcctatcatcaaatgggtcaatagctatcagggtccctttcactaacagaggccgctcatctccatcacaagagtacataaactcctcttggagacccagcatggcgtat

SEQ ID NO: 448217 - DNA, 140 bp, Artificial Sequence
  Synthetic
aggccctggctgctgatatgtgagaattggtatgtctataaggatgtggcagacaagaactacacaagggataaattgttagtgaagatgtcaaaatatgcctctgagggaaagagcctagaccttttgggacagcggtg

SEQ ID NO: 448218 - DNA, 140 bp, Artificial Sequence
  Synthetic
caccgctgtcccaaaaggtctaggctctttccctcagaggcatattttgacatcttcactaacaatttatcccttgtgtagttcttgtctgccacatccttatagacataccaattctcacatatcagcagccagggcct

SEQ ID NO: 448219 - DNA, 140 bp, Artificial Sequence
  Synthetic
aggccctggctgctgatatggctatccagaagtttgaggattgtatgaggcagatagagtcacaaggatgtatgcatatttgtttgtttaagaaacaacagcatggaggtctgagagagagaccttttgggacagcggtg

SEQ ID NO: 448220 - DNA, 140 bp, Artificial Sequence
  Synthetic
caccgctgtcccaaaaggtctctctctcagacctccatgctgttgtttcttaaacaaacaaatatgcatacatccttgtgactctatctgcctcatacaatcctcaaacttctggatagccatatcagcagccagggcct

SEQ ID NO: 448221 - DNA, 140 bp, Artificial Sequence
  Synthetic
aggccctggctgctgatatgtagaggactctgaagcagaggagatggtttataggtacagacttgctcttagtgtgatggatgagctaaggaccttattcccagaactgtcatccacagagaccttttgggacagcggtg

SEQ ID NO: 448222 - DNA, 140 bp, Artificial Sequence
  Synthetic
caccgctgtcccaaaaggtctctgtggatgacagttctgggaataaggtccttagctcatccatcacactaagagcaagtctgtacctataaaccatctcctctgcttcagagtcctctacatatcagcagccagggcct

SEQ ID NO: 448223 - DNA, 140 bp, Artificial Sequence
  Synthetic
atacgccatgctgggtctcctggaaaccacaacagggatgatgcagggaatattgcattatacttcctcactattacacaccattcatcaagaatacatccggtccttgtcctttaaaatcgtacttgggagtcggccat

SEQ ID NO: 448224 - DNA, 140 bp, Artificial Sequence
  Synthetic
atggccgactcccaagtacgattttaaaggacaaggaccggatgtattcttgatgaatggtgtgtaatagtgaggaagtataatgcaatattccctgcatcatccctgttgtggtttccaggagacccagcatggcgtat

SEQ ID NO: 448225 - DNA, 140 bp, Artificial Sequence
  Synthetic
atacgccatgctgggtctccagaagacaaccttagggacctcaatgaccacaagtcaactattcagctgcctccctggctgtcctatcacgatgttgatggcaaagacctgtgccctcttcgtacttgggagtcggccat

SEQ ID NO: 448226 - DNA, 140 bp, Artificial Sequence
  Synthetic
atggccgactcccaagtacgaagagggcacaggtctttgccatcaacatcgtgataggacagccagggaggcagctgaatagttgacttgtggtcattgaggtccctaaggttgtcttctggagacccagcatggcgtat

SEQ ID NO: 448227 - DNA, 140 bp, Artificial Sequence
  Synthetic
aggccctggctgctgatatggtgatgatgatggatttgttgaagttgattagaggttaaggctgccccaccccccaccccccaatcccgaccgtaaccccaacccccttttcccccaaccgaccttttgggacagcggtg

SEQ ID NO: 448228 - DNA, 140 bp, Artificial Sequence
  Synthetic
caccgctgtcccaaaaggtcggttgggggaaaagggggttggggttacggtcgggattggggggtggggggtggggcagccttaacctctaatcaacttcaacaaatccatcatcatcaccatatcagcagccagggcct

SEQ ID NO: 448229 - DNA, 140 bp, Artificial Sequence
  Synthetic
atacgccatgctgggtctcccacacccagcatgttagaccaacgatcaggtggattgcagcatgttgcagcctaccagaggtggaaacactagtagcccgccaggaagaggcctctaacccgtacttgggagtcggccat

SEQ ID NO: 448230 - DNA, 140 bp, Artificial Sequence
  Synthetic
atggccgactcccaagtacgggttagaggcctcttcctggcgggctactagtgtttccacctctggtaggctgcaacatgctgcaatccacctgatcgttggtctaacatgctgggtgtgggagacccagcatggcgtat

SEQ ID NO: 448231 - DNA, 140 bp, Artificial Sequence
  Synthetic
atacgccatgctgggtctccgtctgagctattcttagagtataagaaggcagtgctgaagtggaatgaccctggcctgggtttcttcctgcttgacaatccttatgcgtgcgggttgggacgtacttgggagtcggccat

SEQ ID NO: 448232 - DNA, 140 bp, Artificial Sequence
  Synthetic
atggccgactcccaagtacgtcccaacccgcacgcataaggattgtcaagcaggaagaaacccaggccagggtcattccacttcagcactgccttcttatactctaagaatagctcagacggagacccagcatggcgtat

SEQ ID NO: 448233 - DNA, 140 bp, Artificial Sequence
  Synthetic
atacgccatgctgggtctccggttttagatttaatctcttcaaagctatcaccagaactgatttgcagaagctatatgctttcttcatgaagaaggtcaagggctcagctgctagagactcgtacttgggagtcggccat

SEQ ID NO: 448234 - DNA, 140 bp, Artificial Sequence
  Synthetic
atggccgactcccaagtacgagtctctagcagctgagcccttgaccttcttcatgaagaaagcatatagcttctgcaaatcagttctggtgatagctttgaagagattaaatctaaaaccggagacccagcatggcgtat

SEQ ID NO: 448235 - DNA, 140 bp, Artificial Sequence
  Synthetic
atacgccatgctgggtctccctacagcaaacacagattttgtgatggagtacaattctgagttttatttccacacccagcatgttagacctacgatcaggtggattgcagcatgttgcagcgtacttgggagtcggccat

SEQ ID NO: 448236 - DNA, 140 bp, Artificial Sequence
  Synthetic
atggccgactcccaagtacgctgcaacatgctgcaatccacctgatcgtaggtctaacatgctgggtgtggaaataaaactcagaattgtactccatcacaaaatctgtgtttgctgtagggagacccagcatggcgtat

SEQ ID NO: 448237 - DNA, 140 bp, Artificial Sequence
  Synthetic
aggccctggctgctgatatggggcagatgaagatatcaccatcccagaaacgtgtagcgtgagcccaggtggcgctctaattcttagctcctctctaaagtggggatctaggaagaagttgaccttttgggacagcggtg

SEQ ID NO: 448238 - DNA, 140 bp, Artificial Sequence
  Synthetic
caccgctgtcccaaaaggtcaacttcttcctagatccccactttagagaggagctaagaattagagcgccacctgggctcacgctacacgtttctgggatggtgatatcttcatctgccccatatcagcagccagggcct

SEQ ID NO: 448239 - DNA, 140 bp, Artificial Sequence
  Synthetic
aggccctggctgctgatatgggcgctctaattcttagctcctctctaaagtggggatctaggaagaagtttcagaaactgagagaccgtttgaacataccagagaactggattgaactaagaccttttgggacagcggtg

SEQ ID NO: 448240 - DNA, 140 bp, Artificial Sequence
  Synthetic
caccgctgtcccaaaaggtcttagttcaatccagttctctggtatgttcaaacggtctctcagtttctgaaacttcttcctagatccccactttagagaggagctaagaattagagcgcccatatcagcagccagggcct

SEQ ID NO: 448241 - DNA, 140 bp, Artificial Sequence
  Synthetic
atacgccatgctgggtctccttggaggattctaagtacagcttgctacaaaagatggctgcatattctggctttcatggtttcaatgatatggagccagaagatatattattcctattcccgtacttgggagtcggccat

SEQ ID NO: 448242 - DNA, 140 bp, Artificial Sequence
  Synthetic
atggccgactcccaagtacgggaataggaataatatatcttctggctccatatcattgaaaccatgaaagccagaatatgcagccatcttttgtagcaagctgtacttagaatcctccaaggagacccagcatggcgtat

SEQ ID NO: 448243 - DNA, 140 bp, Artificial Sequence
  Synthetic
aggccctggctgctgatatgaagttaggaatttctttgctagaatggaaagcaagcctagaacagtcagaataacaggagctcctgtaaagaagaggtcaggggttagtaagatagctatgaccttttgggacagcggtg

SEQ ID NO: 448244 - DNA, 140 bp, Artificial Sequence
  Synthetic
caccgctgtcccaaaaggtcatagctatcttactaacccctgacctcttctttacaggagctcctgttattctgactgttctaggcttgctttccattctagcaaagaaattcctaacttcatatcagcagccagggcct

SEQ ID NO: 448245 - DNA, 140 bp, Artificial Sequence
  Synthetic
aggccctggctgctgatatgaatctcattgcggtccactgcttgagcagcaaactggatcgcaagctcttgatagttgtccattattgtaatagtgtttgtatctcagggagctttgtgtgaccttttgggacagcggtg

SEQ ID NO: 448246 - DNA, 140 bp, Artificial Sequence
  Synthetic
caccgctgtcccaaaaggtcacacaaagctccctgagatacaaacactattacaataatggacaactatcaagagcttgcgatccagtttgctgctcaagcagtggaccgcaatgagattcatatcagcagccagggcct

SEQ ID NO: 448247 - DNA, 140 bp, Artificial Sequence
  Synthetic
aggccctggctgctgatatgaactaactgtcagagcagcccatgggacctgagtattccaataaggcagtgggcagaagacatgggggtcacaaacaaccaggattattcctctaaatctgaccttttgggacagcggtg

SEQ ID NO: 448248 - DNA, 140 bp, Artificial Sequence
  Synthetic
caccgctgtcccaaaaggtcagatttagaggaataatcctggttgtttgtgacccccatgtcttctgcccactgccttattggaatactcaggtcccatgggctgctctgacagttagttcatatcagcagccagggcct

SEQ ID NO: 448249 - DNA, 140 bp, Artificial Sequence
  Synthetic
atacgccatgctgggtctcccaagccatttggatgcccagtttatattattaagggtgacatgtcagatgtcatcagactgagaaaggaggaggtggagatgaaagtacggggctctactcgtacttgggagtcggccat

SEQ ID NO: 448250 - DNA, 140 bp, Artificial Sequence
  Synthetic
atggccgactcccaagtacgagtagagccccgtactttcatctccacctcctcctttctcagtctgatgacatctgacatgtcacccttaataatataaactgggcatccaaatggcttgggagacccagcatggcgtat

SEQ ID NO: 448251 - DNA, 140 bp, Artificial Sequence
  Synthetic
aggccctggctgctgatatgaactgctgggtgagatgtgagtctgtagctccaaaatttatatcagccatccttgagatatgtgaggggaagagacagataaaaggaattaacagaaccagaccttttgggacagcggtg

SEQ ID NO: 448252 - DNA, 140 bp, Artificial Sequence
  Synthetic
caccgctgtcccaaaaggtctggttctgttaattccttttatctgtctcttcccctcacatatctcaaggatggctgatataaattttggagctacagactcacatctcacccagcagttcatatcagcagccagggcct

SEQ ID NO: 448253 - DNA, 140 bp, Artificial Sequence
  Synthetic
atacgccatgctgggtctcccccccaccccccaatcccgaccgtaaccccaaccacccctttcccccaaacccctgggcagccacttaggctgctgtcttgtacgcctgagcagctgccacgtacttgggagtcggccat

SEQ ID NO: 448254 - DNA, 140 bp, Artificial Sequence
  Synthetic
atggccgactcccaagtacgtggcagctgctcaggcgtacaagacagcagcctaagtggctgcccaggggtttgggggaaaggggtggttggggttacggtcgggattggggggtgggggggagacccagcatggcgtat

SEQ ID NO: 448255 - DNA, 140 bp, Artificial Sequence
  Synthetic
atacgccatgctgggtctccagaaggcctcatagatcagtacgtgtaggagcaatatgtagaaataagtagacataagcaaaccaaattatgtaaatattgtacagataggtcaaattatcgtacttgggagtcggccat

SEQ ID NO: 448256 - DNA, 140 bp, Artificial Sequence
  Synthetic
atggccgactcccaagtacgataatttgacctatctgtacaatatttacataatttggtttgcttatgtctacttatttctacatattgctcctacacgtactgatctatgaggccttctggagacccagcatggcgtat

SEQ ID NO: 448257 - DNA, 140 bp, Artificial Sequence
  Synthetic
atacgccatgctgggtctcccttgaaggaggcttgcaatcatgctaagctagtcttaaggagcctctatggacagaatttcatggagcaaatagacaatcagattatacgagagctcagtcgtacttgggagtcggccat

SEQ ID NO: 448258 - DNA, 140 bp, Artificial Sequence
  Synthetic
atggccgactcccaagtacgactgagctctcgtataatctgattgtctatttgctccatgaaattctgtccatagaggctccttaagactagcttagcatgattgcaagcctccttcaagggagacccagcatggcgtat

SEQ ID NO: 448259 - DNA, 140 bp, Artificial Sequence
  Synthetic
atacgccatgctgggtctcctgggatatccaagcttagaaacttatgcgataatacattagatgtaggcttagttgtaatttggggtggtggggtgaggcagcagcagtctcaagtgctacgtacttgggagtcggccat

SEQ ID NO: 448260 - DNA, 140 bp, Artificial Sequence
  Synthetic
atggccgactcccaagtacgtagcacttgagactgctgctgcctcaccccaccaccccaaattacaactaagcctacatctaatgtattatcgcataagtttctaagcttggatatcccaggagacccagcatggcgtat

SEQ ID NO: 448261 - DNA, 140 bp, Artificial Sequence
  Synthetic
aggccctggctgctgatatgggcttgttgccacgagttagagccagaacaatcatcttcttggcatccttctcccagtcagccccaccatattgttttaagagttcgataaccctacggggaccttttgggacagcggtg

SEQ ID NO: 448262 - DNA, 140 bp, Artificial Sequence
  Synthetic
caccgctgtcccaaaaggtccccgtagggttatcgaactcttaaaacaatatggtggggctgactgggagaaggatgccaagaagatgattgttctggctctaactcgtggcaacaagcccatatcagcagccagggcct

SEQ ID NO: 448263 - DNA, 140 bp, Artificial Sequence
  Synthetic
aggccctggctgctgatatggatcaattggagtgcacaacaaatctgattgatccctttgttgtctttgagaggggttctctgccacagacaaggaatgacaaaacctttgcagcttcaagaccttttgggacagcggtg

SEQ ID NO: 448264 - DNA, 140 bp, Artificial Sequence
  Synthetic
caccgctgtcccaaaaggtcttgaagctgcaaaggttttgtcattccttgtctgtggcagagaacccctctcaaagacaacaaagggatcaatcagatttgttgtgcactccaattgatccatatcagcagccagggcct

SEQ ID NO: 448265 - DNA, 140 bp, Artificial Sequence
  Synthetic
atacgccatgctgggtctccgaggggttctctgccacagacaaggaatgacaaaacctttgcagcttcaaaaggaaatagaggtgtccaagctttctctaagggctctgtacaagctgatcgtacttgggagtcggccat

SEQ ID NO: 448266 - DNA, 140 bp, Artificial Sequence
  Synthetic
atggccgactcccaagtacgatcagcttgtacagagcccttagagaaagcttggacacctctatttccttttgaagctgcaaaggttttgtcattccttgtctgtggcagagaacccctcggagacccagcatggcgtat

SEQ ID NO: 448267 - DNA, 140 bp, Artificial Sequence
  Synthetic
atacgccatgctgggtctccagaaggcctcatagatcagtacgtgtaaaagcaatatgttgaaataagtagacataagcaaacctaattatgtaagtattgtacagataggtcaaattatcgtacttgggagtcggccat

SEQ ID NO: 448268 - DNA, 140 bp, Artificial Sequence
  Synthetic
atggccgactcccaagtacgataatttgacctatctgtacaatacttacataattaggtttgcttatgtctacttatttcaacatattgcttttacacgtactgatctatgaggccttctggagacccagcatggcgtat

SEQ ID NO: 448269 - DNA, 140 bp, Artificial Sequence
  Synthetic
aggccctggctgctgatatgtgggatatccaagtttagaatcttatacaatagtactttagatgtaagcttagttgtaatttggggtggtggggtgaggcagcagcagtctcaagtacttgaccttttgggacagcggtg

SEQ ID NO: 448270 - DNA, 140 bp, Artificial Sequence
  Synthetic
caccgctgtcccaaaaggtcaagtacttgagactgctgctgcctcaccccaccaccccaaattacaactaagcttacatctaaagtactattgtataagattctaaacttggatatcccacatatcagcagccagggcct

SEQ ID NO: 448271 - DNA, 140 bp, Artificial Sequence
  Synthetic
atacgccatgctgggtctccaactttgctaccctccatgtcgatagatgtggaagatatggccaattttgttcacgatttcacctttggccacttagctgacaagactgacagactgttacgtacttgggagtcggccat

SEQ ID NO: 448272 - DNA, 140 bp, Artificial Sequence
  Synthetic
atggccgactcccaagtacgtaacagtctgtcagtcttgtcagctaagtggccaaaggtgaaatcgtgaacaaaattggccatatcttccacatctatcgacatggagggtagcaaagttggagacccagcatggcgtat

SEQ ID NO: 448273 - DNA, 140 bp, Artificial Sequence
  Synthetic
atacgccatgctgggtctcctggatttatcaagagacaacaatctaaagttgtgcaaaacaaagtggtttattatggagttgggatctggagaggcttcatggatggatatcaggtccatcgtacttgggagtcggccat

SEQ ID NO: 448274 - DNA, 140 bp, Artificial Sequence
  Synthetic
atggccgactcccaagtacgatggacctgatatccatccatgaagcctctccagatcccaactccataataaaccactttgttttgcacaactttagattgttgtctcttgataaatccaggagacccagcatggcgtat

SEQ ID NO: 448275 - DNA, 140 bp, Artificial Sequence
  Synthetic
aggccctggctgctgatatgggcgctctaattcttagctcttctctaaagtggggatctagaaagaagtttcaaaaactaagagaccggttgaacataccagagaactggattgaactaagaccttttgggacagcggtg

SEQ ID NO: 448276 - DNA, 140 bp, Artificial Sequence
  Synthetic
caccgctgtcccaaaaggtcttagttcaatccagttctctggtatgttcaaccggtctcttagtttttgaaacttctttctagatccccactttagagaagagctaagaattagagcgcccatatcagcagccagggcct

SEQ ID NO: 448277 - DNA, 140 bp, Artificial Sequence
  Synthetic
atacgccatgctgggtctccctttcatggtttcaatgatatggagccagaagatatattattcttattcccgaatattgaggaattagaatcactggattctatagtttacaacaagggacgtacttgggagtcggccat

SEQ ID NO: 448278 - DNA, 140 bp, Artificial Sequence
  Synthetic
atggccgactcccaagtacgtcccttgttgtaaactatagaatccagtgattctaattcctcaatattcgggaataagaataatatatcttctggctccatatcattgaaaccatgaaagggagacccagcatggcgtat

SEQ ID NO: 448279 - DNA, 140 bp, Artificial Sequence
  Synthetic
atacgccatgctgggtctcctggattcatcaagagacaacagtctaaagttgtgcagaacaaagtggtctattatggagttgggatttggagaggcttcatggatggatatcaggtccatcgtacttgggagtcggccat

SEQ ID NO: 448280 - DNA, 140 bp, Artificial Sequence
  Synthetic
atggccgactcccaagtacgatggacctgatatccatccatgaagcctctccaaatcccaactccataatagaccactttgttctgcacaactttagactgttgtctcttgatgaatccaggagacccagcatggcgtat

SEQ ID NO: 448281 - DNA, 140 bp, Artificial Sequence
  Synthetic
aggccctggctgctgatatgtgcgtcacaggatcgcagagcccttctactgagatcactcttaagtatccagggatatcccaatcctctgggggggacataggagttcacatggcacatggaccttttgggacagcggtg

SEQ ID NO: 448282 - DNA, 140 bp, Artificial Sequence
  Synthetic
caccgctgtcccaaaaggtccatgtgccatgtgaactcctatgtcccccccagaggattgggatatccctggatacttaagagtgatctcagtagaagggctctgcgatcctgtgacgcacatatcagcagccagggcct

SEQ ID NO: 448283 - DNA, 140 bp, Artificial Sequence
  Synthetic
aggccctggctgctgatatgcatgaagaaggagctgggagtgtaccttgccatttatccctcagagaagtccacagcaaacacagattttgtgatggaatacaactctgagttttatttcgaccttttgggacagcggtg

SEQ ID NO: 448284 - DNA, 140 bp, Artificial Sequence
  Synthetic
caccgctgtcccaaaaggtcgaaataaaactcagagttgtattccatcacaaaatctgtgtttgctgtggacttctctgagggataaatggcaaggtacactcccagctccttcttcatgcatatcagcagccagggcct

SEQ ID NO: 448285 - DNA, 140 bp, Artificial Sequence
  Synthetic
atacgccatgctgggtctccgtgatgatgatggatttgttgaagttgattagaggttaaggctgccccaccccccaccccccaatcccgaccgtaaccccaaacccccttttcccccaaccgtacttgggagtcggccat

SEQ ID NO: 448286 - DNA, 140 bp, Artificial Sequence
  Synthetic
atggccgactcccaagtacggttgggggaaaagggggtttggggttacggtcgggattggggggtggggggtggggcagccttaacctctaatcaacttcaacaaatccatcatcatcacggagacccagcatggcgtat

SEQ ID NO: 448287 - DNA, 140 bp, Artificial Sequence
  Synthetic
atacgccatgctgggtctccattccttctttgctgaagggaatgataaagttctgagattttcaaaaaacgctgaagagtgttccttggcaatagagagagccttaaatcagtatagagccgtacttgggagtcggccat

SEQ ID NO: 448288 - DNA, 140 bp, Artificial Sequence
  Synthetic
atggccgactcccaagtacggctctatactgatttaaggctctctctattgccaaggaacactcttcagcgttttttgaaaatctcagaactttatcattcccttcagcaaagaaggaatggagacccagcatggcgtat

SEQ ID NO: 448289 - DNA, 140 bp, Artificial Sequence
  Synthetic
aggccctggctgctgatatgtctacgtgatgggtgcagaggagagaattgttcaatcggtggtggagacaatagccaggtccatagggaagttctttgcttctgataccctctgtaacccgaccttttgggacagcggtg

SEQ ID NO: 448290 - DNA, 140 bp, Artificial Sequence
  Synthetic
caccgctgtcccaaaaggtcgggttacagagggtatcagaagcaaagaacttccctatggacctggctattgtctccaccaccgattgaacaattctctcctctgcacccatcacgtagacatatcagcagccagggcct

SEQ ID NO: 448291 - DNA, 140 bp, Artificial Sequence
  Synthetic
aggccctggctgctgatatgttacaaggacatcagttcattatctatgattgctcatcccttaatggataagtttgttgattatgctatttccaagatggggagagcctcagtcaggaaagaccttttgggacagcggtg

SEQ ID NO: 448292 - DNA, 140 bp, Artificial Sequence
  Synthetic
caccgctgtcccaaaaggtctttcctgactgaggctctccccatcttggaaatagcataatcaacaaacttatccattaagggatgagcaatcatagataatgaactgatgtccttgtaacatatcagcagccagggcct

SEQ ID NO: 448293 - DNA, 140 bp, Artificial Sequence
  Synthetic
aggccctggctgctgatatgtgtgaacccatcttgcttatttgtgcacacgtatctgcagtcagttagaaaagaggcccttagagtttttaactgtatcgattgggtgcataaactcactgaccttttgggacagcggtg

SEQ ID NO: 448294 - DNA, 140 bp, Artificial Sequence
  Synthetic
caccgctgtcccaaaaggtcagtgagtttatgcacccaatcgatacagttaaaaactctaagggcctcttttctaactgactgcagatacgtgtgcacaaataagcaagatgggttcacacatatcagcagccagggcct

SEQ ID NO: 448295 - DNA, 140 bp, Artificial Sequence
  Synthetic
atacgccatgctgggtctccaagaggcccttagagtttttaactgtatcgattgggtgcataaactcactctggaggtcacagattttgatggctctgtttcaacaatagacttgggagccgtacttgggagtcggccat

SEQ ID NO: 448296 - DNA, 140 bp, Artificial Sequence
  Synthetic
atggccgactcccaagtacggctcccaagtctattgttgaaacagagccatcaaaatctgtgacctccagagtgagtttatgcacccaatcgatacagttaaaaactctaagggcctcttggagacccagcatggcgtat

SEQ ID NO: 448297 - DNA, 140 bp, Artificial Sequence
  Synthetic
aggccctggctgctgatatggtgatgatgatggatttgttgaggttgattagaggttaaggctgccccaccccccaccccccaatcccgaccgtaaccccaactcccccttccccccaacgaccttttgggacagcggtg

SEQ ID NO: 448298 - DNA, 140 bp, Artificial Sequence
  Synthetic
caccgctgtcccaaaaggtcgttggggggaagggggagttggggttacggtcgggattggggggtggggggtggggcagccttaacctctaatcaacctcaacaaatccatcatcatcaccatatcagcagccagggcct

SEQ ID NO: 448299 - DNA, 140 bp, Artificial Sequence
  Synthetic
atacgccatgctgggtctccgtctgagctattcttagaatataagaaggcagtgttgaagtggaatgaccctggcctgggtttcttcctgcttgacaatccttatgcgtgcgggttgggacgtacttgggagtcggccat

SEQ ID NO: 448300 - DNA, 140 bp, Artificial Sequence
  Synthetic
atggccgactcccaagtacgtcccaacccgcacgcataaggattgtcaagcaggaagaaacccaggccagggtcattccacttcaacactgccttcttatattctaagaatagctcagacggagacccagcatggcgtat

SEQ ID NO: 448301 - DNA, 140 bp, Artificial Sequence
  Synthetic
atacgccatgctgggtctcctcgtgatgaagacacactgtccaaatgactaccagtcagcccactacctcaacaatgatgggaaaatggcctcagtcaagtgccctcctaagtatgagctcgtacttgggagtcggccat

SEQ ID NO: 448302 - DNA, 140 bp, Artificial Sequence
  Synthetic
atggccgactcccaagtacgagctcatacttaggagggcacttgactgaggccattttcccatcattgttgaggtagtgggctgactggtagtcatttggacagtgtgtcttcatcacgaggagacccagcatggcgtat

SEQ ID NO: 448303 - DNA, 140 bp, Artificial Sequence
  Synthetic
atacgccatgctgggtctcctctctgatttctacaatgtcggagaattcccctaccgagtcggacttggagactttgcatcaaatgttgcacctccaccagcaaagccttttcagagactcgtacttgggagtcggccat

SEQ ID NO: 448304 - DNA, 140 bp, Artificial Sequence
  Synthetic
atggccgactcccaagtacgagtctctgaaaaggctttgctggtggaggtgcaacatttgatgcaaagtctccaagtccgactcggtaggggaattctccgacattgtagaaatcagagaggagacccagcatggcgtat

SEQ ID NO: 448305 - DNA, 140 bp, Artificial Sequence
  Synthetic
atacgccatgctgggtctcctttgacctgagctccactagagtgcacaggaatgatgacattagaagggaccagattgccactctagcaatgaggagttgcaagatcaccaatgatcttgcgtacttgggagtcggccat

SEQ ID NO: 448306 - DNA, 140 bp, Artificial Sequence
  Synthetic
atggccgactcccaagtacgcaagatcattggtgatcttgcaactcctcattgctagagtggcaatctggtcccttctaatgtcatcattcctgtgcactctagtggagctcaggtcaaaggagacccagcatggcgtat

SEQ ID NO: 448307 - DNA, 140 bp, Artificial Sequence
  Synthetic
aggccctggctgctgatatgagagggattgacctgtgcctgttgccaggctttgacctcatgtatgaggttgctcatgttcagtgtgttcggctcctgcaggcagcaaaagaggacatttgaccttttgggacagcggtg

SEQ ID NO: 448308 - DNA, 140 bp, Artificial Sequence
  Synthetic
caccgctgtcccaaaaggtcaaatgtcctcttttgctgcctgcaggagccgaacacactgaacatgagcaacctcatacatgaggtcaaagcctggcaacaggcacaggtcaatccctctcatatcagcagccagggcct

SEQ ID NO: 448309 - DNA, 140 bp, Artificial Sequence
  Synthetic
atacgccatgctgggtctcccccccaccccccaatcccgaccgtaaccccaaccaccccccttcccccaaacccctgggcagccgcttaggctgctgtcttgtacgcctgagcagctgcccgtacttgggagtcggccat

SEQ ID NO: 448310 - DNA, 140 bp, Artificial Sequence
  Synthetic
atggccgactcccaagtacgggcagctgctcaggcgtacaagacagcagcctaagcggctgcccaggggtttgggggaaggggggtggttggggttacggtcgggattggggggtgggggggagacccagcatggcgtat

SEQ ID NO: 448311 - DNA, 140 bp, Artificial Sequence
  Synthetic
atacgccatgctgggtctcccattcattggctgcgtgaacgttgcagcaacctcctcctttgttctacctcggaggtttgggttgatgacccgggagaactgcagcagatacagagagtgcgtacttgggagtcggccat

SEQ ID NO: 448312 - DNA, 140 bp, Artificial Sequence
  Synthetic
atggccgactcccaagtacgcactctctgtatctgctgcagttctcccgggtcatcaacccaaacctccgaggtagaacaaaggaggaggttgctgcaacgttcacgcagccaatgaatgggagacccagcatggcgtat

SEQ ID NO: 448313 - DNA, 140 bp, Artificial Sequence
  Synthetic
aggccctggctgctgatatgagcctggcaagtccagccagccagggcggcagcaactcttgatagggtcaactcatcccgggaaggattcccctcctttagcttatacttgttgatgagagaccttttgggacagcggtg

SEQ ID NO: 448314 - DNA, 140 bp, Artificial Sequence
  Synthetic
caccgctgtcccaaaaggtctctcatcaacaagtataagctaaaggaggggaatccttcccgggatgagttgaccctatcaagagttgctgccgccctggctggctggacttgccaggctcatatcagcagccagggcct

SEQ ID NO: 448315 - DNA, 140 bp, Artificial Sequence
  Synthetic
aggccctggctgctgatatggcatcaaatccttgataagcaaactctcggacccactgttcaatttcattgcggtccactgcttgagcagcaaactggatcgcaagctcttgatagttgtgaccttttgggacagcggtg

SEQ ID NO: 448316 - DNA, 140 bp, Artificial Sequence
  Synthetic
caccgctgtcccaaaaggtcacaactatcaagagcttgcgatccagtttgctgctcaagcagtggaccgcaatgaaattgaacagtgggtccgagagtttgcttatcaaggatttgatgccatatcagcagccagggcct

SEQ ID NO: 448317 - DNA, 140 bp, Artificial Sequence
  Synthetic
aggccctggctgctgatatgtattgatctaataggccatatgactcttagtgatttcacaaggttccccaatctgagagaagccatatcctggcctcttggagaaccctctctggctttcgaccttttgggacagcggtg

SEQ ID NO: 448318 - DNA, 140 bp, Artificial Sequence
  Synthetic
caccgctgtcccaaaaggtcgaaagccagagagggttctccaagaggccaggatatggcttctctcagattggggaaccttgtgaaatcactaagagtcatatggcctattagatcaatacatatcagcagccagggcct

SEQ ID NO: 448319 - DNA, 140 bp, Artificial Sequence
  Synthetic
atacgccatgctgggtctcctgaagaactagggaagactgagagagagttgctagcgatggtctcctccatccaaataaattggtcagtcacagaatctgtgttcccacccttcagcagacgtacttgggagtcggccat

SEQ ID NO: 448320 - DNA, 140 bp, Artificial Sequence
  Synthetic
atggccgactcccaagtacgtctgctgaagggtgggaacacagattctgtgactgaccaatttatttggatggaggagaccatcgctagcaactctctctcagtcttccctagttcttcaggagacccagcatggcgtat

SEQ ID NO: 448321 - DNA, 140 bp, Artificial Sequence
  Synthetic
atacgccatgctgggtctcccccccaccccccaatcccaaccgtaaccccaaccacccctttcccccaaacccctgggcagccacttaagctgctgtcttgtacgcctgagcagctgccacgtacttgggagtcggccat

SEQ ID NO: 448322 - DNA, 140 bp, Artificial Sequence
  Synthetic
atggccgactcccaagtacgtggcagctgctcaggcgtacaagacagcagcttaagtggctgcccaggggtttgggggaaaggggtggttggggttacggttgggattggggggtgggggggagacccagcatggcgtat

SEQ ID NO: 448323 - DNA, 140 bp, Artificial Sequence
  Synthetic
aggccctggctgctgatatgttgtgtctttctcatgcaccatcgtcctagtcacgaggttcgcttgcgattctctgacttctacaatgtcggagaattcccataccgagtcggacttggagaccttttgggacagcggtg

SEQ ID NO: 448324 - DNA, 140 bp, Artificial Sequence
  Synthetic
caccgctgtcccaaaaggtctccaagtccgactcggtatgggaattctccgacattgtagaagtcagagaatcgcaagcgaacctcgtgactaggacgatggtgcatgagaaagacacaacatatcagcagccagggcct

SEQ ID NO: 448325 - DNA, 140 bp, Artificial Sequence
  Synthetic
atacgccatgctgggtctcctttcccaaagttctcagatcagagctacaggtttacttattaaactgcttatgcagaactatccagagaatagcaggggagccctttattcttaagaagacgtacttgggagtcggccat

SEQ ID NO: 448326 - DNA, 140 bp, Artificial Sequence
  Synthetic
atggccgactcccaagtacgtcttcttaagaataaagggctcccctgctattctctggatagttctgcataagcagtttaataagtaaacctgtagctctgatctgagaactttgggaaaggagacccagcatggcgtat

SEQ ID NO: 448327 - DNA, 140 bp, Artificial Sequence
  Synthetic
aggccctggctgctgatatgatggtaagacaaaaaccaatttgattggaatccttcagagatttctagatggtgatcacgttgtccccataattgaagagatgggagccggaacagtggggaccttttgggacagcggtg

SEQ ID NO: 448328 - DNA, 140 bp, Artificial Sequence
  Synthetic
caccgctgtcccaaaaggtccccactgttccggctcccatctcttcaattatggggacaacgtgatcaccatctagaaatctctgaaggattccaatcaaattggtttttgtcttaccatcatatcagcagccagggcct

SEQ ID NO: 448329 - DNA, 140 bp, Artificial Sequence
  Synthetic
aggccctggctgctgatatgagaaggcctcatagatcagtgcgtgtaaaagcaatatgttgaagtaagtagacataagctaacctaattatgtaagtattgtacagataggtcaaattatgaccttttgggacagcggtg

SEQ ID NO: 448330 - DNA, 140 bp, Artificial Sequence
  Synthetic
caccgctgtcccaaaaggtcataatttgacctatctgtacaatacttacataattaggttagcttatgtctacttacttcaacatattgcttttacacgcactgatctatgaggccttctcatatcagcagccagggcct

SEQ ID NO: 448331 - DNA, 140 bp, Artificial Sequence
  Synthetic
aggccctggctgctgatatggtgatgatgatggatttgttgaggttgattagaggttaaggctgccccaccccccaccccccaatcccgaccgtaaccccaaccaccccttcccccaaacgaccttttgggacagcggtg

SEQ ID NO: 448332 - DNA, 140 bp, Artificial Sequence
  Synthetic
caccgctgtcccaaaaggtcgtttgggggaaggggtggttggggttacggtcgggattggggggtggggggtggggcagccttaacctctaatcaacctcaacaaatccatcatcatcaccatatcagcagccagggcct

SEQ ID NO: 448333 - DNA, 140 bp, Artificial Sequence
  Synthetic
aggccctggctgctgatatgccactgcttgacatgcaaccactcatcagctgttgttacaatggttactttaaaaataaggaagaagagactgagccttcatccctttcagggatgtatagaccttttgggacagcggtg

SEQ ID NO: 448334 - DNA, 140 bp, Artificial Sequence
  Synthetic
caccgctgtcccaaaaggtctatacatccctgaaagggatgaaggctcagtctcttcttccttatttttaaagtaaccattgtaacaacagctgatgagtggttgcatgtcaagcagtggcatatcagcagccagggcct

SEQ ID NO: 448335 - DNA, 140 bp, Artificial Sequence
  Synthetic
atacgccatgctgggtctccagaaggcctcatagaccagtacgtgtagaagcaatatgtagaaataagtagacataagcaaacctgattatgtaaatattgtacagataggctaaactatcgtacttgggagtcggccat

SEQ ID NO: 448336 - DNA, 140 bp, Artificial Sequence
  Synthetic
atggccgactcccaagtacgatagtttagcctatctgtacaatatttacataatcaggtttgcttatgtctacttatttctacatattgcttctacacgtactggtctatgaggccttctggagacccagcatggcgtat

SEQ ID NO: 448337 - DNA, 140 bp, Artificial Sequence
  Synthetic
aggccctggctgctgatatgagggatatcccagtcctctgggggggacataggggttcacatggcacacgatgatcagtcagttagctccaaaatagtagctcactgccccccccaggacgaccttttgggacagcggtg

SEQ ID NO: 448338 - DNA, 140 bp, Artificial Sequence
  Synthetic
caccgctgtcccaaaaggtcgtcctggggggggcagtgagctactattttggagctaactgactgatcatcgtgtgccatgtgaacccctatgtcccccccagaggactgggatatccctcatatcagcagccagggcct

SEQ ID NO: 448339 - DNA, 140 bp, Artificial Sequence
  Synthetic
atacgccatgctgggtctcctgagatatccaagtttagaaacttttgcaataatactttagatgtaagcttagttgtaatttggggtggtggggtgaggcagcagcagtctcaagtacttcgtacttgggagtcggccat

SEQ ID NO: 448340 - DNA, 140 bp, Artificial Sequence
  Synthetic
atggccgactcccaagtacgaagtacttgagactgctgctgcctcaccccaccaccccaaattacaactaagcttacatctaaagtattattgcaaaagtttctaaacttggatatctcaggagacccagcatggcgtat

SEQ ID NO: 448341 - DNA, 140 bp, Artificial Sequence
  Synthetic
aggccctggctgctgatatgcagtaagcaaagtcaggcttagatttagggatactatgctagtattggaatccatgtgggttctgatactagcatagtgctacaatattgggcggtctttgaccttttgggacagcggtg

SEQ ID NO: 448342 - DNA, 140 bp, Artificial Sequence
  Synthetic
caccgctgtcccaaaaggtcaaagaccgcccaatattgtagcactatgctagtatcagaacccacatggattccaatactagcatagtatccctaaatctaagcctgactttgcttactgcatatcagcagccagggcct

SEQ ID NO: 448343 - DNA, 140 bp, Artificial Sequence
  Synthetic
atacgccatgctgggtctcccgttagtgcaacaaatgagagacaggagtaaacagcccttctctccagatcatgatgtggatcacatatctgaatttctctctgcatgctctagtgacttcgtacttgggagtcggccat

SEQ ID NO: 448344 - DNA, 140 bp, Artificial Sequence
  Synthetic
atggccgactcccaagtacgaagtcactagagcatgcagagagaaattcagatatgtgatccacatcatgatctggagagaagggctgtttactcctgtctctcatttgttgcactaacgggagacccagcatggcgtat

SEQ ID NO: 448345 - DNA, 140 bp, Artificial Sequence
  Synthetic
aggccctggctgctgatatgcatcgggagcttgatatcagagatgactttgtgatggatctcttcaaagcttatcatggtgaggcagaagttccatgggcctttaagggcaaaacatattgaccttttgggacagcggtg

SEQ ID NO: 448346 - DNA, 140 bp, Artificial Sequence
  Synthetic
caccgctgtcccaaaaggtcaatatgttttgcccttaaaggcccatggaacttctgcctcaccatgataagctttgaagagatccatcacaaagtcatctctgatatcaagctcccgatgcatatcagcagccagggcct

SEQ ID NO: 448347 - DNA, 140 bp, Artificial Sequence
  Synthetic
atacgccatgctgggtctcccccccaccccccaatcccgaccgtaaccccaacccccattttcccaacccccctgggcagtcacttaggctgctgtcttgtaggcctgagcagctgccatcgtacttgggagtcggccat

SEQ ID NO: 448348 - DNA, 140 bp, Artificial Sequence
  Synthetic
atggccgactcccaagtacgatggcagctgctcaggcctacaagacagcagcctaagtgactgcccaggggggttgggaaaatgggggttggggttacggtcgggattggggggtgggggggagacccagcatggcgtat

SEQ ID NO: 448349 - DNA, 140 bp, Artificial Sequence
  Synthetic
atacgccatgctgggtctccaactttgctaccctctatgtcgatagatgtggaagacatggccaattttgttcacgatttcacttttggccacttagctgacaagactgacagactgttacgtacttgggagtcggccat

SEQ ID NO: 448350 - DNA, 140 bp, Artificial Sequence
  Synthetic
atggccgactcccaagtacgtaacagtctgtcagtcttgtcagctaagtggccaaaagtgaaatcgtgaacaaaattggccatgtcttccacatctatcgacatagagggtagcaaagttggagacccagcatggcgtat

SEQ ID NO: 448351 - DNA, 140 bp, Artificial Sequence
  Synthetic
atacgccatgctgggtctccgtgatgatgatggatttgttgaggttgattagaggttaaggctgccccaccccccaccccccaatcccgaccgtaaccccaacccccattttccccaacccgtacttgggagtcggccat

SEQ ID NO: 448352 - DNA, 140 bp, Artificial Sequence
  Synthetic
atggccgactcccaagtacgggttggggaaaatgggggttggggttacggtcgggattggggggtggggggtggggcagccttaacctctaatcaacctcaacaaatccatcatcatcacggagacccagcatggcgtat

SEQ ID NO: 448353 - DNA, 140 bp, Artificial Sequence
  Synthetic
atacgccatgctgggtctcccccctgggcagccacttaggctgctgtcttgtaagcctgagcagctgccatgacagcagctgacggcttcccattagaatccacaagcccaaaagctttccgtacttgggagtcggccat

SEQ ID NO: 448354 - DNA, 140 bp, Artificial Sequence
  Synthetic
atggccgactcccaagtacggaaagcttttgggcttgtggattctaatgggaagccgtcagctgctgtcatggcagctgctcaggcttacaagacagcagcctaagtggctgcccaggggggagacccagcatggcgtat

SEQ ID NO: 448355 - DNA, 140 bp, Artificial Sequence
  Synthetic
atacgccatgctgggtctccccagtgtcacactgctctcagtgcctttgttgttgtgtttgtgttcagttctattgcaataatttgtttagctattctttatagggtgctcaaatgcttacgtacttgggagtcggccat

SEQ ID NO: 448356 - DNA, 140 bp, Artificial Sequence
  Synthetic
atggccgactcccaagtacgtaagcatttgagcaccctataaagaatagctaaacaaattattgcaatagaactgaacacaaacacaacaacaaaggcactgagagcagtgtgacactggggagacccagcatggcgtat

SEQ ID NO: 448357 - DNA, 140 bp, Artificial Sequence
  Synthetic
aggccctggctgctgatatgttatcgaactcttaaagcagtatggtggggccgactgggagaaggatgccaagaaaatgattgttctggctctaactcgtggcaacaagccccggaggatgaccttttgggacagcggtg

SEQ ID NO: 448358 - DNA, 140 bp, Artificial Sequence
  Synthetic
caccgctgtcccaaaaggtcatcctccggggcttgttgccacgagttagagccagaacaatcattttcttggcatccttctcccagtcggccccaccatactgctttaagagttcgataacatatcagcagccagggcct

SEQ ID NO: 448359 - DNA, 140 bp, Artificial Sequence
  Synthetic
atacgccatgctgggtctccgacataagcaaacctgattatgtaaatattgtacagataggtcaaattattgggatatccaagctcagaaacttctgcaataatactatagatgtaagctcgtacttgggagtcggccat

SEQ ID NO: 448360 - DNA, 140 bp, Artificial Sequence
  Synthetic
atggccgactcccaagtacgagcttacatctatagtattattgcagaagtttctgagcttggatatcccaataatttgacctatctgtacaatatttacataatcaggtttgcttatgtcggagacccagcatggcgtat

SEQ ID NO: 448361 - DNA, 140 bp, Artificial Sequence
  Synthetic
aggccctggctgctgatatgcgatctcttgtagatctgttctctaaacgaactttaaaatctgtgtagctgtcgctcggctgcatgcctagtgcacctacgcagtataaacaataataaagaccttttgggacagcggtg

SEQ ID NO: 448362 - DNA, 140 bp, Artificial Sequence
  Synthetic
caccgctgtcccaaaaggtctttattattgtttatactgcgtaggtgcactaggcatgcagccgagcgacagctacacagattttaaagttcgtttagagaacagatctacaagagatcgcatatcagcagccagggcct

SEQ ID NO: 448363 - DNA, 140 bp, Artificial Sequence
  Synthetic
aggccctggctgctgatatggtcgctcggctgcatgcctagtgcacctacgcagtataaacaataataaattttactgtcgttgacaagaaacgagtaactcgtccctcttctgcagactgaccttttgggacagcggtg

SEQ ID NO: 448364 - DNA, 140 bp, Artificial Sequence
  Synthetic
caccgctgtcccaaaaggtcagtctgcagaagagggacgagttactcgtttcttgtcaacgacagtaaaatttattattgtttatactgcgtaggtgcactaggcatgcagccgagcgaccatatcagcagccagggcct

SEQ ID NO: 448365 - DNA, 140 bp, Artificial Sequence
  Synthetic
atacgccatgctgggtctccgcttacggtttcgtccgtgttgcagtcgatcatcagcatacctaggtttcgtccgggtgtgaccgaaaggtaagatggagagccttgttcttggtgtcaacgtacttgggagtcggccat

SEQ ID NO: 448366 - DNA, 140 bp, Artificial Sequence
  Synthetic
atggccgactcccaagtacgttgacaccaagaacaaggctctccatcttacctttcggtcacacccggacgaaacctaggtatgctgatgatcgactgcaacacggacgaaaccgtaagcggagacccagcatggcgtat

SEQ ID NO: 448367 - DNA, 140 bp, Artificial Sequence
  Synthetic
atacgccatgctgggtctcccgagaaaacacacgtccaactcagtttgcctgtccttcaggttagagacgtgctagtgcgtggcttcggggactctgtggaagaggccctatcggaggcacgtacttgggagtcggccat

SEQ ID NO: 448368 - DNA, 140 bp, Artificial Sequence
  Synthetic
atggccgactcccaagtacgtgcctccgatagggcctcttccacagagtccccgaagccacgcactagcacgtctctaacctgaaggacaggcaaactgagttggacgtgtgttttctcgggagacccagcatggcgtat

SEQ ID NO: 448369 - DNA, 140 bp, Artificial Sequence
  Synthetic
aggccctggctgctgatatgtgccatgcaaaaggagagtgatgattacattaagctaaatggccctcttacagtaggagggtcttgtttgctttctggacataatcttgctaagaagtgtgaccttttgggacagcggtg

SEQ ID NO: 448370 - DNA, 140 bp, Artificial Sequence
  Synthetic
caccgctgtcccaaaaggtcacacttcttagcaagattatgtccagaaagcaaacaagaccctcctactgtaagagggccatttagcttaatgtaatcatcactctccttttgcatggcacatatcagcagccagggcct

SEQ ID NO: 448371 - DNA, 140 bp, Artificial Sequence
  Synthetic
aggccctggctgctgatatgaacacacgtgaagtgttcgctcaagtcaaacaaatgtacaaaaccccaactttgaaagattttggtggttttaatttttcacaaatattacctgaccctcgaccttttgggacagcggtg

SEQ ID NO: 448372 - DNA, 140 bp, Artificial Sequence
  Synthetic
caccgctgtcccaaaaggtcgagggtcaggtaatatttgtgaaaaattaaaaccaccaaaatctttcaaagttggggttttgtacatttgtttgacttgagcgaacacttcacgtgtgttcatatcagcagccagggcct

SEQ ID NO: 448373 - DNA, 140 bp, Artificial Sequence
  Synthetic
aggccctggctgctgatatggacggcattcagtacggtcgtagcggtataacactgggagtactcgtgccacatgtgggcgaaaccccaattgcataccgcaatgttcttcttcgtaagagaccttttgggacagcggtg

SEQ ID NO: 448374 - DNA, 140 bp, Artificial Sequence
  Synthetic
caccgctgtcccaaaaggtctcttacgaagaagaacattgcggtatgcaattggggtttcgcccacatgtggcacgagtactcccagtgttataccgctacgaccgtactgaatgccgtccatatcagcagccagggcct

SEQ ID NO: 448375 - DNA, 140 bp, Artificial Sequence
  Synthetic
aggccctggctgctgatatgacatgtgggcgaaaccccaattgcataccgcaatgttcttcttcgtaagaacggtaataagggagccggtggtcatagctatggcatcgatctaaagtctgaccttttgggacagcggtg

SEQ ID NO: 448376 - DNA, 140 bp, Artificial Sequence
  Synthetic
caccgctgtcccaaaaggtcagactttagatcgatgccatagctatgaccaccggctcccttattaccgttcttacgaagaagaacattgcggtatgcaattggggtttcgcccacatgtcatatcagcagccagggcct

SEQ ID NO: 448377 - DNA, 140 bp, Artificial Sequence
  Synthetic
atacgccatgctgggtctcctatgacttaggtgacgagcttggcactgatcccattgaagattatgaacaaaactggaacactaagcatggcagtggtgcactccgtgaactcactcgtgcgtacttgggagtcggccat

SEQ ID NO: 448378 - DNA, 140 bp, Artificial Sequence
  Synthetic
atggccgactcccaagtacgcacgagtgagttcacggagtgcaccactgccatgcttagtgttccagttttgttcataatcttcaatgggatcagtgccaagctcgtcacctaagtcataggagacccagcatggcgtat

SEQ ID NO: 448379 - DNA, 140 bp, Artificial Sequence
  Synthetic
aggccctggctgctgatatgaaactggaacactaagcatggcagtggtgcactccgtgaactcactcgtgagctcaatggaggtgcagtcactcgctatgtcgacaacaatttctgtggcgaccttttgggacagcggtg

SEQ ID NO: 448380 - DNA, 140 bp, Artificial Sequence
  Synthetic
caccgctgtcccaaaaggtcgccacagaaattgttgtcgacatagcgagtgactgcacctccattgagctcacgagtgagttcacggagtgcaccactgccatgcttagtgttccagtttcatatcagcagccagggcct

SEQ ID NO: 448381 - DNA, 140 bp, Artificial Sequence
  Synthetic
atacgccatgctgggtctccccagatgggtaccctcttgattgcatcaaagattttctcgcacgcgcgggcaagtcaatgtgcactctttccgaacaacttgattacatcgagtcgaagacgtacttgggagtcggccat

SEQ ID NO: 448382 - DNA, 140 bp, Artificial Sequence
  Synthetic
atggccgactcccaagtacgtcttcgactcgatgtaatcaagttgttcggaaagagtgcacattgacttgcccgcgcgtgcgagaaaatctttgatgcaatcaagagggtacccatctggggagacccagcatggcgtat

SEQ ID NO: 448383 - DNA, 140 bp, Artificial Sequence
  Synthetic
atacgccatgctgggtctccctcttaactcaaaagtcaaagtcattcaaccacgtgttgaaaagaaaaagactgagggtttcatggggcgtatacgctctgtgtaccctgttgcatctcccgtacttgggagtcggccat

SEQ ID NO: 448384 - DNA, 140 bp, Artificial Sequence
  Synthetic
atggccgactcccaagtacgggagatgcaacagggtacacagagcgtatacgccccatgaaaccctcagtctttttcttttcaacacgtggttgaatgactttgacttttgagttaagagggagacccagcatggcgtat

SEQ ID NO: 448385 - DNA, 140 bp, Artificial Sequence
  Synthetic
aggccctggctgctgatatgcattgtggcactgaaaatttagttattgaaggacctactacatgtgggtacctacctactaatgctgtagtgaaaatgccatgtcctgcctgtcaagaccgaccttttgggacagcggtg

SEQ ID NO: 448386 - DNA, 140 bp, Artificial Sequence
  Synthetic
caccgctgtcccaaaaggtcggtcttgacaggcaggacatggcattttcactacagcattagtaggtaggtacccacatgtagtaggtccttcaataactaaattttcagtgccacaatgcatatcagcagccagggcct

SEQ ID NO: 448387 - DNA, 140 bp, Artificial Sequence
  Synthetic
atacgccatgctgggtctcccctacctactaatgctgtagtgaaaatgccatgtcctgcctgtcaagacccagagattggacctgagcatagtgttgcagattatcacaaccactcaaaccgtacttgggagtcggccat

SEQ ID NO: 448388 - DNA, 140 bp, Artificial Sequence
  Synthetic
atggccgactcccaagtacggtttgagtggttgtgataatctgcaacactatgctcaggtccaatctctgggtcttgacaggcaggacatggcattttcactacagcattagtaggtaggggagacccagcatggcgtat

SEQ ID NO: 448389 - DNA, 140 bp, Artificial Sequence
  Synthetic
atacgccatgctgggtctccattgaaactcgactccgcaagggaggtaggactagatgttttggaggctgtgtgtttgcctatgttggctgctataataagcgtgcctactgggttcctccgtacttgggagtcggccat

SEQ ID NO: 448390 - DNA, 140 bp, Artificial Sequence
  Synthetic
atggccgactcccaagtacggaggaacccagtaggcacgcttattatagcagccaacataggcaaacacacagcctccaaaacatctagtcctacctcccttgcggagtcgagtttcaatggagacccagcatggcgtat

SEQ ID NO: 448391 - DNA, 140 bp, Artificial Sequence
  Synthetic
aggccctggctgctgatatgtgtgtttgcctatgttggctgctataataagcgtgcctactgggttcctcgtgctagtgctgatattggctcaggccatactggcattactggtgacaatgaccttttgggacagcggtg

SEQ ID NO: 448392 - DNA, 140 bp, Artificial Sequence
  Synthetic
caccgctgtcccaaaaggtcattgtcaccagtaatgccagtatggcctgagccaatatcagcactagcacgaggaacccagtaggcacgcttattatagcagccaacataggcaaacacacatatcagcagccagggcct

SEQ ID NO: 448393 - DNA, 140 bp, Artificial Sequence
  Synthetic
atacgccatgctgggtctccttttggcatctttctctgcttctacaagtgcctttattgacactataaagagtcttgattacaagtctttcaaaaccattgttgagtcctgcggtaactacgtacttgggagtcggccat

SEQ ID NO: 448394 - DNA, 140 bp, Artificial Sequence
  Synthetic
atggccgactcccaagtacgtagttaccgcaggactcaacaatggttttgaaagacttgtaatcaagactctttatagtgtcaataaaggcacttgtagaagcagagaaagatgccaaaaggagacccagcatggcgtat

SEQ ID NO: 448395 - DNA, 140 bp, Artificial Sequence
  Synthetic
aggccctggctgctgatatgagtcttgattacaagtctttcaaaaccattgttgagtcctgcggtaactataaagttaccaagggaaagcccgtaaaaggtgcttggaacattggacaacgaccttttgggacagcggtg

SEQ ID NO: 448396 - DNA, 140 bp, Artificial Sequence
  Synthetic
caccgctgtcccaaaaggtcgttgtccaatgttccaagcaccttttacgggctttcccttggtaactttatagttaccgcaggactcaacaatggttttgaaagacttgtaatcaagactcatatcagcagccagggcct

SEQ ID NO: 448397 - DNA, 140 bp, Artificial Sequence
  Synthetic
atacgccatgctgggtctccagagatcagttttaacaccactgtgtggttttccctcacaggctgctggtgttatcagatcaatttttgcgcgcacacttgatgcagcaaaccactcaatcgtacttgggagtcggccat

SEQ ID NO: 448398 - DNA, 140 bp, Artificial Sequence
  Synthetic
atggccgactcccaagtacgattgagtggtttgctgcatcaagtgtgcgcgcaaaaattgatctgataacaccagcagcctgtgagggaaaaccacacagtggtgttaaaactgatctctggagacccagcatggcgtat

SEQ ID NO: 448399 - DNA, 140 bp, Artificial Sequence
  Synthetic
atacgccatgctgggtctcctcctgatttgcaaagagcagctgtcaccatacttgatggtatttctgaacagtcattacgtcttgtcgacgccatggtttatacttcagacctgctcacccgtacttgggagtcggccat

SEQ ID NO: 448400 - DNA, 140 bp, Artificial Sequence
  Synthetic
atggccgactcccaagtacgggtgagcaggtctgaagtataaaccatggcgtcgacaagacgtaatgactgttcagaaataccatcaagtatggtgacagctgctctttgcaaatcaggaggagacccagcatggcgtat

SEQ ID NO: 448401 - DNA, 140 bp, Artificial Sequence
  Synthetic
atacgccatgctgggtctccaacagtgtcattattatggcatatgtaactggtggtcttgtacaacagacttctcagtggttgtctaatcttttgggcactactgttgaaaaactcaggccgtacttgggagtcggccat

SEQ ID NO: 448402 - DNA, 140 bp, Artificial Sequence
  Synthetic
atggccgactcccaagtacggcctgagtttttcaacagtagtgcccaaaagattagacaaccactgagaagtctgttgtacaagaccaccagttacatatgccataataatgacactgttggagacccagcatggcgtat

SEQ ID NO: 448403 - DNA, 140 bp, Artificial Sequence
  Synthetic
aggccctggctgctgatatgttctcagtggttgtctaatcttttgggcactactgttgaaaaactcaggcctatctttgaatggattgaggcgaaacttagtgcaggagttgaatttctcgaccttttgggacagcggtg

SEQ ID NO: 448404 - DNA, 140 bp, Artificial Sequence
  Synthetic
caccgctgtcccaaaaggtcgagaaattcaactcctgcactaagtttcgcctcaatccattcaaagataggcctgagtttttcaacagtagtgcccaaaagattagacaaccactgagaacatatcagcagccagggcct

SEQ ID NO: 448405 - DNA, 140 bp, Artificial Sequence
  Synthetic
atacgccatgctgggtctccaaggatgcttgggagattctcaaatttctcattacaggtgtttttgacatcgtcaagggtcaaatacaggttgcttcagataacatcaaggattgtgtaacgtacttgggagtcggccat

SEQ ID NO: 448406 - DNA, 140 bp, Artificial Sequence
  Synthetic
atggccgactcccaagtacgttacacaatccttgatgttatctgaagcaacctgtatttgacccttgacgatgtcaaaaacacctgtaatgagaaatttgagaatctcccaagcatccttggagacccagcatggcgtat

SEQ ID NO: 448407 - DNA, 140 bp, Artificial Sequence
  Synthetic
aggccctggctgctgatatgcgtcaagggtcaaatacaggttgcttcagataacatcaaggattgtgtaaaatgcttcattgatgttgttaacaaggcactcgaaatgtgcattgatcaagaccttttgggacagcggtg

SEQ ID NO: 448408 - DNA, 140 bp, Artificial Sequence
  Synthetic
caccgctgtcccaaaaggtcttgatcaatgcacatttcgagtgccttgttaacaacatcaatgaagcattttacacaatccttgatgttatctgaagcaacctgtatttgacccttgacgcatatcagcagccagggcct

SEQ ID NO: 448409 - DNA, 140 bp, Artificial Sequence
  Synthetic
atacgccatgctgggtctccgtcactatcgctggcgcaaagttgcgatcactcaacttaggtgaagtcttcatcgctcaaagcaagggactttaccgtcagtgtatacgtggcaaggagccgtacttgggagtcggccat

SEQ ID NO: 448410 - DNA, 140 bp, Artificial Sequence
  Synthetic
atggccgactcccaagtacggctccttgccacgtatacactgacggtaaagtcccttgctttgagcgatgaagacttcacctaagttgagtgatcgcaactttgcgccagcgatagtgacggagacccagcatggcgtat

SEQ ID NO: 448411 - DNA, 140 bp, Artificial Sequence
  Synthetic
atacgccatgctgggtctccagctgcaactactcatgcctcttaaggcaccaaaagaagtaacctttcttgaaggtgattcacatgacacagtacttacctctgaggaggttgttctcaacgtacttgggagtcggccat

SEQ ID NO: 448412 - DNA, 140 bp, Artificial Sequence
  Synthetic
atggccgactcccaagtacgttgagaacaacctcctcagaggtaagtactgtgtcatgtgaatcaccttcaagaaaggttacttcttttggtgccttaagaggcatgagtagttgcagctggagacccagcatggcgtat

SEQ ID NO: 448413 - DNA, 140 bp, Artificial Sequence
  Synthetic
atacgccatgctgggtctccgaacggtgaactcgaagcactcgagacgcccgttgatagcttcacaaatggagctatcgttggcacaccagtctgtgtaaatggcctcatgctcttagagcgtacttgggagtcggccat

SEQ ID NO: 448414 - DNA, 140 bp, Artificial Sequence
  Synthetic
atggccgactcccaagtacgctctaagagcatgaggccatttacacagactggtgtgccaacgatagctccatttgtgaagctatcaacgggcgtctcgagtgcttcgagttcaccgttcggagacccagcatggcgtat

SEQ ID NO: 448415 - DNA, 140 bp, Artificial Sequence
  Synthetic
aggccctggctgctgatatggagctatcgttggcacaccagtctgtgtaaatggcctcatgctcttagagattaaggacaaagaacaatactgcgcattgtctcctggtttactggctacgaccttttgggacagcggtg

SEQ ID NO: 448416 - DNA, 140 bp, Artificial Sequence
  Synthetic
caccgctgtcccaaaaggtcgtagccagtaaaccaggagacaatgcgcagtattgttctttgtccttaatctctaagagcatgaggccatttacacagactggtgtgccaacgatagctccatatcagcagccagggcct

SEQ ID NO: 448417 - DNA, 140 bp, Artificial Sequence
  Synthetic
aggccctggctgctgatatgacatttgagcttgatgaacgtgttgacaaagtgcttaatgaaaagtgctctgtctacactgttgaatccggtaccgaagttactgagtttgcatgtgttggaccttttgggacagcggtg

SEQ ID NO: 448418 - DNA, 140 bp, Artificial Sequence
  Synthetic
caccgctgtcccaaaaggtccaacacatgcaaactcagtaacttcggtaccggattcaacagtgtagacagagcacttttcattaagcactttgtcaacacgttcatcaagctcaaatgtcatatcagcagccagggcct

SEQ ID NO: 448419 - DNA, 140 bp, Artificial Sequence
  Synthetic
aggccctggctgctgatatgtgtctacactgttgaatccggtaccgaagttactgagtttgcatgtgttgtagcagaggctgttgtgaagactttacaaccagtttctgatctccttaccgaccttttgggacagcggtg

SEQ ID NO: 448420 - DNA, 140 bp, Artificial Sequence
  Synthetic
caccgctgtcccaaaaggtcggtaaggagatcagaaactggttgtaaagtcttcacaacagcctctgctacaacacatgcaaactcagtaacttcggtaccggattcaacagtgtagacacatatcagcagccagggcct

SEQ ID NO: 448421 - DNA, 140 bp, Artificial Sequence
  Synthetic
atacgccatgctgggtctccaacatgggtattgatcttgatgagtggagtgtagctacattctacttatttgatgatgctggtgaagaaaacttttcatcacgtatgtattgttccttttcgtacttgggagtcggccat

SEQ ID NO: 448422 - DNA, 140 bp, Artificial Sequence
  Synthetic
atggccgactcccaagtacgaaaaggaacaatacatacgtgatgaaaagttttcttcaccagcatcatcaaataagtagaatgtagctacactccactcatcaagatcaatacccatgttggagacccagcatggcgtat

SEQ ID NO: 448423 - DNA, 140 bp, Artificial Sequence
  Synthetic
aggccctggctgctgatatgtgatgatgctggtgaagaaaacttttcatcacgtatgtattgttccttttaccctccagatgaggaagaagaggacgatgcagagtgtgaggaagaagaagaccttttgggacagcggtg

SEQ ID NO: 448424 - DNA, 140 bp, Artificial Sequence
  Synthetic
caccgctgtcccaaaaggtcttcttcttcctcacactctgcatcgtcctcttcttcctcatctggagggtaaaaggaacaatacatacgtgatgaaaagttttcttcaccagcatcatcacatatcagcagccagggcct

SEQ ID NO: 448425 - DNA, 140 bp, Artificial Sequence
  Synthetic
atacgccatgctgggtctccattgatgaaacctgtgaacatgagtacggtacagaggatgattatcaaggtctccctctggaatttggtgcctcagctgaaacagttcgagttgaggaagcgtacttgggagtcggccat

SEQ ID NO: 448426 - DNA, 140 bp, Artificial Sequence
  Synthetic
atggccgactcccaagtacgcttcctcaactcgaactgtttcagctgaggcaccaaattccagagggagaccttgataatcatcctctgtaccgtactcatgttcacaggtttcatcaatggagacccagcatggcgtat

SEQ ID NO: 448427 - DNA, 140 bp, Artificial Sequence
  Synthetic
aggccctggctgctgatatgtctccctctggaatttggtgcctcagctgaaacagttcgagttgaggaagaagaagaggaagactggctggatgatactactgagcaatcagagattgaggaccttttgggacagcggtg

SEQ ID NO: 448428 - DNA, 140 bp, Artificial Sequence
  Synthetic
caccgctgtcccaaaaggtcctcaatctctgattgctcagtagtatcatccagccagtcttcctcttcttcttcctcaactcgaactgtttcagctgaggcaccaaattccagagggagacatatcagcagccagggcct

SEQ ID NO: 448429 - DNA, 140 bp, Artificial Sequence
  Synthetic
atacgccatgctgggtctccccagaaccagaacctacacctgaagaaccagttaatcagtttactggttatttaaaacttactgacaatgttgccattaaatgtgttgacatcgttaaggcgtacttgggagtcggccat

SEQ ID NO: 448430 - DNA, 140 bp, Artificial Sequence
  Synthetic
atggccgactcccaagtacgccttaacgatgtcaacacatttaatggcaacattgtcagtaagttttaaataaccagtaaactgattaactggttcttcaggtgtaggttctggttctggggagacccagcatggcgtat

SEQ ID NO: 448431 - DNA, 140 bp, Artificial Sequence
  Synthetic
aggccctggctgctgatatgtttaaaacttactgacaatgttgccattaaatgtgttgacatcgttaaggaggcacaaagtgctaatcctatggtgattgtaaatgctgctaacatacacgaccttttgggacagcggtg

SEQ ID NO: 448432 - DNA, 140 bp, Artificial Sequence
  Synthetic
caccgctgtcccaaaaggtcgtgtatgttagcagcatttacaatcaccataggattagcactttgtgcctccttaacgatgtcaacacatttaatggcaacattgtcagtaagttttaaacatatcagcagccagggcct

SEQ ID NO: 448433 - DNA, 140 bp, Artificial Sequence
  Synthetic
atacgccatgctgggtctccctgaaacatggtggtggtgtagcaggtgcactcaacaaggcaaccaatggtgccatgcaaaaggagagtgatgattacattaagctaaatggccctcttacgtacttgggagtcggccat

SEQ ID NO: 448434 - DNA, 140 bp, Artificial Sequence
  Synthetic
atggccgactcccaagtacgtaagagggccatttagcttaatgtaatcatcactctccttttgcatggcaccattggttgccttgttgagtgcacctgctacaccaccaccatgtttcagggagacccagcatggcgtat

SEQ ID NO: 448435 - DNA, 140 bp, Artificial Sequence
  Synthetic
atacgccatgctgggtctcctcaccttcaatggttttgccatgtattctcctattgtgcctttttggataacagcaatctatgtattctgtatttctctgaagcactgccattggttcttcgtacttgggagtcggccat

SEQ ID NO: 448436 - DNA, 140 bp, Artificial Sequence
  Synthetic
atggccgactcccaagtacgaagaaccaatggcagtgcttcagagaaatacagaatacatagattgctgttatccaaaaaggcacaataggagaatacatggcaaaaccattgaaggtgaggagacccagcatggcgtat

SEQ ID NO: 448437 - DNA, 140 bp, Artificial Sequence
  Synthetic
aggccctggctgctgatatgagggactttaccgtcagtgtatacgtggcaaggagcagctgcaactactcatgcctcttaaggcaccaaaagaagtaacctttcttgaaggtgattcacagaccttttgggacagcggtg

SEQ ID NO: 448438 - DNA, 140 bp, Artificial Sequence
  Synthetic
caccgctgtcccaaaaggtctgtgaatcaccttcaagaaaggttacttcttttggtgccttaagaggcatgagtagttgcagctgctccttgccacgtatacactgacggtaaagtccctcatatcagcagccagggcct

SEQ ID NO: 448439 - DNA, 140 bp, Artificial Sequence
  Synthetic
atacgccatgctgggtctcctgttgtcagcaggcatatttggtgctaaaccacttcagtctttacaagtgtgcgtgcagacggttcgtacacaggtttatattgcagtcaatgacaaagccgtacttgggagtcggccat

SEQ ID NO: 448440 - DNA, 140 bp, Artificial Sequence
  Synthetic
atggccgactcccaagtacggctttgtcattgactgcaatataaacctgtgtacgaaccgtctgcacgcacacttgtaaagactgaagtggtttagcaccaaatatgcctgctgacaacaggagacccagcatggcgtat

SEQ ID NO: 448441 - DNA, 140 bp, Artificial Sequence
  Synthetic
aggccctggctgctgatatgggcctgcattgatgaggttaccacaacactggaagaaactaagtttcttaccaataagttactcttgtttgctgatatcaatggtaagctttaccatgatgaccttttgggacagcggtg

SEQ ID NO: 448442 - DNA, 140 bp, Artificial Sequence
  Synthetic
caccgctgtcccaaaaggtcatcatggtaaagcttaccattgatatcagcaaacaagagtaacttattggtaagaaacttagtttcttccagtgttgtggtaacctcatcaatgcaggcccatatcagcagccagggcct

SEQ ID NO: 448443 - DNA, 140 bp, Artificial Sequence
  Synthetic
aggccctggctgctgatatgccaataagttactcttgtttgctgatatcaatggtaagctttaccatgattctcagaacatgcttagaggtgaagatatgtctttccttgagaaggatgcgaccttttgggacagcggtg

SEQ ID NO: 448444 - DNA, 140 bp, Artificial Sequence
  Synthetic
caccgctgtcccaaaaggtcgcatccttctcaaggaaagacatatcttcacctctaagcatgttctgagaatcatggtaaagcttaccattgatatcagcaaacaagagtaacttattggcatatcagcagccagggcct

SEQ ID NO: 448445 - DNA, 140 bp, Artificial Sequence
  Synthetic
atacgccatgctgggtctccaccttacatggtaggtgatgttatcactagtggtgatatcacttgtgttgtaataccctccaaaaaggctggtggcactactgagatgctctcaagagctcgtacttgggagtcggccat

SEQ ID NO: 448446 - DNA, 140 bp, Artificial Sequence
  Synthetic
atggccgactcccaagtacgagctcttgagagcatctcagtagtgccaccagcctttttggagggtattacaacacaagtgatatcaccactagtgataacatcacctaccatgtaaggtggagacccagcatggcgtat

SEQ ID NO: 448447 - DNA, 140 bp, Artificial Sequence
  Synthetic
atacgccatgctgggtctccttgaagaaagtgccagttgatgagtatataaccacgtaccctggacaaggatgtgctggttatacacttgaggaagctaagactgctcttaagaaatgcacgtacttgggagtcggccat

SEQ ID NO: 448448 - DNA, 140 bp, Artificial Sequence
  Synthetic
atggccgactcccaagtacgtgcatttcttaagagcagtcttagcttcctcaagtgtataaccagcacatccttgtccagggtacgtggttatatactcatcaactggcactttcttcaaggagacccagcatggcgtat

SEQ ID NO: 448449 - DNA, 140 bp, Artificial Sequence
  Synthetic
aggccctggctgctgatatgattctaggaactgtatcctggaatttgagagaaatgcttgctcatgctgaagagacaagaaaattaatgcctatatgcatggatgttagagccataatgggaccttttgggacagcggtg

SEQ ID NO: 448450 - DNA, 140 bp, Artificial Sequence
  Synthetic
caccgctgtcccaaaaggtcccattatggctctaacatccatgcatataggcattaattttcttgtctcttcagcatgagcaagcatttctctcaaattccaggatacagttcctagaatcatatcagcagccagggcct

SEQ ID NO: 448451 - DNA, 140 bp, Artificial Sequence
  Synthetic
atacgccatgctgggtctcccaaccatccaacgtaagtataaaggaattaaaattcaagagggcatcgttgactatggtgtccgattcttcttttatactagtaaagagcctgtagcttccgtacttgggagtcggccat

SEQ ID NO: 448452 - DNA, 140 bp, Artificial Sequence
  Synthetic
atggccgactcccaagtacggaagctacaggctctttactagtataaaagaagaatcggacaccatagtcaacgatgccctcttgaattttaattcctttatacttacgttggatggttgggagacccagcatggcgtat

SEQ ID NO: 448453 - DNA, 140 bp, Artificial Sequence
  Synthetic
aggccctggctgctgatatggactatggtgtccgattcttcttttatactagtaaagagcctgtagcttctattattacgaagctgaactctctaaatgagccgcttgtcacaatgccaagaccttttgggacagcggtg

SEQ ID NO: 448454 - DNA, 140 bp, Artificial Sequence
  Synthetic
caccgctgtcccaaaaggtcttggcattgtgacaagcggctcatttagagagttcagcttcgtaataatagaagctacaggctctttactagtataaaagaagaatcggacaccatagtccatatcagcagccagggcct

SEQ ID NO: 448455 - DNA, 140 bp, Artificial Sequence
  Synthetic
atacgccatgctgggtctcctattattacgaagctgaactctctaaatgagccgcttgtcacaatgccaattggttatgtgacacatggttttaatcttgaagaggctgcgcgctgtatgcgtacttgggagtcggccat

SEQ ID NO: 448456 - DNA, 140 bp, Artificial Sequence
  Synthetic
atggccgactcccaagtacgcatacagcgcgcagcctcttcaagattaaaaccatgtgtcacataaccaattggcattgtgacaagcggctcatttagagagttcagcttcgtaataataggagacccagcatggcgtat

SEQ ID NO: 448457 - DNA, 140 bp, Artificial Sequence
  Synthetic
atacgccatgctgggtctcccgttctcttaaagctcctgccgtagtgtcagtatcatcaccagatgctgttactacatataatggatacctcacttcgtcatcaaagacatctgaggagccgtacttgggagtcggccat

SEQ ID NO: 448458 - DNA, 140 bp, Artificial Sequence
  Synthetic
atggccgactcccaagtacggctcctcagatgtctttgatgacgaagtgaggtatccattatatgtagtaacagcatctggtgatgatactgacactacggcaggagctttaagagaacgggagacccagcatggcgtat

SEQ ID NO: 448459 - DNA, 140 bp, Artificial Sequence
  Synthetic
aggccctggctgctgatatggtacaacactaggggtaatacttatagcactgcttggctttgtgctctaggaaaggttttaccttttcatagatggcacactatggttcaaacatgcacagaccttttgggacagcggtg

SEQ ID NO: 448460 - DNA, 140 bp, Artificial Sequence
  Synthetic
caccgctgtcccaaaaggtctgtgcatgtttgaaccatagtgtgccatctatgaaaaggtaaaacctttcctagagcacaaagccaagcagtgctataagtattacccctagtgttgtaccatatcagcagccagggcct

SEQ ID NO: 448461 - DNA, 140 bp, Artificial Sequence
  Synthetic
aggccctggctgctgatatggtctgataatggaccccaatcaaaccaacgtagtgccccccgcattacatttggtggacccacagattcaactgacaataaccagaatggaggacgcaatgaccttttgggacagcggtg

SEQ ID NO: 448462 - DNA, 140 bp, Artificial Sequence
  Synthetic
caccgctgtcccaaaaggtcattgcgtcctccattctggttattgtcagttgaatctgtgggtccaccaaatgtaatgcggggggcactacgttggtttgattggggtccattatcagaccatatcagcagccagggcct

SEQ ID NO: 448463 - DNA, 140 bp, Artificial Sequence
  Synthetic
aggccctggctgctgatatgaggttctttcacttgacaaactaaagagtctcttatccctgcgggaggttaagactataaaagtgttcacaactgtggacaacactaatctccacacacagaccttttgggacagcggtg

SEQ ID NO: 448464 - DNA, 140 bp, Artificial Sequence
  Synthetic
caccgctgtcccaaaaggtctgtgtgtggagattagtgttgtccacagttgtgaacacttttatagtcttaacctcccgcagggataagagactctttagtttgtcaagtgaaagaacctcatatcagcagccagggcct

SEQ ID NO: 448465 - DNA, 140 bp, Artificial Sequence
  Synthetic
aggccctggctgctgatatgaagactataaaagtgttcacaactgtggacaacactaatctccacacacagcttgtggatatgtctatgacatatggacagcagtttggtccaacatactgaccttttgggacagcggtg

SEQ ID NO: 448466 - DNA, 140 bp, Artificial Sequence
  Synthetic
caccgctgtcccaaaaggtcagtatgttggaccaaactgctgtccatatgtcatagacatatccacaagctgtgtgtggagattagtgttgtccacagttgtgaacacttttatagtcttcatatcagcagccagggcct

SEQ ID NO: 448467 - DNA, 140 bp, Artificial Sequence
  Synthetic
atacgccatgctgggtctcctggatggtgctgatgttacaaaaattaaacctcatgtaaatcatgagggtaagactttctttgtactacctagtgatgacacactacgtagtgaagctttcgtacttgggagtcggccat

SEQ ID NO: 448468 - DNA, 140 bp, Artificial Sequence
  Synthetic
atggccgactcccaagtacgaaagcttcactacgtagtgtgtcatcactaggtagtacaaagaaagtcttaccctcatgatttacatgaggtttaatttttgtaacatcagcaccatccaggagacccagcatggcgtat

SEQ ID NO: 448469 - DNA, 140 bp, Artificial Sequence
  Synthetic
atacgccatgctgggtctccacttcaacagcttgaagtcaaattcaatgcaccagcacttcaagaggcttattatagagcccgtgctggtgatgctgctaacttttgtgcactcatactccgtacttgggagtcggccat

SEQ ID NO: 448470 - DNA, 140 bp, Artificial Sequence
  Synthetic
atggccgactcccaagtacggagtatgagtgcacaaaagttagcagcatcaccagcacgggctctataataagcctcttgaagtgctggtgcattgaatttgacttcaagctgttgaagtggagacccagcatggcgtat

SEQ ID NO: 448471 - DNA, 140 bp, Artificial Sequence
  Synthetic
aggccctggctgctgatatgattatagagcccgtgctggtgatgctgctaacttttgtgcactcatactcgcttacagtaataaaactgttggcgagcttggtgatgtcagagaaactatgaccttttgggacagcggtg

SEQ ID NO: 448472 - DNA, 140 bp, Artificial Sequence
  Synthetic
caccgctgtcccaaaaggtcatagtttctctgacatcaccaagctcgccaacagttttattactgtaagcgagtatgagtgcacaaaagttagcagcatcaccagcacgggctctataatcatatcagcagccagggcct

SEQ ID NO: 448473 - DNA, 140 bp, Artificial Sequence
  Synthetic
atacgccatgctgggtctccgacccatcttctacagcatgctaatttggaatctgcaaagcgagttcttaatgtggtgtgtaaacattgtggtcagaaaactactaccttaacgggtgtacgtacttgggagtcggccat

SEQ ID NO: 448474 - DNA, 140 bp, Artificial Sequence
  Synthetic
atggccgactcccaagtacgtacacccgttaaggtagtagttttctgaccacaatgtttacacaccacattaagaactcgctttgcagattccaaattagcatgctgtagaagatgggtcggagacccagcatggcgtat

SEQ ID NO: 448475 - DNA, 140 bp, Artificial Sequence
  Synthetic
atacgccatgctgggtctccgaagctgtgatgtatatgggtactctatcttatgataatcttaagacaggtgtttccattccatgtgtgtgtggtcgtgatgctacacaatatctagtaccgtacttgggagtcggccat

SEQ ID NO: 448476 - DNA, 140 bp, Artificial Sequence
  Synthetic
atggccgactcccaagtacggtactagatattgtgtagcatcacgaccacacacacatggaatggaaacacctgtcttaagattatcataagatagagtacccatatacatcacagcttcggagacccagcatggcgtat

SEQ ID NO: 448477 - DNA, 140 bp, Artificial Sequence
  Synthetic
aggccctggctgctgatatgttacagcaaggtacattcttatgtgcgaatgagtacactggtaactatcagtgtggtcattacactcatataactgctaaggagaccctctatcgtattggaccttttgggacagcggtg

SEQ ID NO: 448478 - DNA, 140 bp, Artificial Sequence
  Synthetic
caccgctgtcccaaaaggtccaatacgatagagggtctccttagcagttatatgagtgtaatgaccacactgatagttaccagtgtactcattcgcacataagaatgtaccttgctgtaacatatcagcagccagggcct

SEQ ID NO: 448479 - DNA, 140 bp, Artificial Sequence
  Synthetic
aggccctggctgctgatatggtgtggtcattacactcatataactgctaaggagaccctctatcgtattgacggagctcaccttacaaagatgtcagagtacaaaggaccagtgactgatgaccttttgggacagcggtg

SEQ ID NO: 448480 - DNA, 140 bp, Artificial Sequence
  Synthetic
caccgctgtcccaaaaggtcatcagtcactggtcctttgtactctgacatctttgtaaggtgagctccgtcaatacgatagagggtctccttagcagttatatgagtgtaatgaccacaccatatcagcagccagggcct

SEQ ID NO: 448481 - DNA, 140 bp, Artificial Sequence
  Synthetic
atacgccatgctgggtctccgttttctacaaggaaacatcttacactacaaccatcaagcctgtgtcgtataaactcgatggagttacttacacagagattgaaccaaaattggatgggtcgtacttgggagtcggccat

SEQ ID NO: 448482 - DNA, 140 bp, Artificial Sequence
  Synthetic
atggccgactcccaagtacgacccatccaattttggttcaatctctgtgtaagtaactccatcgagtttatacgacacaggcttgatggttgtagtgtaagatgtttccttgtagaaaacggagacccagcatggcgtat

SEQ ID NO: 448483 - DNA, 140 bp, Artificial Sequence
  Synthetic
aggccctggctgctgatatgtaaactcgatggagttacttacacagagattgaaccaaaattggatgggtattataaaaaggataatgcttactatacagagcagcctatagaccttgtagaccttttgggacagcggtg

SEQ ID NO: 448484 - DNA, 140 bp, Artificial Sequence
  Synthetic
caccgctgtcccaaaaggtctacaaggtctataggctgctctgtatagtaagcattatcctttttataatacccatccaattttggttcaatctctgtgtaagtaactccatcgagtttacatatcagcagccagggcct

SEQ ID NO: 448485 - DNA, 140 bp, Artificial Sequence
  Synthetic
atacgccatgctgggtctccccaactcaaccattaccaaatgcgagttttgataatttcaaactcacatgttctaacacaaaatttgctgatgatttaaatcaaatgacaggcttcacaacgtacttgggagtcggccat

SEQ ID NO: 448486 - DNA, 140 bp, Artificial Sequence
  Synthetic
atggccgactcccaagtacgttgtgaagcctgtcatttgatttaaatcatcagcaaattttgtgttagaacatgtgagtttgaaattatcaaaactcgcatttggtaatggttgagttggggagacccagcatggcgtat

SEQ ID NO: 448487 - DNA, 140 bp, Artificial Sequence
  Synthetic
aggccctggctgctgatatgttctaacacaaaatttgctgatgatttaaatcaaatgacaggcttcacaaagccagcttcacgagagctatctgtcacattcttcccagacttgaatggcgaccttttgggacagcggtg

SEQ ID NO: 448488 - DNA, 140 bp, Artificial Sequence
  Synthetic
caccgctgtcccaaaaggtcgccattcaagtctgggaagaatgtgacagatagctctcgtgaagctggctttgtgaagcctgtcatttgatttaaatcatcagcaaattttgtgttagaacatatcagcagccagggcct

SEQ ID NO: 448489 - DNA, 140 bp, Artificial Sequence
  Synthetic
aggccctggctgctgatatggatgtagtggctattgactatagacactattcagcgagtttcaagaaaggtgctaaattactgcataagccaattgtttggcacattaaccaggctacaagaccttttgggacagcggtg

SEQ ID NO: 448490 - DNA, 140 bp, Artificial Sequence
  Synthetic
caccgctgtcccaaaaggtcttgtagcctggttaatgtgccaaacaattggcttatgcagtaatttagcacctttcttgaaactcgctgaatagtgtctatagtcaatagccactacatccatatcagcagccagggcct

SEQ ID NO: 448491 - DNA, 140 bp, Artificial Sequence
  Synthetic
aggccctggctgctgatatgcacacaaggaatggacaatcttgcttgtgaaagtcaacaacccacctctgaagaagtagtggaaaatcctaccatacagaaggaagtcatagagtgtgacgaccttttgggacagcggtg

SEQ ID NO: 448492 - DNA, 140 bp, Artificial Sequence
  Synthetic
caccgctgtcccaaaaggtcgtcacactctatgacttccttctgtatggtaggattttccactacttcttcagaggtgggttgttgactttcacaagcaagattgtccattccttgtgtgcatatcagcagccagggcct

SEQ ID NO: 448493 - DNA, 140 bp, Artificial Sequence
  Synthetic
atacgccatgctgggtctccgtgaaaactaccgaagttgtaggcaatgtcatacttaaaccatcagatgaaggtgttaaagtaacacaagagttaggtcatgaggatcttatggctgcttcgtacttgggagtcggccat

SEQ ID NO: 448494 - DNA, 140 bp, Artificial Sequence
  Synthetic
atggccgactcccaagtacgaagcagccataagatcctcatgacctaactcttgtgttactttaacaccttcatctgatggtttaagtatgacattgcctacaacttcggtagttttcacggagacccagcatggcgtat

SEQ ID NO: 448495 - DNA, 140 bp, Artificial Sequence
  Synthetic
aggccctggctgctgatatgaggtgttaaagtaacacaagagttaggtcatgaggatcttatggctgcttatgtggaaaacacaagcattaccattaagaaacctaatgagctttcactagaccttttgggacagcggtg

SEQ ID NO: 448496 - DNA, 140 bp, Artificial Sequence
  Synthetic
caccgctgtcccaaaaggtctagtgaaagctcattaggtttcttaatggtaatgcttgtgttttccacataagcagccataagatcctcatgacctaactcttgtgttactttaacacctcatatcagcagccagggcct

SEQ ID NO: 448497 - DNA, 140 bp, Artificial Sequence
  Synthetic
atacgccatgctgggtctccatgtggaaaacacaagcattaccattaagaaacctaatgagctttcactagccttaggtttaaaaacaattgccactcatggtattgctgcaattaatagcgtacttgggagtcggccat

SEQ ID NO: 448498 - DNA, 140 bp, Artificial Sequence
  Synthetic
atggccgactcccaagtacgctattaattgcagcaataccatgagtggcaattgtttttaaacctaaggctagtgaaagctcattaggtttcttaatggtaatgcttgtgttttccacatggagacccagcatggcgtat

SEQ ID NO: 448499 - DNA, 140 bp, Artificial Sequence
  Synthetic
aggccctggctgctgatatggccttaggtttaaaaacaattgccactcatggtattgctgcaattaatagtgttccttggagtaaaattttggcttatgtcaaaccattcttaggacaaggaccttttgggacagcggtg

SEQ ID NO: 448500 - DNA, 140 bp, Artificial Sequence
  Synthetic
caccgctgtcccaaaaggtccttgtcctaagaatggtttgacataagccaaaattttactccaaggaacactattaattgcagcaataccatgagtggcaattgtttttaaacctaaggccatatcagcagccagggcct

SEQ ID NO: 448501 - DNA, 140 bp, Artificial Sequence
  Synthetic
atacgccatgctgggtctcccagcaattacaacatcaaattgcgctaagagattagcacaacgtgtgtttaacaattatatgccttatgtgtttacattattgttccaattgtgtactttcgtacttgggagtcggccat

SEQ ID NO: 448502 - DNA, 140 bp, Artificial Sequence
  Synthetic
atggccgactcccaagtacgaaagtacacaattggaacaataatgtaaacacataaggcatataattgttaaacacacgttgtgctaatctcttagcgcaatttgatgttgtaattgctgggagacccagcatggcgtat

SEQ ID NO: 448503 - DNA, 140 bp, Artificial Sequence
  Synthetic
aggccctggctgctgatatgaacaattatatgccttatgtgtttacattattgttccaattgtgtacttttactaaaagtaccaattctagaattagagcttcactacctacaactattggaccttttgggacagcggtg

SEQ ID NO: 448504 - DNA, 140 bp, Artificial Sequence
  Synthetic
caccgctgtcccaaaaggtccaatagttgtaggtagtgaagctctaattctagaattggtacttttagtaaaagtacacaattggaacaataatgtaaacacataaggcatataattgttcatatcagcagccagggcct

SEQ ID NO: 448505 - DNA, 140 bp, Artificial Sequence
  Synthetic
atacgccatgctgggtctccctaaaaatagtgttaagagtgttgctaaattatgtttggatgccggcattaattatgtgaagtcacccaaattttctaaattgttcacaatcgctatgtgcgtacttgggagtcggccat

SEQ ID NO: 448506 - DNA, 140 bp, Artificial Sequence
  Synthetic
atggccgactcccaagtacgcacatagcgattgtgaacaatttagaaaatttgggtgacttcacataattaatgccggcatccaaacataatttagcaacactcttaacactatttttagggagacccagcatggcgtat

SEQ ID NO: 448507 - DNA, 140 bp, Artificial Sequence
  Synthetic
atacgccatgctgggtctccgttagagaattgtatcttaattcgtctaacgttactactatggatttctgtgaaggttcttttccttgcagcatttgtttaagtggattagactcccttgcgtacttgggagtcggccat

SEQ ID NO: 448508 - DNA, 140 bp, Artificial Sequence
  Synthetic
atggccgactcccaagtacgcaagggagtctaatccacttaaacaaatgctgcaaggaaaagaaccttcacagaaatccatagtagtaacgttagacgaattaagatacaattctctaacggagacccagcatggcgtat

SEQ ID NO: 448509 - DNA, 140 bp, Artificial Sequence
  Synthetic
aggccctggctgctgatatgtgaaggttcttttccttgcagcatttgtttaagtggattagactcccttgattcttatccagctcttgaaaccattcaggtgacgatttcatcgtacaaggaccttttgggacagcggtg

SEQ ID NO: 448510 - DNA, 140 bp, Artificial Sequence
  Synthetic
caccgctgtcccaaaaggtccttgtacgatgaaatcgtcacctgaatggtttcaagagctggataagaatcaagggagtctaatccacttaaacaaatgctgcaaggaaaagaaccttcacatatcagcagccagggcct

SEQ ID NO: 448511 - DNA, 140 bp, Artificial Sequence
  Synthetic
atacgccatgctgggtctccctagacttgacaattttaggtctggccgctgagtgggttttggcatatatgttgttcacaaaattcttttatttattaggtctttcagctataatgcaggcgtacttgggagtcggccat

SEQ ID NO: 448512 - DNA, 140 bp, Artificial Sequence
  Synthetic
atggccgactcccaagtacgcctgcattatagctgaaagacctaataaataaaagaattttgtgaacaacatatatgccaaaacccactcagcggccagacctaaaattgtcaagtctagggagacccagcatggcgtat

SEQ ID NO: 448513 - DNA, 140 bp, Artificial Sequence
  Synthetic
aggccctggctgctgatatggttgttcacaaaattcttttatttattaggtctttcagctataatgcaggtgttctttggctattttgctagtcatttcatcagcaattcttggctcatggaccttttgggacagcggtg

SEQ ID NO: 448514 - DNA, 140 bp, Artificial Sequence
  Synthetic
caccgctgtcccaaaaggtccatgagccaagaattgctgatgaaatgactagcaaaatagccaaagaacacctgcattatagctgaaagacctaataaataaaagaattttgtgaacaaccatatcagcagccagggcct

SEQ ID NO: 448515 - DNA, 140 bp, Artificial Sequence
  Synthetic
atacgccatgctgggtctcctggtttatcattagtattgtacaaatggcacccgtttctgcaatggttaggatgtacatcttctttgcttctttctactacatatggaagagctatgttccgtacttgggagtcggccat

SEQ ID NO: 448516 - DNA, 140 bp, Artificial Sequence
  Synthetic
atggccgactcccaagtacggaacatagctcttccatatgtagtagaaagaagcaaagaagatgtacatcctaaccattgcagaaacgggtgccatttgtacaatactaatgataaaccaggagacccagcatggcgtat

SEQ ID NO: 448517 - DNA, 140 bp, Artificial Sequence
  Synthetic
aggccctggctgctgatatggatgtacatcttctttgcttctttctactacatatggaagagctatgttcatatcatggatggttgcacctcttcgacttgcatgatgtgctataagcgcgaccttttgggacagcggtg

SEQ ID NO: 448518 - DNA, 140 bp, Artificial Sequence
  Synthetic
caccgctgtcccaaaaggtcgcgcttatagcacatcatgcaagtcgaagaggtgcaaccatccatgatatgaacatagctcttccatatgtagtagaaagaagcaaagaagatgtacatccatatcagcagccagggcct

SEQ ID NO: 448519 - DNA, 140 bp, Artificial Sequence
  Synthetic
atacgccatgctgggtctccaatcgtgccacacgcgttgagtgtacaactattgttaatggcatgaagagatctttctatgtctatgcaaatggaggccgtggcttctgcaagactcacacgtacttgggagtcggccat

SEQ ID NO: 448520 - DNA, 140 bp, Artificial Sequence
  Synthetic
atggccgactcccaagtacgtgtgagtcttgcagaagccacggcctccatttgcatagacatagaaagatctcttcatgccattaacaatagttgtacactcaacgcgtgtggcacgattggagacccagcatggcgtat

SEQ ID NO: 448521 - DNA, 140 bp, Artificial Sequence
  Synthetic
atacgccatgctgggtctccctattataggagatgaactgagggttaattctgcttgcagaaaagtacaacacatggttgtgaagtctgcattgcttgctgataagtttccagttcttcacgtacttgggagtcggccat

SEQ ID NO: 448522 - DNA, 140 bp, Artificial Sequence
  Synthetic
atggccgactcccaagtacgtgaagaactggaaacttatcagcaagcaatgcagacttcacaaccatgtgttgtacttttctgcaagcagaattaaccctcagttcatctcctataatagggagacccagcatggcgtat

SEQ ID NO: 448523 - DNA, 140 bp, Artificial Sequence
  Synthetic
aggccctggctgctgatatggcgacgagtctgcttctaagtctgcttctgtgtactacagtcagctgatgtgccaacctattctgttgcttgaccaagctcttgtatcagacgttggagagaccttttgggacagcggtg

SEQ ID NO: 448524 - DNA, 140 bp, Artificial Sequence
  Synthetic
caccgctgtcccaaaaggtctctccaacgtctgatacaagagcttggtcaagcaacagaataggttggcacatcagctgactgtagtacacagaagcagacttagaagcagactcgtcgccatatcagcagccagggcct

SEQ ID NO: 448525 - DNA, 140 bp, Artificial Sequence
  Synthetic
aggccctggctgctgatatgtgccaacctattctgttgcttgaccaagctcttgtatcagacgttggagatagtactgaagtttccgttaagatgtttgatgcttatgtcgacaccttttgaccttttgggacagcggtg

SEQ ID NO: 448526 - DNA, 140 bp, Artificial Sequence
  Synthetic
caccgctgtcccaaaaggtcaaaaggtgtcgacataagcatcaaacatcttaacggaaacttcagtactatctccaacgtctgatacaagagcttggtcaagcaacagaataggttggcacatatcagcagccagggcct

SEQ ID NO: 448527 - DNA, 140 bp, Artificial Sequence
  Synthetic
atacgccatgctgggtctccattcgtgtcagctgcccgacaaggtgttgttgataccgatgttgacacaaaggatgttattgaatgtctcaaactttcacatcactctgacttagaagtgcgtacttgggagtcggccat

SEQ ID NO: 448528 - DNA, 140 bp, Artificial Sequence
  Synthetic
atggccgactcccaagtacgcacttctaagtcagagtgatgtgaaagtttgagacattcaataacatcctttgtgtcaacatcggtatcaacaacaccttgtcgggcagctgacacgaatggagacccagcatggcgtat

SEQ ID NO: 448529 - DNA, 140 bp, Artificial Sequence
  Synthetic
atacgccatgctgggtctcctttgatacttataacctgtggaatacatttaccaggttacagagtttagaaaatgtggcttataatgttgttaataaaggacactttgatggacacgccgcgtacttgggagtcggccat

SEQ ID NO: 448530 - DNA, 140 bp, Artificial Sequence
  Synthetic
atggccgactcccaagtacgcggcgtgtccatcaaagtgtcctttattaacaacattataagccacattttctaaactctgtaacctggtaaatgtattccacaggttataagtatcaaaggagacccagcatggcgtat

SEQ ID NO: 448531 - DNA, 140 bp, Artificial Sequence
  Synthetic
atacgccatgctgggtctcccatgacgcccagagatcttggcgcatgtattgactgtaatgcaaggcatatcaatgcccaagtagcaaaaagtcacaatgtttcactcatctggaatgtacgtacttgggagtcggccat

SEQ ID NO: 448532 - DNA, 140 bp, Artificial Sequence
  Synthetic
atggccgactcccaagtacgtacattccagatgagtgaaacattgtgactttttgctacttgggcattgatatgccttgcattacagtcaatacatgcgccaagatctctgggcgtcatgggagacccagcatggcgtat

SEQ ID NO: 448533 - DNA, 140 bp, Artificial Sequence
  Synthetic
aggccctggctgctgatatgtcaatgcccaagtagcaaaaagtcacaatgtttcactcatctggaatgtaaaagactacatgtctttatctgaacagctgcgtaaacaaattcgtagtgcgaccttttgggacagcggtg

SEQ ID NO: 448534 - DNA, 140 bp, Artificial Sequence
  Synthetic
caccgctgtcccaaaaggtcgcactacgaatttgtttacgcagctgttcagataaagacatgtagtcttttacattccagatgagtgaaacattgtgactttttgctacttgggcattgacatatcagcagccagggcct

SEQ ID NO: 448535 - DNA, 140 bp, Artificial Sequence
  Synthetic
atacgccatgctgggtctcctgccaagaagaacaacataccttttagactaacttgtgctacaactagacaggttgtcaatgtcataactactaaaatctcactcaagggtggtaagattcgtacttgggagtcggccat

SEQ ID NO: 448536 - DNA, 140 bp, Artificial Sequence
  Synthetic
atggccgactcccaagtacgaatcttaccacccttgagtgagattttagtagttatgacattgacaacctgtctagttgtagcacaagttagtctaaaaggtatgttgttcttcttggcaggagacccagcatggcgtat

SEQ ID NO: 448537 - DNA, 140 bp, Artificial Sequence
  Synthetic
aggccctggctgctgatatgaggttgtcaatgtcataactactaaaatctcactcaagggtggtaagattgttagtacttgttttaaacttatgcttaaggccacattattgtgcgttctgaccttttgggacagcggtg

SEQ ID NO: 448538 - DNA, 140 bp, Artificial Sequence
  Synthetic
caccgctgtcccaaaaggtcagaacgcacaataatgtggccttaagcataagtttaaaacaagtactaacaatcttaccacccttgagtgagattttagtagttatgacattgacaacctcatatcagcagccagggcct

SEQ ID NO: 448539 - DNA, 140 bp, Artificial Sequence
  Synthetic
atacgccatgctgggtctccccctgattatggtacctacaagaacacttgtgatggtaacacctttacatatgcatctgcactctgggaaatccagcaagttgttgatgcggatagcaagcgtacttgggagtcggccat

SEQ ID NO: 448540 - DNA, 140 bp, Artificial Sequence
  Synthetic
atggccgactcccaagtacgcttgctatccgcatcaacaacttgctggatttcccagagtgcagatgcatatgtaaaggtgttaccatcacaagtgttcttgtaggtaccataatcagggggagacccagcatggcgtat

SEQ ID NO: 448541 - DNA, 140 bp, Artificial Sequence
  Synthetic
atacgccatgctgggtctccgtcactcgtgacatcatttctactgatgattgttttgcaaataaacatgctggttttgacgcatggtttagccagcgtggtggttcatacaaaaatgacacgtacttgggagtcggccat

SEQ ID NO: 448542 - DNA, 140 bp, Artificial Sequence
  Synthetic
atggccgactcccaagtacgtgtcatttttgtatgaaccaccacgctggctaaaccatgcgtcaaaaccagcatgtttatttgcaaaacaatcatcagtagaaatgatgtcacgagtgacggagacccagcatggcgtat

SEQ ID NO: 448543 - DNA, 140 bp, Artificial Sequence
  Synthetic
aggccctggctgctgatatgtggttttgacgcatggtttagccagcgtggtggttcatacaaaaatgacaaaagctgccctgtagtagctgctatcattacaagagagattggtttcatagaccttttgggacagcggtg

SEQ ID NO: 448544 - DNA, 140 bp, Artificial Sequence
  Synthetic
caccgctgtcccaaaaggtctatgaaaccaatctctcttgtaatgatagcagctactacagggcagcttttgtcatttttgtatgaaccaccacgctggctaaaccatgcgtcaaaaccacatatcagcagccagggcct

SEQ ID NO: 448545 - DNA, 140 bp, Artificial Sequence
  Synthetic
atacgccatgctgggtctccgtgcctggcttaccgggtactgtgctgagagcaatcaatggtgacttcttgcattttctacctcgtgtttttagtgctgttggcaacatttgctacacaccgtacttgggagtcggccat

SEQ ID NO: 448546 - DNA, 140 bp, Artificial Sequence
  Synthetic
atggccgactcccaagtacggtgtgtagcaaatgttgccaacagcactaaaaacacgaggtagaaaatgcaagaagtcaccattgattgctctcagcacagtacccggtaagccaggcacggagacccagcatggcgtat

SEQ ID NO: 448547 - DNA, 140 bp, Artificial Sequence
  Synthetic
aggccctggctgctgatatggcattttctacctcgtgtttttagtgctgttggcaacatttgctacacaccttccaaactcattgagtatagtgattttgctacctctgcttgcgttcttgaccttttgggacagcggtg

SEQ ID NO: 448548 - DNA, 140 bp, Artificial Sequence
  Synthetic
caccgctgtcccaaaaggtcaagaacgcaagcagaggtagcaaaatcactatactcaatgagtttggaaggtgtgtagcaaatgttgccaacagcactaaaaacacgaggtagaaaatgccatatcagcagccagggcct

SEQ ID NO: 448549 - DNA, 140 bp, Artificial Sequence
  Synthetic
atacgccatgctgggtctccgctgctgagtgtacaatttttaaggatgctatgggcaaacctgtgccatattgttatgacactaatttgctagagggttctatttcttatagtgagcttccgtacttgggagtcggccat

SEQ ID NO: 448550 - DNA, 140 bp, Artificial Sequence
  Synthetic
atggccgactcccaagtacggaagctcactataagaaatagaaccctctagcaaattagtgtcataacaatatggcacaggtttgcccatagcatccttaaaaattgtacactcagcagcggagacccagcatggcgtat

SEQ ID NO: 448551 - DNA, 140 bp, Artificial Sequence
  Synthetic
atacgccatgctgggtctccgtccagacactcgttatgtgcttatggatggttccatcatacagtttcctaacacttacctggagggttctgttagagtagtaacaacttttgatgctgacgtacttgggagtcggccat

SEQ ID NO: 448552 - DNA, 140 bp, Artificial Sequence
  Synthetic
atggccgactcccaagtacgtcagcatcaaaagttgttactactctaacagaaccctccaggtaagtgttaggaaactgtatgatggaaccatccataagcacataacgagtgtctggacggagacccagcatggcgtat

SEQ ID NO: 448553 - DNA, 140 bp, Artificial Sequence
  Synthetic
atacgccatgctgggtctccgtactgtagacatggtacatgcgaaaggtcagaagtaggtatttgcctatctaccagtggtagatgggttcttaataatgagcattacagagctctatcacgtacttgggagtcggccat

SEQ ID NO: 448554 - DNA, 140 bp, Artificial Sequence
  Synthetic
atggccgactcccaagtacgtgatagagctctgtaatgctcattattaagaacccatctaccactggtagataggcaaatacctacttctgacctttcgcatgtaccatgtctacagtacggagacccagcatggcgtat

SEQ ID NO: 448555 - DNA, 140 bp, Artificial Sequence
  Synthetic
atacgccatgctgggtctccctggtggtattattgccatattggtgacttgtgctgcctactactttatgaaattcagacgtgtttttggtgagtacaaccatgttgttgctgctaatgccgtacttgggagtcggccat

SEQ ID NO: 448556 - DNA, 140 bp, Artificial Sequence
  Synthetic
atggccgactcccaagtacggcattagcagcaacaacatggttgtactcaccaaaaacacgtctgaatttcataaagtagtaggcagcacaagtcaccaatatggcaataataccaccagggagacccagcatggcgtat

SEQ ID NO: 448557 - DNA, 140 bp, Artificial Sequence
  Synthetic
aggccctggctgctgatatgatgtctgataatggaccccaatcaaaccaacgtagtgccccccgcattacatttggtggacccacagattcaactgacaacaaccagaatggaggacgcagaccttttgggacagcggtg

SEQ ID NO: 448558 - DNA, 140 bp, Artificial Sequence
  Synthetic
caccgctgtcccaaaaggtctgcgtcctccattctggttgttgtcagttgaatctgtgggtccaccaaatgtaatgcggggggcactacgttggtttgattggggtccattatcagacatcatatcagcagccagggcct

SEQ ID NO: 448559 - DNA, 140 bp, Artificial Sequence
  Synthetic
aggccctggctgctgatatgttcaccaatgatgtttcattcttggctcaccttcaatggtttgccatgttttctcctattgtgcctttttggataacagcaatctatgtattctgtatttgaccttttgggacagcggtg

SEQ ID NO: 448560 - DNA, 140 bp, Artificial Sequence
  Synthetic
caccgctgtcccaaaaggtcaaatacagaatacatagattgctgttatccaaaaaggcacaataggagaaaacatggcaaaccattgaaggtgagccaagaatgaaacatcattggtgaacatatcagcagccagggcct

SEQ ID NO: 448561 - DNA, 140 bp, Artificial Sequence
  Synthetic
atacgccatgctgggtctccttctcctattgtgcctttttggataacagcaatctatgtattctgtatttctctgaagcactgccattggttctttaacaactatcttaggaaaagagtccgtacttgggagtcggccat

SEQ ID NO: 448562 - DNA, 140 bp, Artificial Sequence
  Synthetic
atggccgactcccaagtacggactcttttcctaagatagttgttaaagaaccaatggcagtgcttcagagaaatacagaatacatagattgctgttatccaaaaaggcacaataggagaaggagacccagcatggcgtat

SEQ ID NO: 448563 - DNA, 140 bp, Artificial Sequence
  Synthetic
atacgccatgctgggtctccatgtttaatggagttacatttagtaccttcgaggaggctgctttgtgtacctttttgctcaacaaggaaatgtacctaaaattgcgtagcgagacactgtcgtacttgggagtcggccat

SEQ ID NO: 448564 - DNA, 140 bp, Artificial Sequence
  Synthetic
atggccgactcccaagtacgacagtgtctcgctacgcaattttaggtacatttccttgttgagcaaaaaggtacacaaagcagcctcctcgaaggtactaaatgtaactccattaaacatggagacccagcatggcgtat

SEQ ID NO: 448565 - DNA, 140 bp, Artificial Sequence
  Synthetic
aggccctggctgctgatatgctttttgctcaacaaggaaatgtacctaaaattgcgtagcgagacactgttgccacttacacagtataacaggtatcttgctctatataacaagtacaaggaccttttgggacagcggtg

SEQ ID NO: 448566 - DNA, 140 bp, Artificial Sequence
  Synthetic
caccgctgtcccaaaaggtccttgtacttgttatatagagcaagatacctgttatactgtgtaagtggcaacagtgtctcgctacgcaattttaggtacatttccttgttgagcaaaaagcatatcagcagccagggcct

SEQ ID NO: 448567 - DNA, 140 bp, Artificial Sequence
  Synthetic
atacgccatgctgggtctcctatttcagtggagccttagatactaccagctatcgtgaagcagcttgctgccacttagcaaaggctctaaatgactttagcaactcaggtgctgatgttccgtacttgggagtcggccat

SEQ ID NO: 448568 - DNA, 140 bp, Artificial Sequence
  Synthetic
atggccgactcccaagtacggaacatcagcacctgagttgctaaagtcatttagagcctttgctaagtggcagcaagctgcttcacgatagctggtagtatctaaggctccactgaaataggagacccagcatggcgtat

SEQ ID NO: 448569 - DNA, 140 bp, Artificial Sequence
  Synthetic
aggccctggctgctgatatgccacttagcaaaggctctaaatgactttagcaactcaggtgctgatgttctctaccaaccaccacagacatcaatcacttctgctgttctgcagagtggtgaccttttgggacagcggtg

SEQ ID NO: 448570 - DNA, 140 bp, Artificial Sequence
  Synthetic
caccgctgtcccaaaaggtcaccactctgcagaacagcagaagtgattgatgtctgtggtggttggtagagaacatcagcacctgagttgctaaagtcatttagagcctttgctaagtggcatatcagcagccagggcct

SEQ ID NO: 448571 - DNA, 140 bp, Artificial Sequence
  Synthetic
atacgccatgctgggtctcctttaggaaaatggcattcccgtcaggcaaagttgaagggtgcatggtacaagtaacctgtggaactacaactcttaatggattgtggttggatgacacagcgtacttgggagtcggccat

SEQ ID NO: 448572 - DNA, 140 bp, Artificial Sequence
  Synthetic
atggccgactcccaagtacgctgtgtcatccaaccacaatccattaagagttgtagttccacaggttacttgtaccatgcacccttcaactttgcctgacgggaatgccattttcctaaaggagacccagcatggcgtat

SEQ ID NO: 448573 - DNA, 140 bp, Artificial Sequence
  Synthetic
aggccctggctgctgatatgagtaacctgtggaactacaactcttaatggattgtggttggatgacacagtatactgtccaagacatgtcatttgcacagcagaagacatgcttaatcctgaccttttgggacagcggtg

SEQ ID NO: 448574 - DNA, 140 bp, Artificial Sequence
  Synthetic
caccgctgtcccaaaaggtcaggattaagcatgtcttctgctgtgcaaatgacatgtcttggacagtatactgtgtcatccaaccacaatccattaagagttgtagttccacaggttactcatatcagcagccagggcct

SEQ ID NO: 448575 - DNA, 140 bp, Artificial Sequence
  Synthetic
atacgccatgctgggtctccaactatgaagatctgctcattcgcaaatccaaccatagctttcttgttcaggctggcaatgttcaacttcgtgttattggccattctatgcaaaattgtccgtacttgggagtcggccat

SEQ ID NO: 448576 - DNA, 140 bp, Artificial Sequence
  Synthetic
atggccgactcccaagtacggacaattttgcatagaatggccaataacacgaagttgaacattgccagcctgaacaagaaagctatggttggatttgcgaatgagcagatcttcatagttggagacccagcatggcgtat

SEQ ID NO: 448577 - DNA, 140 bp, Artificial Sequence
  Synthetic
aggccctggctgctgatatgggctggcaatgttcaacttcgtgttattggccattctatgcaaaattgtctgcttaggcttaaagttgatacttctaaccctaagacacccaagtataaagaccttttgggacagcggtg

SEQ ID NO: 448578 - DNA, 140 bp, Artificial Sequence
  Synthetic
caccgctgtcccaaaaggtctttatacttgggtgtcttagggttagaagtatcaactttaagcctaagcagacaattttgcatagaatggccaataacacgaagttgaacattgccagcccatatcagcagccagggcct

SEQ ID NO: 448579 - DNA, 140 bp, Artificial Sequence
  Synthetic
atacgccatgctgggtctcctttgtccgtatccaacctggtcaaacattttcagttctagcatgctacaatggttcaccatctggtgtttatcagtgtgccatgagacctaatcataccacgtacttgggagtcggccat

SEQ ID NO: 448580 - DNA, 140 bp, Artificial Sequence
  Synthetic
atggccgactcccaagtacgtggtatgattaggtctcatggcacactgataaacaccagatggtgaaccattgtagcatgctagaactgaaaatgtttgaccaggttggatacggacaaaggagacccagcatggcgtat

SEQ ID NO: 448581 - DNA, 140 bp, Artificial Sequence
  Synthetic
aggccctggctgctgatatgtggttcaccatctggtgtttatcagtgtgccatgagacctaatcataccattaaaggttctttccttaatggatcatgtggtagtgttggttttaacattgaccttttgggacagcggtg

SEQ ID NO: 448582 - DNA, 140 bp, Artificial Sequence
  Synthetic
caccgctgtcccaaaaggtcaatgttaaaaccaacactaccacatgatccattaaggaaagaacctttaatggtatgattaggtctcatggcacactgataaacaccagatggtgaaccacatatcagcagccagggcct

SEQ ID NO: 448583 - DNA, 140 bp, Artificial Sequence
  Synthetic
atacgccatgctgggtctccgattatgattgcgtgtctttctgctatatgcatcatatggagcttccaacaggagtacacgctggtactgacttagaaggtaaattctatggtccatttgcgtacttgggagtcggccat

SEQ ID NO: 448584 - DNA, 140 bp, Artificial Sequence
  Synthetic
atggccgactcccaagtacgcaaatggaccatagaatttaccttctaagtcagtaccagcgtgtactcctgttggaagctccatatgatgcatatagcagaaagacacgcaatcataatcggagacccagcatggcgtat

SEQ ID NO: 448585 - DNA, 140 bp, Artificial Sequence
  Synthetic
atacgccatgctgggtctccagagctgctgcagaatggtatgaatggtcgtactatccttggtagcactattttagaagatgagtttacaccatttgatgttgttagacaatgctctggtcgtacttgggagtcggccat

SEQ ID NO: 448586 - DNA, 140 bp, Artificial Sequence
  Synthetic
atggccgactcccaagtacgaccagagcattgtctaacaacatcaaatggtgtaaactcatcttctaaaatagtgctaccaaggatagtacgaccattcataccattctgcagcagctctggagacccagcatggcgtat

SEQ ID NO: 448587 - DNA, 140 bp, Artificial Sequence
  Synthetic
aggccctggctgctgatatgttttagaagatgagtttacaccatttgatgttgttagacaatgctctggtgttaccttccaaggtaagttcaagaaaattgttaagggcactcatcattggaccttttgggacagcggtg

SEQ ID NO: 448588 - DNA, 140 bp, Artificial Sequence
  Synthetic
caccgctgtcccaaaaggtccaatgatgagtgcccttaacaattttcttgaacttaccttggaaggtaacaccagagcattgtctaacaacatcaaatggtgtaaactcatcttctaaaacatatcagcagccagggcct

SEQ ID NO: 448589 - DNA, 140 bp, Artificial Sequence
  Synthetic
atacgccatgctgggtctccgatgcttttaactttcttgacatcactattgattcttgttcaaagtacacagtggtcactgtttttctttgtttacgagaatgctttcttgccatttactcgtacttgggagtcggccat

SEQ ID NO: 448590 - DNA, 140 bp, Artificial Sequence
  Synthetic
atggccgactcccaagtacgagtaaatggcaagaaagcattctcgtaaacaaagaaaaacagtgaccactgtgtactttgaacaagaatcaatagtgatgtcaagaaagttaaaagcatcggagacccagcatggcgtat

SEQ ID NO: 448591 - DNA, 140 bp, Artificial Sequence
  Synthetic
atacgccatgctgggtctccactttaatatggtctacatgcctgctagctgggtgatgcgtatcatgacatggcttgaattggctgacactagcttgtctggttataggcttaaggattgcgtacttgggagtcggccat

SEQ ID NO: 448592 - DNA, 140 bp, Artificial Sequence
  Synthetic
atggccgactcccaagtacgcaatccttaagcctataaccagacaagctagtgtcagccaattcaagccatgtcatgatacgcatcacccagctagcaggcatgtagaccatattaaagtggagacccagcatggcgtat

SEQ ID NO: 448593 - DNA, 140 bp, Artificial Sequence
  Synthetic
aggccctggctgctgatatgtggcttgaattggctgacactagcttgtctggttataggcttaaggattgtgttatgtatgcttcagctttagttttgcttattctcatgacagctcgcagaccttttgggacagcggtg

SEQ ID NO: 448594 - DNA, 140 bp, Artificial Sequence
  Synthetic
caccgctgtcccaaaaggtctgcgagctgtcatgagaataagcaaaactaaagctgaagcatacataacacaatccttaagcctataaccagacaagctagtgtcagccaattcaagccacatatcagcagccagggcct

SEQ ID NO: 448595 - DNA, 140 bp, Artificial Sequence
  Synthetic
atacgccatgctgggtctccctgtttatgatgatgctgctagacgtgtttggacactgatgaatgtcattacacttgtttacaaagtctactatggtaatgctttagatcaagctatttccgtacttgggagtcggccat

SEQ ID NO: 448596 - DNA, 140 bp, Artificial Sequence
  Synthetic
atggccgactcccaagtacggaaatagcttgatctaaagcattaccatagtagactttgtaaacaagtgtaatgacattcatcagtgtccaaacacgtctagcagcatcatcataaacagggagacccagcatggcgtat

SEQ ID NO: 448597 - DNA, 140 bp, Artificial Sequence
  Synthetic
aggccctggctgctgatatgacacttgtttacaaagtctactatggtaatgctttagatcaagctatttccatgtgggccttagttatttctgtaacctctaactattctggtgtcgttagaccttttgggacagcggtg

SEQ ID NO: 448598 - DNA, 140 bp, Artificial Sequence
  Synthetic
caccgctgtcccaaaaggtctaacgacaccagaatagttagaggttacagaaataactaaggcccacatggaaatagcttgatctaaagcattaccatagtagactttgtaaacaagtgtcatatcagcagccagggcct

SEQ ID NO: 448599 - DNA, 140 bp, Artificial Sequence
  Synthetic
atacgccatgctgggtctcccgactatcatgtttttagctagagctatagtgtttgtgtgtgttgagtattacccattgttatttattactggcaacaccttacagtgtatcatgcttgtcgtacttgggagtcggccat

SEQ ID NO: 448600 - DNA, 140 bp, Artificial Sequence
  Synthetic
atggccgactcccaagtacgacaagcatgatacactgtaaggtgttgccagtaataaataacaatgggtaatactcaacacacacaaacactatagctctagctaaaaacatgatagtcgggagacccagcatggcgtat

SEQ ID NO: 448601 - DNA, 140 bp, Artificial Sequence
  Synthetic
aggccctggctgctgatatgtactcaaccgttacttcaggcttactcttggtgtttatgactacttggtctctacacaagaatttaggtatatgaactcccaggggcttttgcctcctaagaccttttgggacagcggtg

SEQ ID NO: 448602 - DNA, 140 bp, Artificial Sequence
  Synthetic
caccgctgtcccaaaaggtcttaggaggcaaaagcccctgggagttcatatacctaaattcttgtgtagagaccaagtagtcataaacaccaagagtaagcctgaagtaacggttgagtacatatcagcagccagggcct

SEQ ID NO: 448603 - DNA, 140 bp, Artificial Sequence
  Synthetic
atacgccatgctgggtctccaagtgcacatctgtggtactgctctcggttcttcaacaacttagagtagagtcatcttctaaattgtgggcacaatgtgtacaactccacaatgatattccgtacttgggagtcggccat

SEQ ID NO: 448604 - DNA, 140 bp, Artificial Sequence
  Synthetic
atggccgactcccaagtacggaatatcattgtggagttgtacacattgtgcccacaatttagaagatgactctactctaagttgttgaagaaccgagagcagtaccacagatgtgcacttggagacccagcatggcgtat

SEQ ID NO: 448605 - DNA, 140 bp, Artificial Sequence
  Synthetic
atacgccatgctgggtctccttcttgcaaaagacacaactgaagctttcgagaagatggtttctcttttgtctgttttgctatccatgcagggtgctgtagacattaataggttgtgcgacgtacttgggagtcggccat

SEQ ID NO: 448606 - DNA, 140 bp, Artificial Sequence
  Synthetic
atggccgactcccaagtacgtcgcacaacctattaatgtctacagcaccctgcatggatagcaaaacagacaaaagagaaaccatcttctcgaaagcttcagttgtgtcttttgcaagaaggagacccagcatggcgtat

SEQ ID NO: 448607 - DNA, 140 bp, Artificial Sequence
  Synthetic
atacgccatgctgggtctccggaaatgctcgataaccgtgctactcttcaggctattgcttcagaatttagttctttaccatcatatgccgcttatgccactgcccaggaggcctatgagcgtacttgggagtcggccat

SEQ ID NO: 448608 - DNA, 140 bp, Artificial Sequence
  Synthetic
atggccgactcccaagtacgctcataggcctcctgggcagtggcataagcggcatatgatggtaaagaactaaattctgaagcaatagcctgaagagtagcacggttatcgagcatttccggagacccagcatggcgtat

SEQ ID NO: 448609 - DNA, 140 bp, Artificial Sequence
  Synthetic
aggccctggctgctgatatggagcatgtcgacacttcttatgagtgcgacattcctattggagctggcatttgtgctagttaccatacagtttctttattacgtagtactagccaaaaatgaccttttgggacagcggtg

SEQ ID NO: 448610 - DNA, 140 bp, Artificial Sequence
  Synthetic
caccgctgtcccaaaaggtcatttttggctagtactacgtaataaagaaactgtatggtaactagcacaaatgccagctccaataggaatgtcgcactcataagaagtgtcgacatgctccatatcagcagccagggcct

SEQ ID NO: 448611 - DNA, 140 bp, Artificial Sequence
  Synthetic
atacgccatgctgggtctcctcaaaggcttaaacaacctaaatagaggtatggtgctgggcagtttagctgctacagtacgtcttcaggctggaaatgctacagaagtacctgccaattccgtacttgggagtcggccat

SEQ ID NO: 448612 - DNA, 140 bp, Artificial Sequence
  Synthetic
atggccgactcccaagtacggaattggcaggtacttctgtagcatttccagcctgaagacgtactgtagcagctaaactgcccagcaccatacctctatttaggttgtttaagcctttgaggagacccagcatggcgtat

SEQ ID NO: 448613 - DNA, 140 bp, Artificial Sequence
  Synthetic
atacgccatgctgggtctccatctttgaatgtggctaaatctgagtttgaccgtgatgctgccatgcaacgcaagttggaaaagatggcagatcaggctatgacccaaatgtacaaacagcgtacttgggagtcggccat

SEQ ID NO: 448614 - DNA, 140 bp, Artificial Sequence
  Synthetic
atggccgactcccaagtacgctgtttgtacatttgggtcatagcctgatctgccatcttttccaacttgcgttgcatggcagcatcacggtcaaactcagatttagccacattcaaagatggagacccagcatggcgtat

SEQ ID NO: 448615 - DNA, 140 bp, Artificial Sequence
  Synthetic
aggccctggctgctgatatggcaagttggaaaagatggcagatcaggctatgacccaaatgtacaaacaggcaagatctgaggacaagagggcaaaagtaactagtgctatgcaaacaatgaccttttgggacagcggtg

SEQ ID NO: 448616 - DNA, 140 bp, Artificial Sequence
  Synthetic
caccgctgtcccaaaaggtcattgtttgcatagcactagttacttttgccctcttgtcctcagatcttgcctgtttgtacatttgggtcatagcctgatctgccatcttttccaacttgccatatcagcagccagggcct

SEQ ID NO: 448617 - DNA, 140 bp, Artificial Sequence
  Synthetic
atacgccatgctgggtctccgctcttcactatgcttaggaagcttgataatgatgcacttaacaacattatcaacaatgcgcgtgatggttgtgttccactcaacatcataccattgactcgtacttgggagtcggccat

SEQ ID NO: 448618 - DNA, 140 bp, Artificial Sequence
  Synthetic
atggccgactcccaagtacgagtcaatggtatgatgttgagtggaacacaaccatcacgcgcattgttgataatgttgttaagtgcatcattatcaagcttcctaagcatagtgaagagcggagacccagcatggcgtat

SEQ ID NO: 448619 - DNA, 140 bp, Artificial Sequence
  Synthetic
aggccctggctgctgatatgtcaacaatgcgcgtgatggttgtgttccactcaacatcataccattgactacagcagccaaactcatggttgttgtccctgattatggtacctacaagaagaccttttgggacagcggtg

SEQ ID NO: 448620 - DNA, 140 bp, Artificial Sequence
  Synthetic
caccgctgtcccaaaaggtcttcttgtaggtaccataatcagggacaacaaccatgagtttggctgctgtagtcaatggtatgatgttgagtggaacacaaccatcacgcgcattgttgacatatcagcagccagggcct

SEQ ID NO: 448621 - DNA, 140 bp, Artificial Sequence
  Synthetic
aggccctggctgctgatatgatggacaattcaccaaatttggcttggcctcttattgttacagctctaagagccaactcagctgttaaactacagaataatgaactgagtccagtagcacgaccttttgggacagcggtg

SEQ ID NO: 448622 - DNA, 140 bp, Artificial Sequence
  Synthetic
caccgctgtcccaaaaggtcgtgctactggactcagttcattattctgtagtttaacagctgagttggctcttagagctgtaacaataagaggccaagccaaatttggtgaattgtccatcatatcagcagccagggcct

SEQ ID NO: 448623 - DNA, 140 bp, Artificial Sequence
  Synthetic
aggccctggctgctgatatggtgatggtacaggtacaatttacacagaactggaaccaccttgtaggtttgttacagacacaccaaaagggcctaaagtgaaatacttgtacttcatcaagaccttttgggacagcggtg

SEQ ID NO: 448624 - DNA, 140 bp, Artificial Sequence
  Synthetic
caccgctgtcccaaaaggtcttgatgaagtacaagtatttcactttaggcccttttggtgtgtctgtaacaaacctacaaggtggttccagttctgtgtaaattgtacctgtaccatcaccatatcagcagccagggcct

SEQ ID NO: 448625 - DNA, 140 bp, Artificial Sequence
  Synthetic
aggccctggctgctgatatgcagtacgtcttcaggctggaaatgctacagaagtacctgccaattcaactgtgctttccttctgtgcttttgcagtagaccctgctaaagcatataaggagaccttttgggacagcggtg

SEQ ID NO: 448626 - DNA, 140 bp, Artificial Sequence
  Synthetic
caccgctgtcccaaaaggtctccttatatgctttagcagggtctactgcaaaagcacagaaggaaagcacagttgaattggcaggtacttctgtagcatttccagcctgaagacgtactgcatatcagcagccagggcct

SEQ ID NO: 448627 - DNA, 140 bp, Artificial Sequence
  Synthetic
aggccctggctgctgatatgtcgttatgccagtacatacattgtcaatccatgatggttacacaaatgaaatcattggttacaaagccattcaggatggtgtcactcgtgacatcatttcgaccttttgggacagcggtg

SEQ ID NO: 448628 - DNA, 140 bp, Artificial Sequence
  Synthetic
caccgctgtcccaaaaggtcgaaatgatgtcacgagtgacaccatcctgaatggctttgtaaccaatgatttcatttgtgtaaccatcatggattgacaatgtatgtactggcataacgacatatcagcagccagggcct

SEQ ID NO: 448629 - DNA, 140 bp, Artificial Sequence
  Synthetic
atacgccatgctgggtctccatggaccaagagtcctttggtggtgcttcatgttgtctgtattgtagatgccacattgaccatccaaatcctaaaggattctgtgacttgaaaggtaagtcgtacttgggagtcggccat

SEQ ID NO: 448630 - DNA, 140 bp, Artificial Sequence
  Synthetic
atggccgactcccaagtacgacttacctttcaagtcacagaatcctttaggatttggatggtcaatgtggcatctacaatacagacaacatgaagcaccaccaaaggactcttggtccatggagacccagcatggcgtat

SEQ ID NO: 448631 - DNA, 140 bp, Artificial Sequence
  Synthetic
atacgccatgctgggtctcccacattattgtgcgttcttgctgcattggtttgttatatcgttatgccagtacatacattgtcaatccatgatggttacacaaatgaaatcattggttaccgtacttgggagtcggccat

SEQ ID NO: 448632 - DNA, 140 bp, Artificial Sequence
  Synthetic
atggccgactcccaagtacggtaaccaatgatttcatttgtgtaaccatcatggattgacaatgtatgtactggcataacgatataacaaaccaatgcagcaagaacgcacaataatgtgggagacccagcatggcgtat

SEQ ID NO: 448633 - DNA, 140 bp, Artificial Sequence
  Synthetic
atacgccatgctgggtctccacgtccaaatacctaccacttgtgctaatgacccagtgggttttacacttagaaacacagtctgtaccgtctgcggaatgtggaaaggttatggctgtagcgtacttgggagtcggccat

SEQ ID NO: 448634 - DNA, 140 bp, Artificial Sequence
  Synthetic
atggccgactcccaagtacgctacagccataacctttccacattccgcagacggtacagactgtgtttctaagtgtaaaacccactgggtcattagcacaagtggtaggtatttggacgtggagacccagcatggcgtat

SEQ ID NO: 448635 - DNA, 140 bp, Artificial Sequence
  Synthetic
atacgccatgctgggtctccttttaaacgggtttgcggtgtaagtgcagcccgtcttacaccgtgcggcacaggcactagtactgatgtcgtctacagggcttttgatatttacaacgaacgtacttgggagtcggccat

SEQ ID NO: 448636 - DNA, 140 bp, Artificial Sequence
  Synthetic
atggccgactcccaagtacgttcgttgtaaatatcaaaagccctgtagacgacatcagtactagtgcctgtgccgcacggtgtaagacgggctgcacttacaccgcaaacccgtttaaaaggagacccagcatggcgtat

SEQ ID NO: 448637 - DNA, 140 bp, Artificial Sequence
  Synthetic
aggccctggctgctgatatgggagaaggatgaggaaggcaatttattagactcttactttgtagttaagaggcatactatgtctaactaccaacatgaagagactatttataacttggttgaccttttgggacagcggtg

SEQ ID NO: 448638 - DNA, 140 bp, Artificial Sequence
  Synthetic
caccgctgtcccaaaaggtcaaccaagttataaatagtctcttcatgttggtagttagacatagtatgcctcttaactacaaagtaagagtctaataaattgccttcctcatccttctcccatatcagcagccagggcct

SEQ ID NO: 448639 - DNA, 140 bp, Artificial Sequence
  Synthetic
aggccctggctgctgatatgggcatactatgtctaactaccaacatgaagagactatttataacttggttaaagattgtccagcggttgctgtccatgactttttcaagtttagagtagagaccttttgggacagcggtg

SEQ ID NO: 448640 - DNA, 140 bp, Artificial Sequence
  Synthetic
caccgctgtcccaaaaggtctctactctaaacttgaaaaagtcatggacagcaaccgctggacaatctttaaccaagttataaatagtctcttcatgttggtagttagacatagtatgcccatatcagcagccagggcct

SEQ ID NO: 448641 - DNA, 140 bp, Artificial Sequence
  Synthetic
atacgccatgctgggtctcctggtgacatggtaccacatatatcacgtcagcgtctaactaaatacacaatggctgatttagtctatgctctacgtcattttgatgagggtaattgtgatcgtacttgggagtcggccat

SEQ ID NO: 448642 - DNA, 140 bp, Artificial Sequence
  Synthetic
atggccgactcccaagtacgatcacaattaccctcatcaaaatgacgtagagcatagactaaatcagccattgtgtatttagttagacgctgacgtgatatatgtggtaccatgtcaccaggagacccagcatggcgtat

SEQ ID NO: 448643 - DNA, 140 bp, Artificial Sequence
  Synthetic
atacgccatgctgggtctccacattaaaagaaatactcgtcacatacaattgctgtgatgatgattatttcaataagaaggattggtatgacttcgtagagaatcctgacatcttacgcgcgtacttgggagtcggccat

SEQ ID NO: 448644 - DNA, 140 bp, Artificial Sequence
  Synthetic
atggccgactcccaagtacgcgcgtaagatgtcaggattctctacgaagtcataccaatccttcttattgaaataatcatcatcacagcaattgtatgtgacgagtatttcttttaatgtggagacccagcatggcgtat

SEQ ID NO: 448645 - DNA, 140 bp, Artificial Sequence
  Synthetic
aggccctggctgctgatatgcaataagaaggattggtatgacttcgtagagaatcctgacatcttacgcgtatatgctaacttaggtgagcgtgtacgccaatcattattaaagactgtagaccttttgggacagcggtg

SEQ ID NO: 448646 - DNA, 140 bp, Artificial Sequence
  Synthetic
caccgctgtcccaaaaggtctacagtctttaataatgattggcgtacacgctcacctaagttagcatatacgcgtaagatgtcaggattctctacgaagtcataccaatccttcttattgcatatcagcagccagggcct

SEQ ID NO: 448647 - DNA, 140 bp, Artificial Sequence
  Synthetic
atacgccatgctgggtctcccaattctgcgatgctatgcgtgatgcaggcattgtaggcgtactgacattagataatcaggatcttaatgggaactggtacgatttcggtgatttcgtaccgtacttgggagtcggccat

SEQ ID NO: 448648 - DNA, 140 bp, Artificial Sequence
  Synthetic
atggccgactcccaagtacggtacgaaatcaccgaaatcgtaccagttcccattaagatcctgattatctaatgtcagtacgcctacaatgcctgcatcacgcatagcatcgcagaattgggagacccagcatggcgtat

SEQ ID NO: 448649 - DNA, 140 bp, Artificial Sequence
  Synthetic
aggccctggctgctgatatgagataatcaggatcttaatgggaactggtacgatttcggtgatttcgtacaagtagcaccaggctgcggagttcctattgtggattcatattactcattggaccttttgggacagcggtg

SEQ ID NO: 448650 - DNA, 140 bp, Artificial Sequence
  Synthetic
caccgctgtcccaaaaggtccaatgagtaatatgaatccacaataggaactccgcagcctggtgctacttgtacgaaatcaccgaaatcgtaccagttcccattaagatcctgattatctcatatcagcagccagggcct

SEQ ID NO: 448651 - DNA, 140 bp, Artificial Sequence
  Synthetic
atacgccatgctgggtctccaagtagcaccaggctgcggagttcctattgtggattcatattactcattgctgatgcccatcctcactttgactagggcattggctgctgagtcccatatcgtacttgggagtcggccat

SEQ ID NO: 448652 - DNA, 140 bp, Artificial Sequence
  Synthetic
atggccgactcccaagtacgatatgggactcagcagccaatgccctagtcaaagtgaggatgggcatcagcaatgagtaatatgaatccacaataggaactccgcagcctggtgctacttggagacccagcatggcgtat

SEQ ID NO: 448653 - DNA, 140 bp, Artificial Sequence
  Synthetic
atacgccatgctgggtctccgatctagaagaaccttgtaccaaagtctaaacgaacatgaaacttctcattgttttgacttgtatttctctatgcagttgcatacgcactgtagtacagccgtacttgggagtcggccat

SEQ ID NO: 448654 - DNA, 140 bp, Artificial Sequence
  Synthetic
atggccgactcccaagtacggctgtactacagtgcgtatgcaactgcatagagaaatacaagtcaaaacaatgagaagtttcatgttcgtttagactttggtacaaggttcttctagatcggagacccagcatggcgtat

SEQ ID NO: 448655 - DNA, 140 bp, Artificial Sequence
  Synthetic
atacgccatgctgggtctccggatgctgatctcgcaaaaccacttattaagtgggatttgctgaaatatgattttacggaagagagactttgtctcttcgaccgttattttaaatattggcgtacttgggagtcggccat

SEQ ID NO: 448656 - DNA, 140 bp, Artificial Sequence
  Synthetic
atggccgactcccaagtacgccaatatttaaaataacggtcgaagagacaaagtctctcttccgtaaaatcatatttcagcaaatcccacttaataagtggttttgcgagatcagcatccggagacccagcatggcgtat

SEQ ID NO: 448657 - DNA, 140 bp, Artificial Sequence
  Synthetic
aggccctggctgctgatatgattttacggaagagagactttgtctcttcgaccgttattttaaatattgggaccagacataccatcccaattgtattaactgtttggatgataggtgtatgaccttttgggacagcggtg

SEQ ID NO: 448658 - DNA, 140 bp, Artificial Sequence
  Synthetic
caccgctgtcccaaaaggtcatacacctatcatccaaacagttaatacaattgggatggtatgtctggtcccaatatttaaaataacggtcgaagagacaaagtctctcttccgtaaaatcatatcagcagccagggcct

SEQ ID NO: 448659 - DNA, 140 bp, Artificial Sequence
  Synthetic
aggccctggctgctgatatgcaagttttggaccactagtaagaaaaatatttgtagatggtgttccttttgttgtttcaactggataccattttcgtgagttaggagtcgtacataatcagaccttttgggacagcggtg

SEQ ID NO: 448660 - DNA, 140 bp, Artificial Sequence
  Synthetic
caccgctgtcccaaaaggtctgattatgtacgactcctaactcacgaaaatggtatccagttgaaacaacaaaaggaacaccatctacaaatatttttcttactagtggtccaaaacttgcatatcagcagccagggcct

SEQ ID NO: 448661 - DNA, 140 bp, Artificial Sequence
  Synthetic
atacgccatgctgggtctccgttgtttcaactggataccattttcgtgagttaggagtcgtacataatcaggatgtaaacttacatagctcgcgtctcagtttcaaggaacttttagtgtcgtacttgggagtcggccat

SEQ ID NO: 448662 - DNA, 140 bp, Artificial Sequence
  Synthetic
atggccgactcccaagtacgacactaaaagttccttgaaactgagacgcgagctatgtaagtttacatcctgattatgtacgactcctaactcacgaaaatggtatccagttgaaacaacggagacccagcatggcgtat

SEQ ID NO: 448663 - DNA, 140 bp, Artificial Sequence
  Synthetic
atacgccatgctgggtctccatgctgctgatccagctatgcatgcagcttctggcaatttattgctagataaacgcactacatgcttttcagtagctgcactaacaaacaatgttgctttcgtacttgggagtcggccat

SEQ ID NO: 448664 - DNA, 140 bp, Artificial Sequence
  Synthetic
atggccgactcccaagtacgaaagcaacattgtttgttagtgcagctactgaaaagcatgtagtgcgtttatctagcaataaattgccagaagctgcatgcatagctggatcagcagcatggagacccagcatggcgtat

SEQ ID NO: 448665 - DNA, 140 bp, Artificial Sequence
  Synthetic
aggccctggctgctgatatgaaacgcactacatgcttttcagtagctgcactaacaaacaatgttgcttttcaaactgtcaaacccggtaattttaataaagacttttatgactttgctggaccttttgggacagcggtg

SEQ ID NO: 448666 - DNA, 140 bp, Artificial Sequence
  Synthetic
caccgctgtcccaaaaggtccagcaaagtcataaaagtctttattaaaattaccgggtttgacagtttgaaaagcaacattgtttgttagtgcagctactgaaaagcatgtagtgcgtttcatatcagcagccagggcct

SEQ ID NO: 448667 - DNA, 140 bp, Artificial Sequence
  Synthetic
aggccctggctgctgatatggatctgttctctaaacgaactttaaaatctgtgtagctgtcgctcggctgcatgcctagtgcacctacgcagtataaacaataataaattttactgtcgtgaccttttgggacagcggtg

SEQ ID NO: 448668 - DNA, 140 bp, Artificial Sequence
  Synthetic
caccgctgtcccaaaaggtcacgacagtaaaatttattattgtttatactgcgtaggtgcactaggcatgcagccgagcgacagctacacagattttaaagttcgtttagagaacagatccatatcagcagccagggcct

SEQ ID NO: 448669 - DNA, 140 bp, Artificial Sequence
  Synthetic
atacgccatgctgggtctcctgtctaaaggtttctttaaggaaggaagttctgttgaactaaaacacttcttctttgctcaggatggcaacgctgctatcagtgattatgactattatcgcgtacttgggagtcggccat

SEQ ID NO: 448670 - DNA, 140 bp, Artificial Sequence
  Synthetic
atggccgactcccaagtacgcgataatagtcataatcactgatagcagcgttgccatcctgagcaaagaagaagtgttttagttcaacagaacttccttccttaaagaaacctttagacaggagacccagcatggcgtat

SEQ ID NO: 448671 - DNA, 140 bp, Artificial Sequence
  Synthetic
aggccctggctgctgatatgttctttgctcaggatggcaacgctgctatcagtgattatgactattatcgttataatctgccaacaatgtgtgatatcagacaactcctattcgtagttggaccttttgggacagcggtg

SEQ ID NO: 448672 - DNA, 140 bp, Artificial Sequence
  Synthetic
caccgctgtcccaaaaggtccaactacgaataggagttgtctgatatcacacattgttggcagattataacgataatagtcataatcactgatagcagcgttgccatcctgagcaaagaacatatcagcagccagggcct

SEQ ID NO: 448673 - DNA, 140 bp, Artificial Sequence
  Synthetic
atacgccatgctgggtctccaagttgttgataaatactttgattgttacgatggtggctgtattaatgccaaccaagtaatcgttaacaatctggataaatcagctggtttcccatttaacgtacttgggagtcggccat

SEQ ID NO: 448674 - DNA, 140 bp, Artificial Sequence
  Synthetic
atggccgactcccaagtacgttaaatgggaaaccagctgatttatccagattgttaacgattacttggttggcattaatacagccaccatcgtaacaatcaaagtatttatcaacaacttggagacccagcatggcgtat

SEQ ID NO: 448675 - DNA, 140 bp, Artificial Sequence
  Synthetic
aggccctggctgctgatatgaaccaagtaatcgttaacaatctggataaatcagctggtttcccatttaataaatggggtaaggctagactttattatgactcaatgagttatgaggatcgaccttttgggacagcggtg

SEQ ID NO: 448676 - DNA, 140 bp, Artificial Sequence
  Synthetic
caccgctgtcccaaaaggtcgatcctcataactcattgagtcataataaagtctagccttaccccatttattaaatgggaaaccagctgatttatccagattgttaacgattacttggttcatatcagcagccagggcct

SEQ ID NO: 448677 - DNA, 140 bp, Artificial Sequence
  Synthetic
atacgccatgctgggtctccaagatgcacttttcgcgtatactaagcgtaatgtcatccctactataactcaaatgaatcttaagtatgccattagtgcaaagaatagagctcgcaccgtcgtacttgggagtcggccat

SEQ ID NO: 448678 - DNA, 140 bp, Artificial Sequence
  Synthetic
atggccgactcccaagtacgacggtgcgagctctattctttgcactaatggcatacttaagattcatttgagttatagtagggatgacattacgcttagtatacgcgaaaagtgcatcttggagacccagcatggcgtat

SEQ ID NO: 448679 - DNA, 140 bp, Artificial Sequence
  Synthetic
aggccctggctgctgatatgcaaatgaatcttaagtatgccattagtgcaaagaatagagctcgcaccgtagctggtgtctctatctgtagtactatgacaaatagacagtttcatcagagaccttttgggacagcggtg

SEQ ID NO: 448680 - DNA, 140 bp, Artificial Sequence
  Synthetic
caccgctgtcccaaaaggtctctgatgaaactgtctatttgtcatagtactacagatagagacaccagctacggtgcgagctctattctttgcactaatggcatacttaagattcatttgcatatcagcagccagggcct

SEQ ID NO: 448681 - DNA, 140 bp, Artificial Sequence
  Synthetic
atacgccatgctgggtctccgctgcaggtacagacacaaccataacattaaatgttttggcatggctgtatgctgctgttatcaatggtgataggtggtttcttaatagattcaccactacgtacttgggagtcggccat

SEQ ID NO: 448682 - DNA, 140 bp, Artificial Sequence
  Synthetic
atggccgactcccaagtacgtagtggtgaatctattaagaaaccacctatcaccattgataacagcagcatacagccatgccaaaacatttaatgttatggttgtgtctgtacctgcagcggagacccagcatggcgtat

SEQ ID NO: 448683 - DNA, 140 bp, Artificial Sequence
  Synthetic
aggccctggctgctgatatgtaggtttttacctacccaggaaaagccaaccaacctcgatctcttgtagatctgttctctaaacgaactttaaaatctgtgtagctgtcgctcggctgcagaccttttgggacagcggtg

SEQ ID NO: 448684 - DNA, 140 bp, Artificial Sequence
  Synthetic
caccgctgtcccaaaaggtctgcagccgagcgacagctacacagattttaaagttcgtttagagaacagatctacaagagatcgaggttggttggcttttcctgggtaggtaaaaacctacatatcagcagccagggcct

SEQ ID NO: 448685 - DNA, 140 bp, Artificial Sequence
  Synthetic
aggccctggctgctgatatgcgagtgtgcgcaagtattaagtgagatggtcatgtgtggcggctcactatatgttaaaccaggtggaacatcatccggtgatgctacaactgcttatgctgaccttttgggacagcggtg

SEQ ID NO: 448686 - DNA, 140 bp, Artificial Sequence
  Synthetic
caccgctgtcccaaaaggtcagcataagcagttgtagcatcaccggatgatgttccacctggtttaacatatagtgagccgccacacatgaccatctcacttaatacttgcgcacactcgcatatcagcagccagggcct

SEQ ID NO: 448687 - DNA, 140 bp, Artificial Sequence
  Synthetic
aggccctggctgctgatatgttcgtggatgagttttacgcttacctgcgtaaacatttctccatgatgattctttctgatgatgccgttgtgtgctataacagtaactatgcggctcaaggaccttttgggacagcggtg

SEQ ID NO: 448688 - DNA, 140 bp, Artificial Sequence
  Synthetic
caccgctgtcccaaaaggtccttgagccgcatagttactgttatagcacacaacggcatcatcagaaagaatcatcatggagaaatgtttacgcaggtaagcgtaaaactcatccacgaacatatcagcagccagggcct

SEQ ID NO: 448689 - DNA, 140 bp, Artificial Sequence
  Synthetic
aggccctggctgctgatatgtctttctgatgatgccgttgtgtgctataacagtaactatgcggctcaaggtttagtagctagcattaagaactttaaggcagttctttattatcaaaatgaccttttgggacagcggtg

SEQ ID NO: 448690 - DNA, 140 bp, Artificial Sequence
  Synthetic
caccgctgtcccaaaaggtcattttgataataaagaactgccttaaagttcttaatgctagctactaaaccttgagccgcatagttactgttatagcacacaacggcatcatcagaaagacatatcagcagccagggcct

SEQ ID NO: 448691 - DNA, 140 bp, Artificial Sequence
  Synthetic
atacgccatgctgggtctccaatgtgttcatgtctgaggcaaaatgttggactgagactgaccttactaaaggacctcacgaattttgctcacagcatacaatgctagttaaacaaggagcgtacttgggagtcggccat

SEQ ID NO: 448692 - DNA, 140 bp, Artificial Sequence
  Synthetic
atggccgactcccaagtacgctccttgtttaactagcattgtatgctgtgagcaaaattcgtgaggtcctttagtaaggtcagtctcagtccaacattttgcctcagacatgaacacattggagacccagcatggcgtat

SEQ ID NO: 448693 - DNA, 140 bp, Artificial Sequence
  Synthetic
aggccctggctgctgatatgaggacctcacgaattttgctcacagcatacaatgctagttaaacaaggagatgattacgtgtacctgccttacccagatccatcaagaatattaggcgcagaccttttgggacagcggtg

SEQ ID NO: 448694 - DNA, 140 bp, Artificial Sequence
  Synthetic
caccgctgtcccaaaaggtctgcgcctaatattcttgatggatctgggtaaggcaggtacacgtaatcatctccttgtttaactagcattgtatgctgtgagcaaaattcgtgaggtcctcatatcagcagccagggcct

SEQ ID NO: 448695 - DNA, 140 bp, Artificial Sequence
  Synthetic
atacgccatgctgggtctccggctgttttgtcgatgatattgtcaaaacagatggtacacttatgattgaaaggttcgtgtcactggctattgatgcttacccacttacaaaacatcctacgtacttgggagtcggccat

SEQ ID NO: 448696 - DNA, 140 bp, Artificial Sequence
  Synthetic
atggccgactcccaagtacgtaggatgttttgtaagtgggtaagcatcaatagccagtgacacgaacctttcaatcataagtgtaccatctgttttgacaatatcatcgacaaaacagccggagacccagcatggcgtat

SEQ ID NO: 448697 - DNA, 140 bp, Artificial Sequence
  Synthetic
aggccctggctgctgatatgaaggttcgtgtcactggctattgatgcttacccacttacaaaacatcctaatcaggagtatgctgatgtctttcacttgtatttacaatacattagaaaggaccttttgggacagcggtg

SEQ ID NO: 448698 - DNA, 140 bp, Artificial Sequence
  Synthetic
caccgctgtcccaaaaggtcctttctaatgtattgtaaatacaagtgaaagacatcagcatactcctgattaggatgttttgtaagtgggtaagcatcaatagccagtgacacgaaccttcatatcagcagccagggcct

SEQ ID NO: 448699 - DNA, 140 bp, Artificial Sequence
  Synthetic
aggccctggctgctgatatgtcttgtttgatggtagagtggaaggacgaggtagacctttttagaaacgcccgtaatggtgttttaataacagaaggttcagtcaaaggtctaacaccttgaccttttgggacagcggtg

SEQ ID NO: 448700 - DNA, 140 bp, Artificial Sequence
  Synthetic
caccgctgtcccaaaaggtcaaggtgttagacctttgactgaaccttctgttattaaaacaccattacgggcgtttctaaaaaggtctacctcgtccttccactctaccatcaaacaagacatatcagcagccagggcct

SEQ ID NO: 448701 - DNA, 140 bp, Artificial Sequence
  Synthetic
atacgccatgctgggtctccttacatgatgagcttactggccacatgttggacatgtattccgtaatgctaactaatgataacacctcacggtactgggaacctgagttttatgaggctacgtacttgggagtcggccat

SEQ ID NO: 448702 - DNA, 140 bp, Artificial Sequence
  Synthetic
atggccgactcccaagtacgtagcctcataaaactcaggttcccagtaccgtgaggtgttatcattagttagcattacggaatacatgtccaacatgtggccagtaagctcatcatgtaaggagacccagcatggcgtat

SEQ ID NO: 448703 - DNA, 140 bp, Artificial Sequence
  Synthetic
aggccctggctgctgatatgaactaatgataacacctcacggtactgggaacctgagttttatgaggctatgtacacaccacatacagtcttgcaggctgtaggtgcttgtgtattgtgcgaccttttgggacagcggtg

SEQ ID NO: 448704 - DNA, 140 bp, Artificial Sequence
  Synthetic
caccgctgtcccaaaaggtcgcacaatacacaagcacctacagcctgcaagactgtatgtggtgtgtacatagcctcataaaactcaggttcccagtaccgtgaggtgttatcattagttcatatcagcagccagggcct

SEQ ID NO: 448705 - DNA, 140 bp, Artificial Sequence
  Synthetic
aggccctggctgctgatatgagctctactcgccactttttctcattgttgctgctctagtatttttaatactttgcttcaccattaagagaaagacagaatgaatgagctcactttaattgaccttttgggacagcggtg

SEQ ID NO: 448706 - DNA, 140 bp, Artificial Sequence
  Synthetic
caccgctgtcccaaaaggtcaattaaagtgagctcattcattctgtctttctcttaatggtgaagcaaagtattaaaaatactagagcagcaacaatgagaaaaagtggcgagtagagctcatatcagcagccagggcct

SEQ ID NO: 448707 - DNA, 140 bp, Artificial Sequence
  Synthetic
atacgccatgctgggtctcctgttgtctgttaatccctatgtttgcaatgccccaggttgtgatgtcactgatgtgacacaactgtatctaggaggtatgagctattattgcaagtcacacgtacttgggagtcggccat

SEQ ID NO: 448708 - DNA, 140 bp, Artificial Sequence
  Synthetic
atggccgactcccaagtacgtgtgacttgcaataatagctcatacctcctagatacagttgtgtcacatcagtgacatcacaacctggggcattgcaaacatagggattaacagacaacaggagacccagcatggcgtat

SEQ ID NO: 448709 - DNA, 140 bp, Artificial Sequence
  Synthetic
atacgccatgctgggtctcctaagcctcccattagttttccattatgtgctaatggtcaggtttttggtttatacaaaaacacatgtgtaggcagtgacaatgtcactgacttcaatgcgcgtacttgggagtcggccat

SEQ ID NO: 448710 - DNA, 140 bp, Artificial Sequence
  Synthetic
atggccgactcccaagtacgcgcattgaagtcagtgacattgtcactgcctacacatgtgtttttgtataaaccaaaaacctgaccattagcacataatggaaaactaatgggaggcttaggagacccagcatggcgtat

SEQ ID NO: 448711 - DNA, 140 bp, Artificial Sequence
  Synthetic
aggccctggctgctgatatgtatagcactgcttggctttgtgctctaggaaaggttttaccttttcatagatggcacactatggttcaaacatgcacacctaatgttactatcaactgtcgaccttttgggacagcggtg

SEQ ID NO: 448712 - DNA, 140 bp, Artificial Sequence
  Synthetic
caccgctgtcccaaaaggtcgacagttgatagtaacattaggtgtgcatgtttgaaccatagtgtgccatctatgaaaaggtaaaacctttcctagagcacaaagccaagcagtgctatacatatcagcagccagggcct

SEQ ID NO: 448713 - DNA, 140 bp, Artificial Sequence
  Synthetic
aggccctggctgctgatatgtctgacagagaattgcatctttcatgggaggttggaaaacctagaccaccattgaacagaaactatgtctttactggttaccgtgtaactaaaaatagtagaccttttgggacagcggtg

SEQ ID NO: 448714 - DNA, 140 bp, Artificial Sequence
  Synthetic
caccgctgtcccaaaaggtctactatttttagttacacggtaaccagtaaagacatagtttctgttcaatggtggtctaggttttccaacctcccatgaaagatgcaattctctgtcagacatatcagcagccagggcct

SEQ ID NO: 448715 - DNA, 140 bp, Artificial Sequence
  Synthetic
aggccctggctgctgatatgattgaacagaaactatgtctttactggttaccgtgtaactaaaaatagtaaagtacagattggagagtacacctttgaaaaaggtgactatggtgatgctgaccttttgggacagcggtg

SEQ ID NO: 448716 - DNA, 140 bp, Artificial Sequence
  Synthetic
caccgctgtcccaaaaggtcagcatcaccatagtcacctttttcaaaggtgtactctccaatctgtactttactatttttagttacacggtaaccagtaaagacatagtttctgttcaatcatatcagcagccagggcct

SEQ ID NO: 448717 - DNA, 140 bp, Artificial Sequence
  Synthetic
atacgccatgctgggtctccgttgtgtacagaggtactacgacatacaagttgaatgttggtgattactttgtgttgacatctcacactgtaatgccacttagtgcacctactctagtgccgtacttgggagtcggccat

SEQ ID NO: 448718 - DNA, 140 bp, Artificial Sequence
  Synthetic
atggccgactcccaagtacggcactagagtaggtgcactaagtggcattacagtgtgagatgtcaacacaaagtaatcaccaacattcaacttgtatgtcgtagtacctctgtacacaacggagacccagcatggcgtat

SEQ ID NO: 448719 - DNA, 140 bp, Artificial Sequence
  Synthetic
aggccctggctgctgatatgtgtgttgacatctcacactgtaatgccacttagtgcacctactctagtgccacaagagcactatgtgagaattactggcttgtacccaacactcaacatcgaccttttgggacagcggtg

SEQ ID NO: 448720 - DNA, 140 bp, Artificial Sequence
  Synthetic
caccgctgtcccaaaaggtcgatgttgagtgttgggtacaagccagtaattctcacatagtgctcttgtggcactagagtaggtgcactaagtggcattacagtgtgagatgtcaacacacatatcagcagccagggcct

SEQ ID NO: 448721 - DNA, 140 bp, Artificial Sequence
  Synthetic
atacgccatgctgggtctcctcagatgagttttctagcaatgttgcaaattatcaaaaggtcggcatgcaaaagtactctacactccaaggaccacctggtactggtaagagtcattttgcgtacttgggagtcggccat

SEQ ID NO: 448722 - DNA, 140 bp, Artificial Sequence
  Synthetic
atggccgactcccaagtacgcaaaatgactcttaccagtaccaggtggtccttggagtgtagagtacttttgcatgccgaccttttgataatttgcaacattgctagaaaactcatctgaggagacccagcatggcgtat

SEQ ID NO: 448723 - DNA, 140 bp, Artificial Sequence
  Synthetic
aggccctggctgctgatatgaaagtactctacactccaaggaccacctggtactggtaagagtcattttgccatcggacttgctctctattacccatctgctcgcatagtgtatacggcagaccttttgggacagcggtg

SEQ ID NO: 448724 - DNA, 140 bp, Artificial Sequence
  Synthetic
caccgctgtcccaaaaggtctgccgtatacactatgcgagcagatgggtaatagagagcaagtccgatggcaaaatgactcttaccagtaccaggtggtccttggagtgtagagtactttcatatcagcagccagggcct

SEQ ID NO: 448725 - DNA, 140 bp, Artificial Sequence
  Synthetic
atacgccatgctgggtctcctgctctcatgcagctgttgatgccctatgtgaaaaggcattaaaatatttgcccatagataaatgtagtagaatcatacctgcgcgtgcgcgcgtagagtcgtacttgggagtcggccat

SEQ ID NO: 448726 - DNA, 140 bp, Artificial Sequence
  Synthetic
atggccgactcccaagtacgactctacgcgcgcacgcgcaggtatgattctactacatttatctatgggcaaatattttaatgccttttcacatagggcatcaacagctgcatgagagcaggagacccagcatggcgtat

SEQ ID NO: 448727 - DNA, 140 bp, Artificial Sequence
  Synthetic
aggccctggctgctgatatggcccatagataaatgtagtagaatcatacctgcgcgtgcgcgcgtagagtgttttgataaattcaaagtgaattcaacactagaacagtatgttttctgcgaccttttgggacagcggtg

SEQ ID NO: 448728 - DNA, 140 bp, Artificial Sequence
  Synthetic
caccgctgtcccaaaaggtcgcagaaaacatactgttctagtgttgaattcactttgaatttatcaaaacactctacgcgcgcacgcgcaggtatgattctactacatttatctatgggccatatcagcagccagggcct

SEQ ID NO: 448729 - DNA, 140 bp, Artificial Sequence
  Synthetic
atacgccatgctgggtctccactgtaaatgcattgccagaaacaactgctgacattgtagtctttgatgaaatctctatggctactaattatgacttgagtgttgtcaatgctagacttccgtacttgggagtcggccat

SEQ ID NO: 448730 - DNA, 140 bp, Artificial Sequence
  Synthetic
atggccgactcccaagtacggaagtctagcattgacaacactcaagtcataattagtagccatagagatttcatcaaagactacaatgtcagcagttgtttctggcaatgcatttacagtggagacccagcatggcgtat

SEQ ID NO: 448731 - DNA, 140 bp, Artificial Sequence
  Synthetic
atacgccatgctgggtctcccgcacattgctgactaaaggcacactagaaccagaatattttaattcagtgtgcagacttatgaaaacaataggtccagacatgttccttggaacttgtccgtacttgggagtcggccat

SEQ ID NO: 448732 - DNA, 140 bp, Artificial Sequence
  Synthetic
atggccgactcccaagtacggacaagttccaaggaacatgtctggacctattgttttcataagtctgcacactgaattaaaatattctggttctagtgtgcctttagtcagcaatgtgcgggagacccagcatggcgtat

SEQ ID NO: 448733 - DNA, 140 bp, Artificial Sequence
  Synthetic
aggccctggctgctgatatgaataagctaaaagcacacaaggataagtcagctcaatgcttcaaaatgttctacaaaggtgttattacacatgatgtttcatctgcaatcaacagacctcgaccttttgggacagcggtg

SEQ ID NO: 448734 - DNA, 140 bp, Artificial Sequence
  Synthetic
caccgctgtcccaaaaggtcgaggtctgttgattgcagatgaaacatcatgtgtaataacacctttgtagaacattttgaagcattgagctgacttatccttgtgtgcttttagcttattcatatcagcagccagggcct

SEQ ID NO: 448735 - DNA, 140 bp, Artificial Sequence
  Synthetic
aggccctggctgctgatatgctacaaaggtgttattacacatgatgtttcatctgcaatcaacagacctcaaataggcgttgtaagagaatttcttacacgcaatcctgcttggagaaaagaccttttgggacagcggtg

SEQ ID NO: 448736 - DNA, 140 bp, Artificial Sequence
  Synthetic
caccgctgtcccaaaaggtcttttctccaagcaggattgcgtgtaagaaattctcttacaacgcctatttgaggtctgttgattgcagatgaaacatcatgtgtaataacacctttgtagcatatcagcagccagggcct

SEQ ID NO: 448737 - DNA, 140 bp, Artificial Sequence
  Synthetic
atacgccatgctgggtctccgctgtttttatctcaccttataattcacagaacgctgtagcttcaaaaatcttaggattgcctacgcagactgttgattcatcacagggttctgaatatgcgtacttgggagtcggccat

SEQ ID NO: 448738 - DNA, 140 bp, Artificial Sequence
  Synthetic
atggccgactcccaagtacgcatattcagaaccctgtgatgaatcaacagtctgcgtaggcaatcctaagatttttgaagctacagcgttctgtgaattataaggtgagataaaaacagcggagacccagcatggcgtat

SEQ ID NO: 448739 - DNA, 140 bp, Artificial Sequence
  Synthetic
aggccctggctgctgatatgcttaggattgcctacgcagactgttgattcatcacagggttctgaatatgactatgtcatattcacacaaactactgaaacagcacactcttgtaatgtcgaccttttgggacagcggtg

SEQ ID NO: 448740 - DNA, 140 bp, Artificial Sequence
  Synthetic
caccgctgtcccaaaaggtcgacattacaagagtgtgctgtttcagtagtttgtgtgaatatgacatagtcatattcagaaccctgtgatgaatcaacagtctgcgtaggcaatcctaagcatatcagcagccagggcct

SEQ ID NO: 448741 - DNA, 140 bp, Artificial Sequence
  Synthetic
atacgccatgctgggtctccaaccgcttcaatgtggctatcacaagggcaaaaattggcattttgtgcataatgtctgatagagatctttatgacaaactgcaatttacaagtctagaaacgtacttgggagtcggccat

SEQ ID NO: 448742 - DNA, 140 bp, Artificial Sequence
  Synthetic
atggccgactcccaagtacgtttctagacttgtaaattgcagtttgtcataaagatctctatcagacattatgcacaaaatgccaatttttgcccttgtgatagccacattgaagcggttggagacccagcatggcgtat

SEQ ID NO: 448743 - DNA, 140 bp, Artificial Sequence
  Synthetic
aggccctggctgctgatatgaatgtctgatagagatctttatgacaaactgcaatttacaagtctagaaataccacgtcgcaatgtggctacattacaagcagaaaatgtaactggacttgaccttttgggacagcggtg

SEQ ID NO: 448744 - DNA, 140 bp, Artificial Sequence
  Synthetic
caccgctgtcccaaaaggtcaagtccagttacattttctgcttgtaatgtagccacattgcgacgtggtatttctagacttgtaaattgcagtttgtcataaagatctctatcagacattcatatcagcagccagggcct

SEQ ID NO: 448745 - DNA, 140 bp, Artificial Sequence
  Synthetic
atacgccatgctgggtctcctttaaggactgtagtaagatcattactggtcttcatcctacacaggcacctacacacctcagcgttgatataaagttcaagactgaaggattatgtgttgcgtacttgggagtcggccat

SEQ ID NO: 448746 - DNA, 140 bp, Artificial Sequence
  Synthetic
atggccgactcccaagtacgcaacacataatccttcagtcttgaactttatatcaacgctgaggtgtgtaggtgcctgtgtaggatgaagaccagtaatgatcttactacagtccttaaaggagacccagcatggcgtat

SEQ ID NO: 448747 - DNA, 140 bp, Artificial Sequence
  Synthetic
aggccctggctgctgatatgtacacacctcagcgttgatataaagttcaagactgaaggattatgtgttgacataccaggcataccaaaggacatgacctaccgtagactcatctctatggaccttttgggacagcggtg

SEQ ID NO: 448748 - DNA, 140 bp, Artificial Sequence
  Synthetic
caccgctgtcccaaaaggtccatagagatgagtctacggtaggtcatgtcctttggtatgcctggtatgtcaacacataatccttcagtcttgaactttatatcaacgctgaggtgtgtacatatcagcagccagggcct

SEQ ID NO: 448749 - DNA, 140 bp, Artificial Sequence
  Synthetic
atacgccatgctgggtctccatgggtttcaaaatgaattaccaagtcaatggttaccctaatatgtttatcacccgcgaagaagctattcgtcacgttcgtgcgtggattggctttgatgcgtacttgggagtcggccat

SEQ ID NO: 448750 - DNA, 140 bp, Artificial Sequence
  Synthetic
atggccgactcccaagtacgcatcaaagccaatccacgcacgaacgtgacgaatagcttcttcgcgggtgataaacatattagggtaaccattgacttggtaattcattttgaaacccatggagacccagcatggcgtat

SEQ ID NO: 448751 - DNA, 140 bp, Artificial Sequence
  Synthetic
aggccctggctgctgatatgcacccgcgaagaagctattcgtcacgttcgtgcgtggattggctttgatgtagagggctgtcatgcaactagagatgctgtgggtactaacctacctctcgaccttttgggacagcggtg

SEQ ID NO: 448752 - DNA, 140 bp, Artificial Sequence
  Synthetic
caccgctgtcccaaaaggtcgagaggtaggttagtacccacagcatctctagttgcatgacagccctctacatcaaagccaatccacgcacgaacgtgacgaatagcttcttcgcgggtgcatatcagcagccagggcct

SEQ ID NO: 448753 - DNA, 140 bp, Artificial Sequence
  Synthetic
aggccctggctgctgatatggagccaccacattttcatcgaggccacgcggagtacgatcgagggtacagtgaataatgctagggagagctgcctatatggaagagccctaatgtgtaaagaccttttgggacagcggtg

SEQ ID NO: 448754 - DNA, 140 bp, Artificial Sequence
  Synthetic
caccgctgtcccaaaaggtctttacacattagggctcttccatataggcagctctccctagcattattcactgtaccctcgatcgtactccgcgtggcctcgatgaaaatgtggtggctccatatcagcagccagggcct

SEQ ID NO: 448755 - DNA, 140 bp, Artificial Sequence
  Synthetic
atacgccatgctgggtctcccagctaggattttctacaggtgttaacttagtagctgtaccgactggttatgttgacactgaaaataacacagaattcaccagagttaatgcaaaacctccgtacttgggagtcggccat

SEQ ID NO: 448756 - DNA, 140 bp, Artificial Sequence
  Synthetic
atggccgactcccaagtacggaggttttgcattaactctggtgaattctgtgttattttcagtgtcaacataaccagtcggtacagctactaagttaacacctgtagaaaatcctagctgggagacccagcatggcgtat

SEQ ID NO: 448757 - DNA, 140 bp, Artificial Sequence
  Synthetic
aggccctggctgctgatatgtgttgacactgaaaataacacagaattcaccagagttaatgcaaaacctccaccaggtgaccagtttaaacatcttataccactcatgtataaaggcttggaccttttgggacagcggtg

SEQ ID NO: 448758 - DNA, 140 bp, Artificial Sequence
  Synthetic
caccgctgtcccaaaaggtccaagcctttatacatgagtggtataagatgtttaaactggtcacctggtggaggttttgcattaactctggtgaattctgtgttattttcagtgtcaacacatatcagcagccagggcct

SEQ ID NO: 448759 - DNA, 140 bp, Artificial Sequence
  Synthetic
atacgccatgctgggtctccccctggaatgtagtgcgtattaagatagtacaaatgctcagtgatacactgaaaggattgtcagacagagtcgtgttcgtcctttgggcgcatggctttgcgtacttgggagtcggccat

SEQ ID NO: 448760 - DNA, 140 bp, Artificial Sequence
  Synthetic
atggccgactcccaagtacgcaaagccatgcgcccaaaggacgaacacgactctgtctgacaatcctttcagtgtatcactgagcatttgtactatcttaatacgcactacattccagggggagacccagcatggcgtat

SEQ ID NO: 448761 - DNA, 140 bp, Artificial Sequence
  Synthetic
aggccctggctgctgatatggaaaggattgtcagacagagtcgtgttcgtcctttgggcgcatggctttgagcttacatcaatgaagtactttgtcaagattggacctgaaagaacgtgtgaccttttgggacagcggtg

SEQ ID NO: 448762 - DNA, 140 bp, Artificial Sequence
  Synthetic
caccgctgtcccaaaaggtcacacgttctttcaggtccaatcttgacaaagtacttcattgatgtaagctcaaagccatgcgcccaaaggacgaacacgactctgtctgacaatcctttccatatcagcagccagggcct

SEQ ID NO: 448763 - DNA, 140 bp, Artificial Sequence
  Synthetic
atacgccatgctgggtctcctgtctgtgtgacaaacgtgcaacttgcttttctacttcatcagatacttatgcctgctggaatcattctgtgggttttgactatgtctataacccatttacgtacttgggagtcggccat

SEQ ID NO: 448764 - DNA, 140 bp, Artificial Sequence
  Synthetic
atggccgactcccaagtacgtaaatgggttatagacatagtcaaaacccacagaatgattccagcaggcataagtatctgatgaagtagaaaagcaagttgcacgtttgtcacacagacaggagacccagcatggcgtat

SEQ ID NO: 448765 - DNA, 140 bp, Artificial Sequence
  Synthetic
aggccctggctgctgatatgtgcctgctggaatcattctgtgggttttgactatgtctataacccatttatgattgatgttcagcagtggggctttacgggtaaccttcagagtaaccatgaccttttgggacagcggtg

SEQ ID NO: 448766 - DNA, 140 bp, Artificial Sequence
  Synthetic
caccgctgtcccaaaaggtcatggttactctgaaggttacccgtaaagccccactgctgaacatcaatcataaatgggttatagacatagtcaaaacccacagaatgattccagcaggcacatatcagcagccagggcct

SEQ ID NO: 448767 - DNA, 140 bp, Artificial Sequence
  Synthetic
atacgccatgctgggtctccgaccaacattgccaggtacatggaaatgcacatgtggctagttgtgatgctatcatgactagatgtttagcagtccatgagtgctttgttaagcgcgttgcgtacttgggagtcggccat

SEQ ID NO: 448768 - DNA, 140 bp, Artificial Sequence
  Synthetic
atggccgactcccaagtacgcaacgcgcttaacaaagcactcatggactgctaaacatctagtcatgatagcatcacaactagccacatgtgcatttccatgtacctggcaatgttggtcggagacccagcatggcgtat

SEQ ID NO: 448769 - DNA, 140 bp, Artificial Sequence
  Synthetic
aggccctggctgctgatatggacaaagcttacaaaatagaggaactcttctattcttatgctacacatcacgataaattcactgatggtgtttgtttgttttggaattgtaacgttgatcgaccttttgggacagcggtg

SEQ ID NO: 448770 - DNA, 140 bp, Artificial Sequence
  Synthetic
caccgctgtcccaaaaggtcgatcaacgttacaattccaaaacaaacaaacaccatcagtgaatttatcgtgatgtgtagcataagaatagaagagttcctctattttgtaagctttgtccatatcagcagccagggcct

SEQ ID NO: 448771 - DNA, 140 bp, Artificial Sequence
  Synthetic
atacgccatgctgggtctccgttacccagccaatgcaattgtgtgtaggtttgacacaagagtcttgtcaaacttgaacttaccaggctgtgatggtggtagtttgtatgtgaataagcacgtacttgggagtcggccat

SEQ ID NO: 448772 - DNA, 140 bp, Artificial Sequence
  Synthetic
atggccgactcccaagtacgtgcttattcacatacaaactaccaccatcacagcctggtaagttcaagtttgacaagactcttgtgtcaaacctacacacaattgcattggctgggtaacggagacccagcatggcgtat

SEQ ID NO: 448773 - DNA, 140 bp, Artificial Sequence
  Synthetic
aggccctggctgctgatatgatgtaaacgttttcgcaattccgtttacgatacatagtctactcttgtgcagaatgaattctcgtaactaaacagcacaagtaggtttagttaactttaagaccttttgggacagcggtg

SEQ ID NO: 448774 - DNA, 140 bp, Artificial Sequence
  Synthetic
caccgctgtcccaaaaggtcttaaagttaactaaacctacttgtgctgtttagttacgagaattcattctgcacaagagtagactatgtatcgtaaacggaattgcgaaaacgtttacatcatatcagcagccagggcct

SEQ ID NO: 448775 - DNA, 140 bp, Artificial Sequence
  Synthetic
atacgccatgctgggtctcctacacgatgcaatttaggtggtgctgtttgcagacaccatgcaaatgagtaccgacagtacttggatgcatataatatgatgatttctgctggatttagccgtacttgggagtcggccat

SEQ ID NO: 448776 - DNA, 140 bp, Artificial Sequence
  Synthetic
atggccgactcccaagtacggctaaatccagcagaaatcatcatattatatgcatccaagtactgtcggtactcatttgcatggtgtctgcaaacagcaccacctaaattgcatcgtgtaggagacccagcatggcgtat

SEQ ID NO: 448777 - DNA, 140 bp, Artificial Sequence
  Synthetic
aggccctggctgctgatatgcaggttacagagtttagaaaatgtggcttataatgttgttaataaaggacactttgatggacacgccggcgaagcacctgtttccatcattaataatgctgaccttttgggacagcggtg

SEQ ID NO: 448778 - DNA, 140 bp, Artificial Sequence
  Synthetic
caccgctgtcccaaaaggtcagcattattaatgatggaaacaggtgcttcgccggcgtgtccatcaaagtgtcctttattaacaacattataagccacattttctaaactctgtaacctgcatatcagcagccagggcct

SEQ ID NO: 448779 - DNA, 140 bp, Artificial Sequence
  Synthetic
aggccctggctgctgatatgactttgatggacacgccggcgaagcacctgtttccatcattaataatgctgtttacacaaaggtagatggtattgatgtggagatctttgaaaataagacgaccttttgggacagcggtg

SEQ ID NO: 448780 - DNA, 140 bp, Artificial Sequence
  Synthetic
caccgctgtcccaaaaggtcgtcttattttcaaagatctccacatcaataccatctacctttgtgtaaacagcattattaatgatggaaacaggtgcttcgccggcgtgtccatcaaagtcatatcagcagccagggcct

SEQ ID NO: 448781 - DNA, 140 bp, Artificial Sequence
  Synthetic
atacgccatgctgggtctccaacacttcctgttaatgttgcatttgagctttgggctaagcgtaacattaaaccagtgccagagattaagatactcaataatttgggtgttgatatcgctcgtacttgggagtcggccat

SEQ ID NO: 448782 - DNA, 140 bp, Artificial Sequence
  Synthetic
atggccgactcccaagtacgagcgatatcaacacccaaattattgagtatcttaatctctggcactggtttaatgttacgcttagcccaaagctcaaatgcaacattaacaggaagtgttggagacccagcatggcgtat

SEQ ID NO: 448783 - DNA, 140 bp, Artificial Sequence
  Synthetic
aggccctggctgctgatatgaaccagtgccagagattaagatactcaataatttgggtgttgatatcgctgctaatactgtaatctgggactacaaaagagaagccccagcacatgtatcgaccttttgggacagcggtg

SEQ ID NO: 448784 - DNA, 140 bp, Artificial Sequence
  Synthetic
caccgctgtcccaaaaggtcgatacatgtgctggggcttctcttttgtagtcccagattacagtattagcagcgatatcaacacccaaattattgagtatcttaatctctggcactggttcatatcagcagccagggcct

SEQ ID NO: 448785 - DNA, 140 bp, Artificial Sequence
  Synthetic
atacgccatgctgggtctccgagtcacattaattggagaatcagtaaaaacacagtttaactactttaagaaagtagacggcattattcaacagttgcctgaaacctactttactcagagcgtacttgggagtcggccat

SEQ ID NO: 448786 - DNA, 140 bp, Artificial Sequence
  Synthetic
atggccgactcccaagtacgctctgagtaaagtaggtttcaggcaactgttgaataatgccgtctactttcttaaagtagttaaactgtgtttttactgattctccaattaatgtgactcggagacccagcatggcgtat

SEQ ID NO: 448787 - DNA, 140 bp, Artificial Sequence
  Synthetic
aggccctggctgctgatatgaaagtagacggcattattcaacagttgcctgaaacctactttactcagagcagagacttagaggattttaagcccagatcacaaatggaaactgactttcgaccttttgggacagcggtg

SEQ ID NO: 448788 - DNA, 140 bp, Artificial Sequence
  Synthetic
caccgctgtcccaaaaggtcgaaagtcagtttccatttgtgatctgggcttaaaatcctctaagtctctgctctgagtaaagtaggtttcaggcaactgttgaataatgccgtctactttcatatcagcagccagggcct

SEQ ID NO: 448789 - DNA, 140 bp, Artificial Sequence
  Synthetic
atacgccatgctgggtctcctcgagctcgctatggatgaattcatacagcgatataagctcgagggctatgccttcgaacacatcgtttatggagatttcagtcatggacaacttggcggcgtacttgggagtcggccat

SEQ ID NO: 448790 - DNA, 140 bp, Artificial Sequence
  Synthetic
atggccgactcccaagtacgccgccaagttgtccatgactgaaatctccataaacgatgtgttcgaaggcatagccctcgagcttatatcgctgtatgaattcatccatagcgagctcgaggagacccagcatggcgtat

SEQ ID NO: 448791 - DNA, 140 bp, Artificial Sequence
  Synthetic
atacgccatgctgggtctccaattagaggattttatccctatggacagcacagtgaaaaattacttcataacagatgcgcaaacaggttcatcaaaatgtgtgtgttctgtgattgatctcgtacttgggagtcggccat

SEQ ID NO: 448792 - DNA, 140 bp, Artificial Sequence
  Synthetic
atggccgactcccaagtacgagatcaatcacagaacacacacattttgatgaacctgtttgcgcatctgttatgaagtaatttttcactgtgctgtccatagggataaaatcctctaattggagacccagcatggcgtat

SEQ ID NO: 448793 - DNA, 140 bp, Artificial Sequence
  Synthetic
aggccctggctgctgatatgtttcaaaagtggtcaaggttacaattgactatgctgaaatttcattcatgctttggtgtaaggatggacatgttgaaaccttctacccaaaactacaagcgaccttttgggacagcggtg

SEQ ID NO: 448794 - DNA, 140 bp, Artificial Sequence
  Synthetic
caccgctgtcccaaaaggtcgcttgtagttttgggtagaaggtttcaacatgtccatccttacaccaaagcatgaatgaaatttcagcatagtcaattgtaaccttgaccacttttgaaacatatcagcagccagggcct

SEQ ID NO: 448795 - DNA, 140 bp, Artificial Sequence
  Synthetic
atacgccatgctgggtctccgttataccaaaaggaataatgatgaatgtcgcaaagtatactcaactgtgtcaatacttaaatacacttactttagctgtaccctacaacatgagagttacgtacttgggagtcggccat

SEQ ID NO: 448796 - DNA, 140 bp, Artificial Sequence
  Synthetic
atggccgactcccaagtacgtaactctcatgttgtagggtacagctaaagtaagtgtatttaagtattgacacagttgagtatactttgcgacattcatcattattccttttggtataacggagacccagcatggcgtat

SEQ ID NO: 448797 - DNA, 140 bp, Artificial Sequence
  Synthetic
aggccctggctgctgatatgtcaatacttaaatacacttactttagctgtaccctacaacatgagagttattcactttggtgctggctctgataaaggagttgcaccaggtacagctgtggaccttttgggacagcggtg

SEQ ID NO: 448798 - DNA, 140 bp, Artificial Sequence
  Synthetic
caccgctgtcccaaaaggtccacagctgtacctggtgcaactcctttatcagagccagcaccaaagtgaataactctcatgttgtagggtacagctaaagtaagtgtatttaagtattgacatatcagcagccagggcct

SEQ ID NO: 448799 - DNA, 140 bp, Artificial Sequence
  Synthetic
atacgccatgctgggtctccctcagacaatggttgccaactggcacactacttgtcgattcagatcttaatgacttcgtctccgacgcagattctactttaattggagactgtgcaacagcgtacttgggagtcggccat

SEQ ID NO: 448800 - DNA, 140 bp, Artificial Sequence
  Synthetic
atggccgactcccaagtacgctgttgcacagtctccaattaaagtagaatctgcgtcggagacgaagtcattaagatctgaatcgacaagtagtgtgccagttggcaaccattgtctgagggagacccagcatggcgtat

SEQ ID NO: 448801 - DNA, 140 bp, Artificial Sequence
  Synthetic
aggccctggctgctgatatggacatggcaagcttaggccctttgagagagacatatctaatgtgcctttctctcctgatggcaaaccttgcaccccacctgctcctaattgttattggccgaccttttgggacagcggtg

SEQ ID NO: 448802 - DNA, 140 bp, Artificial Sequence
  Synthetic
caccgctgtcccaaaaggtcggccaataacaattaggagcaggtggggtgcaaggtttgccatcaggagagaaaggcacattagatatgtctctctcaaagggcctaagcttgccatgtccatatcagcagccagggcct

SEQ ID NO: 448803 - DNA, 140 bp, Artificial Sequence
  Synthetic
atacgccatgctgggtctcctacatacggctaataaatgggaccttattattagcgatatgtatgaccctaggaccaaacatgtgacaaaagagaatgactctaaagaagggtttttcaccgtacttgggagtcggccat

SEQ ID NO: 448804 - DNA, 140 bp, Artificial Sequence
  Synthetic
atggccgactcccaagtacggtgaaaaacccttctttagagtcattctcttttgtcacatgtttggtcctagggtcatacatatcgctaataataaggtcccatttattagccgtatgtaggagacccagcatggcgtat

SEQ ID NO: 448805 - DNA, 140 bp, Artificial Sequence
  Synthetic
aggccctggctgctgatatgaggaccaaacatgtgacaaaagagaatgactctaaagaagggtttttcacttatctgtgtggatttataaagcaaaaactagccctgggtggttctataggaccttttgggacagcggtg

SEQ ID NO: 448806 - DNA, 140 bp, Artificial Sequence
  Synthetic
caccgctgtcccaaaaggtcctatagaaccacccagggctagtttttgctttataaatccacacagataagtgaaaaacccttctttagagtcattctcttttgtcacatgtttggtcctcatatcagcagccagggcct

SEQ ID NO: 448807 - DNA, 140 bp, Artificial Sequence
  Synthetic
atacgccatgctgggtctccttatctgtgtggatttataaagcaaaaactagccctgggtggttctatagctgtaaagataacagagcattcttggaatgctgacctttacaagcttatgcgtacttgggagtcggccat

SEQ ID NO: 448808 - DNA, 140 bp, Artificial Sequence
  Synthetic
atggccgactcccaagtacgcataagcttgtaaaggtcagcattccaagaatgctctgttatctttacagctatagaaccacccagggctagtttttgctttataaatccacacagataaggagacccagcatggcgtat

SEQ ID NO: 448809 - DNA, 140 bp, Artificial Sequence
  Synthetic
atacgccatgctgggtctccggccatttctcatggtggacagcttttgttacaaatgtaaatgcatcatcatcggaagcatttttaattggggctaactatcttggcaagccgaaggaaccgtacttgggagtcggccat

SEQ ID NO: 448810 - DNA, 140 bp, Artificial Sequence
  Synthetic
atggccgactcccaagtacggttccttcggcttgccaagatagttagccccaattaaaaatgcttccgatgatgatgcatttacatttgtaacaaaagctgtccaccatgagaaatggccggagacccagcatggcgtat

SEQ ID NO: 448811 - DNA, 140 bp, Artificial Sequence
  Synthetic
aggccctggctgctgatatgatcggaagcatttttaattggggctaactatcttggcaagccgaaggaacaaattgatggctataccatgcatgctaactacattttctggaggaacacagaccttttgggacagcggtg

SEQ ID NO: 448812 - DNA, 140 bp, Artificial Sequence
  Synthetic
caccgctgtcccaaaaggtctgtgttcctccagaaaatgtagttagcatgcatggtatagccatcaatttgttccttcggcttgccaagatagttagccccaattaaaaatgcttccgatcatatcagcagccagggcct

SEQ ID NO: 448813 - DNA, 140 bp, Artificial Sequence
  Synthetic
atacgccatgctgggtctccaatcctatccagttgtcttcctattcactctttgacatgagcaaatttcctcttaaattaagaggaactgctgtaatgtctcttaaggagaatcaaatcacgtacttgggagtcggccat

SEQ ID NO: 448814 - DNA, 140 bp, Artificial Sequence
  Synthetic
atggccgactcccaagtacgtgatttgattctccttaagagacattacagcagttcctcttaatttaagaggaaatttgctcatgtcaaagagtgaataggaagacaactggataggattggagacccagcatggcgtat

SEQ ID NO: 448815 - DNA, 140 bp, Artificial Sequence
  Synthetic
aggccctggctgctgatatgtcttaaattaagaggaactgctgtaatgtctcttaaggagaatcaaatcaatgatatgatttattctcttctggaaaaaggtaggcttatcattagagaagaccttttgggacagcggtg

SEQ ID NO: 448816 - DNA, 140 bp, Artificial Sequence
  Synthetic
caccgctgtcccaaaaggtcttctctaatgataagcctacctttttccagaagagaataaatcatatcattgatttgattctccttaagagacattacagcagttcctcttaatttaagacatatcagcagccagggcct

SEQ ID NO: 448817 - DNA, 140 bp, Artificial Sequence
  Synthetic
atacgccatgctgggtctccaacaacagagttgtggtttcaagtgatattcttgttaacaactaaacgaacatgtttattttcttattatttcttactctcactagtggtagtgaccttgcgtacttgggagtcggccat

SEQ ID NO: 448818 - DNA, 140 bp, Artificial Sequence
  Synthetic
atggccgactcccaagtacgcaaggtcactaccactagtgagagtaagaaataataagaaaataaacatgttcgtttagttgttaacaagaatatcacttgaaaccacaactctgttgttggagacccagcatggcgtat

SEQ ID NO: 448819 - DNA, 140 bp, Artificial Sequence
  Synthetic
aggccctggctgctgatatgcatgtttattttcttattatttcttactctcactagtggtagtgaccttgaccggtgcaccacttttgatgatgttcaagctcctaattacactcaacatgaccttttgggacagcggtg

SEQ ID NO: 448820 - DNA, 140 bp, Artificial Sequence
  Synthetic
caccgctgtcccaaaaggtcatgttgagtgtaattaggagcttgaacatcatcaaaagtggtgcaccggtcaaggtcactaccactagtgagagtaagaaataataagaaaataaacatgcatatcagcagccagggcct

SEQ ID NO: 448821 - DNA, 140 bp, Artificial Sequence
  Synthetic
atacgccatgctgggtctccacttcatctatgaggggggtttactatcctgatgaaatttttagatcagacactctttatttaactcaggatttatttcttccattttattctaatgttacgtacttgggagtcggccat

SEQ ID NO: 448822 - DNA, 140 bp, Artificial Sequence
  Synthetic
atggccgactcccaagtacgtaacattagaataaaatggaagaaataaatcctgagttaaataaagagtgtctgatctaaaaatttcatcaggatagtaaacccccctcatagatgaagtggagacccagcatggcgtat

SEQ ID NO: 448823 - DNA, 140 bp, Artificial Sequence
  Synthetic
atacgccatgctgggtctcccagggtttcatactattaatcatacgtttggcaaccctgtcataccttttaaggatggtatttattttgctgccacagagaaatcaaatgttgtccgtggcgtacttgggagtcggccat

SEQ ID NO: 448824 - DNA, 140 bp, Artificial Sequence
  Synthetic
atggccgactcccaagtacgccacggacaacatttgatttctctgtggcagcaaaataaataccatccttaaaaggtatgacagggttgccaaacgtatgattaatagtatgaaaccctgggagacccagcatggcgtat

SEQ ID NO: 448825 - DNA, 140 bp, Artificial Sequence
  Synthetic
atacgccatgctgggtctccttgggtttttggttctaccatgaacaacaagtcacagtcggtgattattattaacaattctactaatgttgttatacgagcatgtaactttgaattgtgtcgtacttgggagtcggccat

SEQ ID NO: 448826 - DNA, 140 bp, Artificial Sequence
  Synthetic
atggccgactcccaagtacgacacaattcaaagttacatgctcgtataacaacattagtagaattgttaataataatcaccgactgtgacttgttgttcatggtagaaccaaaaacccaaggagacccagcatggcgtat

SEQ ID NO: 448827 - DNA, 140 bp, Artificial Sequence
  Synthetic
atacgccatgctgggtctcctatgatattcgataatgcatttaattgcactttcgagtacatatctgatgccttttcgcttgatgtttcagaaaagtcaggtaattttaaacacttacgacgtacttgggagtcggccat

SEQ ID NO: 448828 - DNA, 140 bp, Artificial Sequence
  Synthetic
atggccgactcccaagtacgtcgtaagtgtttaaaattacctgacttttctgaaacatcaagcgaaaaggcatcagatatgtactcgaaagtgcaattaaatgcattatcgaatatcataggagacccagcatggcgtat

SEQ ID NO: 448829 - DNA, 140 bp, Artificial Sequence
  Synthetic
aggccctggctgctgatatgccttttcgcttgatgtttcagaaaagtcaggtaattttaaacacttacgagagtttgtgtttaaaaataaagatgggtttctctatgtttataagggctagaccttttgggacagcggtg

SEQ ID NO: 448830 - DNA, 140 bp, Artificial Sequence
  Synthetic
caccgctgtcccaaaaggtctagcccttataaacatagagaaacccatctttatttttaaacacaaactctcgtaagtgtttaaaattacctgacttttctgaaacatcaagcgaaaaggcatatcagcagccagggcct

SEQ ID NO: 448831 - DNA, 140 bp, Artificial Sequence
  Synthetic
atacgccatgctgggtctcctcaacctatagatgtagttcgtgatctaccttctggttttaacactttgaaacctatttttaagttgcctcttggtattaacattacaaattttagagcccgtacttgggagtcggccat

SEQ ID NO: 448832 - DNA, 140 bp, Artificial Sequence
  Synthetic
atggccgactcccaagtacgggctctaaaatttgtaatgttaataccaagaggcaacttaaaaataggtttcaaagtgttaaaaccagaaggtagatcacgaactacatctataggttgaggagacccagcatggcgtat

SEQ ID NO: 448833 - DNA, 140 bp, Artificial Sequence
  Synthetic
aggccctggctgctgatatgggaaaagagtcatgtttaatggagttacatttagtaccttcgaggaggctgctttgtgtacctttttgctcaacaaggaaatgtacctaaaattgcgtaggaccttttgggacagcggtg

SEQ ID NO: 448834 - DNA, 140 bp, Artificial Sequence
  Synthetic
caccgctgtcccaaaaggtcctacgcaattttaggtacatttccttgttgagcaaaaaggtacacaaagcagcctcctcgaaggtactaaatgtaactccattaaacatgactcttttcccatatcagcagccagggcct

SEQ ID NO: 448835 - DNA, 140 bp, Artificial Sequence
  Synthetic
atacgccatgctgggtctccagcctattttgttggctatttaaagccaactacatttatgctcaagtatgatgaaaatggtacaatcacagatgctgttgattgttctcaaaatccacttcgtacttgggagtcggccat

SEQ ID NO: 448836 - DNA, 140 bp, Artificial Sequence
  Synthetic
atggccgactcccaagtacgaagtggattttgagaacaatcaacagcatctgtgattgtaccattttcatcatacttgagcataaatgtagttggctttaaatagccaacaaaataggctggagacccagcatggcgtat

SEQ ID NO: 448837 - DNA, 140 bp, Artificial Sequence
  Synthetic
aggccctggctgctgatatgatgaaaatggtacaatcacagatgctgttgattgttctcaaaatccacttgctgaactcaaatgctctgttaagagctttgagattgacaaaggaatttagaccttttgggacagcggtg

SEQ ID NO: 448838 - DNA, 140 bp, Artificial Sequence
  Synthetic
caccgctgtcccaaaaggtctaaattcctttgtcaatctcaaagctcttaacagagcatttgagttcagcaagtggattttgagaacaatcaacagcatctgtgattgtaccattttcatcatatcagcagccagggcct

SEQ ID NO: 448839 - DNA, 140 bp, Artificial Sequence
  Synthetic
atacgccatgctgggtctccccagacctctaatttcagggttgttccctcaggagatgttgtgagattccctaatattacaaacttgtgtccttttggagaggtttttaatgctactaaacgtacttgggagtcggccat

SEQ ID NO: 448840 - DNA, 140 bp, Artificial Sequence
  Synthetic
atggccgactcccaagtacgtttagtagcattaaaaacctctccaaaaggacacaagtttgtaatattagggaatctcacaacatctcctgagggaacaaccctgaaattagaggtctggggagacccagcatggcgtat

SEQ ID NO: 448841 - DNA, 140 bp, Artificial Sequence
  Synthetic
aggccctggctgctgatatgtgattactctgtgctctacaactcaacatttttttcaacctttaagtgctatggcgtttctgccactaagttgaatgatctttgcttctccaatgtctatgaccttttgggacagcggtg

SEQ ID NO: 448842 - DNA, 140 bp, Artificial Sequence
  Synthetic
caccgctgtcccaaaaggtcatagacattggagaagcaaagatcattcaacttagtggcagaaacgccatagcacttaaaggttgaaaaaaatgttgagttgtagagcacagagtaatcacatatcagcagccagggcct

SEQ ID NO: 448843 - DNA, 140 bp, Artificial Sequence
  Synthetic
atacgccatgctgggtctccaaagcatataaggattacctagcaagtggaggacaaccaatcaccaactgtgtgaagatgttgtgtacacacactggtacaggacaggcaattactgtaacgtacttgggagtcggccat

SEQ ID NO: 448844 - DNA, 140 bp, Artificial Sequence
  Synthetic
atggccgactcccaagtacgttacagtaattgcctgtcctgtaccagtgtgtgtacacaacatcttcacacagttggtgattggttgtcctccacttgctaggtaatccttatatgctttggagacccagcatggcgtat

SEQ ID NO: 448845 - DNA, 140 bp, Artificial Sequence
  Synthetic
atacgccatgctgggtctcctgggttgtgtccttgcttggaatactaggaacattgatgctacttcaactggtaattataattataaatataggtatcttagacatggcaagcttaggcccgtacttgggagtcggccat

SEQ ID NO: 448846 - DNA, 140 bp, Artificial Sequence
  Synthetic
atggccgactcccaagtacgggcctaagcttgccatgtctaagatacctatatttataattataattaccagttgaagtagcatcaatgttcctagtattccaagcaaggacacaacccaggagacccagcatggcgtat

SEQ ID NO: 448847 - DNA, 140 bp, Artificial Sequence
  Synthetic
atacgccatgctgggtctccctttgagagagacatatctaatgtgcctttctcccctgatggcaaaccttgcaccccacctgctcttaattgttattggccattaaatgattatggttttcgtacttgggagtcggccat

SEQ ID NO: 448848 - DNA, 140 bp, Artificial Sequence
  Synthetic
atggccgactcccaagtacgaaaaccataatcatttaatggccaataacaattaagagcaggtggggtgcaaggtttgccatcaggggagaaaggcacattagatatgtctctctcaaagggagacccagcatggcgtat

SEQ ID NO: 448849 - DNA, 140 bp, Artificial Sequence
  Synthetic
atacgccatgctgggtctcctacaccactactggcattggctaccaaccttacagagttgtagtactttcttttgaacttttaaatgcaccggccacggtttgtggaccaaaattatccacgtacttgggagtcggccat

SEQ ID NO: 448850 - DNA, 140 bp, Artificial Sequence
  Synthetic
atggccgactcccaagtacgtggataattttggtccacaaaccgtggccggtgcatttaaaagttcaaaagaaagtactacaactctgtaaggttggtagccaatgccagtagtggtgtaggagacccagcatggcgtat

SEQ ID NO: 448851 - DNA, 140 bp, Artificial Sequence
  Synthetic
aggccctggctgctgatatgttttgaacttttaaatgcaccggccacggtttgtggaccaaaattatccactgaccttattaagaaccagtgtgtcaattttaattttaatggactcactgaccttttgggacagcggtg

SEQ ID NO: 448852 - DNA, 140 bp, Artificial Sequence
  Synthetic
caccgctgtcccaaaaggtcagtgagtccattaaaattaaaattgacacactggttcttaataaggtcagtggataattttggtccacaaaccgtggccggtgcatttaaaagttcaaaacatatcagcagccagggcct

SEQ ID NO: 448853 - DNA, 140 bp, Artificial Sequence
  Synthetic
atacgccatgctgggtctccggtactggtgtgttaactccttcttcaaagagatttcaaccatttcaacaatttggccgtgatgtttctgatttcactgattccgttcgagatcctaaaacgtacttgggagtcggccat

SEQ ID NO: 448854 - DNA, 140 bp, Artificial Sequence
  Synthetic
atggccgactcccaagtacgttttaggatctcgaacggaatcagtgaaatcagaaacatcacggccaaattgttgaaatggttgaaatctctttgaagaaggagttaacacaccagtaccggagacccagcatggcgtat

SEQ ID NO: 448855 - DNA, 140 bp, Artificial Sequence
  Synthetic
aggccctggctgctgatatgtgttaactgcactgatgtttctacagcaattcatgcagatcaactcacaccagcttggcgcatatattctactggaaacaatgtattccagactcaagcagaccttttgggacagcggtg

SEQ ID NO: 448856 - DNA, 140 bp, Artificial Sequence
  Synthetic
caccgctgtcccaaaaggtctgcttgagtctggaatacattgtttccagtagaatatatgcgccaagctggtgtgagttgatctgcatgaattgctgtagaaacatcagtgcagttaacacatatcagcagccagggcct

SEQ ID NO: 448857 - DNA, 140 bp, Artificial Sequence
  Synthetic
aggccctggctgctgatatgcagcttggcgcatatattctactggaaacaatgtattccagactcaagcaggctgtcttataggagctgagcatgtcgacacttcttatgagtgcgacatgaccttttgggacagcggtg

SEQ ID NO: 448858 - DNA, 140 bp, Artificial Sequence
  Synthetic
caccgctgtcccaaaaggtcatgtcgcactcataagaagtgtcgacatgctcagctcctataagacagcctgcttgagtctggaatacattgtttccagtagaatatatgcgccaagctgcatatcagcagccagggcct

SEQ ID NO: 448859 - DNA, 140 bp, Artificial Sequence
  Synthetic
aggccctggctgctgatatgccctcttacagtaggagggtcttgtttgctttctggacataatcttgctaagaagtgtctgcatgttgttggacctaacctaaacgcaggtgaggacatcgaccttttgggacagcggtg

SEQ ID NO: 448860 - DNA, 140 bp, Artificial Sequence
  Synthetic
caccgctgtcccaaaaggtcgatgtcctcacctgcgtttaggttaggtccaacaacatgcagacacttcttagcaagattatgtccagaaagcaaacaagaccctcctactgtaagagggcatatcagcagccagggcct

SEQ ID NO: 448861 - DNA, 140 bp, Artificial Sequence
  Synthetic
aggccctggctgctgatatgccgtagattgtaatatgtacatctgcggagattctactgaatgtgctaatttgcttctccaatatggtagcttttgcacacaactaaatcgtgcactctcgaccttttgggacagcggtg

SEQ ID NO: 448862 - DNA, 140 bp, Artificial Sequence
  Synthetic
caccgctgtcccaaaaggtcgagagtgcacgatttagttgtgtgcaaaagctaccatattggagaagcaaattagcacattcagtagaatctccgcagatgtacatattacaatctacggcatatcagcagccagggcct

SEQ ID NO: 448863 - DNA, 140 bp, Artificial Sequence
  Synthetic
aggccctggctgctgatatgtgaggacttgctctttaataaggtgacactcgctgatgctggcttcatgaagcaatatggcgaatgcctaggtgatattaatgctagagatctcatttgtgaccttttgggacagcggtg

SEQ ID NO: 448864 - DNA, 140 bp, Artificial Sequence
  Synthetic
caccgctgtcccaaaaggtcacaaatgagatctctagcattaatatcacctaggcattcgccatattgcttcatgaagccagcatcagcgagtgtcaccttattaaagagcaagtcctcacatatcagcagccagggcct

SEQ ID NO: 448865 - DNA, 140 bp, Artificial Sequence
  Synthetic
aggccctggctgctgatatggatggacatttggtgctggcgctgctcttcaaataccttttgctatgcaaatggcatataggttcaatggcattggagttacccaaaatgttctctatgagaccttttgggacagcggtg

SEQ ID NO: 448866 - DNA, 140 bp, Artificial Sequence
  Synthetic
caccgctgtcccaaaaggtctcatagagaacattttgggtaactccaatgccattgaacctatatgccatttgcatagcaaaaggtatttgaagagcagcgccagcaccaaatgtccatccatatcagcagccagggcct

SEQ ID NO: 448867 - DNA, 140 bp, Artificial Sequence
  Synthetic
atacgccatgctgggtctccatggcatataggttcaatggcattggagttacccaaaatgttctctatgagaaccaaaaacaaatcgccaaccaatttaacaaggcgattagtcaaattccgtacttgggagtcggccat

SEQ ID NO: 448868 - DNA, 140 bp, Artificial Sequence
  Synthetic
atggccgactcccaagtacggaatttgactaatcgccttgttaaattggttggcgatttgtttttggttctcatagagaacattttgggtaactccaatgccattgaacctatatgccatggagacccagcatggcgtat

SEQ ID NO: 448869 - DNA, 140 bp, Artificial Sequence
  Synthetic
aggccctggctgctgatatggaaccaaaaacaaatcgccaaccaatttaacaaggcgattagtcaaattcaagaatcacttacaacaacatcaactgcattgggcaagctgcaagacgttgaccttttgggacagcggtg

SEQ ID NO: 448870 - DNA, 140 bp, Artificial Sequence
  Synthetic
caccgctgtcccaaaaggtcaacgtcttgcagcttgcccaatgcagttgatgttgttgtaagtgattcttgaatttgactaatcgccttgttaaattggttggcgatttgtttttggttccatatcagcagccagggcct

SEQ ID NO: 448871 - DNA, 140 bp, Artificial Sequence
  Synthetic
atacgccatgctgggtctccgttaaccagaatgctcaagcattaaacacacttgttaaacaacttagctctaattttggtgcaatttcaagtgtgctaaatgatatcctttcgcgacttgcgtacttgggagtcggccat

SEQ ID NO: 448872 - DNA, 140 bp, Artificial Sequence
  Synthetic
atggccgactcccaagtacgcaagtcgcgaaaggatatcatttagcacacttgaaattgcaccaaaattagagctaagttgtttaacaagtgtgtttaatgcttgagcattctggttaacggagacccagcatggcgtat

SEQ ID NO: 448873 - DNA, 140 bp, Artificial Sequence
  Synthetic
aggccctggctgctgatatgtaattttggtgcaatttcaagtgtgctaaatgatatcctttcgcgacttgataaagtcgaggcggaggtacaaattgacaggttaattacaggcagacttgaccttttgggacagcggtg

SEQ ID NO: 448874 - DNA, 140 bp, Artificial Sequence
  Synthetic
caccgctgtcccaaaaggtcaagtctgcctgtaattaacctgtcaatttgtacctccgcctcgactttatcaagtcgcgaaaggatatcatttagcacacttgaaattgcaccaaaattacatatcagcagccagggcct

SEQ ID NO: 448875 - DNA, 140 bp, Artificial Sequence
  Synthetic
atacgccatgctgggtctcccaaagccttcaaacctatgtaacacaacaactaatcagggctgctgaaatcagggcttctgctaatcttgctgctactaaaatgtctgagtgtgttcttgcgtacttgggagtcggccat

SEQ ID NO: 448876 - DNA, 140 bp, Artificial Sequence
  Synthetic
atggccgactcccaagtacgcaagaacacactcagacattttagtagcagcaagattagcagaagccctgatttcagcagccctgattagttgttgtgttacataggtttgaaggctttgggagacccagcatggcgtat

SEQ ID NO: 448877 - DNA, 140 bp, Artificial Sequence
  Synthetic
atacgccatgctgggtctccgacaatcaaaaagagttgacttttgtggaaagggctaccaccttatgtccttcccacaagcagccccgcatggtgttgtcttcctacatgtcacgtatgtcgtacttgggagtcggccat

SEQ ID NO: 448878 - DNA, 140 bp, Artificial Sequence
  Synthetic
atggccgactcccaagtacgacatacgtgacatgtaggaagacaacaccatgcggggctgcttgtgggaaggacataaggtggtagccctttccacaaaagtcaactctttttgattgtcggagacccagcatggcgtat

SEQ ID NO: 448879 - DNA, 140 bp, Artificial Sequence
  Synthetic
aggccctggctgctgatatgttcccacaagcagccccgcatggtgttgtcttcctacatgtcacgtatgtgccatcccaggagaggaacttcaccacagcgccagcaatttgtcatgaaggaccttttgggacagcggtg

SEQ ID NO: 448880 - DNA, 140 bp, Artificial Sequence
  Synthetic
caccgctgtcccaaaaggtccttcatgacaaattgctggcgctgtggtgaagttcctctcctgggatggcacatacgtgacatgtaggaagacaacaccatgcggggctgcttgtgggaacatatcagcagccagggcct

SEQ ID NO: 448881 - DNA, 140 bp, Artificial Sequence
  Synthetic
atacgccatgctgggtctccgccatcccaggagaggaacttcaccacagcgccagcaatttgtcatgaaggcaaagcatacttccctcgtgaaggtgtttttgtgtttaatggcacttctcgtacttgggagtcggccat

SEQ ID NO: 448882 - DNA, 140 bp, Artificial Sequence
  Synthetic
atggccgactcccaagtacgagaagtgccattaaacacaaaaacaccttcacgagggaagtatgctttgccttcatgacaaattgctggcgctgtggtgaagttcctctcctgggatggcggagacccagcatggcgtat

SEQ ID NO: 448883 - DNA, 140 bp, Artificial Sequence
  Synthetic
atacgccatgctgggtctcctggtttattacacagaggaacttcttttctccacaaataattactacagacaatacatttgtctcaggaaattgtgatgtcgttattggcatcattaacacgtacttgggagtcggccat

SEQ ID NO: 448884 - DNA, 140 bp, Artificial Sequence
  Synthetic
atggccgactcccaagtacgtgttaatgatgccaataacgacatcacaatttcctgagacaaatgtattgtctgtagtaattatttgtggagaaaagaagttcctctgtgtaataaaccaggagacccagcatggcgtat

SEQ ID NO: 448885 - DNA, 140 bp, Artificial Sequence
  Synthetic
aggccctggctgctgatatgggctttgtgctctaggaaaggttttaccttttcatagatggcacactatggttcaaacatgcacacctaatgttactatcaactgtcaagatccagctgggaccttttgggacagcggtg

SEQ ID NO: 448886 - DNA, 140 bp, Artificial Sequence
  Synthetic
caccgctgtcccaaaaggtcccagctggatcttgacagttgatagtaacattaggtgtgcatgtttgaaccatagtgtgccatctatgaaaaggtaaaacctttcctagagcacaaagcccatatcagcagccagggcct

SEQ ID NO: 448887 - DNA, 140 bp, Artificial Sequence
  Synthetic
atacgccatgctgggtctccctggacaagtacttcaaaaatcatacatcaccagatgttgatcttggcgacatttcaggcattaacgcttctgtcgtcaacattcaaaaagaaattgacccgtacttgggagtcggccat

SEQ ID NO: 448888 - DNA, 140 bp, Artificial Sequence
  Synthetic
atggccgactcccaagtacgggtcaatttctttttgaatgttgacgacagaagcgttaatgcctgaaatgtcgccaagatcaacatctggtgatgtatgatttttgaagtacttgtccagggagacccagcatggcgtat

SEQ ID NO: 448889 - DNA, 140 bp, Artificial Sequence
  Synthetic
atacgccatgctgggtctcccttggtaggtacatgtctgcgttaaaccacacaaagaaatggaaatttcctcaagttggtggtttaacttcaattaaatgggctgataacaattgttattcgtacttgggagtcggccat

SEQ ID NO: 448890 - DNA, 140 bp, Artificial Sequence
  Synthetic
atggccgactcccaagtacgaataacaattgttatcagcccatttaattgaagttaaaccaccaacttgaggaaatttccatttctttgtgtggtttaacgcagacatgtacctaccaagggagacccagcatggcgtat

SEQ ID NO: 448891 - DNA, 140 bp, Artificial Sequence
  Synthetic
aggccctggctgctgatatgcggcttcattgctggactaattgccatcgtcatggttacaatcttgctttgttgcatgactagttgttgcagttgcctcaagggtgcatgctcttgtggtgaccttttgggacagcggtg

SEQ ID NO: 448892 - DNA, 140 bp, Artificial Sequence
  Synthetic
caccgctgtcccaaaaggtcaccacaagagcatgcacccttgaggcaactgcaacaactagtcatgcaacaaagcaagattgtaaccatgacgatggcaattagtccagcaatgaagccgcatatcagcagccagggcct

SEQ ID NO: 448893 - DNA, 140 bp, Artificial Sequence
  Synthetic
aggccctggctgctgatatgtcttgctgcaagtttgatgaggatgactctgagccagttctcaagggtgtcaaattacattacacataaacgaacttatggatttgtttatgagatttttgaccttttgggacagcggtg

SEQ ID NO: 448894 - DNA, 140 bp, Artificial Sequence
  Synthetic
caccgctgtcccaaaaggtcaaaaatctcataaacaaatccataagttcgtttatgtgtaatgtaatttgacacccttgagaactggctcagagtcatcctcatcaaacttgcagcaagacatatcagcagccagggcct

SEQ ID NO: 448895 - DNA, 140 bp, Artificial Sequence
  Synthetic
aggccctggctgctgatatgctgcaagtactgttcatgctacagcaacgataccgctacaagcctcactccctttcggatggcttgttattggcgttgcatttcttgctgtttttcagaggaccttttgggacagcggtg

SEQ ID NO: 448896 - DNA, 140 bp, Artificial Sequence
  Synthetic
caccgctgtcccaaaaggtcctctgaaaaacagcaagaaatgcaacgccaataacaagccatccgaaagggagtgaggcttgtagcggtatcgttgctgtagcatgaacagtacttgcagcatatcagcagccagggcct

SEQ ID NO: 448897 - DNA, 140 bp, Artificial Sequence
  Synthetic
atacgccatgctgggtctcccctttcggatggcttgttattggcgttgcatttcttgctgtttttcagagcgctaccaaaataattgcgctcaataaaagatggcagctagccctttatacgtacttgggagtcggccat

SEQ ID NO: 448898 - DNA, 140 bp, Artificial Sequence
  Synthetic
atggccgactcccaagtacgtataaagggctagctgccatcttttattgagcgcaattattttggtagcgctctgaaaaacagcaagaaatgcaacgccaataacaagccatccgaaaggggagacccagcatggcgtat

SEQ ID NO: 448899 - DNA, 140 bp, Artificial Sequence
  Synthetic
atacgccatgctgggtctcctgagatgttggctttgttggaagtgcaaatccaagaacccattactttatgatgccaactactttgtttgctggcacacacataactatgactactgtatcgtacttgggagtcggccat

SEQ ID NO: 448900 - DNA, 140 bp, Artificial Sequence
  Synthetic
atggccgactcccaagtacgatacagtagtcatagttatgtgtgtgccagcaaacaaagtagttggcatcataaagtaatgggttcttggatttgcacttccaacaaagccaacatctcaggagacccagcatggcgtat

SEQ ID NO: 448901 - DNA, 140 bp, Artificial Sequence
  Synthetic
atacgccatgctgggtctccaccatataacagtgtcacagatacaattgtcgttactgaaggtgacggcatttcaacaccaaaactcaaagaagactaccaaattggtggttattctgagcgtacttgggagtcggccat

SEQ ID NO: 448902 - DNA, 140 bp, Artificial Sequence
  Synthetic
atggccgactcccaagtacgctcagaataaccaccaatttggtagtcttctttgagttttggtgttgaaatgccgtcaccttcagtaacgacaattgtatctgtgacactgttatatggtggagacccagcatggcgtat

SEQ ID NO: 448903 - DNA, 140 bp, Artificial Sequence
  Synthetic
atacgccatgctgggtctccgataggcactcaggtgttaaagactatgtcgttgtacatggctatttcaccgaagtttactaccagcttgagtctacacaaattactacagacactggtacgtacttgggagtcggccat

SEQ ID NO: 448904 - DNA, 140 bp, Artificial Sequence
  Synthetic
atggccgactcccaagtacgtaccagtgtctgtagtaatttgtgtagactcaagctggtagtaaacttcggtgaaatagccatgtacaacgacatagtctttaacacctgagtgcctatcggagacccagcatggcgtat

SEQ ID NO: 448905 - DNA, 140 bp, Artificial Sequence
  Synthetic
atacgccatgctgggtctccttgaaaatgctacattcttcatctttaacaagcttgttaaagacccaccgaatgtgcaaatacacacaatcgacggctcttcaggagttgctaatccagccgtacttgggagtcggccat

SEQ ID NO: 448906 - DNA, 140 bp, Artificial Sequence
  Synthetic
atggccgactcccaagtacggctggattagcaactcctgaagagccgtcgattgtgtgtatttgcacattcggtgggtctttaacaagcttgttaaagatgaagaatgtagcattttcaaggagacccagcatggcgtat

SEQ ID NO: 448907 - DNA, 140 bp, Artificial Sequence
  Synthetic
aggccctggctgctgatatgaatgtgcaaatacacacaatcgacggctcttcaggagttgctaatccagcaatggatccaatttatgatgagccgacgacgactactagcgtgcctttgtgaccttttgggacagcggtg

SEQ ID NO: 448908 - DNA, 140 bp, Artificial Sequence
  Synthetic
caccgctgtcccaaaaggtcacaaaggcacgctagtagtcgtcgtcggctcatcataaattggatccattgctggattagcaactcctgaagagccgtcgattgtgtgtatttgcacattcatatcagcagccagggcct

SEQ ID NO: 448909 - DNA, 140 bp, Artificial Sequence
  Synthetic
atacgccatgctgggtctccaagcacaagaaagtgagtacgaacttatgtactcattcgtttcggaagaaacaggtacgttaatagttaatagcgtacttctttttcttgctttcgtggtcgtacttgggagtcggccat

SEQ ID NO: 448910 - DNA, 140 bp, Artificial Sequence
  Synthetic
atggccgactcccaagtacgaccacgaaagcaagaaaaagaagtacgctattaactattaacgtacctgtttcttccgaaacgaatgagtacataagttcgtactcactttcttgtgcttggagacccagcatggcgtat

SEQ ID NO: 448911 - DNA, 140 bp, Artificial Sequence
  Synthetic
atacgccatgctgggtctccattcttgctagtcacactagccatccttactgcgcttcgattgtgtgcgtactgctgcaatattgttaacgtgagtttagtaaaaccaacggtttacgtccgtacttgggagtcggccat

SEQ ID NO: 448912 - DNA, 140 bp, Artificial Sequence
  Synthetic
atggccgactcccaagtacggacgtaaaccgttggttttactaaactcacgttaacaatattgcagcagtacgcacacaatcgaagcgcagtaaggatggctagtgtgactagcaagaatggagacccagcatggcgtat

SEQ ID NO: 448913 - DNA, 140 bp, Artificial Sequence
  Synthetic
aggccctggctgctgatatgtcctggaacaatggaacctagtaataggtttcctattcctagcctggattatgttactacaatttgcctattctaatcggaacaggtttttgtacataatgaccttttgggacagcggtg

SEQ ID NO: 448914 - DNA, 140 bp, Artificial Sequence
  Synthetic
caccgctgtcccaaaaggtcattatgtacaaaaacctgttccgattagaataggcaaattgtagtaacataatccaggctaggaataggaaacctattactaggttccattgttccaggacatatcagcagccagggcct

SEQ ID NO: 448915 - DNA, 140 bp, Artificial Sequence
  Synthetic
aggccctggctgctgatatgtgcttgctgctgtctacagaattaattgggtgactggcgggattgcgattgcaatggcttgtattgtaggcttgatgtggcttagctacttcgttgcttcgaccttttgggacagcggtg

SEQ ID NO: 448916 - DNA, 140 bp, Artificial Sequence
  Synthetic
caccgctgtcccaaaaggtcgaagcaacgaagtagctaagccacatcaagcctacaatacaagccattgcaatcgcaatcccgccagtcacccaattaattctgtagacagcagcaagcacatatcagcagccagggcct

SEQ ID NO: 448917 - DNA, 140 bp, Artificial Sequence
  Synthetic
atacgccatgctgggtctccgcaatggcttgtattgtaggcttgatgtggcttagctacttcgttgcttccttcaggctgtttgctcgtacccgctcaatgtggtcattcaacccagaaacgtacttgggagtcggccat

SEQ ID NO: 448918 - DNA, 140 bp, Artificial Sequence
  Synthetic
atggccgactcccaagtacgtttctgggttgaatgaccacattgagcgggtacgagcaaacagcctgaaggaagcaacgaagtagctaagccacatcaagcctacaatacaagccattgcggagacccagcatggcgtat

SEQ ID NO: 448919 - DNA, 140 bp, Artificial Sequence
  Synthetic
atacgccatgctgggtctcccaaacattcttctcaatgtgcctctccgggggacaattgtgaccagaccgctcatggaaagtgaacttgtcattggtgctgtgatcattcgtggtcacttcgtacttgggagtcggccat

SEQ ID NO: 448920 - DNA, 140 bp, Artificial Sequence
  Synthetic
atggccgactcccaagtacgaagtgaccacgaatgatcacagcaccaatgacaagttcactttccatgagcggtctggtcacaattgtcccccggagaggcacattgagaagaatgtttgggagacccagcatggcgtat

SEQ ID NO: 448921 - DNA, 140 bp, Artificial Sequence
  Synthetic
aggccctggctgctgatatgctcatggaaagtgaacttgtcattggtgctgtgatcattcgtggtcacttgcgaatggccggacactccctagggcgctgtgacattaaggacctgccaagaccttttgggacagcggtg

SEQ ID NO: 448922 - DNA, 140 bp, Artificial Sequence
  Synthetic
caccgctgtcccaaaaggtcttggcaggtccttaatgtcacagcgccctagggagtgtccggccattcgcaagtgaccacgaatgatcacagcaccaatgacaagttcactttccatgagcatatcagcagccagggcct

SEQ ID NO: 448923 - DNA, 140 bp, Artificial Sequence
  Synthetic
atacgccatgctgggtctccgctattgttgctgctgctactttggccttttctgtttactcaaccgttacttcaggcttactcttggtgtttatgactacttggtctctacacaagaattcgtacttgggagtcggccat

SEQ ID NO: 448924 - DNA, 140 bp, Artificial Sequence
  Synthetic
atggccgactcccaagtacgaattcttgtgtagagaccaagtagtcataaacaccaagagtaagcctgaagtaacggttgagtaaacagaaaaggccaaagtagcagcagcaacaatagcggagacccagcatggcgtat

SEQ ID NO: 448925 - DNA, 140 bp, Artificial Sequence
  Synthetic
atacgccatgctgggtctccaagagatcactgtggctacatcacgaacgctttcttattacaaattaggagcgtcgcagcgtgtaggcactgattcaggttttgctgcatacaaccgctacgtacttgggagtcggccat

SEQ ID NO: 448926 - DNA, 140 bp, Artificial Sequence
  Synthetic
atggccgactcccaagtacgtagcggttgtatgcagcaaaacctgaatcagtgcctacacgctgcgacgctcctaatttgtaataagaaagcgttcgtgatgtagccacagtgatctcttggagacccagcatggcgtat

SEQ ID NO: 448927 - DNA, 140 bp, Artificial Sequence
  Synthetic
aggccctggctgctgatatgttatttaagcctctaactaagaagaattattcggagttagatgatgaagaacctatggagttagattatccataaaacgaacatgaaaattattctcttcgaccttttgggacagcggtg

SEQ ID NO: 448928 - DNA, 140 bp, Artificial Sequence
  Synthetic
caccgctgtcccaaaaggtcgaagagaataattttcatgttcgttttatggataatctaactccataggttcttcatcatctaactccgaataattcttcttagttagaggcttaaataacatatcagcagccagggcct

SEQ ID NO: 448929 - DNA, 140 bp, Artificial Sequence
  Synthetic
atacgccatgctgggtctccacgagggcaattcaccatttcaccctcttgctgacaataaatttgcactaacttgcactagcacacactttgcttttgcttgtgctgacggtactcgacacgtacttgggagtcggccat

SEQ ID NO: 448930 - DNA, 140 bp, Artificial Sequence
  Synthetic
atggccgactcccaagtacgtgtcgagtaccgtcagcacaagcaaaagcaaagtgtgtgctagtgcaagttagtgcaaatttattgtcagcaagagggtgaaatggtgaattgccctcgtggagacccagcatggcgtat

SEQ ID NO: 448931 - DNA, 140 bp, Artificial Sequence
  Synthetic
atacgccatgctgggtctccaagaggaggttcaacaagagctctactcgccactttttctcattgttgctgctctagtatttttaatactttgcttcaccattaagagaaagacagaatgcgtacttgggagtcggccat

SEQ ID NO: 448932 - DNA, 140 bp, Artificial Sequence
  Synthetic
atggccgactcccaagtacgcattctgtctttctcttaatggtgaagcaaagtattaaaaatactagagcagcaacaatgagaaaaagtggcgagtagagctcttgttgaacctcctcttggagacccagcatggcgtat

SEQ ID NO: 448933 - DNA, 140 bp, Artificial Sequence
  Synthetic
atacgccatgctgggtctccaatgagctcactttaattgacttctatttgtgctttttagcctttctgctattccttgttttaataatgcttattatattttggttttcactcgaaatcccgtacttgggagtcggccat

SEQ ID NO: 448934 - DNA, 140 bp, Artificial Sequence
  Synthetic
atggccgactcccaagtacgggatttcgagtgaaaaccaaaatataataagcattattaaaacaaggaatagcagaaaggctaaaaagcacaaatagaagtcaattaaagtgagctcattggagacccagcatggcgtat

SEQ ID NO: 448935 - DNA, 140 bp, Artificial Sequence
  Synthetic
aggccctggctgctgatatgattccttgttttaataatgcttattatattttggttttcactcgaaatccaggatctagaagaaccttgtaccaaagtctaaacgaacatgaaacttctcgaccttttgggacagcggtg

SEQ ID NO: 448936 - DNA, 140 bp, Artificial Sequence
  Synthetic
caccgctgtcccaaaaggtcgagaagtttcatgttcgtttagactttggtacaaggttcttctagatcctggatttcgagtgaaaaccaaaatataataagcattattaaaacaaggaatcatatcagcagccagggcct

SEQ ID NO: 448937 - DNA, 140 bp, Artificial Sequence
  Synthetic
atacgccatgctgggtctccgaacacctcaaaaatggcacttgtggtctagtagagctggaaaaaggcgtactgccccagcttgaacagccctatgtgttcattaaacgttctgatgcctcgtacttgggagtcggccat

SEQ ID NO: 448938 - DNA, 140 bp, Artificial Sequence
  Synthetic
atggccgactcccaagtacgaggcatcagaacgtttaatgaacacatagggctgttcaagctggggcagtacgcctttttccagctctactagaccacaagtgccatttttgaggtgttcggagacccagcatggcgtat

SEQ ID NO: 448939 - DNA, 140 bp, Artificial Sequence
  Synthetic
aggccctggctgctgatatgtgttggtaccttcatgaaggtcaccaaactgctgcatttagagacgtacttgttgttttaaataaacgaacaaattaaaatgtctgataatggaccccaagaccttttgggacagcggtg

SEQ ID NO: 448940 - DNA, 140 bp, Artificial Sequence
  Synthetic
caccgctgtcccaaaaggtcttggggtccattatcagacattttaatttgttcgtttatttaaaacaacaagtacgtctctaaatgcagcagtttggtgaccttcatgaaggtaccaacacatatcagcagccagggcct

SEQ ID NO: 448941 - DNA, 140 bp, Artificial Sequence
  Synthetic
atacgccatgctgggtctccgccgaccccaaggtttacccaataatactgcgtcttggttcacagctctcactcagcatggcaaggaggaacttagattccctcgaggccagggcgttcccgtacttgggagtcggccat

SEQ ID NO: 448942 - DNA, 140 bp, Artificial Sequence
  Synthetic
atggccgactcccaagtacgggaacgccctggcctcgagggaatctaagttcctccttgccatgctgagtgagagctgtgaaccaagacgcagtattattgggtaaaccttggggtcggcggagacccagcatggcgtat

SEQ ID NO: 448943 - DNA, 140 bp, Artificial Sequence
  Synthetic
atacgccatgctgggtctccatcgcaacacacgtgaagtgttcgctcaagtcaaacaaatgtacaaaaccccaactttgaaatattttggtggttttaatttttcacaaatattacctgacgtacttgggagtcggccat

SEQ ID NO: 448944 - DNA, 140 bp, Artificial Sequence
  Synthetic
atggccgactcccaagtacgtcaggtaatatttgtgaaaaattaaaaccaccaaaatatttcaaagttggggttttgtacatttgtttgacttgagcgaacacttcacgtgtgttgcgatggagacccagcatggcgtat

SEQ ID NO: 448945 - DNA, 140 bp, Artificial Sequence
  Synthetic
aggccctggctgctgatatgatacacccaaagaccacattggcacccgcaatcctaataacaatgctgccaccgtgctacaacttcctcaaggaacaacattgccaaaaggcttctacgcgaccttttgggacagcggtg

SEQ ID NO: 448946 - DNA, 140 bp, Artificial Sequence
  Synthetic
caccgctgtcccaaaaggtcgcgtagaagccttttggcaatgttgttccttgaggaagttgtagcacggtggcagcattgttattaggattgcgggtgccaatgtggtctttgggtgtatcatatcagcagccagggcct

SEQ ID NO: 448947 - DNA, 140 bp, Artificial Sequence
  Synthetic
atacgccatgctgggtctccaccgtgctacaacttcctcaaggaacaacattgccaaaaggcttctacgcagagggaagcagaggcggcagtcaagcctcttctcgctcctcatcacgtacgtacttgggagtcggccat

SEQ ID NO: 448948 - DNA, 140 bp, Artificial Sequence
  Synthetic
atggccgactcccaagtacgtacgtgatgaggagcgagaagaggcttgactgccgcctctgcttccctctgcgtagaagccttttggcaatgttgttccttgaggaagttgtagcacggtggagacccagcatggcgtat

SEQ ID NO: 448949 - DNA, 140 bp, Artificial Sequence
  Synthetic
aggccctggctgctgatatgagagggaagcagaggcggcagtcaagcctcttctcgctcctcatcacgtagtcgcggtaattcaagaaattcaactcctggcagcagtaggggaaattctgaccttttgggacagcggtg

SEQ ID NO: 448950 - DNA, 140 bp, Artificial Sequence
  Synthetic
caccgctgtcccaaaaggtcagaatttcccctactgctgccaggagttgaatttcttgaattaccgcgactacgtgatgaggagcgagaagaggcttgactgccgcctctgcttccctctcatatcagcagccagggcct

SEQ ID NO: 448951 - DNA, 140 bp, Artificial Sequence
  Synthetic
aggccctggctgctgatatgcctgctcgaatggctagcggaggtggtgaaactgccctcgcgctattgctgctagacagattgaaccagcttgagagcaaagtttctggtaaaggccaacgaccttttgggacagcggtg

SEQ ID NO: 448952 - DNA, 140 bp, Artificial Sequence
  Synthetic
caccgctgtcccaaaaggtcgttggcctttaccagaaactttgctctcaagctggttcaatctgtctagcagcaatagcgcgagggcagtttcaccacctccgctagccattcgagcaggcatatcagcagccagggcct

SEQ ID NO: 448953 - DNA, 140 bp, Artificial Sequence
  Synthetic
aggccctggctgctgatatggctagacagattgaaccagcttgagagcaaagtttctggtaaaggccaacaacaacaaggccaaactgtcactaagaaatctgctgctgaggcatctaaagaccttttgggacagcggtg

SEQ ID NO: 448954 - DNA, 140 bp, Artificial Sequence
  Synthetic
caccgctgtcccaaaaggtctttagatgcctcagcagcagatttcttagtgacagtttggccttgttgttgttggcctttaccagaaactttgctctcaagctggttcaatctgtctagccatatcagcagccagggcct

SEQ ID NO: 448955 - DNA, 140 bp, Artificial Sequence
  Synthetic
aggccctggctgctgatatgtgcaagtcacataagcctcccattagttttccattatgtgctaatggtcaggtttttggtttatacaaaaacacatgtgtaggcagtgacaatgtcactggaccttttgggacagcggtg

SEQ ID NO: 448956 - DNA, 140 bp, Artificial Sequence
  Synthetic
caccgctgtcccaaaaggtccagtgacattgtcactgcctacacatgtgtttttgtataaaccaaaaacctgaccattagcacataatggaaaactaatgggaggcttatgtgacttgcacatatcagcagccagggcct

SEQ ID NO: 448957 - DNA, 140 bp, Artificial Sequence
  Synthetic
atacgccatgctgggtctccaagcctcgccaaaaacgtactgccacaaaacagtacaacgtcactcaagcatttgggagacgtggtccagaacaaacccaaggaaatttcggggaccaagcgtacttgggagtcggccat

SEQ ID NO: 448958 - DNA, 140 bp, Artificial Sequence
  Synthetic
atggccgactcccaagtacgcttggtccccgaaatttccttgggtttgttctggaccacgtctcccaaatgcttgagtgacgttgtactgttttgtggcagtacgtttttggcgaggcttggagacccagcatggcgtat

SEQ ID NO: 448959 - DNA, 140 bp, Artificial Sequence
  Synthetic
aggccctggctgctgatatgtttgctccaagtgcctctgcattctttggaatgtcacgcattggcatggaagtcacaccttcgggaacatggctgacttatcatggagccattaaattgggaccttttgggacagcggtg

SEQ ID NO: 448960 - DNA, 140 bp, Artificial Sequence
  Synthetic
caccgctgtcccaaaaggtcccaatttaatggctccatgataagtcagccatgttcccgaaggtgtgacttccatgccaatgcgtgacattccaaagaatgcagaggcacttggagcaaacatatcagcagccagggcct

SEQ ID NO: 448961 - DNA, 140 bp, Artificial Sequence
  Synthetic
atacgccatgctgggtctccgaaaaagactgatgaagctcagcctttgccgcagagacaaaagaagcagcccactgtgactcttcttcctgcggctgacatggatgatttctccagacaacgtacttgggagtcggccat

SEQ ID NO: 448962 - DNA, 140 bp, Artificial Sequence
  Synthetic
atggccgactcccaagtacgttgtctggagaaatcatccatgtcagccgcaggaagaagagtcacagtgggctgcttcttttgtctctgcggcaaaggctgagcttcatcagtctttttcggagacccagcatggcgtat

SEQ ID NO: 448963 - DNA, 140 bp, Artificial Sequence
  Synthetic
aggccctggctgctgatatgccactgtgactcttcttcctgcggctgacatggatgatttctccagacaacttcaaaattccatgagtggagcttctgctgattcaactcaggcataaacgaccttttgggacagcggtg

SEQ ID NO: 448964 - DNA, 140 bp, Artificial Sequence
  Synthetic
caccgctgtcccaaaaggtcgtttatgcctgagttgaatcagcagaagctccactcatggaattttgaagttgtctggagaaatcatccatgtcagccgcaggaagaagagtcacagtggcatatcagcagccagggcct

SEQ ID NO: 448965 - DNA, 140 bp, Artificial Sequence
  Synthetic
atacgccatgctgggtctccactcatgatgaccacacaaggcagatgggctatgtaaacgttttcgcaattccgtttacgatacatagtctactcttgtgcagaatgaattctcgtaactcgtacttgggagtcggccat

SEQ ID NO: 448966 - DNA, 140 bp, Artificial Sequence
  Synthetic
atggccgactcccaagtacgagttacgagaattcattctgcacaagagtagactatgtatcgtaaacggaattgcgaaaacgtttacatagcccatctgccttgtgtggtcatcatgagtggagacccagcatggcgtat

SEQ ID NO: 448967 - DNA, 140 bp, Artificial Sequence
  Synthetic
aggccctggctgctgatatgatcaatgtgtaacattagggaggacttgaaagagccaccacattttcatcgaggccacgcggagtacgatcgagggtacagtgaataatgctagggagaggaccttttgggacagcggtg

SEQ ID NO: 448968 - DNA, 140 bp, Artificial Sequence
  Synthetic
caccgctgtcccaaaaggtcctctccctagcattattcactgtaccctcgatcgtactccgcgtggcctcgatgaaaatgtggtggctctttcaagtcctccctaatgttacacattgatcatatcagcagccagggcct

SEQ ID NO: 448969 - DNA, 140 bp, Artificial Sequence
  Synthetic
aggccctggctgctgatatgcatcgaggccacgcggagtacgatcgagggtacagtgaataatgctagggagagctgcctatatggaagagccctaatgtgtaaaattaattttagtagtgaccttttgggacagcggtg

SEQ ID NO: 448970 - DNA, 140 bp, Artificial Sequence
  Synthetic
caccgctgtcccaaaaggtcactactaaaattaattttacacattagggctcttccatataggcagctctccctagcattattcactgtaccctcgatcgtactccgcgtggcctcgatgcatatcagcagccagggcct

SEQ ID NO: 448971 - DNA, 140 bp, Artificial Sequence
  Synthetic
aggccctggctgctgatatgcttgtatttctctatgcagttgcatatgcactgtagtacagcgctgtgcatctaataaacctcatgtgcttgaactgtcaagatccagctaggggtgcgcgaccttttgggacagcggtg

SEQ ID NO: 448972 - DNA, 140 bp, Artificial Sequence
  Synthetic
caccgctgtcccaaaaggtcgcgcacccctagctggatcttgacagttcaagcacatgaggtttattagatgcacagcgctgtactacagtgcatatgcaactgcatagagaaatacaagcatatcagcagccagggcct

SEQ ID NO: 448973 - DNA, 140 bp, Artificial Sequence
  Synthetic
atacgccatgctgggtctccgagtccagtagcactacgacagatgtcctgtgcggctggtaccacacaaacagcttgtactgatgacaatgcacttgcctactataacaattcgaagggacgtacttgggagtcggccat

SEQ ID NO: 448974 - DNA, 140 bp, Artificial Sequence
  Synthetic
atggccgactcccaagtacgtcccttcgaattgttatagtaggcaagtgcattgtcatcagtacaagctgtttgtgtggtaccagccgcacaggacatctgtcgtagtgctactggactcggagacccagcatggcgtat

SEQ ID NO: 448975 - DNA, 140 bp, Artificial Sequence
  Synthetic
atacgccatgctgggtctccttatgagcaggttgtcatggattatcttgataacctgaagcctagagtggaagcacctaaacaagaggagccaccaaacacagaagattccaaaactgagcgtacttgggagtcggccat

SEQ ID NO: 448976 - DNA, 140 bp, Artificial Sequence
  Synthetic
atggccgactcccaagtacgctcagttttggaatcttctgtgtttggtggctcctcttgtttaggtgcttccactctaggcttcaggttatcaagataatccatgacaacctgctcataaggagacccagcatggcgtat

SEQ ID NO: 448977 - DNA, 140 bp, Artificial Sequence
  Synthetic
atacgccatgctgggtctccatattaggtttttacctacccaggaaaagccaaccaacctcgatctcttgtagatctgttctctaaacgaactttaaaatctgtgtagctgtcgctcggccgtacttgggagtcggccat

SEQ ID NO: 448978 - DNA, 140 bp, Artificial Sequence
  Synthetic
atggccgactcccaagtacggccgagcgacagctacacagattttaaagttcgtttagagaacagatctacaagagatcgaggttggttggcttttcctgggtaggtaaaaacctaatatggagacccagcatggcgtat

SEQ ID NO: 448979 - DNA, 140 bp, Artificial Sequence
  Synthetic
aggccctggctgctgatatgtagatctgttctctaaacgaactttaaaatctgtgtagctgtcgctcggctgcatgcctagtgcacctacgcagtataaacaataataaattttactgtcgaccttttgggacagcggtg

SEQ ID NO: 448980 - DNA, 140 bp, Artificial Sequence
  Synthetic
caccgctgtcccaaaaggtcgacagtaaaatttattattgtttatactgcgtaggtgcactaggcatgcagccgagcgacagctacacagattttaaagttcgtttagagaacagatctacatatcagcagccagggcct

SEQ ID NO: 448981 - DNA, 140 bp, Artificial Sequence
  Synthetic
atacgccatgctgggtctccaggggcttttgcctcctaagagtagtattgatgctttcaagcttaacattaagttgttgggtattggaggtaaaccatgtatcaaggttgctactgtacacgtacttgggagtcggccat

SEQ ID NO: 448982 - DNA, 140 bp, Artificial Sequence
  Synthetic
atggccgactcccaagtacgtgtacagtagcaaccttgatacatggtttacctccaatacccaacaacttaatgttaagcttgaaagcatcaatactactcttaggaggcaaaagcccctggagacccagcatggcgtat

SEQ ID NO: 448983 - DNA, 140 bp, Artificial Sequence
  Synthetic
aggccctggctgctgatatggaccgaaaggtaagatggagagccttgttcttggtgtcaacgagaaaacacacgtccaactcagtttgcctgtccttcaggttagagacgtgctagtgcggaccttttgggacagcggtg

SEQ ID NO: 448984 - DNA, 140 bp, Artificial Sequence
  Synthetic
caccgctgtcccaaaaggtccgcactagcacgtctctaacctgaaggacaggcaaactgagttggacgtgtgttttctcgttgacaccaagaacaaggctctccatcttacctttcggtccatatcagcagccagggcct

SEQ ID NO: 448985 - DNA, 140 bp, Artificial Sequence
  Synthetic
aggccctggctgctgatatgatgcagcaaaccactcaattcctgatttgcaaagagcagctgtcaccatacttgatggtatttctgaacagtcattacgtcttgtcgacgcaatggtttagaccttttgggacagcggtg

SEQ ID NO: 448986 - DNA, 140 bp, Artificial Sequence
  Synthetic
caccgctgtcccaaaaggtctaaaccattgcgtcgacaagacgtaatgactgttcagaaataccatcaagtatggtgacagctgctctttgcaaatcaggaattgagtggtttgctgcatcatatcagcagccagggcct

SEQ ID NO: 448987 - DNA, 140 bp, Artificial Sequence
  Synthetic
atacgccatgctgggtctcccaatcacggccacaaggtcgttgagctggttgcagaaatggacggcattcagtacggtcgtagcggtataacactgggagtactcgtgccacatgtgggccgtacttgggagtcggccat

SEQ ID NO: 448988 - DNA, 140 bp, Artificial Sequence
  Synthetic
atggccgactcccaagtacggcccacatgtggcacgagtactcccagtgttataccgctacgaccgtactgaatgccgtccatttctgcaaccagctcaacgaccttgtggccgtgattgggagacccagcatggcgtat

SEQ ID NO: 448989 - DNA, 140 bp, Artificial Sequence
  Synthetic
aggccctggctgctgatatggtcgaagagaggtgtctactgctgccgtgaccatgagcatgaaattgcctggttcactgagcgctctgataagagctacgagcaccagacacccttcgaagaccttttgggacagcggtg

SEQ ID NO: 448990 - DNA, 140 bp, Artificial Sequence
  Synthetic
caccgctgtcccaaaaggtcttcgaagggtgtctggtgctcgtagctcttatcagagcgctcagtgaaccaggcaatttcatgctcatggtcacggcagcagtagacacctctcttcgaccatatcagcagccagggcct

SEQ ID NO: 448991 - DNA, 140 bp, Artificial Sequence
  Synthetic
aggccctggctgctgatatggagcttccaacaggagtacacgctggtactgacttagaaggtaaattctatggtccatttgttgacagacaaactgcacaggctgcaggtacagacacaagaccttttgggacagcggtg

SEQ ID NO: 448992 - DNA, 140 bp, Artificial Sequence
  Synthetic
caccgctgtcccaaaaggtcttgtgtctgtacctgcagcctgtgcagtttgtctgtcaacaaatggaccatagaatttaccttctaagtcagtaccagcgtgtactcctgttggaagctccatatcagcagccagggcct

SEQ ID NO: 448993 - DNA, 140 bp, Artificial Sequence
  Synthetic
atacgccatgctgggtctcctagttagtggtactgccactgctggatggacattggtgctggcgctgctcttcaataccttttgctatgcaaatggcatataggttcaatggcattggagcgtacttgggagtcggccat

SEQ ID NO: 448994 - DNA, 140 bp, Artificial Sequence
  Synthetic
atggccgactcccaagtacgctccaatgccattgaacctatatgccatttgcatagcaaaaggtattgaagagcagcgccagcaccaatgtccatccagcagtggcagtaccactaactaggagacccagcatggcgtat

SEQ ID NO: 448995 - DNA, 140 bp, Artificial Sequence
  Synthetic
aggccctggctgctgatatgaagctcctgccgtagtgtcagtatcatcaccagatgctgttactacatataatggatacctcacttcgtcatcaaagacatctgaggagcactttgtagagaccttttgggacagcggtg

SEQ ID NO: 448996 - DNA, 140 bp, Artificial Sequence
  Synthetic
caccgctgtcccaaaaggtctctacaaagtgctcctcagatgtctttgatgacgaagtgaggtatccattatatgtagtaacagcatctggtgatgatactgacactacggcaggagcttcatatcagcagccagggcct

SEQ ID NO: 448997 - DNA, 140 bp, Artificial Sequence
  Synthetic
atacgccatgctgggtctccaggtcttttattgaggacttgctctttaataaggtgacactcgctgatgctggcttcatgaagcaatatggcgaatgcctaggtgatattaatgctagagcgtacttgggagtcggccat

SEQ ID NO: 448998 - DNA, 140 bp, Artificial Sequence
  Synthetic
atggccgactcccaagtacgctctagcattaatatcacctaggcattcgccatattgcttcatgaagccagcatcagcgagtgtcaccttattaaagagcaagtcctcaataaaagacctggagacccagcatggcgtat

SEQ ID NO: 448999 - DNA, 140 bp, Artificial Sequence
  Synthetic
aggccctggctgctgatatgcacaaagaaatggaaatttcctcaagttggtggtttaacttcaattaaatgggctgataacaattgttatttgtctagtgttttattagcacttcaacaggaccttttgggacagcggtg

SEQ ID NO: 449000 - DNA, 140 bp, Artificial Sequence
  Synthetic
caccgctgtcccaaaaggtcctgttgaagtgctaataaaacactagacaaataacaattgttatcagcccatttaattgaagttaaaccaccaacttgaggaaatttccatttctttgtgcatatcagcagccagggcct

SEQ ID NO: 449001 - DNA, 140 bp, Artificial Sequence
  Synthetic
atacgccatgctgggtctccttcttttgttatgatgtctgcaccacctgctgagtataaattacagcaaggtacattcttatgtgcgaatgagtacactggtaactatcagtgtggtcatcgtacttgggagtcggccat

SEQ ID NO: 449002 - DNA, 140 bp, Artificial Sequence
  Synthetic
atggccgactcccaagtacgatgaccacactgatagttaccagtgtactcattcgcacataagaatgtaccttgctgtaatttatactcagcaggtggtgcagacatcataacaaaagaaggagacccagcatggcgtat

SEQ ID NO: 449003 - DNA, 140 bp, Artificial Sequence
  Synthetic
atacgccatgctgggtctcctacccagggggaaagccaaccaacctcgatctcttgtagatctgttctctaaacgaactttaaaatctgtgtagctgtcgctcggctgcatgcctagtgccgtacttgggagtcggccat

SEQ ID NO: 449004 - DNA, 140 bp, Artificial Sequence
  Synthetic
atggccgactcccaagtacggcactaggcatgcagccgagcgacagctacacagattttaaagttcgtttagagaacagatctacaagagatcgaggttggttggctttccccctgggtaggagacccagcatggcgtat

SEQ ID NO: 449005 - DNA, 140 bp, Artificial Sequence
  Synthetic
aggccctggctgctgatatggctgttatcaatggtgataggtggtttcttaatagattcaccactacttttgaatgactttaaccttgtggcaatgaagtacaactatgaaccttttgacgaccttttgggacagcggtg

SEQ ID NO: 449006 - DNA, 140 bp, Artificial Sequence
  Synthetic
caccgctgtcccaaaaggtcgtcaaaaggttcatagttgtacttcattgccacaaggttaaagtcattcaaaagtagtggtgaatctattaagaaaccacctatcaccattgataacagccatatcagcagccagggcct

SEQ ID NO: 449007 - DNA, 140 bp, Artificial Sequence
  Synthetic
aggccctggctgctgatatgaggaaacatcttacactacaaccatcaagcctgtgtcgtataaactcgatggagttacttacacagagattgaaccaaaattggatgggtattataaaaagaccttttgggacagcggtg

SEQ ID NO: 449008 - DNA, 140 bp, Artificial Sequence
  Synthetic
caccgctgtcccaaaaggtctttttataatacccatccaattttggttcaatctctgtgtaagtaactccatcgagtttatacgacacaggcttgatggttgtagtgtaagatgtttcctcatatcagcagccagggcct

SEQ ID NO: 449009 - DNA, 140 bp, Artificial Sequence
  Synthetic
atacgccatgctgggtctccgctcttgtggttcttgctgcaagtttgatgaggatgactctgagccagttctcaagggtgtcaaattacattacacataaacgaacttatggatttgtttcgtacttgggagtcggccat

SEQ ID NO: 449010 - DNA, 140 bp, Artificial Sequence
  Synthetic
atggccgactcccaagtacgaaacaaatccataagttcgtttatgtgtaatgtaatttgacacccttgagaactggctcagagtcatcctcatcaaacttgcagcaagaaccacaagagcggagacccagcatggcgtat

SEQ ID NO: 449011 - DNA, 140 bp, Artificial Sequence
  Synthetic
aggccctggctgctgatatgctcaagggtgtcaaattacattacacataaacgaacttatggatttgtttatgagattttttactcttggatcaattactgcacagccagtaaaaattgagaccttttgggacagcggtg

SEQ ID NO: 449012 - DNA, 140 bp, Artificial Sequence
  Synthetic
caccgctgtcccaaaaggtctcaatttttactggctgtgcagtaattgatccaagagtaaaaaatctcataaacaaatccataagttcgtttatgtgtaatgtaatttgacacccttgagcatatcagcagccagggcct

SEQ ID NO: 449013 - DNA, 140 bp, Artificial Sequence
  Synthetic
atacgccatgctgggtctcctgaagctttcgagaagatggtttctcttttgtactgttttgctatccatgcagggtgctgtagacattaataggttgtgcgaggaaaatgctcgataacccgtacttgggagtcggccat

SEQ ID NO: 449014 - DNA, 140 bp, Artificial Sequence
  Synthetic
atggccgactcccaagtacgggttatcgagcattttcctcgcacaacctattaatgtctacagcaccctgcatggatagcaaaacagtacaaaagagaaaccatcttctcgaaagcttcaggagacccagcatggcgtat

SEQ ID NO: 449015 - DNA, 140 bp, Artificial Sequence
  Synthetic
atacgccatgctgggtctccgtagtactagccaaaaatctattgtggcttatactatgtctttaggtgctgatagttcaattgcttactctaataacaccattgctatacctactaacttcgtacttgggagtcggccat

SEQ ID NO: 449016 - DNA, 140 bp, Artificial Sequence
  Synthetic
atggccgactcccaagtacgaagttagtaggtatagcaatggtgttattagagtaagcaattgaactatcagcacctaaagacatagtataagccacaatagatttttggctagtactacggagacccagcatggcgtat

SEQ ID NO: 449017 - DNA, 140 bp, Artificial Sequence
  Synthetic
atacgccatgctgggtctcccagacaaggaactgattacaaacagtggccgcaaattgcacaatttgctccaagtgcctctgcattctttggaatgtcacgcattggcatggaagtcacacgtacttgggagtcggccat

SEQ ID NO: 449018 - DNA, 140 bp, Artificial Sequence
  Synthetic
atggccgactcccaagtacgtgtgacttccatgccaatgcgtgacattccaaagaatgcagaggcacttggagcaaattgtgcaatttgcggccactgtttgtaatcagttccttgtctgggagacccagcatggcgtat

SEQ ID NO: 449019 - DNA, 140 bp, Artificial Sequence
  Synthetic
atacgccatgctgggtctccttgtacataataaagcttgttttcctctggctcttgtggccagtaacacttgcttgttttgtgcttgctgctgtctacagaattaattgggtgactggcgcgtacttgggagtcggccat

SEQ ID NO: 449020 - DNA, 140 bp, Artificial Sequence
  Synthetic
atggccgactcccaagtacgcgccagtcacccaattaattctgtagacagcagcaagcacaaaacaagcaagtgttactggccacaagagccagaggaaaacaagctttattatgtacaaggagacccagcatggcgtat

SEQ ID NO: 449021 - DNA, 140 bp, Artificial Sequence
  Synthetic
atacgccatgctgggtctcctattaggtttttacctacccaggaaaagccaaccgacctcgatctcttgtggatctgttctctaaacgaactttaaaatctgtgtagctgtcgctcggctcgtacttgggagtcggccat

SEQ ID NO: 449022 - DNA, 140 bp, Artificial Sequence
  Synthetic
atggccgactcccaagtacgagccgagcgacagctacacagattttaaagttcgtttagagaacagatccacaagagatcgaggtcggttggcttttcctgggtaggtaaaaacctaataggagacccagcatggcgtat

SEQ ID NO: 449023 - DNA, 140 bp, Artificial Sequence
  Synthetic
atacgccatgctgggtctccaccaagatctcaaatgggctagattccctaagagtgatggtacaggtacaatttacacagaactggaaccaccttgtaggtttgttacagacacaccaaacgtacttgggagtcggccat

SEQ ID NO: 449024 - DNA, 140 bp, Artificial Sequence
  Synthetic
atggccgactcccaagtacgtttggtgtgtctgtaacaaacctacaaggtggttccagttctgtgtaaattgtacctgtaccatcactcttagggaatctagcccatttgagatcttggtggagacccagcatggcgtat

SEQ ID NO: 449025 - DNA, 140 bp, Artificial Sequence
  Synthetic
aggccctggctgctgatatgtgtcataactactaaaatctcactcaagggtggtaagattgttagtacttgttttaaacttatgcttaaggccacattattgtgcgttcttgctgcattggaccttttgggacagcggtg

SEQ ID NO: 449026 - DNA, 140 bp, Artificial Sequence
  Synthetic
caccgctgtcccaaaaggtccaatgcagcaagaacgcacaataatgtggccttaagcataagtttaaaacaagtactaacaatcttaccacccttgagtgagattttagtagttatgacacatatcagcagccagggcct

SEQ ID NO: 449027 - DNA, 140 bp, Artificial Sequence
  Synthetic
aggccctggctgctgatatgtgaaacttctcattgttttgacttgtatttctctatgcagttgcatatgcactgtagtacagcgctgtgcatctaataaacctcatgtgcttgaagatccgaccttttgggacagcggtg

SEQ ID NO: 449028 - DNA, 140 bp, Artificial Sequence
  Synthetic
caccgctgtcccaaaaggtcggatcttcaagcacatgaggtttattagatgcacagcgctgtactacagtgcatatgcaactgcatagagaaatacaagtcaaaacaatgagaagtttcacatatcagcagccagggcct

SEQ ID NO: 449029 - DNA, 140 bp, Artificial Sequence
  Synthetic
atacgccatgctgggtctcctctacccaaaactacaagcaagtcaagcgtggcaaccaggtgttgcgatgcctaacttgtacaagatgcaaagaatgcttcttgaaaagtgtgaccttcacgtacttgggagtcggccat

SEQ ID NO: 449030 - DNA, 140 bp, Artificial Sequence
  Synthetic
atggccgactcccaagtacgtgaaggtcacacttttcaagaagcattctttgcatcttgtacaagttaggcatcgcaacacctggttgccacgcttgacttgcttgtagttttgggtagaggagacccagcatggcgtat

SEQ ID NO: 449031 - DNA, 140 bp, Artificial Sequence
  Synthetic
atacgccatgctgggtctcctcacttccctacggcgctaacaaagaaggcatcgtatgggttgcaactgagggagccttgaatacacccaaagaccacattggcacccgcaatcctaatacgtacttgggagtcggccat

SEQ ID NO: 449032 - DNA, 140 bp, Artificial Sequence
  Synthetic
atggccgactcccaagtacgtattaggattgcgggtgccaatgtggtctttgggtgtattcaaggctccctcagttgcaacccatacgatgccttctttgttagcgccgtagggaagtgaggagacccagcatggcgtat

SEQ ID NO: 449033 - DNA, 140 bp, Artificial Sequence
  Synthetic
atacgccatgctgggtctccttgctggttttgcaaagttcctaaaaactaattgctgtcgcttccaggagaaggatgaggaaggcaatttattagactcttactttgtagttaagaggcacgtacttgggagtcggccat

SEQ ID NO: 449034 - DNA, 140 bp, Artificial Sequence
  Synthetic
atggccgactcccaagtacgtgcctcttaactacaaagtaagagtctaataaattgccttcctcatccttctcctggaagcgacagcaattagtttttaggaactttgcaaaaccagcaaggagacccagcatggcgtat

SEQ ID NO: 449035 - DNA, 140 bp, Artificial Sequence
  Synthetic
atacgccatgctgggtctcccattaaattggatgacaaagatccacaattcaaagacaacgtcatactgctgaacaagcacattgacgcatacaaaacattcccaccaacagagcctaaacgtacttgggagtcggccat

SEQ ID NO: 449036 - DNA, 140 bp, Artificial Sequence
  Synthetic
atggccgactcccaagtacgtttaggctctgttggtgggaatgttttgtatgcgtcaatgtgcttgttcagcagtatgacgttgtctttgaattgtggatctttgtcatccaatttaatgggagacccagcatggcgtat

SEQ ID NO: 449037 - DNA, 140 bp, Artificial Sequence
  Synthetic
aggccctggctgctgatatggttttcgcaattccgtttacgatacatagtctactcttgtgcagaatgaattctcgtaactaaacagcacaagtaggtttagttaactttaatctcacatgaccttttgggacagcggtg

SEQ ID NO: 449038 - DNA, 140 bp, Artificial Sequence
  Synthetic
caccgctgtcccaaaaggtcatgtgagattaaagttaactaaacctacttgtgctgtttagttacgagaattcattctgcacaagagtagactatgtatcgtaaacggaattgcgaaaaccatatcagcagccagggcct

SEQ ID NO: 449039 - DNA, 140 bp, Artificial Sequence
  Synthetic
aggccctggctgctgatatgggagatgttgtgagattccctaatattacaaacttgtgtccttttggagaggtttttaatgctactaaattcccttctgtctatgcatgggagaggaaaagaccttttgggacagcggtg

SEQ ID NO: 449040 - DNA, 140 bp, Artificial Sequence
  Synthetic
caccgctgtcccaaaaggtcttttcctctcccatgcatagacagaagggaatttagtagcattaaaaacctctccaaaaggacacaagtttgtaatattagggaatctcacaacatctcccatatcagcagccagggcct

SEQ ID NO: 449041 - DNA, 140 bp, Artificial Sequence
  Synthetic
atacgccatgctgggtctccctagggagagctgcctatatggaagagccctaatgtgtaaaattaattttagtagtgctatccccatgtgattttacacattagggctcttccatataggcgtacttgggagtcggccat

SEQ ID NO: 449042 - DNA, 140 bp, Artificial Sequence
  Synthetic
atggccgactcccaagtacgcctatatggaagagccctaatgtgtaaaatcacatggggatagcactactaaaattaattttacacattagggctcttccatataggcagctctccctagggagacccagcatggcgtat

SEQ ID NO: 449043 - DNA, 140 bp, Artificial Sequence
  Synthetic
atacgccatgctgggtctccactgtcaagatccagctggtggtgcgcttatagctaggtgttggtaccttcatgaaggtcaccaaactgctgcatttagagacgtacttgttgttttaaacgtacttgggagtcggccat

SEQ ID NO: 449044 - DNA, 140 bp, Artificial Sequence
  Synthetic
atggccgactcccaagtacgtttaaaacaacaagtacgtctctaaatgcagcagtttggtgaccttcatgaaggtaccaacacctagctataagcgcaccaccagctggatcttgacagtggagacccagcatggcgtat

SEQ ID NO: 449045 - DNA, 140 bp, Artificial Sequence
  Synthetic
aggccctggctgctgatatgtgctagagatctcatttgtgcgcagaagttcaatggacttacagtgttgccacctctgctcactgatgatatgattgctgcctacactgctgctctagttgaccttttgggacagcggtg

SEQ ID NO: 449046 - DNA, 140 bp, Artificial Sequence
  Synthetic
caccgctgtcccaaaaggtcaactagagcagcagtgtaggcagcaatcatatcatcagtgagcagaggtggcaacactgtaagtccattgaacttctgcgcacaaatgagatctctagcacatatcagcagccagggcct

SEQ ID NO: 449047 - DNA, 140 bp, Artificial Sequence
  Synthetic
atacgccatgctgggtctcccaacatgtgattggactaatgctggcgattacatacttgccaacacttgtactgagagactcaagcttttcgcagcagaaacgctcaaagccactgaggacgtacttgggagtcggccat

SEQ ID NO: 449048 - DNA, 140 bp, Artificial Sequence
  Synthetic
atggccgactcccaagtacgtcctcagtggctttgagcgtttctgctgcgaaaagcttgagtctctcagtacaagtgttggcaagtatgtaatcgccagcattagtccaatcacatgttgggagacccagcatggcgtat

SEQ ID NO: 449049 - DNA, 140 bp, Artificial Sequence
  Synthetic
aggccctggctgctgatatggcctatatggaagagccctaatgtgtaaaattaattttagtagtgctatccccatgtgattttaatagcttcttaggagaatgacaaaaaaaaaaaaaaagaccttttgggacagcggtg

SEQ ID NO: 449050 - DNA, 140 bp, Artificial Sequence
  Synthetic
caccgctgtcccaaaaggtctttttttttttttttgtcattctcctaagaagctattaaaatcacatggggatagcactactaaaattaattttacacattagggctcttccatataggccatatcagcagccagggcct

SEQ ID NO: 449051 - DNA, 140 bp, Artificial Sequence
  Synthetic
aggccctggctgctgatatgtctagtagagctggaaaaaggcgtactgccccagcttgaacagccctatgtgttcattaaacgttctgatgccttaagcaccaatcacggccacaaggtcgaccttttgggacagcggtg

SEQ ID NO: 449052 - DNA, 140 bp, Artificial Sequence
  Synthetic
caccgctgtcccaaaaggtcgaccttgtggccgtgattggtgcttaaggcatcagaacgtttaatgaacacatagggctgttcaagctggggcagtacgcctttttccagctctactagacatatcagcagccagggcct

SEQ ID NO: 449053 - DNA, 140 bp, Artificial Sequence
  Synthetic
aggccctggctgctgatatgatctttctatgtctatgcaaatggaggccgtggcttctgcaagactcacaattggaattgtctcaattgtgacacattttgcactggtagtacattcattgaccttttgggacagcggtg

SEQ ID NO: 449054 - DNA, 140 bp, Artificial Sequence
  Synthetic
caccgctgtcccaaaaggtcaatgaatgtactaccagtgcaaaatgtgtcacaattgagacaattccaattgtgagtcttgcagaagccacggcctccatttgcatagacatagaaagatcatatcagcagccagggcct

SEQ ID NO: 449055 - DNA, 140 bp, Artificial Sequence
  Synthetic
atacgccatgctgggtctcccatgaaattgcctggttcactgagcgctctgataagagctacgagcaccagacacccttcgaaattaagagtgccaagaaatttgacactttcaaaggggcgtacttgggagtcggccat

SEQ ID NO: 449056 - DNA, 140 bp, Artificial Sequence
  Synthetic
atggccgactcccaagtacgcccctttgaaagtgtcaaatttcttggcactcttaatttcgaagggtgtctggtgctcgtagctcttatcagagcgctcagtgaaccaggcaatttcatgggagacccagcatggcgtat

SEQ ID NO: 449057 - DNA, 140 bp, Artificial Sequence
  Synthetic
atacgccatgctgggtctccaccatcccaattgtattaactgtttggatgataggtgtatccttcattgtgcaaactttaatgtgttattttctactgtgtttccacctacaagttttggcgtacttgggagtcggccat

SEQ ID NO: 449058 - DNA, 140 bp, Artificial Sequence
  Synthetic
atggccgactcccaagtacgccaaaacttgtaggtggaaacacagtagaaaataacacattaaagtttgcacaatgaaggatacacctatcatccaaacagttaatacaattgggatggtggagacccagcatggcgtat

SEQ ID NO: 449059 - DNA, 140 bp, Artificial Sequence
  Synthetic
atacgccatgctgggtctccactggcattactggtgacaatgtggagaccttgaatgaggatctccttgagatactgagtcgtgaacgtgttaacattaacattgttggcgattttcattcgtacttgggagtcggccat

SEQ ID NO: 449060 - DNA, 140 bp, Artificial Sequence
  Synthetic
atggccgactcccaagtacgaatgaaaatcgccaacaatgttaatgttaacacgttcacgactcagtatctcaaggagatcctcattcaaggtctccacattgtcaccagtaatgccagtggagacccagcatggcgtat

SEQ ID NO: 449061 - DNA, 140 bp, Artificial Sequence
  Synthetic
aggccctggctgctgatatgtgaacttaccaggctgtgatggtggtagtttgtatgtgaataagcatgcattccacactccagctttcgataaaagtgcatttactaatttaaagcaattgaccttttgggacagcggtg

SEQ ID NO: 449062 - DNA, 140 bp, Artificial Sequence
  Synthetic
caccgctgtcccaaaaggtcaattgctttaaattagtaaatgcacttttatcgaaagctggagtgtggaatgcatgcttattcacatacaaactaccaccatcacagcctggtaagttcacatatcagcagccagggcct

SEQ ID NO: 449063 - DNA, 140 bp, Artificial Sequence
  Synthetic
atacgccatgctgggtctccaacaacatgcacttgtctaccttgatgaaatgtaatcattgcgatgaagtttcatggcagacgtgcgactttctgaaagccacttgtgaacattgtggcacgtacttgggagtcggccat

SEQ ID NO: 449064 - DNA, 140 bp, Artificial Sequence
  Synthetic
atggccgactcccaagtacgtgccacaatgttcacaagtggctttcagaaagtcgcacgtctgccatgaaacttcatcgcaatgattacatttcatcaaggtagacaagtgcatgttgttggagacccagcatggcgtat

SEQ ID NO: 449065 - DNA, 140 bp, Artificial Sequence
  Synthetic
aggccctggctgctgatatgttctatttgtgctttttagcctttctgctattccttgttttaataatgcttattatattttggttttcactcgaaatccaggatctagaagaaccttgtagaccttttgggacagcggtg

SEQ ID NO: 449066 - DNA, 140 bp, Artificial Sequence
  Synthetic
caccgctgtcccaaaaggtctacaaggttcttctagatcctggatttcgagtgaaaaccaaaatataataagcattattaaaacaaggaatagcagaaaggctaaaaagcacaaatagaacatatcagcagccagggcct

SEQ ID NO: 449067 - DNA, 140 bp, Artificial Sequence
  Synthetic
aggccctggctgctgatatgtattatattttggttttcactcgaaatccaggatctagaagaaccttgtaccaaagtctaaacgaacatgaaacttctcattgttttgacttgtatttctgaccttttgggacagcggtg

SEQ ID NO: 449068 - DNA, 140 bp, Artificial Sequence
  Synthetic
caccgctgtcccaaaaggtcagaaatacaagtcaaaacaatgagaagtttcatgttcgtttagactttggtacaaggttcttctagatcctggatttcgagtgaaaaccaaaatataatacatatcagcagccagggcct

SEQ ID NO: 449069 - DNA, 140 bp, Artificial Sequence
  Synthetic
atacgccatgctgggtctcccataatcttgctaagaagtgtctgcatgttgttggacctaacctaaatgcaggtgaggacatccagcttcttaaggcagcatatgaaaatttcaattcaccgtacttgggagtcggccat

SEQ ID NO: 449070 - DNA, 140 bp, Artificial Sequence
  Synthetic
atggccgactcccaagtacggtgaattgaaattttcatatgctgccttaagaagctggatgtcctcacctgcatttaggttaggtccaacaacatgcagacacttcttagcaagattatgggagacccagcatggcgtat

SEQ ID NO: 449071 - DNA, 140 bp, Artificial Sequence
  Synthetic
atacgccatgctgggtctccagaagtagtggaaaatcctaccatacagaaggaagtcatagagtgtgacgtgaaaactaccgaagttgtaggcaaatgtcatacttaaaccatcagatgacgtacttgggagtcggccat

SEQ ID NO: 449072 - DNA, 140 bp, Artificial Sequence
  Synthetic
atggccgactcccaagtacgtcatctgatggtttaagtatgacatttgcctacaacttcggtagttttcacgtcacactctatgacttccttctgtatggtaggattttccactacttctggagacccagcatggcgtat

SEQ ID NO: 449073 - DNA, 140 bp, Artificial Sequence
  Synthetic
atacgccatgctgggtctcctaagctgtcatatggtattgccactgtacgcgaagtactctctgacagagaattgcatctttcatgggaggttggaaaacctagaccaccattgaacagacgtacttgggagtcggccat

SEQ ID NO: 449074 - DNA, 140 bp, Artificial Sequence
  Synthetic
atggccgactcccaagtacgtctgttcaatggtggtctaggttttccaacctcccatgaaagatgcaattctctgtcagagagtacttcgcgtacagtggcaataccatatgacagcttaggagacccagcatggcgtat

SEQ ID NO: 449075 - DNA, 140 bp, Artificial Sequence
  Synthetic
aggccctggctgctgatatgcatccgctctcccattttgtcaatttagacaatttgagagctaacaaacactaaaggttcactgcctattaatgccatagtttttgatggcaagtccaaagaccttttgggacagcggtg

SEQ ID NO: 449076 - DNA, 140 bp, Artificial Sequence
  Synthetic
caccgctgtcccaaaaggtctttggacttgccatcaaaaactatggcattaataggcagtgaacctttagtgtttgttagctctcaaattgtctaaattgacaaaatgggagagcggatgcatatcagcagccagggcct

SEQ ID NO: 449077 - DNA, 140 bp, Artificial Sequence
  Synthetic
aggccctggctgctgatatgaaccacgtaccctggacaaggatgtgctggttatacacttgaggaagctaagactgctcttaagaaatgcaaatctgcattttatgtactaccttcagaagaccttttgggacagcggtg

SEQ ID NO: 449078 - DNA, 140 bp, Artificial Sequence
  Synthetic
caccgctgtcccaaaaggtcttctgaaggtagtacataaaatgcagatttgcatttcttaagagcagtcttagcttcctcaagtgtataaccagcacatccttgtccagggtacgtggttcatatcagcagccagggcct

SEQ ID NO: 449079 - DNA, 140 bp, Artificial Sequence
  Synthetic
aggccctggctgctgatatgaggatgttattgaatgtctcaaactttcacatcactctgacttagaagtgacaggtgacagttgtaacaatttcatgctcacctataataaggttgaaaagaccttttgggacagcggtg

SEQ ID NO: 449080 - DNA, 140 bp, Artificial Sequence
  Synthetic
caccgctgtcccaaaaggtcttttcaaccttattataggtgagcatgaaattgttacaactgtcacctgtcacttctaagtcagagtgatgtgaaagtttgagacattcaataacatcctcatatcagcagccagggcct

SEQ ID NO: 449081 - DNA, 140 bp, Artificial Sequence
  Synthetic
aggccctggctgctgatatgcagttgcatacgcactgtagtacagcgctgtgcatctaataaacctcatgtgcttgaagatccttgtcctactggttaccaacctgaatggaatataagggaccttttgggacagcggtg

SEQ ID NO: 449082 - DNA, 140 bp, Artificial Sequence
  Synthetic
caccgctgtcccaaaaggtcccttatattccattcaggttggtaaccagtaggacaaggatcttcaagcacatgaggtttattagatgcacagcgctgtactacagtgcgtatgcaactgcatatcagcagccagggcct

SEQ ID NO: 449083 - DNA, 140 bp, Artificial Sequence
  Synthetic
atacgccatgctgggtctcctgctgaaattgttgacactgtgagtgctttagtttatgacaataagctaaaagcacacaaggataagtcagctcaatgcttcaaaatgttctacaaaggtcgtacttgggagtcggccat

SEQ ID NO: 449084 - DNA, 140 bp, Artificial Sequence
  Synthetic
atggccgactcccaagtacgacctttgtagaacattttgaagcattgagctgacttatccttgtgtgcttttagcttattgtcataaactaaagcactcacagtgtcaacaatttcagcaggagacccagcatggcgtat

SEQ ID NO: 449085 - DNA, 140 bp, Artificial Sequence
  Synthetic
aggccctggctgctgatatgataatcaggatcttaatgggaactggtacgatttcggtgatttcgtacaagtagcaccaggctgcggagttcctattgtggattcatattactcattgctgaccttttgggacagcggtg

SEQ ID NO: 449086 - DNA, 140 bp, Artificial Sequence
  Synthetic
caccgctgtcccaaaaggtcagcaatgagtaatatgaatccacaataggaactccgcagcctggtgctacttgtacgaaatcaccgaaatcgtaccagttcccattaagatcctgattatcatatcagcagccagggcct

SEQ ID NO: 449087 - DNA, 140 bp, Artificial Sequence
  Synthetic
aggccctggctgctgatatgtcattgcgcaaactttaatgtgttattttctactgtgtttccacctacaagttttggaccactagtaagaaaaatatttgtagatggtgttccttttgttgaccttttgggacagcggtg

SEQ ID NO: 449088 - DNA, 140 bp, Artificial Sequence
  Synthetic
caccgctgtcccaaaaggtcaacaaaaggaacaccatctacaaatatttttcttactagtggtccaaaacttgtaggtggaaacacagtagaaaataacacattaaagtttgcgcaatgacatatcagcagccagggcct

SEQ ID NO: 449089 - DNA, 140 bp, Artificial Sequence
  Synthetic
atacgccatgctgggtctccagtgtcacagatacaattgtcgttactgcaggtgacggcatttcaacaccaaaactcaaagaagactaccaaattggtggttattctgaggattggcactcgtacttgggagtcggccat

SEQ ID NO: 449090 - DNA, 140 bp, Artificial Sequence
  Synthetic
atggccgactcccaagtacgagtgccaatcctcagaataaccaccaatttggtagtcttctttgagttttggtgttgaaatgccgtcacctgcagtaacgacaattgtatctgtgacactggagacccagcatggcgtat

SEQ ID NO: 449091 - DNA, 140 bp, Artificial Sequence
  Synthetic
aggccctggctgctgatatgttatgataatcttaagacaggtgtttccattccatgtgtgtgtggtcgtgatgctacacaatatctagtacaacaagagtcttcttttgttatgatgtctgaccttttgggacagcggtg

SEQ ID NO: 449092 - DNA, 140 bp, Artificial Sequence
  Synthetic
caccgctgtcccaaaaggtcagacatcataacaaaagaagactcttgttgtactagatattgtgtagcatcacgaccacacacacatggaatggaaacacctgtcttaagattatcataacatatcagcagccagggcct

SEQ ID NO: 449093 - DNA, 140 bp, Artificial Sequence
  Synthetic
aggccctggctgctgatatgcttttactattctgatagtccttgtgagtctcatggcaaacaagtagtgtcggatattgattatgttccactcaaatctgctacgtgtattacacgatgcgaccttttgggacagcggtg

SEQ ID NO: 449094 - DNA, 140 bp, Artificial Sequence
  Synthetic
caccgctgtcccaaaaggtcgcatcgtgtaatacacgtagcagatttgagtggaacataatcaatatccgacactacttgtttgccatgagactcacaaggactatcagaatagtaaaagcatatcagcagccagggcct

SEQ ID NO: 449095 - DNA, 140 bp, Artificial Sequence
  Synthetic
atacgccatgctgggtctccgagtagtattgatgctttcaagcttaaccattaagttgttgggtattggaggtaaaccatgtatcaaggttgctactgtaccagtctaaaatgtctgacgcgtacttgggagtcggccat

SEQ ID NO: 449096 - DNA, 140 bp, Artificial Sequence
  Synthetic
atggccgactcccaagtacgcgtcagacattttagactggtacagtagcaaccttgatacatggtttacctccaatacccaacaacttaatggttaagcttgaaagcatcaatactactcggagacccagcatggcgtat

SEQ ID NO: 449097 - DNA, 140 bp, Artificial Sequence
  Synthetic
atacgccatgctgggtctccgactttgtcgagataataaagtcacaagatttgtcagtgatttcaaaagtggtcaaggttacaattgactatgctgaaatttcattcatgctttggtgtacgtacttgggagtcggccat

SEQ ID NO: 449098 - DNA, 140 bp, Artificial Sequence
  Synthetic
atggccgactcccaagtacgtacaccaaagcatgaatgaaatttcagcatagtcaattgtaaccttgaccacttttgaaatcactgacaaatcttgtgactttattatctcgacaaagtcggagacccagcatggcgtat

SEQ ID NO: 449099 - DNA, 140 bp, Artificial Sequence
  Synthetic
aggccctggctgctgatatggttttacacttagaaacacagtctgtaccgtctgcggaatgtggaaaggttatggctgtagttgtgaccaactccgcgaacccttgatgcagtctgcggagaccttttgggacagcggtg

SEQ ID NO: 449100 - DNA, 140 bp, Artificial Sequence
  Synthetic
caccgctgtcccaaaaggtctccgcagactgcatcaagggttcgcggagttggtcacaactacagccataacctttccacattccgcagacggtacagactgtgtttctaagtgtaaaaccatatcagcagccagggcct

SEQ ID NO: 449101 - DNA, 140 bp, Artificial Sequence
  Synthetic
atacgccatgctgggtctccatgcttatgtcgacaccttttcagcaacttttagtgttcctatggaaaaacttaaggcacttgttgctacagctcacagcgagttagcaaagggtgtagccgtacttgggagtcggccat

SEQ ID NO: 449102 - DNA, 140 bp, Artificial Sequence
  Synthetic
atggccgactcccaagtacggctacaccctttgctaactcgctgtgagctgtagcaacaagtgccttaagtttttccataggaacactaaaagttgctgaaaaggtgtcgacataagcatggagacccagcatggcgtat

SEQ ID NO: 449103 - DNA, 140 bp, Artificial Sequence
  Synthetic
aggccctggctgctgatatggctagggagagctgcctatatggaagagccctaatgtgtaaaattaattttagtagtgctatccccatgtgattttaatagcttctaggagaaaatgacagaccttttgggacagcggtg

SEQ ID NO: 449104 - DNA, 140 bp, Artificial Sequence
  Synthetic
caccgctgtcccaaaaggtctgtcattttctcctagaagctattaaaatcacatggggatagcactactaaaattaattttacacattagggctcttccatataggcagctctccctagccatatcagcagccagggcct

SEQ ID NO: 449105 - DNA, 140 bp, Artificial Sequence
  Synthetic
aggccctggctgctgatatgacacactttgcttttgcttgtgctgacggtactcgacatacctatcagctgcgtgcaagatcagtttcaccaaaacttttcatcagacaagaggaggttcgaccttttgggacagcggtg

SEQ ID NO: 449106 - DNA, 140 bp, Artificial Sequence
  Synthetic
caccgctgtcccaaaaggtcgaacctcctcttgtctgatgaaaagttttggtgaaactgatcttgcacgcagctgataggtatgtcgagtaccgtcagcacaagcaaaagcaaagtgtgtcatatcagcagccagggcct

SEQ ID NO: 449107 - DNA, 140 bp, Artificial Sequence
  Synthetic
aggccctggctgctgatatgactacgacagatgtcctgtgcggctggtaccacacaaacagcttgtactgatgacaatgcacttgcctactataacaatccgaagggagataggtttgtggaccttttgggacagcggtg

SEQ ID NO: 449108 - DNA, 140 bp, Artificial Sequence
  Synthetic
caccgctgtcccaaaaggtccacaaacctatctcccttcggattgttatagtaggcaagtgcattgtcatcagtacaagctgtttgtgtggtaccagccgcacaggacatctgtcgtagtcatatcagcagccagggcct

SEQ ID NO: 449109 - DNA, 140 bp, Artificial Sequence
  Synthetic
aggccctggctgctgatatgcttgtgtattgtgcaattcacagacttcacttcgttgcggtgcctgtattaggagaccattcctatgttgcaagtgctgctatgaccatgtcatttcaacgaccttttgggacagcggtg

SEQ ID NO: 449110 - DNA, 140 bp, Artificial Sequence
  Synthetic
caccgctgtcccaaaaggtcgttgaaatgacatggtcatagcagcacttgcaacataggaatggtctcctaatacaggcaccgcaacgaagtgaagtctgtgaattgcacaatacacaagcatatcagcagccagggcct

SEQ ID NO: 449111 - DNA, 140 bp, Artificial Sequence
  Synthetic
atacgccatgctgggtctcccaatgaggtcgctaaaaatttaaatgaatcactcattgaccttcaagaattgggaaaatatgagcaatatattaaatggccttggtatgtttggctcggccgtacttgggagtcggccat

SEQ ID NO: 449112 - DNA, 140 bp, Artificial Sequence
  Synthetic
atggccgactcccaagtacggccgagccaaacataccaaggccatttaatatattgctcatattttcccaattcttgaaggtcaatgagtgattcatttaaatttttagcgacctcattgggagacccagcatggcgtat

SEQ ID NO: 449113 - DNA, 140 bp, Artificial Sequence
  Synthetic
atacgccatgctgggtctccaagagaagccccagcacatgtatctacaataggtgtctgcacaatgactgacattgccaagaaacctactgagagtgcttgttcttcacttactgtcttgcgtacttgggagtcggccat

SEQ ID NO: 449114 - DNA, 140 bp, Artificial Sequence
  Synthetic
atggccgactcccaagtacgcaagacagtaagtgaagaacaagcactctcagtaggtttcttggcaatgtcagtcattgtgcagacacctattgtagatacatgtgctggggcttctcttggagacccagcatggcgtat

SEQ ID NO: 449115 - DNA, 140 bp, Artificial Sequence
  Synthetic
aggccctggctgctgatatgaaggcagcatatgaaaatttcaattcacaggacaccttacttgcaccattgttgtcagcaggcatatttggtgctaaaccacttcagtctttacaagtgtgaccttttgggacagcggtg

SEQ ID NO: 449116 - DNA, 140 bp, Artificial Sequence
  Synthetic
caccgctgtcccaaaaggtcacacttgtaaagactgaagtggtttagcaccaaatatgcctgctgacaacaatggtgcaagtaaggtgtcctgtgaattgaaattttcatatgctgccttcatatcagcagccagggcct

SEQ ID NO: 449117 - DNA, 140 bp, Artificial Sequence
  Synthetic
aggccctggctgctgatatgcctttgacacaagatcatgttgacatattgggacctctttctgctcaaacaggaattgccgtcttagatatgtgtgctgctttgaaagagctgctgcagagaccttttgggacagcggtg

SEQ ID NO: 449118 - DNA, 140 bp, Artificial Sequence
  Synthetic
caccgctgtcccaaaaggtctctgcagcagctctttcaaagcagcacacatatctaagacggcaattcctgtttgagcagaaagaggtcccaatatgtcaacatgatcttgtgtcaaaggcatatcagcagccagggcct

SEQ ID NO: 449119 - DNA, 140 bp, Artificial Sequence
  Synthetic
aggccctggctgctgatatgttagataatcaggatcttaatgggaactggtacgatttcggagatttcgtacgagtagcacccaggctgcggagttcctattgtggattcatattactcagaccttttgggacagcggtg

SEQ ID NO: 449120 - DNA, 140 bp, Artificial Sequence
  Synthetic
caccgctgtcccaaaaggtctgagtaatatgaatccacaataggaactccgcagcctgggtgctactcgtacgaaatctccgaaatcgtaccagttcccattaagatcctgattatctaacatatcagcagccagggcct

SEQ ID NO: 449121 - DNA, 140 bp, Artificial Sequence
  Synthetic
atacgccatgctgggtctccttgctgatgccccatcctcactttgactagggccattggctgctgagtcccatatggatgctgatctcgcaaaacccacttattaagtgggatttgctgacgtacttgggagtcggccat

SEQ ID NO: 449122 - DNA, 140 bp, Artificial Sequence
  Synthetic
atggccgactcccaagtacgtcagcaaatcccacttaataagtgggttttgcgagatcagcatccatatgggactcagcagccaatggccctagtcaaagtgaggatggggcatcagcaaggagacccagcatggcgtat

SEQ ID NO: 449123 - DNA, 140 bp, Artificial Sequence
  Synthetic
aggccctggctgctgatatgcatatggatgctgatctcgcaaaacccacttattaagtgggatttgctgaaatatgattttacggaagagagactttgtctcttcgaccgttattttaaagaccttttgggacagcggtg

SEQ ID NO: 449124 - DNA, 140 bp, Artificial Sequence
  Synthetic
caccgctgtcccaaaaggtctttaaaataacggtcgaagagacaaagtctctcttccgtaaaatcatatttcagcaaatcccacttaataagtgggttttgcgagatcagcatccatatgcatatcagcagccagggcct

SEQ ID NO: 449125 - DNA, 140 bp, Artificial Sequence
  Synthetic
atacgccatgctgggtctccattagacatttcaccttgcgcttttgggggtgtaagtgtaattacacctggaacaaatgcttcatctgaagttgctgttctatatcaagatgttaactgccgtacttgggagtcggccat

SEQ ID NO: 449126 - DNA, 140 bp, Artificial Sequence
  Synthetic
atggccgactcccaagtacggcagttaacatcttgatatagaacagcaacttcagatgaagcatttgttccaggtgtaattacacttacacccccaaaagcgcaaggtgaaatgtctaatggagacccagcatggcgtat

SEQ ID NO: 449127 - DNA, 140 bp, Artificial Sequence
  Synthetic
atacgccatgctgggtctccactttaaccttgtggcaatgaagtacaactatgaacctttgacacaagatcatgttgacatattgggacctctttctgctcaaacaggaattgccgtcttcgtacttgggagtcggccat

SEQ ID NO: 449128 - DNA, 140 bp, Artificial Sequence
  Synthetic
atggccgactcccaagtacgaagacggcaattcctgtttgagcagaaagaggtcccaatatgtcaacatgatcttgtgtcaaaggttcatagttgtacttcattgccacaaggttaaagtggagacccagcatggcgtat

SEQ ID NO: 449129 - DNA, 140 bp, Artificial Sequence
  Synthetic
aggccctggctgctgatatgtaatatgtacatctgcggagattctactgaatgtgctaatttgcttctccaatatggtagcttttgcacacaactaaatcgtgcactctcaggtattgctgaccttttgggacagcggtg

SEQ ID NO: 449130 - DNA, 140 bp, Artificial Sequence
  Synthetic
caccgctgtcccaaaaggtcagcaatacctgagagtgcacgatttagttgtgtgcaaaagctaccatattggagaagcaaattagcacattcagtagaatctccgcagatgtacatattacatatcagcagccagggcct

SEQ ID NO: 449131 - DNA, 140 bp, Artificial Sequence
  Synthetic
aggccctggctgctgatatgcatgtagtgacaaagcttacaaaatagaggaactcttctattcttatgccacacatcacggtaaatttcactgatggtgtttgtttgttttggaattgtagaccttttgggacagcggtg

SEQ ID NO: 449132 - DNA, 140 bp, Artificial Sequence
  Synthetic
caccgctgtcccaaaaggtctacaattccaaaacaaacaaacaccatcagtgaaatttaccgtgatgtgtggcataagaatagaagagttcctctattttgtaagctttgtcactacatgcatatcagcagccagggcct

SEQ ID NO: 449133 - DNA, 140 bp, Artificial Sequence
  Synthetic
atacgccatgctgggtctccagaaccttgtaccaaagtctatcatgtgcttgaactgtcaagatccagctaggggtgcgcttatagctaggtgttggtaccttcatgaaggtcaccaaaccgtacttgggagtcggccat

SEQ ID NO: 449134 - DNA, 140 bp, Artificial Sequence
  Synthetic
atggccgactcccaagtacggtttggtgaccttcatgaaggtaccaacacctagctataagcgcacccctagctggatcttgacagttcaagcacatgatagactttggtacaaggttctggagacccagcatggcgtat

SEQ ID NO: 449135 - DNA, 140 bp, Artificial Sequence
  Synthetic
atacgccatgctgggtctccgaaggacaggtagacctttttagaaacgcccgtaatggtgttttaataacagaaggtccagtcaaaggactaacaccttcaaaaggtccagcacaagctacgtacttgggagtcggccat

SEQ ID NO: 449136 - DNA, 140 bp, Artificial Sequence
  Synthetic
atggccgactcccaagtacgtagcttgtgctggaccttttgaaggtgttagtcctttgactggaccttctgttattaaaacaccattacgggcgtttctaaaaaggtctacctgtccttcggagacccagcatggcgtat

SEQ ID NO: 449137 - DNA, 140 bp, Artificial Sequence
  Synthetic
aggccctggctgctgatatgaatatgagcaatatattaaatggccttggtatgtttggctcggcttcattgctggactaattgccatcgtcatggttacaatcttgctttgttgcatgacgaccttttgggacagcggtg

SEQ ID NO: 449138 - DNA, 140 bp, Artificial Sequence
  Synthetic
caccgctgtcccaaaaggtcgtcatgcaacaaagcaagattgtaaccatgacgatggcaattagtccagcaatgaagccgagccaaacataccaaggccatttaatatattgctcatattcatatcagcagccagggcct

SEQ ID NO: 449139 - DNA, 140 bp, Artificial Sequence
  Synthetic
aggccctggctgctgatatgacacaaacagcttgtactgatgacaatgcacttgcctactataacaattcgaagggaggtaggtttgtgctggcattactatcagaccaccaagatctcagaccttttgggacagcggtg

SEQ ID NO: 449140 - DNA, 140 bp, Artificial Sequence
  Synthetic
caccgctgtcccaaaaggtctgagatcttggtggtctgatagtaatgccagcacaaacctacctcccttcgaattgttatagtaggcaagtgcattgtcatcagtacaagctgtttgtgtcatatcagcagccagggcct

SEQ ID NO: 449141 - DNA, 140 bp, Artificial Sequence
  Synthetic
aggccctggctgctgatatgtgcttgtcgctgcaggtatggaggcgcaatttttgtacctctatgccttgatatattttctacaatgcatcaacgcatgtagaattattatgagatgttggaccttttgggacagcggtg

SEQ ID NO: 449142 - DNA, 140 bp, Artificial Sequence
  Synthetic
caccgctgtcccaaaaggtccaacatctcataataattctacatgcgttgatgcattgtagaaaatatatcaaggcatagaggtacaaaaattgcgcctccatacctgcagcgacaagcacatatcagcagccagggcct

SEQ ID NO: 449143 - DNA, 140 bp, Artificial Sequence
  Synthetic
atacgccatgctgggtctccctattgtggcttatactatgtctttaggtgctgatagttcaaattgcttactctaataacaccattgctatacctactaacttttcaaattagcattactcgtacttgggagtcggccat

SEQ ID NO: 449144 - DNA, 140 bp, Artificial Sequence
  Synthetic
atggccgactcccaagtacgagtaatgctaatttgaaaagttagtaggtatagcaatggtgttattagagtaagcaatttgaactatcagcacctaaagacatagtataagccacaatagggagacccagcatggcgtat

SEQ ID NO: 449145 - DNA, 140 bp, Artificial Sequence
  Synthetic
aggccctggctgctgatatgaagccaaccaacctcgatctcttgtagatctgttctctaaacgaactttaaaatctgtgtagttgtcgctcggctgcatgcctagtgcacctacgcagtagaccttttgggacagcggtg

SEQ ID NO: 449146 - DNA, 140 bp, Artificial Sequence
  Synthetic
caccgctgtcccaaaaggtctactgcgtaggtgcactaggcatgcagccgagcgacaactacacagattttaaagttcgtttagagaacagatctacaagagatcgaggttggttggcttcatatcagcagccagggcct

SEQ ID NO: 449147 - DNA, 140 bp, Artificial Sequence
  Synthetic
aggccctggctgctgatatggtgtaggcactgattcaggttttgctgcatacaaccgctaccgtattggaaactataaattaaatacagaccacgccggtagcaacgacaatattgctttgaccttttgggacagcggtg

SEQ ID NO: 449148 - DNA, 140 bp, Artificial Sequence
  Synthetic
caccgctgtcccaaaaggtcaaagcaatattgtcgttgctaccggcgtggtctgtatttaatttatagtttccaatacggtagcggttgtatgcagcaaaacctgaatcagtgcctacaccatatcagcagccagggcct

SEQ ID NO: 449149 - DNA, 140 bp, Artificial Sequence
  Synthetic
aggccctggctgctgatatgttgtatttacatcttgcgagctatatcactatcaggagtgtgttagaggtacgactgtactactaaaagaaccttgcccatcaggaacatacgagggcaagaccttttgggacagcggtg

SEQ ID NO: 449150 - DNA, 140 bp, Artificial Sequence
  Synthetic
caccgctgtcccaaaaggtcttgccctcgtatgttcctgatgggcaaggttcttttagtagtacagtcgtacctctaacacactcctgatagtgatatagctcgcaagatgtaaatacaacatatcagcagccagggcct

SEQ ID NO: 449151 - DNA, 140 bp, Artificial Sequence
  Synthetic
aggccctggctgctgatatggtaatacttatagcactgcttggctttgtgctctaggaaaggttttaccttttcatagatggcacactatggttcaaacatgcacacctaatgttactatgaccttttgggacagcggtg

SEQ ID NO: 449152 - DNA, 140 bp, Artificial Sequence
  Synthetic
caccgctgtcccaaaaggtcatagtaacattaggtgtgcatgtttgaaccatagtgtgccatctatgaaaaggtaaaacctttcctagagcacaaagccaagcagtgctataagtattaccatatcagcagccagggcct

SEQ ID NO: 449153 - DNA, 140 bp, Artificial Sequence
  Synthetic
aggccctggctgctgatatggggattatccaaaatgtgacagagccatgcctaacatgcttaggataatggcctctcttgttcttgctcgcaaacataacacttgctgtaacttatcacagaccttttgggacagcggtg

SEQ ID NO: 449154 - DNA, 140 bp, Artificial Sequence
  Synthetic
caccgctgtcccaaaaggtctgtgataagttacagcaagtgttatgtttgcgagcaagaacaagagaggccattatcctaagcatgttaggcatggctctgtcacattttggataatccccatatcagcagccagggcct

SEQ ID NO: 449155 - DNA, 140 bp, Artificial Sequence
  Synthetic
aggccctggctgctgatatgaaccagaatggaggacgcaatggggcaaggccaaaacagcgccgaccccaaggtttacccaataatactgcgtcttggttcacagctctcactcagcatggaccttttgggacagcggtg

SEQ ID NO: 449156 - DNA, 140 bp, Artificial Sequence
  Synthetic
caccgctgtcccaaaaggtccatgctgagtgagagctgtgaaccaagacgcagtattattgggtaaaccttggggtcggcgctgttttggccttgccccattgcgtcctccattctggttcatatcagcagccagggcct

SEQ ID NO: 449157 - DNA, 140 bp, Artificial Sequence
  Synthetic
aggccctggctgctgatatgtacagccaatgtaaatgcacttctttcaactgatggtaataagatagctgacaagtatgtccgcaatctacaacacaggctctatgagtgtctctatagagaccttttgggacagcggtg

SEQ ID NO: 449158 - DNA, 140 bp, Artificial Sequence
  Synthetic
caccgctgtcccaaaaggtctctatagagacactcatagagcctgtgttgtagattgcggacatacttgtcagctatcttattaccatcagttgaaagaagtgcatttacattggctgtacatatcagcagccagggcct

SEQ ID NO: 449159 - DNA, 140 bp, Artificial Sequence
  Synthetic
atacgccatgctgggtctcctgatgtctttcactatactctgtctggcaccagcttacagctttctgccgggagtctactcagtcttttacttgtacttgacattctatttcaccaatgacgtacttgggagtcggccat

SEQ ID NO: 449160 - DNA, 140 bp, Artificial Sequence
  Synthetic
atggccgactcccaagtacgtcattggtgaaatagaatgtcaagtacaagtaaaagactgagtagactcccggcagaaagctgtaagctggtgccagacagagtatagtgaaagacatcaggagacccagcatggcgtat

SEQ ID NO: 449161 - DNA, 140 bp, Artificial Sequence
  Synthetic
atacgccatgctgggtctcccattttgcactggtagtacattcattagtgatgaagttgctcgtgatttgtcactccagtttaaaagaccaatcaaccctactgaccagtcatcgtatatcgtacttgggagtcggccat

SEQ ID NO: 449162 - DNA, 140 bp, Artificial Sequence
  Synthetic
atggccgactcccaagtacgatatacgatgactggtcagtagggttgattggtcttttaaactggagtgacaaatcacgagcaacttcatcactaatgaatgtactaccagtgcaaaatgggagacccagcatggcgtat

SEQ ID NO: 449163 - DNA, 140 bp, Artificial Sequence
  Synthetic
aggccctggctgctgatatgcgattacatacttgccaacacttgtactgagagactcaagcttttcgcagcagaaacgctcaaagccactgaggaaacatttaagctgtcatatggtattgaccttttgggacagcggtg

SEQ ID NO: 449164 - DNA, 140 bp, Artificial Sequence
  Synthetic
caccgctgtcccaaaaggtcaataccatatgacagcttaaatgtttcctcagtggctttgagcgtttctgctgcgaaaagcttgagtctctcagtacaagtgttggcaagtatgtaatcgcatatcagcagccagggcct

SEQ ID NO: 449165 - DNA, 140 bp, Artificial Sequence
  Synthetic
atacgccatgctgggtctcccatagtttttgatggcaagtccaaatgcgacgagtctgcttctaagtctgcttctgtgtactacagtcagctgatgtgccaacctattctgttgcttgaccgtacttgggagtcggccat

SEQ ID NO: 449166 - DNA, 140 bp, Artificial Sequence
  Synthetic
atggccgactcccaagtacggtcaagcaacagaataggttggcacatcagctgactgtagtacacagaagcagacttagaagcagactcgtcgcatttggacttgccatcaaaaactatgggagacccagcatggcgtat

SEQ ID NO: 449167 - DNA, 140 bp, Artificial Sequence
  Synthetic
aggccctggctgctgatatgggagtacgatcgagggtacagtgaataatgctagggagagctgcctatatggaagagccctaatgtgtaaaattaattttagtagtgctatccccatgtggaccttttgggacagcggtg

SEQ ID NO: 449168 - DNA, 140 bp, Artificial Sequence
  Synthetic
caccgctgtcccaaaaggtccacatggggatagcactactaaaattaattttacacattagggctcttccatataggcagctctccctagcattattcactgtaccctcgatcgtactcccatatcagcagccagggcct

SEQ ID NO: 449169 - DNA, 140 bp, Artificial Sequence
  Synthetic
aggccctggctgctgatatgtatgcagttgcatatgcactgtagtacagcgctgtgcatctaataaacctcatgtgcttgaagatccttgtaaggtacaacactaggggtaatacttatagaccttttgggacagcggtg

SEQ ID NO: 449170 - DNA, 140 bp, Artificial Sequence
  Synthetic
caccgctgtcccaaaaggtctataagtattacccctagtgttgtaccttacaaggatcttcaagcacatgaggtttattagatgcacagcgctgtactacagtgcatatgcaactgcatacatatcagcagccagggcct

SEQ ID NO: 449171 - DNA, 140 bp, Artificial Sequence
  Synthetic
aggccctggctgctgatatgatgctagggagagctgcctatatggaagagccctaatgtgtaaaattaattttagtagtgctatccccatgtgattttaatagcttcttaggagaatgacgaccttttgggacagcggtg

SEQ ID NO: 449172 - DNA, 140 bp, Artificial Sequence
  Synthetic
caccgctgtcccaaaaggtcgtcattctcctaagaagctattaaaatcacatggggatagcactactaaaattaattttacacattagggctcttccatataggcagctctccctagcatcatatcagcagccagggcct

SEQ ID NO: 449173 - DNA, 140 bp, Artificial Sequence
  Synthetic
aggccctggctgctgatatgaggaaaagccaaccaacctcgatctcttgtagatctgttctctaaacgaactttaaaatctgtgtagctgtcgctcggctgcatgcctagtgcacctacggaccttttgggacagcggtg

SEQ ID NO: 449174 - DNA, 140 bp, Artificial Sequence
  Synthetic
caccgctgtcccaaaaggtccgtaggtgcactaggcatgcagccgagcgacagctacacagattttaaagttcgtttagagaacagatctacaagagatcgaggttggttggcttttcctcatatcagcagccagggcct

SEQ ID NO: 449175 - DNA, 140 bp, Artificial Sequence
  Synthetic
  misc_feature (100)..(100): n is a, c, g, or t
  misc_feature (116)..(116): n is a, c, g, or t
aggccctggctgctgatatgcggcttcattgctggactaattgccatcgtcatggttacaaatcttgctttgttgatgctagttgttgcagttgcctcanggggctgctcttgtgnttctgaccttttgggacagcggtg

SEQ ID NO: 449176 - DNA, 140 bp, Artificial Sequence
  Synthetic
  misc_feature (25)..(25): n is a, c, g, or t
  misc_feature (41)..(41): n is a, c, g, or t
caccgctgtcccaaaaggtcagaancacaagagcagccccntgaggcaactgcaacaactagcatcaacaaagcaagatttgtaaccatgacgatggcaattagtccagcaatgaagccgcatatcagcagccagggcct

SEQ ID NO: 449177 - DNA, 140 bp, Artificial Sequence
  Synthetic
  misc_feature (22)..(22): n is a, c, g, or t
  misc_feature (26)..(26): n is a, c, g, or t
  misc_feature (29)..(29): n is a, c, g, or t
  misc_feature (33)..(33): n is a, c, g, or t
  misc_feature (41)..(41): n is a, c, g, or t
  misc_feature (50)..(50): n is a, c, g, or t
  misc_feature (52)..(52): n is a, c, g, or t
  misc_feature (55)..(55): n is a, c, g, or t
  misc_feature (57)..(57): n is a, c, g, or t
  misc_feature (61)..(61): n is a, c, g, or t
  misc_feature (68)..(68): n is a, c, g, or t
  misc_feature (75)..(75): n is a, c, g, or t
  misc_feature (83)..(83): n is a, c, g, or t
  misc_feature (86)..(86): n is a, c, g, or t
  misc_feature (88)..(88): n is a, c, g, or t
atacgccatgctgggtctcctntganccngttntcaagggngtcaaattncnttncncatnaacgaanttatggntttgtttntgngnttttttttactcttggatcaattactgcacagcgtacttgggagtcggccat

SEQ ID NO: 449178 - DNA, 140 bp, Artificial Sequence
  Synthetic
  misc_feature (53)..(53): n is a, c, g, or t
  misc_feature (55)..(55): n is a, c, g, or t
  misc_feature (58)..(58): n is a, c, g, or t
  misc_feature (66)..(66): n is a, c, g, or t
  misc_feature (73)..(73): n is a, c, g, or t
  misc_feature (80)..(80): n is a, c, g, or t
  misc_feature (84)..(84): n is a, c, g, or t
  misc_feature (86)..(86): n is a, c, g, or t
  misc_feature (89)..(89): n is a, c, g, or t
  misc_feature (91)..(91): n is a, c, g, or t
  misc_feature (100)..(100): n is a, c, g, or t
  misc_feature (108)..(108): n is a, c, g, or t
  misc_feature (112)..(112): n is a, c, g, or t
  misc_feature (115)..(115): n is a, c, g, or t
  misc_feature (119)..(119): n is a, c, g, or t
atggccgactcccaagtacgctgtgcagtaattgatccaagagtaaaaaaaancncanaaacaaanccataanttcgttnatgngnaangnaatttgacncccttganaacnggntcanaggagacccagcatggcgtat

SEQ ID NO: 449179 - DNA, 140 bp, Artificial Sequence
  Synthetic
atacgccatgctgggtctccggcttccaggaaaagccaaccaacctccaggaaaagccaaccaacctcgatctcttgtagatctgttctctaaacgaactttaaaatctgtgtagctgtccgtacttgggagtcggccat

SEQ ID NO: 449180 - DNA, 140 bp, Artificial Sequence
  Synthetic
atggccgactcccaagtacggacagctacacagattttaaagttcgtttagagaacagatctacaagagatcgaggttggttggcttttcctggaggttggttggcttttcctggaagccggagacccagcatggcgtat

SEQ ID NO: 449181 - DNA, 140 bp, Artificial Sequence
  Synthetic
atacgccatgctgggtctccgtgcatttactaatttaaagcaattgcctttcttttactattctgatagtccttgtgagtctcatggcaaacaagtagtgtcggatattgattatgttcccgtacttgggagtcggccat

SEQ ID NO: 449182 - DNA, 140 bp, Artificial Sequence
  Synthetic
atggccgactcccaagtacgggaacataatcaatatccgacactacttgtttgccatgagactcacaaggactatcagaatagtaaaagaaaggcaattgctttaaattagtaaatgcacggagacccagcatggcgtat

SEQ ID NO: 449183 - DNA, 140 bp, Artificial Sequence
  Synthetic
aggccctggctgctgatatgtggcattactggtgacaatgtggagaccttgaatgaggatctccttgagatactgagtcgtgaacgtgttaacattaacattgttggcgattttcatttggaccttttgggacagcggtg

SEQ ID NO: 449184 - DNA, 140 bp, Artificial Sequence
  Synthetic
caccgctgtcccaaaaggtccaaatgaaaatcgccaacaatgttaatgttaacacgttcacgactcagtatctcaaggagatcctcattcaaggtctccacattgtcaccagtaatgccacatatcagcagccagggcct

SEQ ID NO: 449185 - DNA, 140 bp, Artificial Sequence
  Synthetic
aggccctggctgctgatatgctgaggaggttgttctcaagaacggtgaactcgaagcactcgagacgcccgttgatagcttcacaaatggagctatcgttggcacaccagtctgtgtaaagaccttttgggacagcggtg

SEQ ID NO: 449186 - DNA, 140 bp, Artificial Sequence
  Synthetic
caccgctgtcccaaaaggtctttacacagactggtgtgccaacgatagctccatttgtgaagctatcaacgggcgtctcgagtgcttcgagttcaccgttcttgagaacaacctcctcagcatatcagcagccagggcct

SEQ ID NO: 449187 - DNA, 140 bp, Artificial Sequence
  Synthetic
aggccctggctgctgatatgtcactccagtttaaaagaccaatcaaccatactgaccagtcatcgtatatagttgatagtgttgctgtgaaaaatggcgcgcttcacatctactttgacagaccttttgggacagcggtg

SEQ ID NO: 449188 - DNA, 140 bp, Artificial Sequence
  Synthetic
caccgctgtcccaaaaggtctgtcaaagtagatgtgaagcgcgccatttttcacagcaacactatcaactatatacgatgactggtcagtatggttgattggtcttttaaactggagtgacatatcagcagccagggcct

SEQ ID NO: 449189 - DNA, 140 bp, Artificial Sequence
  Synthetic
atacgccatgctgggtctccttacaagaatgtgagaatcacatttgagcttgatgaacgtgttgacaaagtgcttaatgaaaagtgctctgtctacactgttgaatccggtaccgaagttcgtacttgggagtcggccat

SEQ ID NO: 449190 - DNA, 140 bp, Artificial Sequence
  Synthetic
atggccgactcccaagtacgaacttcggtaccggattcaacagtgtagacagagcacttttcattaagcactttgtcaacacgttcatcaagctcaaatgtgattctcacattcttgtaaggagacccagcatggcgtat

SEQ ID NO: 449191 - DNA, 140 bp, Artificial Sequence
  Synthetic
aggccctggctgctgatatggtatggtgctgggcagtttagctgctacagtacgtcttcaggctggaaatgctacagaagtacctgcccattcagactgtgatttccttctgtgcttttggaccttttgggacagcggtg

SEQ ID NO: 449192 - DNA, 140 bp, Artificial Sequence
  Synthetic
caccgctgtcccaaaaggtccaaaagcacagaaggaaatcacagtctgaatgggcaggtacttctgtagcatttccagcctgaagacgtactgtagcagctaaactgcccagcaccataccatatcagcagccagggcct

SEQ ID NO: 449193 - DNA, 140 bp, Artificial Sequence
  Synthetic
aggccctggctgctgatatggcggaatgtggaaaggttatggctgtagttgtgaccaactccgcgaacccttgatgcagtctgcggatgcatctaacgtttttaaacgggtttgcggtgtgaccttttgggacagcggtg

SEQ ID NO: 449194 - DNA, 140 bp, Artificial Sequence
  Synthetic
caccgctgtcccaaaaggtcacaccgcaaacccgtttaaaaacgttagatgcatccgcagactgcatcaagggttcgcggagttggtcacaactacagccataacctttccacattccgccatatcagcagccagggcct

SEQ ID NO: 449195 - DNA, 140 bp, Artificial Sequence
  Synthetic
atacgccatgctgggtctccaagtgcagcccgtcttacaccgtgcggcacaggcactagtactgatgtctgtctacagggcattttgatatttacaacgaaaaagttgctggttttgcaacgtacttgggagtcggccat

SEQ ID NO: 449196 - DNA, 140 bp, Artificial Sequence
  Synthetic
atggccgactcccaagtacgttgcaaaaccagcaactttttcgttgtaaatatcaaaatgccctgtagacagacatcagtactagtgcctgtgccgcacggtgtaagacgggctgcacttggagacccagcatggcgtat

SEQ ID NO: 449197 - DNA, 140 bp, Artificial Sequence
  Synthetic
atacgccatgctgggtctccaaattttgtttcatctatacaggaaaagccaaccaacctcgatctcttgttacccaggaaaagccaaccaacctcgatctcttgtagatctgttctctaacgtacttgggagtcggccat

SEQ ID NO: 449198 - DNA, 140 bp, Artificial Sequence
  Synthetic
atggccgactcccaagtacgttagagaacagatctacaagagatcgaggttggttggcttttcctgggtaacaagagatcgaggttggttggcttttcctgtatagatgaaacaaaatttggagacccagcatggcgtat

SEQ ID NO: 449199 - DNA, 140 bp, Artificial Sequence
  Synthetic
aggccctggctgctgatatgctgctcttaagaaatgcaaatctgcattttatgtactaccttcagaagcacctaatgctaaggaagagattctaggaactgtatcctggaatttgagagagaccttttgggacagcggtg

SEQ ID NO: 449200 - DNA, 140 bp, Artificial Sequence
  Synthetic
caccgctgtcccaaaaggtctctctcaaattccaggatacagttcctagaatctcttccttagcattaggtgcttctgaaggtagtacataaaatgcagatttgcatttcttaagagcagcatatcagcagccagggcct

SEQ ID NO: 449201 - DNA, 140 bp, Artificial Sequence
  Synthetic
atacgccatgctgggtctccaaattttgtttcatctatacaggaaaagccaaccaacctcgatctcttgtagatctgttctctaaacgaactttaaaatctgtgtagctgtcgctcggctcgtacttgggagtcggccat

SEQ ID NO: 449202 - DNA, 140 bp, Artificial Sequence
  Synthetic
atggccgactcccaagtacgagccgagcgacagctacacagattttaaagttcgtttagagaacagatctacaagagatcgaggttggttggcttttcctgtatagatgaaacaaaatttggagacccagcatggcgtat

SEQ ID NO: 449203 - DNA, 140 bp, Artificial Sequence
  Synthetic
atacgccatgctgggtctcctgggagagaaaaaaaatttctaattgtgttgctgattactctgtgctctacaactcaacatttttttcaacctttaagtgctatggcgtttctgccactacgtacttgggagtcggccat

SEQ ID NO: 449204 - DNA, 140 bp, Artificial Sequence
  Synthetic
atggccgactcccaagtacgtagtggcagaaacgccatagcacttaaaggttgaaaaaaatgttgagttgtagagcacagagtaatcagcaacacaattagaaattttttttctctcccaggagacccagcatggcgtat

SEQ ID NO: 449205 - DNA, 140 bp, Artificial Sequence
  Synthetic
atacgccatgctgggtctccagtttcatcttgacggtgaggttctttcacttgacaaactaaagagtctcttatccctgcgggaggttaagactataaaagtgttcacaactgtggacaacgtacttgggagtcggccat

SEQ ID NO: 449206 - DNA, 140 bp, Artificial Sequence
  Synthetic
atggccgactcccaagtacgttgtccacagttgtgaacacttttatagtcttaacctcccgcagggataagagactctttagtttgtcaagtgaaagaacctcaccgtcaagatgaaactggagacccagcatggcgtat

SEQ ID NO: 449207 - DNA, 140 bp, Artificial Sequence
  Synthetic
aggccctggctgctgatatggagggtaagactttctttgtactacctagtgatgacacactacgtagtgaagctttcgagtactaccatactcttgatgagagttttcttggtaggtacagaccttttgggacagcggtg

SEQ ID NO: 449208 - DNA, 140 bp, Artificial Sequence
  Synthetic
caccgctgtcccaaaaggtctgtacctaccaagaaaactctcatcaagagtatggtagtactcgaaagcttcactacgtagtgtgtcatcactaggtagtacaaagaaagtcttaccctccatatcagcagccagggcct

SEQ ID NO: 449209 - DNA, 140 bp, Artificial Sequence
  Synthetic
aggccctggctgctgatatgactcagcatggcaaggaggaacttagattccctcgaggccagggcgttccaatcaacaccaatagtggtccagatgaccaaattggctactaccgaagaggaccttttgggacagcggtg

SEQ ID NO: 449210 - DNA, 140 bp, Artificial Sequence
  Synthetic
caccgctgtcccaaaaggtcctcttcggtagtagccaatttggtcatctggaccactattggtgttgattggaacgccctggcctcgagggaatctaagttcctccttgccatgctgagtcatatcagcagccagggcct

SEQ ID NO: 449211 - DNA, 140 bp, Artificial Sequence
  Synthetic
atacgccatgctgggtctccttcatgcagatcaactcacaccagcttggcgcatatattctactggaaacaatgtattccagactcaagcaggctgtcttataggagctgagcatgtcgacgtacttgggagtcggccat

SEQ ID NO: 449212 - DNA, 140 bp, Artificial Sequence
  Synthetic
atggccgactcccaagtacgtcgacatgctcagctcctataagacagcctgcttgagtctggaatacattgtttccagtagaatatatgcgccaagctggtgtgagttgatctgcatgaaggagacccagcatggcgtat

SEQ ID NO: 449213 - DNA, 140 bp, Artificial Sequence
  Synthetic
aggccctggctgctgatatggtcaagctgttacagccaatgtaaatgcacttctttcaactgatggtaataagatagctgacaagtatgtccgcatctacaacacaggctctatgagtgtgaccttttgggacagcggtg

SEQ ID NO: 449214 - DNA, 140 bp, Artificial Sequence
  Synthetic
caccgctgtcccaaaaggtcacactcatagagcctgtgttgtagatgcggacatacttgtcagctatcttattaccatcagttgaaagaagtgcatttacattggctgtaacagcttgaccatatcagcagccagggcct

SEQ ID NO: 449215 - DNA, 140 bp, Artificial Sequence
  Synthetic
atacgccatgctgggtctccttcccagacttgaatggcgatgtagtggctattgactatagacactattcagcgagtttcaagaaaggtgctaaattactgcataagccaattgtttggccgtacttgggagtcggccat

SEQ ID NO: 449216 - DNA, 140 bp, Artificial Sequence
  Synthetic
atggccgactcccaagtacggccaaacaattggcttatgcagtaatttagcacctttcttgaaactcgctgaatagtgtctatagtcaatagccactacatcgccattcaagtctgggaaggagacccagcatggcgtat

SEQ ID NO: 449217 - DNA, 140 bp, Artificial Sequence
  Synthetic
atacgccatgctgggtctccgccacctctgctcactgatgatatgattgctgcctacactgctgctctagttagtggtactgccactgctggatggacatttggtgctggcgctgctcttcgtacttgggagtcggccat

SEQ ID NO: 449218 - DNA, 140 bp, Artificial Sequence
  Synthetic
atggccgactcccaagtacgaagagcagcgccagcaccaaatgtccatccagcagtggcagtaccactaactagagcagcagtgtaggcagcaatcatatcatcagtgagcagaggtggcggagacccagcatggcgtat

SEQ ID NO: 449219 - DNA, 140 bp, Artificial Sequence
  Synthetic
aggccctggctgctgatatggttcacaatcgctatgtggctattgttgttaagtatttgcttaggttctctaatctgtgtaactgctgcttttggtgtactcttatctaattttggtgctgaccttttgggacagcggtg

SEQ ID NO: 449220 - DNA, 140 bp, Artificial Sequence
  Synthetic
caccgctgtcccaaaaggtcagcaccaaaattagataagagtacaccaaaagcagcagttacacagattagagaacctaagcaaatacttaacaacaatagccacatagcgattgtgaaccatatcagcagccagggcct

SEQ ID NO: 449221 - DNA, 140 bp, Artificial Sequence
  Synthetic
atacgccatgctgggtctccaaaatggcgcgcttcacctctactttgacaaggctggtcaaaagacctatgagagacatccgctctcccattttgtcaatttagacaatttgagagctaacgtacttgggagtcggccat

SEQ ID NO: 449222 - DNA, 140 bp, Artificial Sequence
  Synthetic
atggccgactcccaagtacgttagctctcaaattgtctaaattgacaaaatgggagagcggatgtctctcataggtcttttgaccagccttgtcaaagtagaggtgaagcgcgccattttggagacccagcatggcgtat

SEQ ID NO: 449223 - DNA, 140 bp, Artificial Sequence
  Synthetic
aggccctggctgctgatatgcaaaagacctatgagagacatccgctctcccattttgtcaatttagacaatttgagagctaacaacactaaaggttcactgcctattaatgtcatagtttgaccttttgggacagcggtg

SEQ ID NO: 449224 - DNA, 140 bp, Artificial Sequence
  Synthetic
caccgctgtcccaaaaggtcaaactatgacattaataggcagtgaacctttagtgttgttagctctcaaattgtctaaattgacaaaatgggagagcggatgtctctcataggtcttttgcatatcagcagccagggcct

SEQ ID NO: 449225 - DNA, 140 bp, Artificial Sequence
  Synthetic
aggccctggctgctgatatgcttatgtcgacaccttttcagcaacttttagtgttcctatggaaaaacttaaggcacttgttgctacagctcacagcgagttagcaaagggtgtagctttgaccttttgggacagcggtg

SEQ ID NO: 449226 - DNA, 140 bp, Artificial Sequence
  Synthetic
caccgctgtcccaaaaggtcaaagctacaccctttgctaactcgctgtgagctgtagcaacaagtgccttaagtttttccataggaacactaaaagttgctgaaaaggtgtcgacataagcatatcagcagccagggcct

SEQ ID NO: 449227 - DNA, 140 bp, Artificial Sequence
  Synthetic
aggccctggctgctgatatgtcactcatctggaatgtaaaagactacatgtctttatctgaacagctgcgtaaacaaattcgtagtgctgccaagaagaacaacataccttttagactaagaccttttgggacagcggtg

SEQ ID NO: 449228 - DNA, 140 bp, Artificial Sequence
  Synthetic
caccgctgtcccaaaaggtcttagtctaaaaggtatgttgttcttcttggcagcactacgaatttgtttacgcagctgttcagataaagacatgtagtcttttacattccagatgagtgacatatcagcagccagggcct

SEQ ID NO: 449229 - DNA, 140 bp, Artificial Sequence
  Synthetic
aggccctggctgctgatatgtgaaggagttcctgatcttctggtctaaacgaactaactattattattattctgtttggaactttaacattgcttatcatggcagacaacggtactattagaccttttgggacagcggtg

SEQ ID NO: 449230 - DNA, 140 bp, Artificial Sequence
  Synthetic
caccgctgtcccaaaaggtctaatagtaccgttgtctgccatgataagcaatgttaaagttccaaacagaataataataatagttagttcgtttagaccagaagatcaggaactccttcacatatcagcagccagggcct

SEQ ID NO: 449231 - DNA, 140 bp, Artificial Sequence
  Synthetic
aggccctggctgctgatatgcattacagagctctatcaggagttttctgtggtgttgatgcgatgaatctcatagctaacatctttactcctcttgtgcaacctgtgggtgctttagatggaccttttgggacagcggtg

SEQ ID NO: 449232 - DNA, 140 bp, Artificial Sequence
  Synthetic
caccgctgtcccaaaaggtccatctaaagcacccacaggttgcacaagaggagtaaagatgttagctatgagattcatcgcatcaacaccacagaaaactcctgatagagctctgtaatgcatatcagcagccagggcct

SEQ ID NO: 449233 - DNA, 140 bp, Artificial Sequence
  Synthetic
aggccctggctgctgatatgagggtttcatactattaatcatacgtttgacaaccctgtcataccttttaaggatggtatttattttgctgccacagagaaatcaaatgttgtccgtggtgaccttttgggacagcggtg

SEQ ID NO: 449234 - DNA, 140 bp, Artificial Sequence
  Synthetic
caccgctgtcccaaaaggtcaccacggacaacatttgatttctctgtggcagcaaaataaataccatccttaaaaggtatgacagggttgtcaaacgtatgattaatagtatgaaaccctcatatcagcagccagggcct

SEQ ID NO: 449235 - DNA, 140 bp, Artificial Sequence
  Synthetic
atacgccatgctgggtctccataagttcaatagtgagacaattatttaagcctctaactaagaagaattattcggagttagatgatgaagaacctatggagttagattatccataaaacgcgtacttgggagtcggccat

SEQ ID NO: 449236 - DNA, 140 bp, Artificial Sequence
  Synthetic
atggccgactcccaagtacgcgttttatggataatctaactccataggttcttcatcatctaactccgaataattcttcttagttagaggcttaaataattgtctcactattgaacttatggagacccagcatggcgtat

SEQ ID NO: 449237 - DNA, 140 bp, Artificial Sequence
  Synthetic
atacgccatgctgggtctcccgtacagaagcctgtcgatgtgaagccaaaaattaaggcctgcattgatgaggttaccacaacactggaagaaactaagtttcttaccaataagttactccgtacttgggagtcggccat

SEQ ID NO: 449238 - DNA, 140 bp, Artificial Sequence
  Synthetic
atggccgactcccaagtacggagtaacttattggtaagaaacttagtttcttccagtgttgtggtaacctcatcaatgcaggccttaatttttggcttcacatcgacaggcttctgtacgggagacccagcatggcgtat

SEQ ID NO: 449239 - DNA, 140 bp, Artificial Sequence
  Synthetic
aggccctggctgctgatatgcattaagagaaagacagaatgaatgagctcactttaattgacttctatttgtgctttttagcctttctgctattccttgttttaataatgcttattatatgaccttttgggacagcggtg

SEQ ID NO: 449240 - DNA, 140 bp, Artificial Sequence
  Synthetic
caccgctgtcccaaaaggtcatataataagcattattaaaacaaggaatagcagaaaggctaaaaagcacaaatagaagtcaattaaagtgagctcattcattctgtctttctcttaatgcatatcagcagccagggcct

SEQ ID NO: 449241 - DNA, 140 bp, Artificial Sequence
  Synthetic
aggccctggctgctgatatggtgctttttagcctttctgctattccttgttttaataatgcttattatattttggttttcactcgaaatccaggatctagaagaaccttgtaccaaagtcgaccttttgggacagcggtg

SEQ ID NO: 449242 - DNA, 140 bp, Artificial Sequence
  Synthetic
caccgctgtcccaaaaggtcgactttggtacaaggttcttctagatcctggatttcgagtgaaaaccaaaatataataagcattattaaaacaaggaatagcagaaaggctaaaaagcaccatatcagcagccagggcct

SEQ ID NO: 449243 - DNA, 140 bp, Artificial Sequence
  Synthetic
aggccctggctgctgatatggttctttaccatcatatgccgcttatgccactgcccaggaggcctatgagcaggctgtagctaatggtgattctgaagtcgttctcaaaaagttaaagaagaccttttgggacagcggtg

SEQ ID NO: 449244 - DNA, 140 bp, Artificial Sequence
  Synthetic
caccgctgtcccaaaaggtcttctttaactttttgagaacgacttcagaatcaccattagctacagcctgctcataggcctcctgggcagtggcataagcggcatatgatggtaaagaaccatatcagcagccagggcct

SEQ ID NO: 449245 - DNA, 140 bp, Artificial Sequence
  Synthetic
aggccctggctgctgatatgcgttcgagatcctaaaacatctgaaatattagacatttcaccttgctcttttgggggtgtaagtgtaattacacctggaacaaatgcttcatctgaagttgaccttttgggacagcggtg

SEQ ID NO: 449246 - DNA, 140 bp, Artificial Sequence
  Synthetic
caccgctgtcccaaaaggtcaacttcagatgaagcatttgttccaggtgtaattacacttacacccccaaaagagcaaggtgaaatgtctaatatttcagatgttttaggatctcgaacgcatatcagcagccagggcct

SEQ ID NO: 449247 - DNA, 140 bp, Artificial Sequence
  Synthetic
atacgccatgctgggtctccgaagtaatgcctgtttctatggctaaaacctccgtagattgtaatatgtacatctgcggagattctactgaatgtgctaatttgcttctccaatatggtacgtacttgggagtcggccat

SEQ ID NO: 449248 - DNA, 140 bp, Artificial Sequence
  Synthetic
atggccgactcccaagtacgtaccatattggagaagcaaattagcacattcagtagaatctccgcagatgtacatattacaatctacggaggttttagccatagaaacaggcattacttcggagacccagcatggcgtat

SEQ ID NO: 449249 - DNA, 140 bp, Artificial Sequence
  Synthetic
aggccctggctgctgatatggctttcttgccatttactcttggtattatggcaattgctgcatgtgctatgctgcttgttaagcataagcacgcattcttgtgcttgtttctgttaccttgaccttttgggacagcggtg

SEQ ID NO: 449250 - DNA, 140 bp, Artificial Sequence
  Synthetic
caccgctgtcccaaaaggtcaaggtaacagaaacaagcacaagaatgcgtgcttatgcttaacaagcagcatagcacatgcagcaattgccataataccaagagtaaatggcaagaaagccatatcagcagccagggcct

SEQ ID NO: 449251 - DNA, 140 bp, Artificial Sequence
  Synthetic
aggccctggctgctgatatgtttgtgtgtgttgagtattacccattgttatttattactggcaacaccttacagtgtatcatgcttgtttattgtttcttaggctattgttgctgctgctgaccttttgggacagcggtg

SEQ ID NO: 449252 - DNA, 140 bp, Artificial Sequence
  Synthetic
caccgctgtcccaaaaggtcagcagcagcaacaatagcctaagaaacaataaacaagcatgatacactgtaaggtgttgccagtaataaataacaatgggtaatactcaacacacacaaacatatcagcagccagggcct

SEQ ID NO: 449253 - DNA, 140 bp, Artificial Sequence
  Synthetic
atacgccatgctgggtctcccaacttagtgaaattaacatggacaattcaccaaatttggcttggcctcttattgttacagctctaagagccaactcagctgttaaactacagaataatgcgtacttgggagtcggccat

SEQ ID NO: 449254 - DNA, 140 bp, Artificial Sequence
  Synthetic
atggccgactcccaagtacgcattattctgtagtttaacagctgagttggctcttagagctgtaacaataagaggccaagccaaatttggtgaattgtccatgttaatttcactaagttgggagacccagcatggcgtat

SEQ ID NO: 449255 - DNA, 140 bp, Artificial Sequence
  Synthetic
aggccctggctgctgatatggtacctgccaattcaactgtgctttccttctgtgcttttgcagtagaccctgctaaagcatataaggattacctagcaagtggaggacaaccaatcaccagaccttttgggacagcggtg

SEQ ID NO: 449256 - DNA, 140 bp, Artificial Sequence
  Synthetic
caccgctgtcccaaaaggtctggtgattggttgtcctccacttgctaggtaatccttatatgctttagcagggtctactgcaaaagcacagaaggaaagcacagttgaattggcaggtaccatatcagcagccagggcct

SEQ ID NO: 449257 - DNA, 140 bp, Artificial Sequence
  Synthetic
atacgccatgctgggtctcctgaactcttctgaaggagttcctgatcttctggtctaaacgaactaactattattattattctgtttggaactttaacattgcttatcatggcagacaaccgtacttgggagtcggccat

SEQ ID NO: 449258 - DNA, 140 bp, Artificial Sequence
  Synthetic
atggccgactcccaagtacggttgtctgccatgataagcaatgttaaagttccaaacagaataataataatagttagttcgtttagaccagaagatcaggaactccttcagaagagttcaggagacccagcatggcgtat

SEQ ID NO: 449259 - DNA, 140 bp, Artificial Sequence
  Synthetic
atacgccatgctgggtctcccaattactgcacagccagtaaaaattgacaatgcttctcatgcaagtactgttcgtgctacagcaacgataccgctacaagcctcactccctttcggatgcgtacttgggagtcggccat

SEQ ID NO: 449260 - DNA, 140 bp, Artificial Sequence
  Synthetic
atggccgactcccaagtacgcatccgaaagggagtgaggcttgtagcggtatcgttgctgtagcacgaacagtacttgcatgagaagcattgtcaatttttactggctgtgcagtaattgggagacccagcatggcgtat

SEQ ID NO: 449261 - DNA, 140 bp, Artificial Sequence
  Synthetic
aggccctggctgctgatatgcttgctcttttgggggtgtaagtgtaattacacctggaacaaatgcttcatctgaagttgctgttctatatcaagatgttaactgcactgatgtttctacgaccttttgggacagcggtg

SEQ ID NO: 449262 - DNA, 140 bp, Artificial Sequence
  Synthetic
caccgctgtcccaaaaggtcgtagaaacatcagtgcagttaacatcttgatatagaacagcaacttcagatgaagcatttgttccaggtgtaattacacttacacccccaaaagagcaagcatatcagcagccagggcct

SEQ ID NO: 449263 - DNA, 140 bp, Artificial Sequence
  Synthetic
atacgccatgctgggtctccaactccacaccttatgggttgggattatccaaaatgtgacagagccatgcctaacatgcttaggataatggcctctcttgttcttgctcgcaaacataaccgtacttgggagtcggccat

SEQ ID NO: 449264 - DNA, 140 bp, Artificial Sequence
  Synthetic
atggccgactcccaagtacggttatgtttgcgagcaagaacaagagaggccattatcctaagcatgttaggcatggctctgtcacattttggataatcccaacccataaggtgtggagttggagacccagcatggcgtat

SEQ ID NO: 449265 - DNA, 140 bp, Artificial Sequence
  Synthetic
aggccctggctgctgatatgctaggaactggcccgaagcttcacttccctacggcgctaacaaagaaggcatcgtatgggttgcaactgagggagcctgaaatacacccaaagaccacatgaccttttgggacagcggtg

SEQ ID NO: 449266 - DNA, 140 bp, Artificial Sequence
  Synthetic
caccgctgtcccaaaaggtcatgtggtctttgggtgtatttcaggctccctcagttgcaacccatacgatgccttctttgttagcgccgtagggaagtgaagcttcgggccagttcctagcatatcagcagccagggcct

SEQ ID NO: 449267 - DNA, 140 bp, Artificial Sequence
  Synthetic
atacgccatgctgggtctcctatgctaatagtgtctttaacatttgtcaagctgttacagccaatgtaaatgcacttctttcaactgatggtaataagatagctgacaagtatgtccgcacgtacttgggagtcggccat

SEQ ID NO: 449268 - DNA, 140 bp, Artificial Sequence
  Synthetic
atggccgactcccaagtacgtgcggacatacttgtcagctatcttattaccatcagttgaaagaagtgcatttacattggctgtaacagcttgacaaatgttaaagacactattagcataggagacccagcatggcgtat

SEQ ID NO: 449269 - DNA, 140 bp, Artificial Sequence
  Synthetic
atacgccatgctgggtctccccgtaatggtgttttaataacagaaggttcagtcaaaggtctaacaccttcaaagggaccagcacaagctagcgtcaaatggagtcacattaattggagacgtacttgggagtcggccat

SEQ ID NO: 449270 - DNA, 140 bp, Artificial Sequence
  Synthetic
atggccgactcccaagtacgtctccaattaatgtgactccatttgacgctagcttgtgctggtccctttgaaggtgttagacctttgactgaaccttctgttattaaaacaccattacggggagacccagcatggcgtat

SEQ ID NO: 449271 - DNA, 140 bp, Artificial Sequence
  Synthetic
atacgccatgctgggtctccggtgcttgtgtattgtgcaattcacagacttcacttcgttgcggtgcctgtattaggagaccattcctatgttgcaagtgctgctatgaccatgtcatttcgtacttgggagtcggccat

SEQ ID NO: 449272 - DNA, 140 bp, Artificial Sequence
  Synthetic
atggccgactcccaagtacgaaatgacatggtcatagcagcacttgcaacataggaatggtctcctaatacaggcaccgcaacgaagtgaagtctgtgaattgcacaatacacaagcaccggagacccagcatggcgtat

SEQ ID NO: 449273 - DNA, 140 bp, Artificial Sequence
  Synthetic
atacgccatgctgggtctccaactcctggcagcagtaggggaaattctcctgctcgaatggctagcggaggtggtgaaactgccctcgcgctattgctgctagacagattgaaccagcttcgtacttgggagtcggccat

SEQ ID NO: 449274 - DNA, 140 bp, Artificial Sequence
  Synthetic
atggccgactcccaagtacgaagctggttcaatctgtctagcagcaatagcgcgagggcagtttcaccacctccgctagccattcgagcaggagaatttcccctactgctgccaggagttggagacccagcatggcgtat

SEQ ID NO: 449275 - DNA, 140 bp, Artificial Sequence
  Synthetic
aggccctggctgctgatatggtacacacactggtacaggacaggcaattactgtaacaccagaagctaacatggaccaagagtcctttggtggtgcttcatgttgtctgtattgtagatggaccttttgggacagcggtg

SEQ ID NO: 449276 - DNA, 140 bp, Artificial Sequence
  Synthetic
caccgctgtcccaaaaggtccatctacaatacagacaacatgaagcaccaccaaaggactcttggtccatgttagcttctggtgttacagtaattgcctgtcctgtaccagtgtgtgtaccatatcagcagccagggcct

SEQ ID NO: 449277 - DNA, 140 bp, Artificial Sequence
  Synthetic
atacgccatgctgggtctccgacgacgactactagcgtgcctttgtaagcacaagaaagtgagtacgaacttatgtactcattcgtttcggaagaaacaggtacgttaataaatagcgtacgtacttgggagtcggccat

SEQ ID NO: 449278 - DNA, 140 bp, Artificial Sequence
  Synthetic
atggccgactcccaagtacgtacgctatttattaacgtacctgtttcttccgaaacgaatgagtacataagttcgtactcactttcttgtgcttacaaaggcacgctagtagtcgtcgtcggagacccagcatggcgtat

SEQ ID NO: 449279 - DNA, 140 bp, Artificial Sequence
  Synthetic
aggccctggctgctgatatgcattgtagtctttgatgaaatctctatggctactaattatgacttgagtgttgtcaatgctagacttcgtgcaaaacactacgtctatattggcgatcctgaccttttgggacagcggtg

SEQ ID NO: 449280 - DNA, 140 bp, Artificial Sequence
  Synthetic
caccgctgtcccaaaaggtcaggatcgccaatatagacgtagtgttttgcacgaagtctagcattgacaacactcaagtcataattagtagccatagagatttcatcaaagactacaatgcatatcagcagccagggcct

SEQ ID NO: 449281 - DNA, 140 bp, Artificial Sequence
  Synthetic
atacgccatgctgggtctcccaacagatgtttcatcttgttgacttccaggttacaatagcagagatattgattatcattatgaggactttcaggattgctatttggaatcttgacgttacgtacttgggagtcggccat

SEQ ID NO: 449282 - DNA, 140 bp, Artificial Sequence
  Synthetic
atggccgactcccaagtacgtaacgtcaagattccaaatagcaatcctgaaagtcctcataatgataatcaatatctctgctattgtaacctggaagtcaacaagatgaaacatctgttgggagacccagcatggcgtat

SEQ ID NO: 449283 - DNA, 140 bp, Artificial Sequence
  Synthetic
aggccctggctgctgatatgttaccctaatatgtttatcacccgcgaagaagctattcgtcacgttcgtgcgtggattggctttgatgtagagggctgtcatgcaactagagatgctgtggaccttttgggacagcggtg

SEQ ID NO: 449284 - DNA, 140 bp, Artificial Sequence
  Synthetic
caccgctgtcccaaaaggtccacagcatctctagttgcatgacagccctctacatcaaagccaatccacgcacgaacgtgacgaatagcttcttcgcgggtgataaacatattagggtaacatatcagcagccagggcct

SEQ ID NO: 449285 - DNA, 140 bp, Artificial Sequence
  Synthetic
atacgccatgctgggtctcccaaaggctatcaagtgtgtgcctcaggctgaagtagaatggaagttctacgatgctcagccatgtagtgacaaagcttacaaaatagaggaactcttctacgtacttgggagtcggccat

SEQ ID NO: 449286 - DNA, 140 bp, Artificial Sequence
  Synthetic
atggccgactcccaagtacgtagaagagttcctctattttgtaagctttgtcactacatggctgagcatcgtagaacttccattctacttcagcctgaggcacacacttgatagcctttgggagacccagcatggcgtat

SEQ ID NO: 449287 - DNA, 140 bp, Artificial Sequence
  Synthetic
aggccctggctgctgatatgctatgcagttgcatacgcactgtagtacagcgctgtgcatctaataaacctcatgtgtttgaagatccttgtcctactggttaccaacctgaatggaatagaccttttgggacagcggtg

SEQ ID NO: 449288 - DNA, 140 bp, Artificial Sequence
  Synthetic
caccgctgtcccaaaaggtctattccattcaggttggtaaccagtaggacaaggatcttcaaacacatgaggtttattagatgcacagcgctgtactacagtgcgtatgcaactgcatagcatatcagcagccagggcct

SEQ ID NO: 449289 - DNA, 140 bp, Artificial Sequence
  Synthetic
atacgccatgctgggtctccggtagagtggaaggacaggtagacctttttagaaacgcccgtaatggtgttttaataacagaaggttcagtcaaaggtctaacaccttcaaagggaccagcgtacttgggagtcggccat

SEQ ID NO: 449290 - DNA, 140 bp, Artificial Sequence
  Synthetic
atggccgactcccaagtacgctggtccctttgaaggtgttagacctttgactgaaccttctgttattaaaacaccattacgggcgtttctaaaaaggtctacctgtccttccactctaccggagacccagcatggcgtat

SEQ ID NO: 449291 - DNA, 140 bp, Artificial Sequence
  Synthetic
aggccctggctgctgatatgagtgaaaaattacttcataacagatgcgcaaacaggttcatcaaaatgtgtgtgttctgtgattgatcttttacttgatgactttgtcgagataataaaggaccttttgggacagcggtg

SEQ ID NO: 449292 - DNA, 140 bp, Artificial Sequence
  Synthetic
caccgctgtcccaaaaggtcctttattatctcgacaaagtcatcaagtaaaagatcaatcacagaacacacacattttgatgaacctgtttgcgcatctgttatgaagtaatttttcactcatatcagcagccagggcct

SEQ ID NO: 449293 - DNA, 140 bp, Artificial Sequence
  Synthetic
atacgccatgctgggtctcccattgtctcctggtttactggctacaaacaatgtctttcgcttaaaagggggtgcaccaattaaaggtgtaacctttggagaagatactgttttggaagtcgtacttgggagtcggccat

SEQ ID NO: 449294 - DNA, 140 bp, Artificial Sequence
  Synthetic
atggccgactcccaagtacgacttccaaaacagtatcttctccaaaggttacacctttaattggtgcacccccttttaagcgaaagacattgtttgtagccagtaaaccaggagacaatgggagacccagcatggcgtat

SEQ ID NO: 449295 - DNA, 140 bp, Artificial Sequence
  Synthetic
aggccctggctgctgatatgcactactgagatgctctcaagagctttgaagaaagtgccagttgatgagtatataaccacgtaccctggacaaggatgtgctggttatacacttgaggaagaccttttgggacagcggtg

SEQ ID NO: 449296 - DNA, 140 bp, Artificial Sequence
  Synthetic
caccgctgtcccaaaaggtcttcctcaagtgtataaccagcacatccttgtccagggtacgtggttatatactcatcaactggcactttcttcaaagctcttgagagcatctcagtagtgcatatcagcagccagggcct

SEQ ID NO: 449297 - DNA, 140 bp, Artificial Sequence
  Synthetic
aggccctggctgctgatatgtcatggacaacttggcggtcttcatttaatgataggcttagccaagcgctcacaagattcaccacttaaattagaggattttatccctatggacagcacagaccttttgggacagcggtg

SEQ ID NO: 449298 - DNA, 140 bp, Artificial Sequence
  Synthetic
caccgctgtcccaaaaggtctgtgctgtccatagggataaaatcctctaatttaagtggtgaatcttgtgagcgcttggctaagcctatcattaaatgaagaccgccaagttgtccatgacatatcagcagccagggcct

SEQ ID NO: 449299 - DNA, 140 bp, Artificial Sequence
  Synthetic
aggccctggctgctgatatgcacagtcggtgattattattaacaattctactaatgttgttatacgagcatgtaactttgaattgtgtgacaaccctttctttgctgtttctaaacccatgaccttttgggacagcggtg

SEQ ID NO: 449300 - DNA, 140 bp, Artificial Sequence
  Synthetic
caccgctgtcccaaaaggtcatgggtttagaaacagcaaagaaagggttgtcacacaattcaaagttacatgctcgtataacaacattagtagaattgttaataataatcaccgactgtgcatatcagcagccagggcct

SEQ ID NO: 449301 - DNA, 140 bp, Artificial Sequence
  Synthetic
aggccctggctgctgatatgattacaaattttagagccattcttacagccttttcacctgctcaagacacttggggcacgtcagctgcagcctattttgttggctatttaaagccaactagaccttttgggacagcggtg

SEQ ID NO: 449302 - DNA, 140 bp, Artificial Sequence
  Synthetic
caccgctgtcccaaaaggtctagttggctttaaatagccaacaaaataggctgcagctgacgtgccccaagtgtcttgagcaggtgaaaaggctgtaagaatggctctaaaatttgtaatcatatcagcagccagggcct

SEQ ID NO: 449303 - DNA, 140 bp, Artificial Sequence
  Synthetic
atacgccatgctgggtctccctttttctcattgttgctgctctagtatttttaatactttgcttcaccattaagagaaagacagaatgaatgagctcactttaattgacttctattttatcgtacttgggagtcggccat

SEQ ID NO: 449304 - DNA, 140 bp, Artificial Sequence
  Synthetic
atggccgactcccaagtacgataaaatagaagtcaattaaagtgagctcattcattctgtctttctcttaatggtgaagcaaagtattaaaaatactagagcagcaacaatgagaaaaagggagacccagcatggcgtat

SEQ ID NO: 449305 - DNA, 140 bp, Artificial Sequence
  Synthetic
atacgccatgctgggtctcctgcttctccaatgtctatgcagattcttttgtagtcaagggagatgatgtaagacaaatagcgccaggacaaactggtgttattgctgattataattatacgtacttgggagtcggccat

SEQ ID NO: 449306 - DNA, 140 bp, Artificial Sequence
  Synthetic
atggccgactcccaagtacgtataattataatcagcaataacaccagtttgtcctggcgctatttgtcttacatcatctcccttgactacaaaagaatctgcatagacattggagaagcaggagacccagcatggcgtat

SEQ ID NO: 449307 - DNA, 140 bp, Artificial Sequence
  Synthetic
atacgccatgctgggtctccgttcgaaccaaacacttggtgtttacgttgtctttggagtacaaagccagcagatacttcaaattcatttgaagttctggcagtagaagacacataaggacgtacttgggagtcggccat

SEQ ID NO: 449308 - DNA, 140 bp, Artificial Sequence
  Synthetic
atggccgactcccaagtacgtccttatgtgtcttctactgccagaacttcaaatgaatttgaagtatctgctggctttgtactccaaagacaacgtaaacaccaagtgtttggttcgaacggagacccagcatggcgtat

SEQ ID NO: 449309 - DNA, 140 bp, Artificial Sequence
  Synthetic
aggccctggctgctgatatggcaatttactgctgctatttgttaccatctattcacatcttttgcttgtcgctgcaggtatggaggcgcaatttttgtacctctatgccttgatatatttgaccttttgggacagcggtg

SEQ ID NO: 449310 - DNA, 140 bp, Artificial Sequence
  Synthetic
caccgctgtcccaaaaggtcaaatatatcaaggcatagaggtacaaaaattgcgcctccatacctgcagcgacaagcaaaagatgtgaatagatggtaacaaatagcagcagtaaattgccatatcagcagccagggcct

SEQ ID NO: 449311 - DNA, 140 bp, Artificial Sequence
  Synthetic
aggccctggctgctgatatgaatttgacactttcaaaggggaatgcccaaagtttgtgtttcctcttaactcaaaagtcaaagtcattcaaccacgtgttgaaaagaaaaagactgaggggaccttttgggacagcggtg

SEQ ID NO: 449312 - DNA, 140 bp, Artificial Sequence
  Synthetic
caccgctgtcccaaaaggtcccctcagtctttttcttttcaacacgtggttgaatgactttgacttttgagttaagaggaaacacaaactttgggcattcccctttgaaagtgtcaaattcatatcagcagccagggcct

SEQ ID NO: 449313 - DNA, 140 bp, Artificial Sequence
  Synthetic
aggccctggctgctgatatgtattttggttttcactcgaaatccaggatctagaagaaccttgtaccaaagtctaaacgaacatgctcattgttttgacttgtatttctctatgcagttggaccttttgggacagcggtg

SEQ ID NO: 449314 - DNA, 140 bp, Artificial Sequence
  Synthetic
caccgctgtcccaaaaggtccaactgcatagagaaatacaagtcaaaacaatgagcatgttcgtttagactttggtacaaggttcttctagatcctggatttcgagtgaaaaccaaaatacatatcagcagccagggcct

SEQ ID NO: 449315 - DNA, 140 bp, Artificial Sequence
  Synthetic
aggccctggctgctgatatgttattggcatcattaacaacacagtttatgatcctctgcaacctgagcttgactcattcaaagaagagctggacaagtacttcaaaaatcatacatcaccgaccttttgggacagcggtg

SEQ ID NO: 449316 - DNA, 140 bp, Artificial Sequence
  Synthetic
caccgctgtcccaaaaggtcggtgatgtatgatttttgaagtacttgtccagctcttctttgaatgagtcaagctcaggttgcagaggatcataaactgtgttgttaatgatgccaataacatatcagcagccagggcct

SEQ ID NO: 449317 - DNA, 140 bp, Artificial Sequence
  Synthetic
atacgccatgctgggtctccttactcttggatcaattactgcacagccagtaaaaattgacaatgcttctcctgcaagtactgttcatgctacagcaacgataccgctacaagcctcactcgtacttgggagtcggccat

SEQ ID NO: 449318 - DNA, 140 bp, Artificial Sequence
  Synthetic
atggccgactcccaagtacgagtgaggcttgtagcggtatcgttgctgtagcatgaacagtacttgcaggagaagcattgtcaatttttactggctgtgcagtaattgatccaagagtaaggagacccagcatggcgtat

SEQ ID NO: 449319 - DNA, 140 bp, Artificial Sequence
  Synthetic
aggccctggctgctgatatgccgctacaagcctcactccctttcggatggcttgttattggcgttgcatttcttgctgtttttcagagcgctaccaaaataattgcgctcaataaaagatgaccttttgggacagcggtg

SEQ ID NO: 449320 - DNA, 140 bp, Artificial Sequence
  Synthetic
caccgctgtcccaaaaggtcatcttttattgagcgcaattattttggtagcgctctgaaaaacagcaagaaatgcaacgccaataacaagccatccgaaagggagtgaggcttgtagcggcatatcagcagccagggcct

SEQ ID NO: 449321 - DNA, 140 bp, Artificial Sequence
  Synthetic
aggccctggctgctgatatgttttcttgctttcgtggtattcttgctagtcacactagccatccttactgcgcttcgattgtgtgcgtactgctgcaatattgttaacgtgagtttagtagaccttttgggacagcggtg

SEQ ID NO: 449322 - DNA, 140 bp, Artificial Sequence
  Synthetic
caccgctgtcccaaaaggtctactaaactcacgttaacaatattgcagcagtacgcacacaatcgaagcgcagtaaggatggctagtgtgactagcaagaataccacgaaagcaagaaaacatatcagcagccagggcct

SEQ ID NO: 449323 - DNA, 140 bp, Artificial Sequence
  Synthetic
atacgccatgctgggtctccttttatgtactaccttcagaagcacctaatgctaaggaagagattctaggaactgtatcctggaatttgagagaaatgcttgctcatgctgaagagacaacgtacttgggagtcggccat

SEQ ID NO: 449324 - DNA, 140 bp, Artificial Sequence
  Synthetic
atggccgactcccaagtacgttgtctcttcagcatgagcaagcatttctctcaaattccaggatacagttcctagaatctcttccttagcattaggtgcttctgaaggtagtacataaaaggagacccagcatggcgtat

SEQ ID NO: 449325 - DNA, 140 bp, Artificial Sequence
  Synthetic
aggccctggctgctgatatgaggagttcctgatcttctggtctaaacgaactaactattattattattctgtttggaactttaacattgcttatcatggcagacaacggtactattaccggaccttttgggacagcggtg

SEQ ID NO: 449326 - DNA, 140 bp, Artificial Sequence
  Synthetic
caccgctgtcccaaaaggtccggtaatagtaccgttgtctgccatgataagcaatgttaaagttccaaacagaataataataatagttagttcgtttagaccagaagatcaggaactcctcatatcagcagccagggcct

SEQ ID NO: 449327 - DNA, 140 bp, Artificial Sequence
  Synthetic
atacgccatgctgggtctccttgaggagcttaaacaactcctggaacaatggaacctagtaataggtttcctattcctagcctggattatgttactacaatttgcctattctaatcggaacgtacttgggagtcggccat

SEQ ID NO: 449328 - DNA, 140 bp, Artificial Sequence
  Synthetic
atggccgactcccaagtacgttccgattagaataggcaaattgtagtaacataatccaggctaggaataggaaacctattactaggttccattgttccaggagttgtttaagctcctcaaggagacccagcatggcgtat

SEQ ID NO: 449329 - DNA, 140 bp, Artificial Sequence
  Synthetic
atacgccatgctgggtctccctcttcctgacattgattgtatttacatcttgcgagctatatcactatcaggagtgtgttagaggtacgactgtactactaaaagaaccttgcccatcagcgtacttgggagtcggccat

SEQ ID NO: 449330 - DNA, 140 bp, Artificial Sequence
  Synthetic
atggccgactcccaagtacgctgatgggcaaggttcttttagtagtacagtcgtacctctaacacactcctgatagtgatatagctcgcaagatgtaaatacaatcaatgtcaggaagagggagacccagcatggcgtat

SEQ ID NO: 449331 - DNA, 140 bp, Artificial Sequence
  Synthetic
aggccctggctgctgatatgatgtggcttagctacttcgttgcttccttcaggctgtttgctcgtacccgctcaatgtggtcattcaacccagaaacaaacattcttctcaatgtgcctcgaccttttgggacagcggtg

SEQ ID NO: 449332 - DNA, 140 bp, Artificial Sequence
  Synthetic
caccgctgtcccaaaaggtcgaggcacattgagaagaatgtttgtttctgggttgaatgaccacattgagcgggtacgagcaaacagcctgaaggaagcaacgaagtagctaagccacatcatatcagcagccagggcct

SEQ ID NO: 449333 - DNA, 140 bp, Artificial Sequence
  Synthetic
  misc_feature (23)..(23): n is a, c, g, or t
aggccctggctgctgatatgagntaggtgttggtaccttcatgaaggtcaccaaactgctgcatttagagacgtacttgttgttttaaataaacgaacaaattaaaatgtctgataatgggaccttttgggacagcggtg

SEQ ID NO: 449334 - DNA, 140 bp, Artificial Sequence
  Synthetic
  misc_feature (118)..(118): n is a, c, g, or t
caccgctgtcccaaaaggtcccattatcagacattttaatttgttcgtttatttaaaacaacaagtacgtctctaaatgcagcagtttggtgaccttcatgaaggtaccaacacctanctcatatcagcagccagggcct

SEQ ID NO: 449335 - DNA, 140 bp, Artificial Sequence
  Synthetic
atacgccatgctgggtctcctgcttgaagatccttgtaaggtacaacactaggggtaatacttatagcactgcttggctttgtgctctaggaaaggttttaccttttcatagatggcacacgtacttgggagtcggccat

SEQ ID NO: 449336 - DNA, 140 bp, Artificial Sequence
  Synthetic
atggccgactcccaagtacgtgtgccatctatgaaaaggtaaaacctttcctagagcacaaagccaagcagtgctataagtattacccctagtgttgtaccttacaaggatcttcaagcaggagacccagcatggcgtat

SEQ ID NO: 449337 - DNA, 140 bp, Artificial Sequence
  Synthetic
atacgccatgctgggtctccaaaatgtctgataatggaccccaatcaaaccaacgtagtgccccccgcattacatttggtggacccacagattcaactgacaataaccagaatggaggaccgtacttgggagtcggccat

SEQ ID NO: 449338 - DNA, 140 bp, Artificial Sequence
  Synthetic
atggccgactcccaagtacggtcctccattctggttattgtcagttgaatctgtgggtccaccaaatgtaatgcggggggcactacgttggtttgattggggtccattatcagacattttggagacccagcatggcgtat

SEQ ID NO: 449339 - DNA, 140 bp, Artificial Sequence
  Synthetic
atacgccatgctgggtctccaccaaattggctactaccgaagagctacccgacgagttcgtggtggtgacggcaaaatgaaagagctcagccccagatggtacttctattacctaggaaccgtacttgggagtcggccat

SEQ ID NO: 449340 - DNA, 140 bp, Artificial Sequence
  Synthetic
atggccgactcccaagtacggttcctaggtaatagaagtaccatctggggctgagctctttcattttgccgtcaccaccacgaactcgtcgggtagctcttcggtagtagccaatttggtggagacccagcatggcgtat

SEQ ID NO: 449341 - DNA, 140 bp, Artificial Sequence
  Synthetic
atacgccatgctgggtctccaattattgaagtcaatagccgccactagaggagctactgtggtaattggaacaagcaagttttacggtggctggcataatatgttaaaaactgtttacagcgtacttgggagtcggccat

SEQ ID NO: 449342 - DNA, 140 bp, Artificial Sequence
  Synthetic
atggccgactcccaagtacgctgtaaacagtttttaacatattatgccagccaccgtaaaacttgcttgttccaattaccacagtagctcctctagtggcggctattgacttcaataattggagacccagcatggcgtat

SEQ ID NO: 449343 - DNA, 140 bp, Artificial Sequence
  Synthetic
aggccctggctgctgatatggagccctaatgtgtaaaattaattttagtagtgctatccccatgtgattttaatagcttcttaggagaatgacaaaaaaaaaaaaaaaaaaaaaaaaaaagaccttttgggacagcggtg

SEQ ID NO: 449344 - DNA, 140 bp, Artificial Sequence
  Synthetic
caccgctgtcccaaaaggtctttttttttttttttttttttttttttgtcattctcctaagaagctattaaaatcacatggggatagcactactaaaattaattttacacattagggctccatatcagcagccagggcct

SEQ ID NO: 449345 - DNA, 140 bp, Artificial Sequence
  Synthetic
aggccctggctgctgatatggtaaaaattgacaatgcttctcatgcaagtactgttcgtgctacagcaacgataccgctacaagcctcactccctttcggagggcttgttattggcgttggaccttttgggacagcggtg

SEQ ID NO: 449346 - DNA, 140 bp, Artificial Sequence
  Synthetic
caccgctgtcccaaaaggtccaacgccaataacaagccctccgaaagggagtgaggcttgtagcggtatcgttgctgtagcacgaacagtacttgcatgagaagcattgtcaatttttaccatatcagcagccagggcct

SEQ ID NO: 449347 - DNA, 140 bp, Artificial Sequence
  Synthetic
atacgccatgctgggtctccccagttcattttcaatttactgctgctatttgttaccatctattcacatcttttgcttgtcgctgcaggtatggaggcgcaatttttgtacctctatgcccgtacttgggagtcggccat

SEQ ID NO: 449348 - DNA, 140 bp, Artificial Sequence
  Synthetic
atggccgactcccaagtacgggcatagaggtacaaaaattgcgcctccatacctgcagcgacaagcaaaagatgtgaatagatggtaacaaatagcagcagtaaattgaaaatgaactggggagacccagcatggcgtat

SEQ ID NO: 449349 - DNA, 140 bp, Artificial Sequence
  Synthetic
aggccctggctgctgatatgtgtacataataaagcttgttttcctctggctcttgtggccagtaacacttgcttgctttgtgcttgctgctgtctacagaattaattgggtgactggcgggaccttttgggacagcggtg

SEQ ID NO: 449350 - DNA, 140 bp, Artificial Sequence
  Synthetic
caccgctgtcccaaaaggtcccgccagtcacccaattaattctgtagacagcagcaagcacaaagcaagcaagtgttactggccacaagagccagaggaaaacaagctttattatgtacacatatcagcagccagggcct

SEQ ID NO: 449351 - DNA, 140 bp, Artificial Sequence
  Synthetic
atacgccatgctgggtctccaacttatcacaccgtttctacaggttagctaacgagtgtgcgcaagtattaagtgagatggtcatgtgtggcggctcactatatgttaaaccaggtggaacgtacttgggagtcggccat

SEQ ID NO: 449352 - DNA, 140 bp, Artificial Sequence
  Synthetic
atggccgactcccaagtacgttccacctggtttaacatatagtgagccgccacacatgaccatctcacttaatacttgcgcacactcgttagctaacctgtagaaacggtgtgataagttggagacccagcatggcgtat

SEQ ID NO: 449353 - DNA, 140 bp, Artificial Sequence
  Synthetic
atacgccatgctgggtctcctacccaggaaaagccaaccaacctcgatctcttgtagatctgttctctaaacgaactttaaaatctgtgtagctgtcgctcggctgcatgcctagtgcaccgtacttgggagtcggccat

SEQ ID NO: 449354 - DNA, 140 bp, Artificial Sequence
  Synthetic
atggccgactcccaagtacggtgcactaggcatgcagccgagcgacagctacacagattttaaagttcgtttagagaacagatctacaagagatcgaggttggttggcttttcctgggtaggagacccagcatggcgtat

SEQ ID NO: 449355 - DNA, 140 bp, Artificial Sequence
  Synthetic
atacgccatgctgggtctcctttaatctcacatagcaatctttaatcaatgtgtaacattagggaggacttgaaagagccaccacattttcatcgaggccacgcggagtacgatcgagggcgtacttgggagtcggccat

SEQ ID NO: 449356 - DNA, 140 bp, Artificial Sequence
  Synthetic
atggccgactcccaagtacgccctcgatcgtactccgcgtggcctcgatgaaaatgtggtggctctttcaagtcctccctaatgttacacattgattaaagattgctatgtgagattaaaggagacccagcatggcgtat

SEQ ID NO: 449357 - DNA, 140 bp, Artificial Sequence
  Synthetic
atacgccatgctgggtctcctacagtgaataatgctagggagagctgcctatatggaagagccctaatgtgtaaaattaattttagtagtgctatccccatgtgattttaatagcttcttcgtacttgggagtcggccat

SEQ ID NO: 449358 - DNA, 140 bp, Artificial Sequence
  Synthetic
atggccgactcccaagtacgaagaagctattaaaatcacatggggatagcactactaaaattaattttacacattagggctcttccatataggcagctctccctagcattattcactgtaggagacccagcatggcgtat

SEQ ID NO: 449359 - DNA, 140 bp, Artificial Sequence
  Synthetic
aggccctggctgctgatatgagggagagctgcctatatggaagagccctaatgtgtaaaattaattttagtagtgctatccccatgtgattttaatagcttcttaggagaatgacaaaaagaccttttgggacagcggtg

SEQ ID NO: 449360 - DNA, 140 bp, Artificial Sequence
  Synthetic
caccgctgtcccaaaaggtctttttgtcattctcctaagaagctattaaaatcacatggggatagcactactaaaattaattttacacattagggctcttccatataggcagctctccctcatatcagcagccagggcct

SEQ ID NO: 449361 - DNA, 140 bp, Artificial Sequence
  Synthetic
aggccctggctgctgatatgtctgtgtagctgtcgctcggctgcatgcctagtgcacctacgcagtataaacaataataaattttactgtcgttgacaagaaacgagtaactcgtccctcgaccttttgggacagcggtg

SEQ ID NO: 449362 - DNA, 140 bp, Artificial Sequence
  Synthetic
caccgctgtcccaaaaggtcgagggacgagttactcgtttcttgtcaacgacagtaaaatttattattgtttatactgcgtaggtgcactaggcatgcagccgagcgacagctacacagacatatcagcagccagggcct

SEQ ID NO: 449363 - DNA, 140 bp, Artificial Sequence
  Synthetic
aggccctggctgctgatatgtcaacattcaaaaagaaattgaccgcctcaatgaggtcgctaaaaatttaaatgaatcactcattgaccttcaagaatgggaaaatatgagcaatatattgaccttttgggacagcggtg

SEQ ID NO: 449364 - DNA, 140 bp, Artificial Sequence
  Synthetic
caccgctgtcccaaaaggtcaatatattgctcatattttcccattcttgaaggtcaatgagtgattcatttaaatttttagcgacctcattgaggcggtcaatttctttttgaatgttgacatatcagcagccagggcct

SEQ ID NO: 449365 - DNA, 140 bp, Artificial Sequence
  Synthetic
aggccctggctgctgatatgggcatggctgtatgctgctgttatcaatggtgataggtggtttcttaatagattcaccactactttgaatgactttaaccttgtggcaatgaagtacaacgaccttttgggacagcggtg

SEQ ID NO: 449366 - DNA, 140 bp, Artificial Sequence
  Synthetic
caccgctgtcccaaaaggtcgttgtacttcattgccacaaggttaaagtcattcaaagtagtggtgaatctattaagaaaccacctatcaccattgataacagcagcatacagccatgcccatatcagcagccagggcct

SEQ ID NO: 449367 - DNA, 140 bp, Artificial Sequence
  Synthetic
atacgccatgctgggtctccaagacaacgttcaaaccaaacacttggtgtttacgttgtctttggagtacaaagccagtagatacttcaaattcatttgaagttctggcagtagaagacacgtacttgggagtcggccat

SEQ ID NO: 449368 - DNA, 140 bp, Artificial Sequence
  Synthetic
atggccgactcccaagtacgtgtcttctactgccagaacttcaaatgaatttgaagtatctactggctttgtactccaaagacaacgtaaacaccaagtgtttggtttgaacgttgtcttggagacccagcatggcgtat

SEQ ID NO: 449369 - DNA, 140 bp, Artificial Sequence
  Synthetic
aggccctggctgctgatatgatcttgataacctgaagcctagagtggaagcacctaaacaagaggagccaccaaacacagaagattccaaaactgaggagaaatctgtcgtacagaagccgaccttttgggacagcggtg

SEQ ID NO: 449370 - DNA, 140 bp, Artificial Sequence
  Synthetic
caccgctgtcccaaaaggtcggcttctgtacgacagatttctcctcagttttggaatcttctgtgtttggtggctcctcttgtttaggtgcttccactctaggcttcaggttatcaagatcatatcagcagccagggcct

SEQ ID NO: 449371 - DNA, 140 bp, Artificial Sequence
  Synthetic
atacgccatgctgggtctccggctcttacagagattggtcctattcaggacagcgtacagagttaggtgttgaatttcttaagcgtggtgacaaaattgtgtaccacactctggagagcccgtacttgggagtcggccat

SEQ ID NO: 449372 - DNA, 140 bp, Artificial Sequence
  Synthetic
atggccgactcccaagtacgggctctccagagtgtggtacacaattttgtcaccacgcttaagaaattcaacacctaactctgtacgctgtcctgaataggaccaatctctgtaagagccggagacccagcatggcgtat

SEQ ID NO: 449373 - DNA, 140 bp, Artificial Sequence
  Synthetic
aggccctggctgctgatatgttgacaaggctggtcaaaagacctatgagagacatccgctctcccattttgtcaatttagacaatttgagagctaacaacactaaaggttcactgcctatgaccttttgggacagcggtg

SEQ ID NO: 449374 - DNA, 140 bp, Artificial Sequence
  Synthetic
caccgctgtcccaaaaggtcataggcagtgaacctttagtgttgttagctctcaaattgtctaaattgacaaaatgggagagcggatgtctctcataggtcttttgaccagccttgtcaacatatcagcagccagggcct

SEQ ID NO: 449375 - DNA, 140 bp, Artificial Sequence
  Synthetic
atacgccatgctgggtctccgtacgccaatcattattaaagactgtacaattctgcgatgctatgcgtgatggcaggcattgtaggcgtactgacattagataatcaggatcttaatgggcgtacttgggagtcggccat

SEQ ID NO: 449376 - DNA, 140 bp, Artificial Sequence
  Synthetic
atggccgactcccaagtacgcccattaagatcctgattatctaatgtcagtacgcctacaatgcctgccatcacgcatagcatcgcagaattgtacagtctttaataatgattggcgtacggagacccagcatggcgtat

SEQ ID NO: 449377 - DNA, 140 bp, Artificial Sequence
  Synthetic
aggccctggctgctgatatgtattaaaattacaaattttagagccattcttacagcctttttacctgctcaagacacttggggcacgtcagctgcagcctattttgttggctatttaaaggaccttttgggacagcggtg

SEQ ID NO: 449378 - DNA, 140 bp, Artificial Sequence
  Synthetic
caccgctgtcccaaaaggtcctttaaatagccaacaaaataggctgcagctgacgtgccccaagtgtcttgagcaggtaaaaaggctgtaagaatggctctaaaatttgtaattttaatacatatcagcagccagggcct

SEQ ID NO: 449379 - DNA, 140 bp, Artificial Sequence
  Synthetic
aggccctggctgctgatatgttacgttgtctttggagtacaaagccagtagatacttcaaattcatttgaagttctggcagtagaagacacacaaggaatggacaatcttgcttgtgaaagaccttttgggacagcggtg

SEQ ID NO: 449380 - DNA, 140 bp, Artificial Sequence
  Synthetic
caccgctgtcccaaaaggtctttcacaagcaagattgtccattccttgtgtgtcttctactgccagaacttcaaatgaatttgaagtatctactggctttgtactccaaagacaacgtaacatatcagcagccagggcct

SEQ ID NO: 449381 - DNA, 140 bp, Artificial Sequence
  Synthetic
atacgccatgctgggtctccagaaatagggatgttgatcatgaattcgtggatgagttttacgcttacctgcgtaaacatttctccatgatgattctttctgatgatgccgttgtgtgctcgtacttgggagtcggccat

SEQ ID NO: 449382 - DNA, 140 bp, Artificial Sequence
  Synthetic
atggccgactcccaagtacgagcacacaacggcatcatcagaaagaatcatcatggagaaatgtttacgcaggtaagcgtaaaactcatccacgaattcatgatcaacatccctatttctggagacccagcatggcgtat

SEQ ID NO: 449383 - DNA, 140 bp, Artificial Sequence
  Synthetic
atacgccatgctgggtctccagtaaatcctgtgtgctaattgaggtgcattggtctgcaaatcgagttgctaggcaataaacacatttggattaattttaatcgttcgttgagcgattagcgtacttgggagtcggccat

SEQ ID NO: 449384 - DNA, 140 bp, Artificial Sequence
  Synthetic
atggccgactcccaagtacgctaatcgctcaacgaacgattaaaattaatccaaatgtgtttattgcctagcaactcgatttgcagaccaatgcacctcaattagcacacaggatttactggagacccagcatggcgtat

SEQ ID NO: 449385 - DNA, 140 bp, Artificial Sequence
  Synthetic
atacgccatgctgggtctcctggctgctctaaggaaagttaaaagagtggttgccggtttgatgagaggattgtcctcaaggaaacgccgttcccatgatgttctgactgtgcaattcctcgtacttgggagtcggccat

SEQ ID NO: 449386 - DNA, 140 bp, Artificial Sequence
  Synthetic
atggccgactcccaagtacgaggaattgcacagtcagaacatcatgggaacggcgtttccttgaggacaatcctctcatcaaaccggcaaccactcttttaactttccttagagcagccaggagacccagcatggcgtat

SEQ ID NO: 449387 - DNA, 140 bp, Artificial Sequence
  Synthetic
atacgccatgctgggtctccaattttgggaatgctgttgatgacgggtggagtgaccttgatgcggaagaatagatggttgctcctaaatgtgacatctgaggacctcgggaaaacattccgtacttgggagtcggccat

SEQ ID NO: 449388 - DNA, 140 bp, Artificial Sequence
  Synthetic
atggccgactcccaagtacggaatgttttcccgaggtcctcagatgtcacatttaggagcaaccatctattcttccgcatcaaggtcactccacccgtcatcaacagcattcccaaaattggagacccagcatggcgtat

SEQ ID NO: 449389 - DNA, 140 bp, Artificial Sequence
  Synthetic
aggccctggctgctgatatgagccagatgacattgattgctggtgttatggagtggagaacgttagagtcacatatggtaagtgtgactcagcaggcaggtctaggaggtcaagaagggcgaccttttgggacagcggtg

SEQ ID NO: 449390 - DNA, 140 bp, Artificial Sequence
  Synthetic
caccgctgtcccaaaaggtcgcccttcttgacctcctagacctgcctgctgagtcacacttaccatatgtgactctaacgttctccactccataacaccagcaatcaatgtcatctggctcatatcagcagccagggcct

SEQ ID NO: 449391 - DNA, 140 bp, Artificial Sequence
  Synthetic
aggccctggctgctgatatgtggctgttggtccggcctactcagctcactgcattggagttgctgacagggatttcattgagggggtgcatggaggaacttgggtctcagccaccctggagaccttttgggacagcggtg

SEQ ID NO: 449392 - DNA, 140 bp, Artificial Sequence
  Synthetic
caccgctgtcccaaaaggtctccagggtggctgagacccaagttcctccatgcaccccctcaatgaaatccctgtcagcaactccaatgcagtgagctgagtaggccggaccaacagccacatatcagcagccagggcct

SEQ ID NO: 449393 - DNA, 140 bp, Artificial Sequence
  Synthetic
atacgccatgctgggtctcctgttacaatgcagttctcactcatgtgaagattgatgacaagtgccccagcactggagaggcccacctagctgaagagaacgaaggggacaatgcgtgcacgtacttgggagtcggccat

SEQ ID NO: 449394 - DNA, 140 bp, Artificial Sequence
  Synthetic
atggccgactcccaagtacgtgcacgcattgtccccttcgttctcttcagctaggtgggcctctccagtgctggggcacttgtcatcaatcttcacatgagtgagaactgcattgtaacaggagacccagcatggcgtat

SEQ ID NO: 449395 - DNA, 140 bp, Artificial Sequence
  Synthetic
atacgccatgctgggtctccagcgcacttattctgatagaggctggggcaatggctgtggcctatttgggaaaggaagcattgtggcatgcgccaaattcacttgtgccaaatccatgagcgtacttgggagtcggccat

SEQ ID NO: 449396 - DNA, 140 bp, Artificial Sequence
  Synthetic
atggccgactcccaagtacgctcatggatttggcacaagtgaatttggcgcatgccacaatgcttcctttcccaaataggccacagccattgccccagcctctatcagaataagtgcgctggagacccagcatggcgtat

SEQ ID NO: 449397 - DNA, 140 bp, Artificial Sequence
  Synthetic
atacgccatgctgggtctcctttgtttgaggttgatcagaccaagattcagtatgttatcaaagcacaattgcatgtaggggccaagcaggaagattggaaaaccgacattaagactctccgtacttgggagtcggccat

SEQ ID NO: 449398 - DNA, 140 bp, Artificial Sequence
  Synthetic
atggccgactcccaagtacggagagtcttaatgtcggttttccaatcttcctgcttggcccctacatgcaattgtgctttgataacatactgaatcttggtctgatcaacctcaaacaaaggagacccagcatggcgtat

SEQ ID NO: 449399 - DNA, 140 bp, Artificial Sequence
  Synthetic
aggccctggctgctgatatgaaaagttacactggaatgccaggtgcaaactgcggtggactttggtaacagttacatcgctgagatggaaaaagagagctggatagtggacagacagtgggaccttttgggacagcggtg

SEQ ID NO: 449400 - DNA, 140 bp, Artificial Sequence
  Synthetic
caccgctgtcccaaaaggtcccactgtctgtccactatccagctctctttttccatctcagcgatgtaactgttaccaaagtccaccgcagtttgcacctggcattccagtgtaacttttcatatcagcagccagggcct

SEQ ID NO: 449401 - DNA, 140 bp, Artificial Sequence
  Synthetic
atacgccatgctgggtctccgttacatcgctgagatggaaaaagagagctggatagtggacagacagtgggcccaggacttgaccctgccatggcagagtggaagtggcggggtgtggagcgtacttgggagtcggccat

SEQ ID NO: 449402 - DNA, 140 bp, Artificial Sequence
  Synthetic
atggccgactcccaagtacgctccacaccccgccacttccactctgccatggcagggtcaagtcctgggcccactgtctgtccactatccagctctctttttccatctcagcgatgtaacggagacccagcatggcgtat

SEQ ID NO: 449403 - DNA, 140 bp, Artificial Sequence
  Synthetic
aggccctggctgctgatatgaggggacatcctacaaaatgtgcactgacaaaatgtcttttgtcaagaacccaactgacactggtcatggcactgttgtgatgcaggtgaaagtgccaaagaccttttgggacagcggtg

SEQ ID NO: 449404 - DNA, 140 bp, Artificial Sequence
  Synthetic
caccgctgtcccaaaaggtctttggcactttcacctgcatcacaacagtgccatgaccagtgtcagttgggttcttgacaaaagacattttgtcagtgcacattttgtaggatgtcccctcatatcagcagccagggcct

SEQ ID NO: 449405 - DNA, 140 bp, Artificial Sequence
  Synthetic
atacgccatgctgggtctcccaatcaataaaggcattttggttacagttaaccccatcgcctcaaccaatgatgatgaagtgctgattgaggtgaacccaccttttggagatagctacatcgtacttgggagtcggccat

SEQ ID NO: 449406 - DNA, 140 bp, Artificial Sequence
  Synthetic
atggccgactcccaagtacgatgtagctatctccaaaaggtgggttcacctcaatcagcacttcatcatcattggttgaggcgatggggttaactgtaaccaaaatgcctttattgattgggagacccagcatggcgtat

SEQ ID NO: 449407 - DNA, 140 bp, Artificial Sequence
  Synthetic
atacgccatgctgggtctccctggccgtcatgggagacgccgcctgggatttcagctccgctggagggttcttcacctcggttgggaaaggaattcatacggtgtttggctctgcctttccgtacttgggagtcggccat

SEQ ID NO: 449408 - DNA, 140 bp, Artificial Sequence
  Synthetic
atggccgactcccaagtacggaaaggcagagccaaacaccgtatgaattcctttcccaaccgaggtgaagaaccctccagcggagctgaaatcccaggcggcgtctcccatgacggccagggagacccagcatggcgtat

SEQ ID NO: 449409 - DNA, 140 bp, Artificial Sequence
  Synthetic
aggccctggctgctgatatgcggatcaaggatgcgccatcaactttggcaagagagagcttaagtgcggagatggtatcttcatattcagagactctgatgactggttgaacaagtactcgaccttttgggacagcggtg

SEQ ID NO: 449410 - DNA, 140 bp, Artificial Sequence
  Synthetic
caccgctgtcccaaaaggtcgagtacttgttcaaccagtcatcagagtctctgaatatgaagataccatctccgcacttaagctctctcttgccaaagttgatggcgcatccttgatccgcatatcagcagccagggcct

SEQ ID NO: 449411 - DNA, 140 bp, Artificial Sequence
  Synthetic
aggccctggctgctgatatgatattatccagaagatcctgtgaagcttgcatcaatagtgaaagcctcttttgaagaagggaagtgtggcctaaattcagttgactcccttgagcatgaggaccttttgggacagcggtg

SEQ ID NO: 449412 - DNA, 140 bp, Artificial Sequence
  Synthetic
caccgctgtcccaaaaggtcctcatgctcaagggagtcaactgaatttaggccacacttcccttcttcaaaagaggctttcactattgatgcaagcttcacaggatcttctggataatatcatatcagcagccagggcct

SEQ ID NO: 449413 - DNA, 140 bp, Artificial Sequence
  Synthetic
atacgccatgctgggtctccttgaagaagggaagtgtggcctaaattcagttgactcccttgagcatgagatgtggagaagcagggcagatgagatcaatgccattcttgaggaaaacgacgtacttgggagtcggccat

SEQ ID NO: 449414 - DNA, 140 bp, Artificial Sequence
  Synthetic
atggccgactcccaagtacgtcgttttcctcaagaatggcattgatctcatctgccctgcttctccacatctcatgctcaagggagtcaactgaatttaggccacacttcccttcttcaaggagacccagcatggcgtat

SEQ ID NO: 449415 - DNA, 140 bp, Artificial Sequence
  Synthetic
aggccctggctgctgatatgggtggacatttctgttgtcgtgcaggatccaaagaatgtttaccagagaggaactcatccattctccagaattcgggatggtctgcagtatggttggaaggaccttttgggacagcggtg

SEQ ID NO: 449416 - DNA, 140 bp, Artificial Sequence
  Synthetic
caccgctgtcccaaaaggtccttccaaccatactgcagaccatcccgaattctggagaatggatgagttcctctctggtaaacattctttggatcctgcacgacaacagaaatgtccacccatatcagcagccagggcct

SEQ ID NO: 449417 - DNA, 140 bp, Artificial Sequence
  Synthetic
atacgccatgctgggtctccccaccacggatagcgggaaaattattcctgaatggtgttgccgctcctgcacaatgccgcctgtgagcttccatggtagtgatgggtgttggtatcccatcgtacttgggagtcggccat

SEQ ID NO: 449418 - DNA, 140 bp, Artificial Sequence
  Synthetic
atggccgactcccaagtacgatgggataccaacacccatcactaccatggaagctcacaggcggcattgtgcaggagcggcaacaccattcaggaataattttcccgctatccgtggtggggagacccagcatggcgtat

SEQ ID NO: 449419 - DNA, 140 bp, Artificial Sequence
  Synthetic
atacgccatgctgggtctccggaaattaggccaatgaaaacgcatgaaagccatctggtgcgctcctgggttacagctggagaaatacatgctgtcccttttggtttggtgagcatgatgcgtacttgggagtcggccat

SEQ ID NO: 449420 - DNA, 140 bp, Artificial Sequence
  Synthetic
atggccgactcccaagtacgcatcatgctcaccaaaccaaaagggacagcatgtatttctccagctgtaacccaggagcgcaccagatggctttcatgcgttttcattggcctaatttccggagacccagcatggcgtat

SEQ ID NO: 449421 - DNA, 140 bp, Artificial Sequence
  Synthetic
atacgccatgctgggtctccggttggaggagtcgtgctcttaggagcaatgctggtcgggcaagtaactctccttgatttgctggaactcacagtggctgtggggttgcatttccatgagcgtacttgggagtcggccat

SEQ ID NO: 449422 - DNA, 140 bp, Artificial Sequence
  Synthetic
atggccgactcccaagtacgctcatggaaatgcaaccccacagccactgtgagttccagcaaatcaaggagagttacttgcccgaccagcattgctcctaagagcacgactcctccaaccggagacccagcatggcgtat

SEQ ID NO: 449423 - DNA, 140 bp, Artificial Sequence
  Synthetic
atacgccatgctgggtctccctcgggagcgccttgtgctggccttgggagcagccatggtggagattgctttgggtggcatgatgggcggcctgtggaagtatctaaacgcagtttctctcgtacttgggagtcggccat

SEQ ID NO: 449424 - DNA, 140 bp, Artificial Sequence
  Synthetic
atggccgactcccaagtacgagagaaactgcgtttagatacttccacaggccgcccatcatgccacccaaagcaatctccaccatggctgctcccaaggccagcacaaggcgctcccgagggagacccagcatggcgtat

SEQ ID NO: 449425 - DNA, 140 bp, Artificial Sequence
  Synthetic
aggccctggctgctgatatgttgggtggcatgatgggcggcctgtggaagtatctaaacgcagtttctctctgtatcctgacaataaatgctgttgcttctaggaaagcatcaaatgccagaccttttgggacagcggtg

SEQ ID NO: 449426 - DNA, 140 bp, Artificial Sequence
  Synthetic
caccgctgtcccaaaaggtctggcatttgatgctttcctagaagcaacagcatttattgtcaggatacagagagaaactgcgtttagatacttccacaggccgcccatcatgccacccaacatatcagcagccagggcct

SEQ ID NO: 449427 - DNA, 140 bp, Artificial Sequence
  Synthetic
aggccctggctgctgatatgtcctgcccctcatggctctgttgacacctgttactatggctgaggtgagacttgccacaatgctcttttgtaccgtggttatcataggggtccttcaccagaccttttgggacagcggtg

SEQ ID NO: 449428 - DNA, 140 bp, Artificial Sequence
  Synthetic
caccgctgtcccaaaaggtctggtgaaggacccctatgataaccacggtacaaaagagcattgtggcaagtctcacctcagccatagtaacaggtgtcaacagagccatgaggggcaggacatatcagcagccagggcct

SEQ ID NO: 449429 - DNA, 140 bp, Artificial Sequence
  Synthetic
aggccctggctgctgatatgcactcacatcttacctgggcttgacacaaccttttttgggcctgtgtgcatttctggcaacccgcatatttggtcgaaggagtatcccagtgaatgaggcgaccttttgggacagcggtg

SEQ ID NO: 449430 - DNA, 140 bp, Artificial Sequence
  Synthetic
caccgctgtcccaaaaggtcgcctcattcactgggatactccttcgaccaaatatgcgggttgccagaaatgcacacaggcccaaaaaaggttgtgtcaagcccaggtaagatgtgagtgcatatcagcagccagggcct

SEQ ID NO: 449431 - DNA, 140 bp, Artificial Sequence
  Synthetic
aggccctggctgctgatatgatgatgtggcactcagtgaacaaggggagttcaagctgctttctgaagagaaggtgccatgggaccaggttgtgatgacctcgctggccttggttggggcgaccttttgggacagcggtg

SEQ ID NO: 449432 - DNA, 140 bp, Artificial Sequence
  Synthetic
caccgctgtcccaaaaggtcgccccaaccaaggccagcgaggtcatcacaacctggtcccatggcaccttctcttcagaaagcagcttgaactccccttgttcactgagtgccacatcatcatatcagcagccagggcct

SEQ ID NO: 449433 - DNA, 140 bp, Artificial Sequence
  Synthetic
aggccctggctgctgatatgtgccattcatccatttgctcttctactggtccttgctgggtggctgtttcatgtcaggagagctaggagaagtggggatgtcttgtgggacattcccactgaccttttgggacagcggtg

SEQ ID NO: 449434 - DNA, 140 bp, Artificial Sequence
  Synthetic
caccgctgtcccaaaaggtcagtgggaatgtcccacaagacatccccacttctcctagctctcctgacatgaaacagccacccagcaaggaccagtagaagagcaaatggatgaatggcacatatcagcagccagggcct

SEQ ID NO: 449435 - DNA, 140 bp, Artificial Sequence
  Synthetic
aggccctggctgctgatatgattccagtcaaccttcttgggggcctcccagcgaggagtgggagtggcacagggaggggtgttccacacaatgtggcatgtcacaagaggagctttccttgaccttttgggacagcggtg

SEQ ID NO: 449436 - DNA, 140 bp, Artificial Sequence
  Synthetic
caccgctgtcccaaaaggtcaaggaaagctcctcttgtgacatgccacattgtgtggaacacccctccctgtgccactcccactcctcgctgggaggcccccaagaaggttgactggaatcatatcagcagccagggcct

SEQ ID NO: 449437 - DNA, 140 bp, Artificial Sequence
  Synthetic
atacgccatgctgggtctccagggaggggtgttccacacaatgtggcatgtcacaagaggagctttccttgtttggaatggcaagaagttgatcccatcttgggcttcagtaaaggaagacgtacttgggagtcggccat

SEQ ID NO: 449438 - DNA, 140 bp, Artificial Sequence
  Synthetic
atggccgactcccaagtacgtcttcctttactgaagcccaagatgggatcaacttcttgccattccaaacaaggaaagctcctcttgtgacatgccacattgtgtggaacacccctccctggagacccagcatggcgtat

SEQ ID NO: 449439 - DNA, 140 bp, Artificial Sequence
  Synthetic
atacgccatgctgggtctccaggaagaagtccagctgatcgcggctgctccaggaaagaacgtggtcaacgtccagacaaaaccgagcttgtttaaagtgaggaatgggggagaaatcggcgtacttgggagtcggccat

SEQ ID NO: 449440 - DNA, 140 bp, Artificial Sequence
  Synthetic
atggccgactcccaagtacgccgatttctcccccattcctcactttaaacaagctcggttttgtctggacgttgaccacgttctttcctggagcagccgcgatcagctggacttcttcctggagacccagcatggcgtat

SEQ ID NO: 449441 - DNA, 140 bp, Artificial Sequence
  Synthetic
aggccctggctgctgatatgggctgtcgctcttgactatccgagtggcacttcaggatctcctattgttaacaggaacggagaggtgattgggctgtacggcaatggcatccttgtcggtgaccttttgggacagcggtg

SEQ ID NO: 449442 - DNA, 140 bp, Artificial Sequence
  Synthetic
caccgctgtcccaaaaggtcaccgacaaggatgccattgccgtacagcccaatcacctctccgttcctgttaacaataggagatcctgaagtgccactcggatagtcaagagcgacagcccatatcagcagccagggcct

SEQ ID NO: 449443 - DNA, 140 bp, Artificial Sequence
  Synthetic
atacgccatgctgggtctccgacaactccttcgtgtccgccatatctcagactgaggtgaaggaagaaggaaaagaggaactccaagagatcccgacaatgctaaagaaaggaaagacaacgtacttgggagtcggccat

SEQ ID NO: 449444 - DNA, 140 bp, Artificial Sequence
  Synthetic
atggccgactcccaagtacgttgtctttcctttctttagcattgtcgggatctcttggagttcctcttttccttcttccttcacctcagtctgagatatggcggacacgaaggagttgtcggagacccagcatggcgtat

SEQ ID NO: 449445 - DNA, 140 bp, Artificial Sequence
  Synthetic
aggccctggctgctgatatgcagatcttggccgagtgcgcacggagacgcttgcgcactcttgtgttggcccccaccagggttgttctttctgaaatgaaggaggcttttcacggcctgggaccttttgggacagcggtg

SEQ ID NO: 449446 - DNA, 140 bp, Artificial Sequence
  Synthetic
caccgctgtcccaaaaggtcccaggccgtgaaaagcctccttcatttcagaaagaacaaccctggtgggggccaacacaagagtgcgcaagcgtctccgtgcgcactcggccaagatctgcatatcagcagccagggcct

SEQ ID NO: 449447 - DNA, 140 bp, Artificial Sequence
  Synthetic
aggccctggctgctgatatgtgcctctttgcgcaaggccggaaagagtgtggtggtcctgaacaggaaaacctttgagagagaataccccacgataaagcagaagaaacctgactttatagaccttttgggacagcggtg

SEQ ID NO: 449448 - DNA, 140 bp, Artificial Sequence
  Synthetic
caccgctgtcccaaaaggtctataaagtcaggtttcttctgctttatcgtggggtattctctctcaaaggttttcctgttcaggaccaccacactctttccggccttgcgcaaagaggcacatatcagcagccagggcct

SEQ ID NO: 449449 - DNA, 140 bp, Artificial Sequence
  Synthetic
aggccctggctgctgatatggagactgagggatgaccagaggaaagtcttcagagaactagtgaggaattgtgacctgcccgtttggctctcgtggcaagtggccaaggctggtttgaaggaccttttgggacagcggtg

SEQ ID NO: 449450 - DNA, 140 bp, Artificial Sequence
  Synthetic
caccgctgtcccaaaaggtccttcaaaccagccttggccacttgccacgagagccaaacgggcaggtcacaattcctcactagttctctgaagactttcctctggtcatccctcagtctccatatcagcagccagggcct

SEQ ID NO: 449451 - DNA, 140 bp, Artificial Sequence
  Synthetic
atacgccatgctgggtctccgtgacctgcccgtttggctctcgtggcaagtggccaaggctggtttgaagacgaatgatcgtaagtggtgttttgaaggccctgaggaacatgagatcttcgtacttgggagtcggccat

SEQ ID NO: 449452 - DNA, 140 bp, Artificial Sequence
  Synthetic
atggccgactcccaagtacgaagatctcatgttcctcagggccttcaaaacaccacttacgatcattcgtcttcaaaccagccttggccacttgccacgagagccaaacgggcaggtcacggagacccagcatggcgtat

SEQ ID NO: 449453 - DNA, 140 bp, Artificial Sequence
  Synthetic
atacgccatgctgggtctcctcatgtctcccaaaggcatcagtagaatgtcaatggcgaaaggcacaatggccggctgcggatatctcatgtttcttggaggcgtggaacccactcacatcgtacttgggagtcggccat

SEQ ID NO: 449454 - DNA, 140 bp, Artificial Sequence
  Synthetic
atggccgactcccaagtacgatgtgagtgggttccacgcctccaagaaacatgagatatccgcagccggccattgtgcctttcgccattgacattctactgatgcctttgggagacatgaggagacccagcatggcgtat

SEQ ID NO: 449455 - DNA, 140 bp, Artificial Sequence
  Synthetic
aggccctggctgctgatatggccggctgcggatatctcatgtttcttggaggcgtggaacccactcacatctcctatataatgctcatattctttgtcctgatggtggttgtgatccccggaccttttgggacagcggtg

SEQ ID NO: 449456 - DNA, 140 bp, Artificial Sequence
  Synthetic
caccgctgtcccaaaaggtccggggatcacaaccaccatcaggacaaagaatatgagcattatataggagatgtgagtgggttccacgcctccaagaaacatgagatatccgcagccggccatatcagcagccagggcct

SEQ ID NO: 449457 - DNA, 140 bp, Artificial Sequence
  Synthetic
aggccctggctgctgatatgccactggatcaaagtcgaatatggcaacctgtctctgtctggaatagcccagtcagcctcagtcctttctttcatggacaaggggataccattcatgaaggaccttttgggacagcggtg

SEQ ID NO: 449458 - DNA, 140 bp, Artificial Sequence
  Synthetic
caccgctgtcccaaaaggtccttcatgaatggtatccccttgtccatgaaagaaaggactgaggctgactgggctattccagacagagacaggttgccatattcgactttgatccagtggcatatcagcagccagggcct

SEQ ID NO: 449459 - DNA, 140 bp, Artificial Sequence
  Synthetic
aggccctggctgctgatatggtgttccatggcgttgccaagaaccctgtggttgatgggaatccaacagttgacattgaggaagctcctgaaatgcctgccctttatgagaagaaactgggaccttttgggacagcggtg

SEQ ID NO: 449460 - DNA, 140 bp, Artificial Sequence
  Synthetic
caccgctgtcccaaaaggtcccagtttcttctcataaagggcaggcatttcaggagcttcctcaatgtcaactgttggattcccatcaaccacagggttcttggcaacgccatggaacaccatatcagcagccagggcct

SEQ ID NO: 449461 - DNA, 140 bp, Artificial Sequence
  Synthetic
aggccctggctgctgatatggccgctcatagagggaaacaccagccttctttggaatggacccatggctgtctccatgacaggagtcatgcgggggaattactatgcttttgtgggagtcgaccttttgggacagcggtg

SEQ ID NO: 449462 - DNA, 140 bp, Artificial Sequence
  Synthetic
caccgctgtcccaaaaggtcgactcccacaaaagcatagtaattcccccgcatgactcctgtcatggagacagccatgggtccattccaaagaaggctggtgtttccctctatgagcggccatatcagcagccagggcct

SEQ ID NO: 449463 - DNA, 140 bp, Artificial Sequence
  Synthetic
aggccctggctgctgatatgtctccatgacaggagtcatgcgggggaattactatgcttttgtgggagtcgcgtacaatctatggaagatgaaaactgcacgccgggggacagcgaatgggaccttttgggacagcggtg

SEQ ID NO: 449464 - DNA, 140 bp, Artificial Sequence
  Synthetic
caccgctgtcccaaaaggtcccattcgctgtcccccggcgtgcagttttcatcttccatagattgtacgcgactcccacaaaagcatagtaattcccccgcatgactcctgtcatggagacatatcagcagccagggcct

SEQ ID NO: 449465 - DNA, 140 bp, Artificial Sequence
  Synthetic
aggccctggctgctgatatgaaaaactttgggtgaagtctggaagagggaactgaatctgttggacaagcaacagtttgagttgtataaaaggaccgacattgtggaggtggatcgtgatgaccttttgggacagcggtg

SEQ ID NO: 449466 - DNA, 140 bp, Artificial Sequence
  Synthetic
caccgctgtcccaaaaggtcatcacgatccacctccacaatgtcggtccttttatacaactcaaactgttgcttgtccaacagattcagttccctcttccagacttcacccaaagtttttcatatcagcagccagggcct

SEQ ID NO: 449467 - DNA, 140 bp, Artificial Sequence
  Synthetic
aggccctggctgctgatatgacatcattaccttcaaggacaaaactgatgtccaccccctagaaccagtgaaatgtgacacccttttgtgtgacattggagaatcatcatcgtcatcggtgaccttttgggacagcggtg

SEQ ID NO: 449468 - DNA, 140 bp, Artificial Sequence
  Synthetic
caccgctgtcccaaaaggtcaccgatgacgatgatgattctccaatgtcacacaaaagggtgtcacatttcactggttctagggggtggacatcagttttgtccttgaaggtaatgatgtcatatcagcagccagggcct

SEQ ID NO: 449469 - DNA, 140 bp, Artificial Sequence
  Synthetic
aggccctggctgctgatatgcacagagggggaaaggaccgtgagagttcttgatactgtagaaaaatggctggcttgtggggtggacaacttctgtgtgaaggtgttagctccatacatggaccttttgggacagcggtg

SEQ ID NO: 449470 - DNA, 140 bp, Artificial Sequence
  Synthetic
caccgctgtcccaaaaggtccatgtatggagctaacaccttcacacagaagttgtccaccccacaagccagccatttttctacagtatcaagaactctcacggtcctttccccctctgtgcatatcagcagccagggcct

SEQ ID NO: 449471 - DNA, 140 bp, Artificial Sequence
  Synthetic
aggccctggctgctgatatgagagatgttctcgagaaactggaattgctccaaaggaggtttggcggaacagtgatcaggaaccctctctccaggaattccactcatgaaatgtactacggaccttttgggacagcggtg

SEQ ID NO: 449472 - DNA, 140 bp, Artificial Sequence
  Synthetic
caccgctgtcccaaaaggtccgtagtacatttcatgagtggaattcctggagagagggttcctgatcactgttccgccaaacctcctttggagcaattccagtttctcgagaacatctctcatatcagcagccagggcct

SEQ ID NO: 449473 - DNA, 140 bp, Artificial Sequence
  Synthetic
atacgccatgctgggtctccctcctgatgaggagaatgaggcgtccaactggaaaagttaccctagaggctgacgtcaccctcccaattgggacacgcagtgttgagacagataagggaccgtacttgggagtcggccat

SEQ ID NO: 449474 - DNA, 140 bp, Artificial Sequence
  Synthetic
atggccgactcccaagtacggtcccttatctgtctcaacactgcgtgtcccaattgggagggtgacgtcagcctctagggtaacttttccagttggacgcctcattctcctcatcaggagggagacccagcatggcgtat

SEQ ID NO: 449475 - DNA, 140 bp, Artificial Sequence
  Synthetic
aggccctggctgctgatatgtgacgtcaccctcccaattgggacacgcagtgttgagacagataagggacccctggacaaagaggccataaaagaaagggttgagaggataaaatctgaggaccttttgggacagcggtg

SEQ ID NO: 449476 - DNA, 140 bp, Artificial Sequence
  Synthetic
caccgctgtcccaaaaggtcctcagattttatcctctcaaccctttcttttatggcctctttgtccaggggtcccttatctgtctcaacactgcgtgtcccaattgggagggtgacgtcacatatcagcagccagggcct

SEQ ID NO: 449477 - DNA, 140 bp, Artificial Sequence
  Synthetic
aggccctggctgctgatatggtttaaagaaaaagttgacaccagagcaaaggatccaccagcgggaaccaggaagatcatgaaagttgtcaacaggtggctgttccgccacctggccagagaccttttgggacagcggtg

SEQ ID NO: 449478 - DNA, 140 bp, Artificial Sequence
  Synthetic
caccgctgtcccaaaaggtctctggccaggtggcggaacagccacctgttgacaactttcatgatcttcctggttcccgctggtggatcctttgctctggtgtcaactttttctttaaaccatatcagcagccagggcct

SEQ ID NO: 449479 - DNA, 140 bp, Artificial Sequence
  Synthetic
atacgccatgctgggtctccaagtcatgcagccattggagcttacctggaagaacaagatcagtggaagactgccaacgaggccgtccaagacccaaagttctgggaactggtggatgaacgtacttgggagtcggccat

SEQ ID NO: 449480 - DNA, 140 bp, Artificial Sequence
  Synthetic
atggccgactcccaagtacgttcatccaccagttcccagaactttgggtcttggacggcctcgttggcagtcttccactgatcttgttcttccaggtaagctccaatggctgcatgacttggagacccagcatggcgtat

SEQ ID NO: 449481 - DNA, 140 bp, Artificial Sequence
  Synthetic
aggccctggctgctgatatggccgtgccatatggtatatgtggctgggagcgcggtatcttgagtttgaggccctgggattcctgaatgaggaccattgggcttccagggaaaactcagggaccttttgggacagcggtg

SEQ ID NO: 449482 - DNA, 140 bp, Artificial Sequence
  Synthetic
caccgctgtcccaaaaggtccctgagttttccctggaagcccaatggtcctcattcaggaatcccagggcctcaaactcaagataccgcgctcccagccacatataccatatggcacggccatatcagcagccagggcct

SEQ ID NO: 449483 - DNA, 140 bp, Artificial Sequence
  Synthetic
atacgccatgctgggtctccgaactacatgagcccacatcacaaaaaactggcacaagcagtgatggaaatgacatacaagaacaaagtggtgaaagtgttgagaccagccccaggagggcgtacttgggagtcggccat

SEQ ID NO: 449484 - DNA, 140 bp, Artificial Sequence
  Synthetic
atggccgactcccaagtacgccctcctggggctggtctcaacactttcaccactttgttcttgtatgtcatttccatcactgcttgtgccagttttttgtgatgtgggctcatgtagttcggagacccagcatggcgtat

SEQ ID NO: 449485 - DNA, 140 bp, Artificial Sequence
  Synthetic
atacgccatgctgggtctccaaagcctacatggatgtcataagtcgacgagaccagagaggatccgggcaggtagtgacttatgctctgaacaccatcaccaacttgaaagtccaattgacgtacttgggagtcggccat

SEQ ID NO: 449486 - DNA, 140 bp, Artificial Sequence
  Synthetic
atggccgactcccaagtacgtcaattggactttcaagttggtgatggtgttcagagcataagtcactacctgcccggatcctctctggtctcgtcgacttatgacatccatgtaggctttggagacccagcatggcgtat

SEQ ID NO: 449487 - DNA, 140 bp, Artificial Sequence
  Synthetic
atacgccatgctgggtctcctcagaatggcagaagcagagatggtgatacatcaccaacatgttcaagattgtgatgaatcagttctgaccaggctggaggcatggctcactgagcacggcgtacttgggagtcggccat

SEQ ID NO: 449488 - DNA, 140 bp, Artificial Sequence
  Synthetic
atggccgactcccaagtacgccgtgctcagtgagccatgcctccagcctggtcagaactgattcatcacaatcttgaacatgttggtgatgtatcaccatctctgcttctgccattctgaggagacccagcatggcgtat

SEQ ID NO: 449489 - DNA, 140 bp, Artificial Sequence
  Synthetic
atacgccatgctgggtctccggcccatcgatgacaggttcggcctggccctgtcccatctcaacgccatgtccaaggttagaaaggacatatctgaatggcagccatcaaaagggtggaacgtacttgggagtcggccat

SEQ ID NO: 449490 - DNA, 140 bp, Artificial Sequence
  Synthetic
atggccgactcccaagtacgttccacccttttgatggctgccattcagatatgtcctttctaaccttggacatggcgttgagatgggacagggccaggccgaacctgtcatcgatgggccggagacccagcatggcgtat

SEQ ID NO: 449491 - DNA, 140 bp, Artificial Sequence
  Synthetic
aggccctggctgctgatatgtccaaggttagaaaggacatatctgaatggcagccatcaaaagggtggaatgattgggagaatgtgcccttctgttcccaccacttccatgaactacagcgaccttttgggacagcggtg

SEQ ID NO: 449492 - DNA, 140 bp, Artificial Sequence
  Synthetic
caccgctgtcccaaaaggtcgctgtagttcatggaagtggtgggaacagaagggcacattctcccaatcattccacccttttgatggctgccattcagatatgtcctttctaaccttggacatatcagcagccagggcct

SEQ ID NO: 449493 - DNA, 140 bp, Artificial Sequence
  Synthetic
atacgccatgctgggtctcctggaatgaccaatagggccacctgggcctccaacatccatttggtcatccaccgtatccgaacgctagttggacaggagaaatatactgactacctaacacgtacttgggagtcggccat

SEQ ID NO: 449494 - DNA, 140 bp, Artificial Sequence
  Synthetic
atggccgactcccaagtacgtgttaggtagtcagtatatttctcctgtccaactagcgttcggatacggtggatgaccaaatggatgttggaggcccaggtggccctattggtcattccaggagacccagcatggcgtat

SEQ ID NO: 449495 - DNA, 140 bp, Artificial Sequence
  Synthetic
atacgccatgctgggtctccgtcatggacagatattctgtggatgctgacctacaaccgggtgagcttatctgaaatgccatctaatgaaacagaaaccgggataaaaactacggatggacgtacttgggagtcggccat

SEQ ID NO: 449496 - DNA, 140 bp, Artificial Sequence
  Synthetic
atggccgactcccaagtacgtccatccgtagtttttatcccggtttctgtttcattagatggcatttcagataagctcacccggttgtaggtcagcatccacagaatatctgtccatgacggagacccagcatggcgtat

SEQ ID NO: 449497 - DNA, 140 bp, Artificial Sequence
  Synthetic
aggccctggctgctgatatggaaccggactccacacattgagacacaaaaagttgtcagcccagaactccacacgagttttgccactgctaagctgtgaggcagtgcaggctgggacagcgaccttttgggacagcggtg

SEQ ID NO: 449498 - DNA, 140 bp, Artificial Sequence
  Synthetic
caccgctgtcccaaaaggtcgctgtcccagcctgcactgcctcacagcttagcagtggcaaaactcgtgtggagttctgggctgacaactttttgtgtctcaatgtgtggagtccggttccatatcagcagccagggcct

SEQ ID NO: 449499 - DNA, 140 bp, Artificial Sequence
  Synthetic
aggccctggctgctgatatgcattggtctgcaaatcgagttgctaggcaataaacacatttggattaattttaatcgttcgttgagcgattagcagagaactgaccagaacatgtctggtgaccttttgggacagcggtg

SEQ ID NO: 449500 - DNA, 140 bp, Artificial Sequence
  Synthetic
caccgctgtcccaaaaggtcaccagacatgttctggtcagttctctgctaatcgctcaacgaacgattaaaattaatccaaatgtgtttattgcctagcaactcgatttgcagaccaatgcatatcagcagccagggcct

SEQ ID NO: 449501 - DNA, 140 bp, Artificial Sequence
  Synthetic
aggccctggctgctgatatgaatgctggacccaagacaaggcttggctgttctaaggaaagtcaagagagtggtggccagtttgatgagaggattgtcctcaaggaaacgccgttcccatgaccttttgggacagcggtg

SEQ ID NO: 449502 - DNA, 140 bp, Artificial Sequence
  Synthetic
caccgctgtcccaaaaggtcatgggaacggcgtttccttgaggacaatcctctcatcaaactggccaccactctcttgactttccttagaacagccaagccttgtcttgggtccagcattcatatcagcagccagggcct

SEQ ID NO: 449503 - DNA, 140 bp, Artificial Sequence
  Synthetic
atacgccatgctgggtctccgatgttctgactgtgcaattcctaattttgggaatgctgttgatgacgggtggagtgaccttggtgcggaaaaacagatggttgctcctaaatgtgacatcgtacttgggagtcggccat

SEQ ID NO: 449504 - DNA, 140 bp, Artificial Sequence
  Synthetic
atggccgactcccaagtacgatgtcacatttaggagcaaccatctgtttttccgcaccaaggtcactccacccgtcatcaacagcattcccaaaattaggaattgcacagtcagaacatcggagacccagcatggcgtat

SEQ ID NO: 449505 - DNA, 140 bp, Artificial Sequence
  Synthetic
atacgccatgctgggtctccctgaggacctcgggaaaacattctctgtgggcacaggcaactgcacaacaaacattttggaagccaagtactggtgcccagactcaatggaatacaactgcgtacttgggagtcggccat

SEQ ID NO: 449506 - DNA, 140 bp, Artificial Sequence
  Synthetic
atggccgactcccaagtacgcagttgtattccattgagtctgggcaccagtacttggcttccaaaatgtttgttgtgcagttgcctgtgcccacagagaatgttttcccgaggtcctcagggagacccagcatggcgtat

SEQ ID NO: 449507 - DNA, 140 bp, Artificial Sequence
  Synthetic
aggccctggctgctgatatgaggtctaggaggtcaagaagggccattgacttgcctacgcatgaaaaccatggtttgaagacccggcaagaaaaatggatgactggaagaatgggtgaaagaccttttgggacagcggtg

SEQ ID NO: 449508 - DNA, 140 bp, Artificial Sequence
  Synthetic
caccgctgtcccaaaaggtctttcacccattcttccagtcatccatttttcttgccgggtcttcaaaccatggttttcatgcgtaggcaagtcaatggcccttcttgacctcctagacctcatatcagcagccagggcct

SEQ ID NO: 449509 - DNA, 140 bp, Artificial Sequence
  Synthetic
aggccctggctgctgatatgggcaactccaaaagattgagagatggttcgtgaggaaccccttttttgcagtgacggctctgaccattgcctaccttgtgggaagcaacatgacgcaacggaccttttgggacagcggtg

SEQ ID NO: 449510 - DNA, 140 bp, Artificial Sequence
  Synthetic
caccgctgtcccaaaaggtccgttgcgtcatgttgcttcccacaaggtaggcaatggtcagagccgtcactgcaaaaaaggggttcctcacgaaccatctctcaatcttttggagttgcccatatcagcagccagggcct

SEQ ID NO: 449511 - DNA, 140 bp, Artificial Sequence
  Synthetic
aggccctggctgctgatatgagtcgtgattgccctactggtcttggctgttggtccggcctactcagctcactgcattggaattactgacagggatttcattgagggggtgcatggaggagaccttttgggacagcggtg

SEQ ID NO: 449512 - DNA, 140 bp, Artificial Sequence
  Synthetic
caccgctgtcccaaaaggtctcctccatgcaccccctcaatgaaatccctgtcagtaattccaatgcagtgagctgagtaggccggaccaacagccaagaccagtagggcaatcacgactcatatcagcagccagggcct

SEQ ID NO: 449513 - DNA, 140 bp, Artificial Sequence
  Synthetic
aggccctggctgctgatatgacttgggtttcagctaccctggagcaagacaagtgtgtcactgttatggcccctgacaagccttcattggacatctcactagagacagtagccattgatagaccttttgggacagcggtg

SEQ ID NO: 449514 - DNA, 140 bp, Artificial Sequence
  Synthetic
caccgctgtcccaaaaggtctatcaatggctactgtctctagtgagatgtccaatgaaggcttgtcaggggccataacagtgacacacttgtcttgctccagggtagctgaaacccaagtcatatcagcagccagggcct

SEQ ID NO: 449515 - DNA, 140 bp, Artificial Sequence
  Synthetic
aggccctggctgctgatatgccctgacaagccttcattggacatctcactagagacagtagccattgatagacctgctgaggtgaggaaagtgtgttacaatgcagttctcactcatgtggaccttttgggacagcggtg

SEQ ID NO: 449516 - DNA, 140 bp, Artificial Sequence
  Synthetic
caccgctgtcccaaaaggtccacatgagtgagaactgcattgtaacacactttcctcacctcagcaggtctatcaatggctactgtctctagtgagatgtccaatgaaggcttgtcagggcatatcagcagccagggcct

SEQ ID NO: 449517 - DNA, 140 bp, Artificial Sequence
  Synthetic
atacgccatgctgggtctccaatgacaacaacctttacaaactacatggtggacatgtttcttgcagagtgaaattgtcagctttgacactcaaggggacatcctacaaaatatgcactgcgtacttgggagtcggccat

SEQ ID NO: 449518 - DNA, 140 bp, Artificial Sequence
  Synthetic
atggccgactcccaagtacgcagtgcatattttgtaggatgtccccttgagtgtcaaagctgacaatttcactctgcaagaaacatgtccaccatgtagtttgtaaaggttgttgtcattggagacccagcatggcgtat

SEQ ID NO: 449519 - DNA, 140 bp, Artificial Sequence
  Synthetic
aggccctggctgctgatatggaaattgtcagctttgacactcaaggggacatcctacaaaatatgcactgacaaaatgttttttgtcaagaacccaactgacactggccatggcactgttgaccttttgggacagcggtg

SEQ ID NO: 449520 - DNA, 140 bp, Artificial Sequence
  Synthetic
caccgctgtcccaaaaggtcaacagtgccatggccagtgtcagttgggttcttgacaaaaaacattttgtcagtgcatattttgtaggatgtccccttgagtgtcaaagctgacaatttccatatcagcagccagggcct

SEQ ID NO: 449521 - DNA, 140 bp, Artificial Sequence
  Synthetic
aggccctggctgctgatatggtttttgtctctaggagttggggcggatcaaggatgcgccatcaactttggcaagagagagctcaagtgcggagatggtatcttcatatttagagactctgaccttttgggacagcggtg

SEQ ID NO: 449522 - DNA, 140 bp, Artificial Sequence
  Synthetic
caccgctgtcccaaaaggtcagagtctctaaatatgaagataccatctccgcacttgagctctctcttgccaaagttgatggcgcatccttgatccgccccaactcctagagacaaaaaccatatcagcagccagggcct

SEQ ID NO: 449523 - DNA, 140 bp, Artificial Sequence
  Synthetic
atacgccatgctgggtctccccagggaggaagaatggaagcttcatcatagatggaaagtccaggaaagaatgcccgttttcaaaccgggtctggaattctttccagatagaggagtttgcgtacttgggagtcggccat

SEQ ID NO: 449524 - DNA, 140 bp, Artificial Sequence
  Synthetic
atggccgactcccaagtacgcaaactcctctatctggaaagaattccagacccggtttgaaaacgggcattctttcctggactttccatctatgatgaagcttccattcttcctccctggggagacccagcatggcgtat

SEQ ID NO: 449525 - DNA, 140 bp, Artificial Sequence
  Synthetic
atacgccatgctgggtctccggacgggagtgttcaccacacgcgtgtacatggacgcagtctttgaatacaccatagactgcgatggatctatcttgggtgcagcggtgaacggaaaaaacgtacttgggagtcggccat

SEQ ID NO: 449526 - DNA, 140 bp, Artificial Sequence
  Synthetic
atggccgactcccaagtacgttttttccgttcaccgctgcacccaagatagatccatcgcagtctatggtgtattcaaagactgcgtccatgtacacgcgtgtggtgaacactcccgtccggagacccagcatggcgtat

SEQ ID NO: 449527 - DNA, 140 bp, Artificial Sequence
  Synthetic
aggccctggctgctgatatggagcagccatggtggagattgccttgggtggcgtgatgggcggcctgtggaagtatctaaatgcagtttctctctgcatcctgacaataaatgctgttgcgaccttttgggacagcggtg

SEQ ID NO: 449528 - DNA, 140 bp, Artificial Sequence
  Synthetic
caccgctgtcccaaaaggtcgcaacagcatttattgtcaggatgcagagagaaactgcatttagatacttccacaggccgcccatcacgccacccaaggcaatctccaccatggctgctccatatcagcagccagggcct

SEQ ID NO: 449529 - DNA, 140 bp, Artificial Sequence
  Synthetic
atacgccatgctgggtctccaggagtatcccagtgaatgaggcactcgcagcagctggtctagtgggagtgctggcaggactggcttttcaggagatggagaacttccttggtccgattgcgtacttgggagtcggccat

SEQ ID NO: 449530 - DNA, 140 bp, Artificial Sequence
  Synthetic
atggccgactcccaagtacgcaatcggaccaaggaagttctccatctcctgaaaagccagtcctgccagcactcccactagaccagctgctgcgagtgcctcattcactgggatactcctggagacccagcatggcgtat

SEQ ID NO: 449531 - DNA, 140 bp, Artificial Sequence
  Synthetic
aggccctggctgctgatatgagttcaagctgctttctgaagagaaagtgccatgggaccaggttgtgatgacctcgctggccttggttggggctgccctccatccatttgctcttctgctgaccttttgggacagcggtg

SEQ ID NO: 449532 - DNA, 140 bp, Artificial Sequence
  Synthetic
caccgctgtcccaaaaggtcagcagaagagcaaatggatggagggcagccccaaccaaggccagcgaggtcatcacaacctggtcccatggcactttctcttcagaaagcagcttgaactcatatcagcagccagggcct

SEQ ID NO: 449533 - DNA, 140 bp, Artificial Sequence
  Synthetic
aggccctggctgctgatatgccagcgaggagtgggagtggcacagggaggggtgttccacacaatgtggcatgtcacaagaggagctttccttgtcaggaatggcaagaagttgattccagaccttttgggacagcggtg

SEQ ID NO: 449534 - DNA, 140 bp, Artificial Sequence
  Synthetic
caccgctgtcccaaaaggtctggaatcaacttcttgccattcctgacaaggaaagctcctcttgtgacatgccacattgtgtggaacacccctccctgtgccactcccactcctcgctggcatatcagcagccagggcct

SEQ ID NO: 449535 - DNA, 140 bp, Artificial Sequence
  Synthetic
atacgccatgctgggtctccgtgaggaatgggggagaaatcggggctgtcgctcttgactatccgagtggcacttcaggatctcctattgttaacaggaacggagaggtgattgggctgtcgtacttgggagtcggccat

SEQ ID NO: 449536 - DNA, 140 bp, Artificial Sequence
  Synthetic
atggccgactcccaagtacgacagcccaatcacctctccgttcctgttaacaataggagatcctgaagtgccactcggatagtcaagagcgacagccccgatttctcccccattcctcacggagacccagcatggcgtat

SEQ ID NO: 449537 - DNA, 140 bp, Artificial Sequence
  Synthetic
aggccctggctgctgatatgtgtggtggtcctgaacaggaaaacctttgagagagaataccccacgataaagcagaagaaacctgactttatattggccactgacatagctgaaatgggagaccttttgggacagcggtg

SEQ ID NO: 449538 - DNA, 140 bp, Artificial Sequence
  Synthetic
caccgctgtcccaaaaggtctcccatttcagctatgtcagtggccaatataaagtcaggtttcttctgctttatcgtggggtattctctctcaaaggttttcctgttcaggaccaccacacatatcagcagccagggcct

SEQ ID NO: 449539 - DNA, 140 bp, Artificial Sequence
  Synthetic
aggccctggctgctgatatgaagtggccaaggctggtttgaagacgaatgatcgtaagtggtgttttgaaggccctgaggaacatgagatcttgaatgacagcggtgaaacagtgaagtggaccttttgggacagcggtg

SEQ ID NO: 449540 - DNA, 140 bp, Artificial Sequence
  Synthetic
caccgctgtcccaaaaggtccacttcactgtttcaccgctgtcattcaagatctcatgttcctcagggccttcaaaacaccacttacgatcattcgtcttcaaaccagccttggccacttcatatcagcagccagggcct

SEQ ID NO: 449541 - DNA, 140 bp, Artificial Sequence
  Synthetic
aggccctggctgctgatatgcagggctcctggaggagcaaagaagcctctgcgcccaaggtggtgtgatgaaagggtgtcatctgaccagagtgcgctgtctgaatttattaagtttgctgaccttttgggacagcggtg

SEQ ID NO: 449542 - DNA, 140 bp, Artificial Sequence
  Synthetic
caccgctgtcccaaaaggtcagcaaacttaataaattcagacagcgcactctggtcagatgacaccctttcatcacaccaccttgggcgcagaggcttctttgctcctccaggagccctgcatatcagcagccagggcct

SEQ ID NO: 449543 - DNA, 140 bp, Artificial Sequence
  Synthetic
atacgccatgctgggtctccgacatcgggaatggtcatctttttcatgtctcccaaaggcatcagtagaatgtctatggcgatgggcacaatggccggctgtggatatctcatgttccttcgtacttgggagtcggccat

SEQ ID NO: 449544 - DNA, 140 bp, Artificial Sequence
  Synthetic
atggccgactcccaagtacgaaggaacatgagatatccacagccggccattgtgcccatcgccatagacattctactgatgcctttgggagacatgaaaaagatgaccattcccgatgtcggagacccagcatggcgtat

SEQ ID NO: 449545 - DNA, 140 bp, Artificial Sequence
  Synthetic
aggccctggctgctgatatgtgtctatggcgatgggcacaatggccggctgtggatatctcatgttccttggaggcgtcaaacccactcacatctcctatatcatgctcatattctttgtgaccttttgggacagcggtg

SEQ ID NO: 449546 - DNA, 140 bp, Artificial Sequence
  Synthetic
caccgctgtcccaaaaggtcacaaagaatatgagcatgatataggagatgtgagtgggtttgacgcctccaaggaacatgagatatccacagccggccattgtgcccatcgccatagacacatatcagcagccagggcct

SEQ ID NO: 449547 - DNA, 140 bp, Artificial Sequence
  Synthetic
aggccctggctgctgatatgcctgatggtggttgtgatccccgagccagggcaacaaaggtccatccaagacaaccaagtggcatacctcattattggcatcctgacgctggtttcagcggaccttttgggacagcggtg

SEQ ID NO: 449548 - DNA, 140 bp, Artificial Sequence
  Synthetic
caccgctgtcccaaaaggtccgctgaaaccagcgtcaggatgccaataatgaggtatgccacttggttgtcttggatggacctttgttgccctggctcggggatcacaaccaccatcaggcatatcagcagccagggcct

SEQ ID NO: 449549 - DNA, 140 bp, Artificial Sequence
  Synthetic
atacgccatgctgggtctccgtggcagccaacgagctaggcatgctggagaaaaccaaagaggacctctttgggaagaagaacttaattccatctagtgcttcaccctggagttggccggcgtacttgggagtcggccat

SEQ ID NO: 449550 - DNA, 140 bp, Artificial Sequence
  Synthetic
atggccgactcccaagtacgccggccaactccagggtgaagcactagatggaattaagttcttcttcccaaagaggtcctctttggttttctccagcatgcctagctcgttggctgccacggagacccagcatggcgtat

SEQ ID NO: 449551 - DNA, 140 bp, Artificial Sequence
  Synthetic
aggccctggctgctgatatggtcagtggctggaattcaataacagtgatgcctctgctctgtggcatagggtgcgccatgctccactggtctctcattttacctggaatcaaagcgcagcgaccttttgggacagcggtg

SEQ ID NO: 449552 - DNA, 140 bp, Artificial Sequence
  Synthetic
caccgctgtcccaaaaggtcgctgcgctttgattccaggtaaaatgagagaccagtggagcatggcgcaccctatgccacagagcagaggcatcactgttattgaattccagccactgaccatatcagcagccagggcct

SEQ ID NO: 449553 - DNA, 140 bp, Artificial Sequence
  Synthetic
atacgccatgctgggtctccagtcaaagcttgcacagagaagggtgttccatggcgttgccaagaaccctgtggttgatgggaatccaacagttgacattgaggaagctcctgaaatgcccgtacttgggagtcggccat

SEQ ID NO: 449554 - DNA, 140 bp, Artificial Sequence
  Synthetic
atggccgactcccaagtacgggcatttcaggagcttcctcaatgtcaactgttggattcccatcaaccacagggttcttggcaacgccatggaacacccttctctgtgcaagctttgactggagacccagcatggcgtat

SEQ ID NO: 449555 - DNA, 140 bp, Artificial Sequence
  Synthetic
atacgccatgctgggtctcctgccctttatgagaagaaactggctctatatctccttcttgctctcagcctagcttctgttgccatgtgcagaacgcccttttcattggctgaaggcattcgtacttgggagtcggccat

SEQ ID NO: 449556 - DNA, 140 bp, Artificial Sequence
  Synthetic
atggccgactcccaagtacgaatgccttcagccaatgaaaagggcgttctgcacatggcaacagaagctaggctgagagcaagaaggagatatagagccagtttcttctcataaagggcaggagacccagcatggcgtat

SEQ ID NO: 449557 - DNA, 140 bp, Artificial Sequence
  Synthetic
atacgccatgctgggtctccgtcctagcatcagctgccctagggccgctcatagagggaaacaccagccttctttggaatggacccatggctgtctccatgacaggagtcatgagggggacgtacttgggagtcggccat

SEQ ID NO: 449558 - DNA, 140 bp, Artificial Sequence
  Synthetic
atggccgactcccaagtacgtccccctcatgactcctgtcatggagacagccatgggtccattccaaagaaggctggtgtttccctctatgagcggccctagggcagctgatgctaggacggagacccagcatggcgtat

SEQ ID NO: 449559 - DNA, 140 bp, Artificial Sequence
  Synthetic
aggccctggctgctgatatgagtggggtcaaaggatttactcttggaagagacggccatgagaaacccatgaatgtgcaaagtctgggatggaacatcatcaccttcaaggacaaaactggaccttttgggacagcggtg

SEQ ID NO: 449560 - DNA, 140 bp, Artificial Sequence
  Synthetic
caccgctgtcccaaaaggtccagttttgtccttgaaggtgatgatgttccatcccagactttgcacattcatgggtttctcatggccgtctcttccaagagtaaatcctttgaccccactcatatcagcagccagggcct

SEQ ID NO: 449561 - DNA, 140 bp, Artificial Sequence
  Synthetic
aggccctggctgctgatatgttccactcatgaaatgtactacgtgtctggagcccgcagcaatgtcacatttactgtgaaccaaacatcccgcctcctgatgaggagaatgaggcgtccagaccttttgggacagcggtg

SEQ ID NO: 449562 - DNA, 140 bp, Artificial Sequence
  Synthetic
caccgctgtcccaaaaggtctggacgcctcattctcctcatcaggaggcgggatgtttggttcacagtaaatgtgacattgctgcgggctccagacacgtagtacatttcatgagtggaacatatcagcagccagggcct

SEQ ID NO: 449563 - DNA, 140 bp, Artificial Sequence
  Synthetic
aggccctggctgctgatatgagttctgggaactggtggatgaagaaaggaagctgcaccaacaaggcaggtgtcggacttgtgtgtacaacatgatggggaaaagagagaagaagctgtcgaccttttgggacagcggtg

SEQ ID NO: 449564 - DNA, 140 bp, Artificial Sequence
  Synthetic
caccgctgtcccaaaaggtcgacagcttcttctctcttttccccatcatgttgtacacacaagtccgacacctgccttgttggtgcagcttcctttcttcatccaccagttcccagaactcatatcagcagccagggcct

SEQ ID NO: 449565 - DNA, 140 bp, Artificial Sequence
  Synthetic
aggccctggctgctgatatgtctacgcggatgacaccgctggatgggacacgcgcatcacagaggcagaccttgatgatgaacaggagatcttgaactacatgagcccacatcacaaaaagaccttttgggacagcggtg

SEQ ID NO: 449566 - DNA, 140 bp, Artificial Sequence
  Synthetic
caccgctgtcccaaaaggtctttttgtgatgtgggctcatgtagttcaagatctcctgttcatcatcaaggtctgcctctgtgatgcgcgtgtcccatccagcggtgtcatccgcgtagacatatcagcagccagggcct

SEQ ID NO: 449567 - DNA, 140 bp, Artificial Sequence
  Synthetic
aggccctggctgctgatatgtggctgtttcctcagctgttcccacctcatgggttccacaaggacgcacaacatggtcgattcatgggaaaggggagtggatgaccacggaagacatgctgaccttttgggacagcggtg

SEQ ID NO: 449568 - DNA, 140 bp, Artificial Sequence
  Synthetic
caccgctgtcccaaaaggtcagcatgtcttccgtggtcatccactcccctttcccatgaatcgaccatgttgtgcgtccttgtggaacccatgaggtgggaacagctgaggaaacagccacatatcagcagccagggcct

SEQ ID NO: 449569 - DNA, 140 bp, Artificial Sequence
  Synthetic
atacgccatgctgggtctcctgaggtgtggaacagagtatggataaccaacaacccacacatgcaggacaagacaatggtgaaaaaatggagagatgtcccttatctaaccaagagacaacgtacttgggagtcggccat

SEQ ID NO: 449570 - DNA, 140 bp, Artificial Sequence
  Synthetic
atggccgactcccaagtacgttgtctcttggttagataagggacatctctccattttttcaccattgtcttgtcctgcatgtgtgggttgttggttatccatactctgttccacacctcaggagacccagcatggcgtat

SEQ ID NO: 449571 - DNA, 140 bp, Artificial Sequence
  Synthetic
atacgccatgctgggtctccgacaagctgtgcggatcactgattggaatgaccaatagggccacctgggcctcccacatccatttggtcatccatcgtatccgaacgctgattggacaggcgtacttgggagtcggccat

SEQ ID NO: 449572 - DNA, 140 bp, Artificial Sequence
  Synthetic
atggccgactcccaagtacgcctgtccaatcagcgttcggatacgatggatgaccaaatggatgtgggaggcccaggtggccctattggtcattccaatcagtgatccgcacagcttgtcggagacccagcatggcgtat

SEQ ID NO: 449573 - DNA, 140 bp, Artificial Sequence
  Synthetic
atacgccatgctgggtctccagaaatacactgactacctaacagtcatggacaggtattctgtggatgctgacctgcaactgggtgagcttatctgaaacaccatctaacaggaataacccgtacttgggagtcggccat

SEQ ID NO: 449574 - DNA, 140 bp, Artificial Sequence
  Synthetic
atggccgactcccaagtacgggttattcctgttagatggtgtttcagataagctcacccagttgcaggtcagcatccacagaatacctgtccatgactgttaggtagtcagtgtatttctggagacccagcatggcgtat

SEQ ID NO: 449575 - DNA, 140 bp, Artificial Sequence
  Synthetic
atacgccatgctgggtctccgggatacaaaccacgggtggagaaccggactccccacaacctgaaaccgggatataaaccacggctggagaaccggactccgcacttaaaatgaaacagacgtacttgggagtcggccat

SEQ ID NO: 449576 - DNA, 140 bp, Artificial Sequence
  Synthetic
atggccgactcccaagtacgtctgtttcattttaagtgcggagtccggttctccagccgtggtttatatcccggtttcaggttgtggggagtccggttctccacccgtggtttgtatcccggagacccagcatggcgtat

SEQ ID NO: 449577 - DNA, 140 bp, Artificial Sequence
  Synthetic
atacgccatgctgggtctccaaccgggataaaaactacggatggagaaccggactccacacattgagacagaagaagttgtcagcccagaaccccacacgagttttgccactgctaagctcgtacttgggagtcggccat

SEQ ID NO: 449578 - DNA, 140 bp, Artificial Sequence
  Synthetic
atggccgactcccaagtacgagcttagcagtggcaaaactcgtgtggggttctgggctgacaacttcttctgtctcaatgtgtggagtccggttctccatccgtagtttttatcccggttggagacccagcatggcgtat

SEQ ID NO: 449579 - DNA, 140 bp, Artificial Sequence
  Synthetic
atacgccatgctgggtctccgtgaggcagtgcaggctgggacagccgacctccaggttgcgaaaaacctggtttctgggacctcccaccccagagtaaaaagaacggagcctccgctacccgtacttgggagtcggccat

SEQ ID NO: 449580 - DNA, 140 bp, Artificial Sequence
  Synthetic
atggccgactcccaagtacgggtagcggaggctccgttctttttactctggggtgggaggtcccagaaaccaggtttttcgcaacctggaggtcggctgtcccagcctgcactgcctcacggagacccagcatggcgtat

SEQ ID NO: 449581 - DNA, 140 bp, Artificial Sequence
  Synthetic
aggccctggctgctgatatgaaatagtgggaccatattgacgccagggaaagaccggagtggttctctgcttttcctccagaggtctgtgagcacagtttgctcaagaataagcagacctgaccttttgggacagcggtg

SEQ ID NO: 449582 - DNA, 140 bp, Artificial Sequence
  Synthetic
caccgctgtcccaaaaggtcaggtctgcttattcttgagcaaactgtgctcacagacctctggaggaaaagcagagaaccactccggtctttccctggcgtcaatatggtcccactatttcatatcagcagccagggcct

SEQ ID NO: 449583 - DNA, 140 bp, Artificial Sequence
  Synthetic
aggccctggctgctgatatgtaggcaataaacacatttggattaattttaatcgttcgttgagcgattagcagagaactgaccagaacatgtctggtcgtaaagctcagggaaaaaccctgaccttttgggacagcggtg

SEQ ID NO: 449584 - DNA, 140 bp, Artificial Sequence
  Synthetic
caccgctgtcccaaaaggtcagggtttttccctgagctttacgaccagacatgttctggtcagttctctgctaatcgctcaacgaacgattaaaattaatccaaatgtgtttattgcctacatatcagcagccagggcct

SEQ ID NO: 449585 - DNA, 140 bp, Artificial Sequence
  Synthetic
atacgccatgctgggtctccgggcgtcaatatggtacgacgaggagttcgctccttgtcaaacaaaataaaacaaaaaacaaaacaaattggaaacagacctggaccttcaagaggtgttcgtacttgggagtcggccat

SEQ ID NO: 449586 - DNA, 140 bp, Artificial Sequence
  Synthetic
atggccgactcccaagtacgaacacctcttgaaggtccaggtctgtttccaatttgttttgttttttgttttattttgtttgacaaggagcgaactcctcgtcgtaccatattgacgcccggagacccagcatggcgtat

SEQ ID NO: 449587 - DNA, 140 bp, Artificial Sequence
  Synthetic
aggccctggctgctgatatgaagtttgatgccctgtcaggctcccaggaagtcgagttcattgggtatggaaaagctacactggaatgccaggtgcaaactgcggtggactttggtaacagaccttttgggacagcggtg

SEQ ID NO: 449588 - DNA, 140 bp, Artificial Sequence
  Synthetic
caccgctgtcccaaaaggtctgttaccaaagtccaccgcagtttgcacctggcattccagtgtagcttttccatacccaatgaactcgacttcctgggagcctgacagggcatcaaacttcatatcagcagccagggcct

SEQ ID NO: 449589 - DNA, 140 bp, Artificial Sequence
  Synthetic
atacgccatgctgggtctccaggggctatttggcggcttgaactggataacaaaggtcatcatgggggcggtactcatatgggttggcatcaacacaagaaacatgacaatgtccatgagcgtacttgggagtcggccat

SEQ ID NO: 449590 - DNA, 140 bp, Artificial Sequence
  Synthetic
atggccgactcccaagtacgctcatggacattgtcatgtttcttgtgttgatgccaacccatatgagtaccgcccccatgatgacctttgttatccagttcaagccgccaaatagcccctggagacccagcatggcgtat

SEQ ID NO: 449591 - DNA, 140 bp, Artificial Sequence
  Synthetic
atacgccatgctgggtctcccatgatcttggtaggagtgatcatgatgtttttgtctctaggagttggggcggatcaaggatgcgccatcaactttggcaagagagagctcaagtgcggacgtacttgggagtcggccat

SEQ ID NO: 449592 - DNA, 140 bp, Artificial Sequence
  Synthetic
atggccgactcccaagtacgtccgcacttgagctctctcttgccaaagttgatggcgcatccttgatccgccccaactcctagagacaaaaacatcatgatcactcctaccaagatcatgggagacccagcatggcgtat

SEQ ID NO: 449593 - DNA, 140 bp, Artificial Sequence
  Synthetic
aggccctggctgctgatatgccttggatgcaggtaccactagaagtgaagagagaagcttgcccagggactagcgtgatcattgatggcaactgtgatggacggggaaaatcaaccagatgaccttttgggacagcggtg

SEQ ID NO: 449594 - DNA, 140 bp, Artificial Sequence
  Synthetic
caccgctgtcccaaaaggtcatctggttgattttccccgtccatcacagttgccatcaatgatcacgctagtccctgggcaagcttctctcttcacttctagtggtacctgcatccaaggcatatcagcagccagggcct

SEQ ID NO: 449595 - DNA, 140 bp, Artificial Sequence
  Synthetic
aggccctggctgctgatatgttacagctggagaaatacatgctgtcccttttggtttggtgagcatgatgatagcaatggaagtggtcctaaggaaaagacagggaccaaagcaaatgctgaccttttgggacagcggtg

SEQ ID NO: 449596 - DNA, 140 bp, Artificial Sequence
  Synthetic
caccgctgtcccaaaaggtcagcatttgctttggtccctgtcttttccttaggaccacttccattgctatcatcatgctcaccaaaccaaaagggacagcatgtatttctccagctgtaacatatcagcagccagggcct

SEQ ID NO: 449597 - DNA, 140 bp, Artificial Sequence
  Synthetic
atacgccatgctgggtctccatgaacaatggaggagacgccatgtatatggcgttgattgctgccttttcaatcagaccagggctgctcatcggctttgggctcaggaccctatggagcccgtacttgggagtcggccat

SEQ ID NO: 449598 - DNA, 140 bp, Artificial Sequence
  Synthetic
atggccgactcccaagtacgggctccatagggtcctgagcccaaagccgatgagcagccctggtctgattgaaaaggcagcaatcaacgccatatacatggcgtctcctccattgttcatggagacccagcatggcgtat

SEQ ID NO: 449599 - DNA, 140 bp, Artificial Sequence
  Synthetic
atacgccatgctgggtctccctcgggaacgccttgtgctgaccctaggagcagccatggtggagattgccttgggtggcgtgatgggcggcctgtggaagtatctaaatgcagtttctctcgtacttgggagtcggccat

SEQ ID NO: 449600 - DNA, 140 bp, Artificial Sequence
  Synthetic
atggccgactcccaagtacgagagaaactgcatttagatacttccacaggccgcccatcacgccacccaaggcaatctccaccatggctgctcctagggtcagcacaaggcgttcccgagggagacccagcatggcgtat

SEQ ID NO: 449601 - DNA, 140 bp, Artificial Sequence
  Synthetic
aggccctggctgctgatatgtcttgcccctcatggctctgttgacacctgtcactatggctgaggtgagacttgccgcaatgctcttttgtgccgtggttatcataggggtccttcaccagaccttttgggacagcggtg

SEQ ID NO: 449602 - DNA, 140 bp, Artificial Sequence
  Synthetic
caccgctgtcccaaaaggtctggtgaaggacccctatgataaccacggcacaaaagagcattgcggcaagtctcacctcagccatagtgacaggtgtcaacagagccatgaggggcaagacatatcagcagccagggcct

SEQ ID NO: 449603 - DNA, 140 bp, Artificial Sequence
  Synthetic
atacgccatgctgggtctcccctaagatcattgaggaatgtgaacatctggaggatgggatttatggcatattccagtcaaccttcttgggggcctcccagcgaggagtgggagtggcaccgtacttgggagtcggccat

SEQ ID NO: 449604 - DNA, 140 bp, Artificial Sequence
  Synthetic
atggccgactcccaagtacggtgccactcccactcctcgctgggaggcccccaagaaggttgactggaatatgccataaatcccatcctccagatgttcacattcctcaatgatcttaggggagacccagcatggcgtat

SEQ ID NO: 449605 - DNA, 140 bp, Artificial Sequence
  Synthetic
atacgccatgctgggtctccacgtgaaattccacacacaggctttttccgctcacggcagcgggagagaagtcattgatgccatgtgccatgccaccctaacttacaggatgttggaacccgtacttgggagtcggccat

SEQ ID NO: 449606 - DNA, 140 bp, Artificial Sequence
  Synthetic
atggccgactcccaagtacgggttccaacatcctgtaagttagggtggcatggcacatggcatcaatgacttctctcccgctgccgtgagcggaaaaagcctgtgtgtggaatttcacgtggagacccagcatggcgtat

SEQ ID NO: 449607 - DNA, 140 bp, Artificial Sequence
  Synthetic
aggccctggctgctgatatggcaaatgaaagtgcaacaatcttgatgacagccacaccgcctgggactagtgatgaatttccacattcaaatggtgaaatagaagatgttcaaacggacagaccttttgggacagcggtg

SEQ ID NO: 449608 - DNA, 140 bp, Artificial Sequence
  Synthetic
caccgctgtcccaaaaggtctgtccgtttgaacatcttctatttcaccatttgaatgtggaaattcatcactagtcccaggcggtgtggctgtcatcaagattgttgcactttcatttgccatatcagcagccagggcct

SEQ ID NO: 449609 - DNA, 140 bp, Artificial Sequence
  Synthetic
atacgccatgctgggtctccaggcccacggcatggttccttccatccatcagagctgcaaatgtcatggctgcctctttgcgtaaggctggaaagagtgtggtggtcctgaacaggaaaacgtacttgggagtcggccat

SEQ ID NO: 449610 - DNA, 140 bp, Artificial Sequence
  Synthetic
atggccgactcccaagtacgttttcctgttcaggaccaccacactctttccagccttacgcaaagaggcagccatgacatttgcagctctgatggatggaaggaaccatgccgtgggcctggagacccagcatggcgtat

SEQ ID NO: 449611 - DNA, 140 bp, Artificial Sequence
  Synthetic
atacgccatgctgggtctccccactctatggcgttgaaggaactaaaacaccagtttcccctggtgaaatgagactgagggatgaccagaggaaagtcttcagagaactagtgaggaattcgtacttgggagtcggccat

SEQ ID NO: 449612 - DNA, 140 bp, Artificial Sequence
  Synthetic
atggccgactcccaagtacgaattcctcactagttctctgaagactttcctctggtcatccctcagtctcatttcaccaggggaaactggtgttttagttccttcaacgccatagagtggggagacccagcatggcgtat

SEQ ID NO: 449613 - DNA, 140 bp, Artificial Sequence
  Synthetic
aggccctggctgctgatatggctggagaaaaccaaagaggacctctttgggaagaagaacttaattccatctagtgcttcaccctggagttggccggatcttgacctgaagccaggagctgaccttttgggacagcggtg

SEQ ID NO: 449614 - DNA, 140 bp, Artificial Sequence
  Synthetic
caccgctgtcccaaaaggtcagctcctggcttcaggtcaagatccggccaactccagggtgaagcactagatggaattaagttcttcttcccaaagaggtcctctttggttttctccagccatatcagcagccagggcct

SEQ ID NO: 449615 - DNA, 140 bp, Artificial Sequence
  Synthetic
atacgccatgctgggtctccatgtacaatctatggaagatgaaaactggacgccgggggagcgcgaatggaaaaactttgggtgaagtctggaagagggaactgaatctgttggacaagccgtacttgggagtcggccat

SEQ ID NO: 449616 - DNA, 140 bp, Artificial Sequence
  Synthetic
atggccgactcccaagtacggcttgtccaacagattcagttccctcttccagacttcacccaaagtttttccattcgcgctcccccggcgtccagttttcatcttccatagattgtacatggagacccagcatggcgtat

SEQ ID NO: 449617 - DNA, 140 bp, Artificial Sequence
  Synthetic
aggccctggctgctgatatgacggcacgcaggcatttggccgaagggaaggtggacaccggggtggcggtctccagggggaccgcaaagttaaggtggttccatgagcgtggctatgtcagaccttttgggacagcggtg

SEQ ID NO: 449618 - DNA, 140 bp, Artificial Sequence
  Synthetic
caccgctgtcccaaaaggtctgacatagccacgctcatggaaccaccttaactttgcggtccccctggagaccgccaccccggtgtccaccttcccttcggccaaatgcctgcgtgccgtcatatcagcagccagggcct

SEQ ID NO: 449619 - DNA, 140 bp, Artificial Sequence
  Synthetic
aggccctggctgctgatatgctgccaatgaggctgtccaagacccaaagttctgggaactggtggatgaagaaaggaagctgcaccaacaaggcaggtgtcggacttgtgtgtacaacatgaccttttgggacagcggtg

SEQ ID NO: 449620 - DNA, 140 bp, Artificial Sequence
  Synthetic
caccgctgtcccaaaaggtcatgttgtacacacaagtccgacacctgccttgttggtgcagcttcctttcttcatccaccagttcccagaactttgggtcttggacagcctcattggcagcatatcagcagccagggcct

SEQ ID NO: 449621 - DNA, 140 bp, Artificial Sequence
  Synthetic
atacgccatgctgggtctccaggaggagtggaaggcattggcttacaatacctaggatatgtgatcagagacctggctgcaatggatggtggtggattctacgcggatgacaccgctggacgtacttgggagtcggccat

SEQ ID NO: 449622 - DNA, 140 bp, Artificial Sequence
  Synthetic
atggccgactcccaagtacgtccagcggtgtcatccgcgtagaatccaccaccatccattgcagccaggtctctgatcacatatcctaggtattgtaagccaatgccttccactcctcctggagacccagcatggcgtat

SEQ ID NO: 449623 - DNA, 140 bp, Artificial Sequence
  Synthetic
atacgccatgctgggtctccgacggggtctagaggttagaggagaccctccagggaacaaatagtgggaccatattgacgccagggaaagaccggagtggttctctgcttttcctccagacgtacttgggagtcggccat

SEQ ID NO: 449624 - DNA, 140 bp, Artificial Sequence
  Synthetic
atggccgactcccaagtacgtctggaggaaaagcagagaaccactccggtctttccctggcgtcaatatggtcccactatttgttccctggagggtctcctctaacctctagaccccgtcggagacccagcatggcgtat

SEQ ID NO: 449625 - DNA, 140 bp, Artificial Sequence
  Synthetic
aggccctggctgctgatatgcatattgacgccagggaaagaccggagtggttctctgcttttcctccagaggtctgtgagcacagtttgctcaagaataagcagacctttggatgaaaaagaccttttgggacagcggtg

SEQ ID NO: 449626 - DNA, 140 bp, Artificial Sequence
  Synthetic
caccgctgtcccaaaaggtctttttcatccaaaggtctgcttattcttgagcaaactgtgctcacagacctctggaggaaaagcagagaaccactccggtctttccctggcgtcaatatgcatatcagcagccagggcct

SEQ ID NO: 449627 - DNA, 140 bp, Artificial Sequence
  Synthetic
aggccctggctgctgatatgaggaagaggtccagttgatcgctgctgttccaggaaagaacgtggtcaacgtccagacaaaaccgagcttgttcaaagtgaggaatgggggggaaatcgggaccttttgggacagcggtg

SEQ ID NO: 449628 - DNA, 140 bp, Artificial Sequence
  Synthetic
caccgctgtcccaaaaggtcccgatttcccccccattcctcactttgaacaagctcggttttgtctggacgttgaccacgttctttcctggaacagcagcgatcaactggacctcttcctcatatcagcagccagggcct

SEQ ID NO: 449629 - DNA, 140 bp, Artificial Sequence
  Synthetic
aggccctggctgctgatatgtaggcaataaacacatttggattaattttaatcgttctttgagcgattagcagagaactgaccagaaaaatgtctggtcgaaaagctcagggtaaaacccgaccttttgggacagcggtg

SEQ ID NO: 449630 - DNA, 140 bp, Artificial Sequence
  Synthetic
caccgctgtcccaaaaggtcgggttttaccctgagcttttcgaccagacatttttctggtcagttctctgctaatcgctcaaagaacgattaaaattaatccaaatgtgtttattgcctacatatcagcagccagggcct

SEQ ID NO: 449631 - DNA, 140 bp, Artificial Sequence
  Synthetic
aggccctggctgctgatatgaaacaaaaaacaaaacagattggaaacagacctggcccttcaagaggtgttcaaggatttattttcttctttttgttcaacattctaactgggaaaaaatgaccttttgggacagcggtg

SEQ ID NO: 449632 - DNA, 140 bp, Artificial Sequence
  Synthetic
caccgctgtcccaaaaggtcattttttcccagttagaatgttgaacaaaaagaagaaaataaatccttgaacacctcttgaagggccaggtctgtttccaatctgttttgttttttgtttcatatcagcagccagggcct

SEQ ID NO: 449633 - DNA, 140 bp, Artificial Sequence
  Synthetic
atacgccatgctgggtctcctaaccacccacctgaaaaggctctggagaatgcttgacccccgacagggacttgctgttctgaggaaagtcaagagggtggtagccagcttgatgataggcgtacttgggagtcggccat

SEQ ID NO: 449634 - DNA, 140 bp, Artificial Sequence
  Synthetic
atggccgactcccaagtacgcctatcatcaagctggctaccaccctcttgactttcctcagaacagcaagtccctgtcgggggtcaagcattctccagagccttttcaggtgggtggttaggagacccagcatggcgtat

SEQ ID NO: 449635 - DNA, 140 bp, Artificial Sequence
  Synthetic
atacgccatgctgggtctccgctgtcatctaggaaacgccgctctaatgagatggccatgatgccacttctaatcttgagcatggtgattttggctggaggggtgacactcgtccggaaacgtacttgggagtcggccat

SEQ ID NO: 449636 - DNA, 140 bp, Artificial Sequence
  Synthetic
atggccgactcccaagtacgtttccggacgagtgtcacccctccagccaaaatcaccatgctcaagattagaagtggcatcatggccatctcattagagcggcgtttcctagatgacagcggagacccagcatggcgtat

SEQ ID NO: 449637 - DNA, 140 bp, Artificial Sequence
  Synthetic
atacgccatgctgggtctccaatcgatggttgcttttgaatgtcacagctgaggacttgggaaagacgttctcattgggaaccgggaactgcaccaccaacatccttgaggcaaagtattcgtacttgggagtcggccat

SEQ ID NO: 449638 - DNA, 140 bp, Artificial Sequence
  Synthetic
atggccgactcccaagtacgaatactttgcctcaaggatgttggtggtgcagttcccggttcccaatgagaacgtctttcccaagtcctcagctgtgacattcaaaagcaaccatcgattggagacccagcatggcgtat

SEQ ID NO: 449639 - DNA, 140 bp, Artificial Sequence
  Synthetic
atacgccatgctgggtctccggtgtcccgactcaatggaatacaactgtcccaatctcagtcccagagaggagcctgacgacattgactgttggtgttatggagtggaaaatgtcagagtcgtacttgggagtcggccat

SEQ ID NO: 449640 - DNA, 140 bp, Artificial Sequence
  Synthetic
atggccgactcccaagtacgactctgacattttccactccataacaccaacagtcaatgtcgtcaggctcctctctgggactgagattgggacagttgtattccattgagtcgggacaccggagacccagcatggcgtat

SEQ ID NO: 449641 - DNA, 140 bp, Artificial Sequence
  Synthetic
atacgccatgctgggtctccggcctatggaaggtgtgatgcagtggggaggtcaaagcggtctaggagggcaattgatctgcccacgcatgaaaatcacggactgaaaactcggcaggagcgtacttgggagtcggccat

SEQ ID NO: 449642 - DNA, 140 bp, Artificial Sequence
  Synthetic
atggccgactcccaagtacgctcctgccgagttttcagtccgtgattttcatgcgtgggcagatcaattgccctcctagaccgctttgacctccccactgcatcacaccttccataggccggagacccagcatggcgtat

SEQ ID NO: 449643 - DNA, 140 bp, Artificial Sequence
  Synthetic
atacgccatgctgggtctccaaatggatggcaggcagaatgggtgagcggcaactccaaaagattgagcggtggctggtgagaaatccgtttttcgccataacagccttggccattgcttcgtacttgggagtcggccat

SEQ ID NO: 449644 - DNA, 140 bp, Artificial Sequence
  Synthetic
atggccgactcccaagtacgaagcaatggccaaggctgttatggcgaaaaacggatttctcaccagccaccgctcaatcttttggagttgccgctcacccattctgcctgccatccatttggagacccagcatggcgtat

SEQ ID NO: 449645 - DNA, 140 bp, Artificial Sequence
  Synthetic
atacgccatgctgggtctccatttagtgggtaataacatgacacaacgtgtcgtcatagctctgctagtcttagcagttggtccagcctattctgcacattgtattgggataactgacagcgtacttgggagtcggccat

SEQ ID NO: 449646 - DNA, 140 bp, Artificial Sequence
  Synthetic
atggccgactcccaagtacgctgtcagttatcccaatacaatgtgcagaataggctggaccaactgctaagactagcagagctatgacgacacgttgtgtcatgttattacccactaaatggagacccagcatggcgtat

SEQ ID NO: 449647 - DNA, 140 bp, Artificial Sequence
  Synthetic
atacgccatgctgggtctccagacttcattgagggtgtccatgggggcacgtgggtgtcagcaaccctagagcagggcaagtgcgtaactgtcatggctcctgataaaccatcattggatcgtacttgggagtcggccat

SEQ ID NO: 449648 - DNA, 140 bp, Artificial Sequence
  Synthetic
atggccgactcccaagtacgatccaatgatggtttatcaggagccatgacagttacgcacttgccctgctctagggttgctgacacccacgtgcccccatggacaccctcaatgaagtctggagacccagcatggcgtat

SEQ ID NO: 449649 - DNA, 140 bp, Artificial Sequence
  Synthetic
atacgccatgctgggtctccatctcgctccaaacagtggcaatagatgggcctgctgaagcgagaaaggtttgctacagcgcggttctcacccatgtaaaaatcaatgacaagtgcccaacgtacttgggagtcggccat

SEQ ID NO: 449650 - DNA, 140 bp, Artificial Sequence
  Synthetic
atggccgactcccaagtacgttgggcacttgtcattgatttttacatgggtgagaaccgcgctgtagcaaacctttctcgcttcagcaggcccatctattgccactgtttggagcgagatggagacccagcatggcgtat

SEQ ID NO: 449651 - DNA, 140 bp, Artificial Sequence
  Synthetic
atacgccatgctgggtctccgcactggtgaggctcacctcgcagaggaaaatgatggtgacaatgcttgcaaacgaacatactcagatagaggctggggtaatggttgtgggctctttggcgtacttgggagtcggccat

SEQ ID NO: 449652 - DNA, 140 bp, Artificial Sequence
  Synthetic
atggccgactcccaagtacgccaaagagcccacaaccattaccccagcctctatctgagtatgttcgtttgcaagcattgtcaccatcattttcctctgcgaggtgagcctcaccagtgcggagacccagcatggcgtat

SEQ ID NO: 449653 - DNA, 140 bp, Artificial Sequence
  Synthetic
atacgccatgctgggtctccaaaggggagtattgtggcatgtgccaaatttacgtgtgccaaatccatgagcctttttgaagtggaccagaccaaaatccagtacgttatcagggctcagcgtacttgggagtcggccat

SEQ ID NO: 449654 - DNA, 140 bp, Artificial Sequence
  Synthetic
atggccgactcccaagtacgctgagccctgataacgtactggattttggtctggtccacttcaaaaaggctcatggatttggcacacgtaaatttggcacatgccacaatactcccctttggagacccagcatggcgtat

SEQ ID NO: 449655 - DNA, 140 bp, Artificial Sequence
  Synthetic
atacgccatgctgggtctcccttcatgtgggtgctaagcaggagaactggaacacagatataaagacactgaaatttgatgccctatctggctctcaagaagccgaatttactggttatgcgtacttgggagtcggccat

SEQ ID NO: 449656 - DNA, 140 bp, Artificial Sequence
  Synthetic
atggccgactcccaagtacgcataaccagtaaattcggcttcttgagagccagatagggcatcaaatttcagtgtctttatatctgtgttccagttctcctgcttagcacccacatgaagggagacccagcatggcgtat

SEQ ID NO: 449657 - DNA, 140 bp, Artificial Sequence
  Synthetic
aggccctggctgctgatatggaaatttgatgccctatctggctctcaagaagccgaatttactggttatgggaaagcaacactggagtgtcaggtccagactgcagttgactttgggaacgaccttttgggacagcggtg

SEQ ID NO: 449658 - DNA, 140 bp, Artificial Sequence
  Synthetic
caccgctgtcccaaaaggtcgttcccaaagtcaactgcagtctggacctgacactccagtgttgctttcccataaccagtaaattcggcttcttgagagccagatagggcatcaaatttccatatcagcagccagggcct

SEQ ID NO: 449659 - DNA, 140 bp, Artificial Sequence
  Synthetic
atacgccatgctgggtctccagttacattgcagagatggagaaagacagctggattgttgaccgccagtgggcacaagacttgacactaccatggcagagcgggagtggtggaatatggacgtacttgggagtcggccat

SEQ ID NO: 449660 - DNA, 140 bp, Artificial Sequence
  Synthetic
atggccgactcccaagtacgtccatattccaccactcccgctctgccatggtagtgtcaagtcttgtgcccactggcggtcaacaatccagctgtctttctccatctctgcaatgtaactggagacccagcatggcgtat

SEQ ID NO: 449661 - DNA, 140 bp, Artificial Sequence
  Synthetic
aggccctggctgctgatatgggcacaagacttgacactaccatggcagagcgggagtggtggaatatggagggaaatgcatcatcttgttgagtttgagcctcctcatgccgccacaatcgaccttttgggacagcggtg

SEQ ID NO: 449662 - DNA, 140 bp, Artificial Sequence
  Synthetic
caccgctgtcccaaaaggtcgattgtggcggcatgaggaggctcaaactcaacaagatgatgcatttccctccatattccaccactcccgctctgccatggtagtgtcaagtcttgtgcccatatcagcagccagggcct

SEQ ID NO: 449663 - DNA, 140 bp, Artificial Sequence
  Synthetic
atacgccatgctgggtctccagagtgctagccttgggaaaccaagaggggtctctgaaaacagctctcacaggagctatgcgggtcactaaagatgaaaatgacaacaacttgtacaagccgtacttgggagtcggccat

SEQ ID NO: 449664 - DNA, 140 bp, Artificial Sequence
  Synthetic
atggccgactcccaagtacggcttgtacaagttgttgtcattttcatctttagtgacccgcatagctcctgtgagagctgttttcagagacccctcttggtttcccaaggctagcactctggagacccagcatggcgtat

SEQ ID NO: 449665 - DNA, 140 bp, Artificial Sequence
  Synthetic
atacgccatgctgggtctcctgcatggtggtcatgtctcttgtagggtgaaactttcagctctaactcttaagggaacatcctacaagatgtgcacagataaaatgtcatttgtgaaaaacgtacttgggagtcggccat

SEQ ID NO: 449666 - DNA, 140 bp, Artificial Sequence
  Synthetic
atggccgactcccaagtacgtttttcacaaatgacattttatctgtgcacatcttgtaggatgttcccttaagagttagagctgaaagtttcaccctacaagagacatgaccaccatgcaggagacccagcatggcgtat

SEQ ID NO: 449667 - DNA, 140 bp, Artificial Sequence
  Synthetic
atacgccatgctgggtctcccccaacggacacaggtcatggcacggttgtcatgcaggtgaaggtccccaaaggagccccatgcaagattcccgtgattgtggctgatgacctaacggctcgtacttgggagtcggccat

SEQ ID NO: 449668 - DNA, 140 bp, Artificial Sequence
  Synthetic
atggccgactcccaagtacgagccgttaggtcatcagccacaatcacgggaatcttgcatggggctcctttggggaccttcacctgcatgacaaccgtgccatgacctgtgtccgttgggggagacccagcatggcgtat

SEQ ID NO: 449669 - DNA, 140 bp, Artificial Sequence
  Synthetic
atacgccatgctgggtctccgcagtgaacaagggcatactggtcactgtcaaccccatagcatccacaaatgatgatgaagtcctaattgaagtcaatcccccttttggagacagctacacgtacttgggagtcggccat

SEQ ID NO: 449670 - DNA, 140 bp, Artificial Sequence
  Synthetic
atggccgactcccaagtacgtgtagctgtctccaaaagggggattgacttcaattaggacttcatcatcatttgtggatgctatggggttgacagtgaccagtatgcccttgttcactgcggagacccagcatggcgtat

SEQ ID NO: 449671 - DNA, 140 bp, Artificial Sequence
  Synthetic
atacgccatgctgggtctcctcattgttgggactggagactcaagactgacttatcagtggcataaggaaggaagttcaattgggaaactgttcacacagacaatgaagggagctgaacgcgtacttgggagtcggccat

SEQ ID NO: 449672 - DNA, 140 bp, Artificial Sequence
  Synthetic
atggccgactcccaagtacgcgttcagctcccttcattgtctgtgtgaacagtttcccaattgaacttccttccttatgccactgataagtcagtcttgagtctccagtcccaacaatgaggagacccagcatggcgtat

SEQ ID NO: 449673 - DNA, 140 bp, Artificial Sequence
  Synthetic
atacgccatgctgggtctcctcttgcagtgatgggtgatgccgcctgggactttagctctgcaggtggtttcttcacgtcagtggggaaaggaattcacactgtgtttggctcagctttccgtacttgggagtcggccat

SEQ ID NO: 449674 - DNA, 140 bp, Artificial Sequence
  Synthetic
atggccgactcccaagtacggaaagctgagccaaacacagtgtgaattcctttccccactgacgtgaagaaaccacctgcagagctaaagtcccaggcggcatcacccatcactgcaagaggagacccagcatggcgtat

SEQ ID NO: 449675 - DNA, 140 bp, Artificial Sequence
  Synthetic
atacgccatgctgggtctcccaggggttgtttggtggtctgagctggattacgaaagtcatcatgggagccgttctcatctgggtaggaattaacacacgtaacatgaccatgtccatgtcgtacttgggagtcggccat

SEQ ID NO: 449676 - DNA, 140 bp, Artificial Sequence
  Synthetic
atggccgactcccaagtacgacatggacatggtcatgttacgtgtgttaattcctacccagatgagaacggctcccatgatgactttcgtaatccagctcagaccaccaaacaacccctgggagacccagcatggcgtat

SEQ ID NO: 449677 - DNA, 140 bp, Artificial Sequence
  Synthetic
atacgccatgctgggtctccctatgattctggtaggtgtgatcatgatgttcctctccctgggtgttggggcagaccaaggatgtgctgtcaactttgggaagcgagagctcaaatgtggcgtacttgggagtcggccat

SEQ ID NO: 449678 - DNA, 140 bp, Artificial Sequence
  Synthetic
atggccgactcccaagtacgccacatttgagctctcgcttcccaaagttgacagcacatccttggtctgccccaacacccagggagaggaacatcatgatcacacctaccagaatcatagggagacccagcatggcgtat

SEQ ID NO: 449679 - DNA, 140 bp, Artificial Sequence
  Synthetic
atacgccatgctgggtctccagatggcatctttgtgttcagagactcagatgattggctcactaagtattcatattatccagaagaccctgttaagctggcttctatcatcaaggcctcccgtacttgggagtcggccat

SEQ ID NO: 449680 - DNA, 140 bp, Artificial Sequence
  Synthetic
atggccgactcccaagtacgggaggccttgatgatagaagccagcttaacagggtcttctggataatatgaatacttagtgagccaatcatctgagtctctgaacacaaagatgccatctggagacccagcatggcgtat

SEQ ID NO: 449681 - DNA, 140 bp, Artificial Sequence
  Synthetic
atacgccatgctgggtctcccatgaagagggcaaatgtggactgaattctgtggactcccttgagcatgaaatgtggaggagtagagctgatgagatcaacgccatatttgaggaaaatgcgtacttgggagtcggccat

SEQ ID NO: 449682 - DNA, 140 bp, Artificial Sequence
  Synthetic
atggccgactcccaagtacgcattttcctcaaatatggcgttgatctcatcagctctactcctccacatttcatgctcaagggagtccacagaattcagtccacatttgccctcttcatgggagacccagcatggcgtat

SEQ ID NO: 449683 - DNA, 140 bp, Artificial Sequence
  Synthetic
atacgccatgctgggtctccaggtagacatctcggttgttgttcaagacccaaagaatatctatcaaagagggacacatcctttctctcggattcgtgatgggttgcagtatggatggaacgtacttgggagtcggccat

SEQ ID NO: 449684 - DNA, 140 bp, Artificial Sequence
  Synthetic
atggccgactcccaagtacgttccatccatactgcaacccatcacgaatccgagagaaaggatgtgtccctctttgatagatattctttgggtcttgaacaacaaccgagatgtctacctggagacccagcatggcgtat

SEQ ID NO: 449685 - DNA, 140 bp, Artificial Sequence
  Synthetic
atacgccatgctgggtctccaacctggggaaaaaatctcatcttctcacccggaaggaaaaatggcagtttcatcattgatgggaagtcaaggaaggaatgccctttctcaaacagagtgcgtacttgggagtcggccat

SEQ ID NO: 449686 - DNA, 140 bp, Artificial Sequence
  Synthetic
atggccgactcccaagtacgcactctgtttgagaaagggcattccttccttgacttcccatcaatgatgaaactgccatttttccttccgggtgagaagatgagattttttccccaggttggagacccagcatggcgtat

SEQ ID NO: 449687 - DNA, 140 bp, Artificial Sequence
  Synthetic
atacgccatgctgggtctcctggaactctttccagattgaggagtttggcatgggagttttcacaacacgggtttttatggatgctgtttttgattactcagtggactgtgatggggctacgtacttgggagtcggccat

SEQ ID NO: 449688 - DNA, 140 bp, Artificial Sequence
  Synthetic
atggccgactcccaagtacgtagccccatcacagtccactgagtaatcaaaaacagcatccataaaaacccgtgttgtgaaaactcccatgccaaactcctcaatctggaaagagttccaggagacccagcatggcgtat

SEQ ID NO: 449689 - DNA, 140 bp, Artificial Sequence
  Synthetic
aggccctggctgctgatatgggtttttatggatgctgtttttgattactcagtggactgtgatggggctatactaggtgcagctgtgaatgggaagaagagcgcacacggatcgcccacagaccttttgggacagcggtg

SEQ ID NO: 449690 - DNA, 140 bp, Artificial Sequence
  Synthetic
caccgctgtcccaaaaggtctgtgggcgatccgtgtgcgctcttcttcccattcacagctgcacctagtatagccccatcacagtccactgagtaatcaaaaacagcatccataaaaacccatatcagcagccagggcct

SEQ ID NO: 449691 - DNA, 140 bp, Artificial Sequence
  Synthetic
atacgccatgctgggtctccttctggatgggaagccatgaggtcaatggaacatggatggtacacacacttgagacccttgattacaaagagtgtgaatggcctttgacacacaccatagcgtacttgggagtcggccat

SEQ ID NO: 449692 - DNA, 140 bp, Artificial Sequence
  Synthetic
atggccgactcccaagtacgctatggtgtgtgtcaaaggccattcacactctttgtaatcaagggtctcaagtgtgtgtaccatccatgttccattgacctcatggcttcccatccagaaggagacccagcatggcgtat

SEQ ID NO: 449693 - DNA, 140 bp, Artificial Sequence
  Synthetic
aggccctggctgctgatatgtgagacccttgattacaaagagtgtgaatggcctttgacacacaccataggaacctcagtggaagagagtgacatgttcatgccccgttccattggaggcgaccttttgggacagcggtg

SEQ ID NO: 449694 - DNA, 140 bp, Artificial Sequence
  Synthetic
caccgctgtcccaaaaggtcgcctccaatggaacggggcatgaacatgtcactctcttccactgaggttcctatggtgtgtgtcaaaggccattcacactctttgtaatcaagggtctcacatatcagcagccagggcct

SEQ ID NO: 449695 - DNA, 140 bp, Artificial Sequence
  Synthetic
atacgccatgctgggtctccccagtgagctcccataaccatattccaggttacaaagtccaaacgaatggaccatggatgcaagtccctctggaagttagaagggagccatgcccggggacgtacttgggagtcggccat

SEQ ID NO: 449696 - DNA, 140 bp, Artificial Sequence
  Synthetic
atggccgactcccaagtacgtccccgggcatggctcccttctaacttccagagggacttgcatccatggtccattcgtttggactttgtaacctggaatatggttatgggagctcactggggagacccagcatggcgtat

SEQ ID NO: 449697 - DNA, 140 bp, Artificial Sequence
  Synthetic
atacgccatgctgggtctcccaagtgtggtgctggacaccggctgtgatggacgtggcaaatcaaccagatcaaccactgacagtgggaaaattattccagaatggtgctgcagatcttgcgtacttgggagtcggccat

SEQ ID NO: 449698 - DNA, 140 bp, Artificial Sequence
  Synthetic
atggccgactcccaagtacgcaagatctgcagcaccattctggaataattttcccactgtcagtggttgatctggttgatttgccacgtccatcacagccggtgtccagcaccacacttgggagacccagcatggcgtat

SEQ ID NO: 449699 - DNA, 140 bp, Artificial Sequence
  Synthetic
atacgccatgctgggtctcccactatgcccccagttagctttcacggcagtgatggctgctggtaccccatggaaatcagacccatgaaaacccatgaaagccatctggtgagatcatggcgtacttgggagtcggccat

SEQ ID NO: 449700 - DNA, 140 bp, Artificial Sequence
  Synthetic
atggccgactcccaagtacgccatgatctcaccagatggctttcatgggttttcatgggtctgatttccatggggtaccagcagccatcactgccgtgaaagctaactgggggcatagtgggagacccagcatggcgtat

SEQ ID NO: 449701 - DNA, 140 bp, Artificial Sequence
  Synthetic
atacgccatgctgggtctccgttaccgcaggagaagtgcatgcggttcctttcggattggtgagcatgatgattgccatggaggttgtcctacgtaaaagacaaggaccaaagcagatgccgtacttgggagtcggccat

SEQ ID NO: 449702 - DNA, 140 bp, Artificial Sequence
  Synthetic
atggccgactcccaagtacggcatctgctttggtccttgtcttttacgtaggacaacctccatggcaatcatcatgctcaccaatccgaaaggaaccgcatgcacttctcctgcggtaacggagacccagcatggcgtat

SEQ ID NO: 449703 - DNA, 140 bp, Artificial Sequence
  Synthetic
atacgccatgctgggtctcctggtgggaggaatcattttacttggagcaatgctagtgggacaagtcacggtgctagatctagtgaaactcattgtggcagtaggcttgcacttccatgacgtacttgggagtcggccat

SEQ ID NO: 449704 - DNA, 140 bp, Artificial Sequence
  Synthetic
atggccgactcccaagtacgtcatggaagtgcaagcctactgccacaatgagtttcactagatctagcaccgtgacttgtcccactagcattgctccaagtaaaatgattcctcccaccaggagacccagcatggcgtat

SEQ ID NO: 449705 - DNA, 140 bp, Artificial Sequence
  Synthetic
atacgccatgctgggtctccgatcaacaatggaggagatgccatgtatatggctttgattgcgagcttttccattcgcccaggcctgctcgtaggctttggactgcgcacactctggagtcgtacttgggagtcggccat

SEQ ID NO: 449706 - DNA, 140 bp, Artificial Sequence
  Synthetic
atggccgactcccaagtacgactccagagtgtgcgcagtccaaagcctacgagcaggcctgggcgaatggaaaagctcgcaatcaaagccatatacatggcatctcctccattgttgatcggagacccagcatggcgtat

SEQ ID NO: 449707 - DNA, 140 bp, Artificial Sequence
  Synthetic
atacgccatgctgggtctcccctcgcgagcgtctcgtgatggcattcggagcagccatggtcgaagtggccttgggcgggatgatgggtggactgtggcagtacttgaacgccgtctcaccgtacttgggagtcggccat

SEQ ID NO: 449708 - DNA, 140 bp, Artificial Sequence
  Synthetic
atggccgactcccaagtacggtgagacggcgttcaagtactgccacagtccacccatcatcccgcccaaggccacttcgaccatggctgctccgaatgccatcacgagacgctcgcgaggggagacccagcatggcgtat

SEQ ID NO: 449709 - DNA, 140 bp, Artificial Sequence
  Synthetic
atacgccatgctgggtctcctatgtgtcctcaccatcaacgcaatttcttcaagaaaggcgtcaaatgcggtcctccccctgatggcactcttgactcctgtaacaatgcatgaagtaagcgtacttgggagtcggccat

SEQ ID NO: 449710 - DNA, 140 bp, Artificial Sequence
  Synthetic
atggccgactcccaagtacgcttacttcatgcattgttacaggagtcaagagtgccatcagggggaggaccgcatttgacgcctttcttgaagaaattgcgttgatggtgaggacacataggagacccagcatggcgtat

SEQ ID NO: 449711 - DNA, 140 bp, Artificial Sequence
  Synthetic
atacgccatgctgggtctccgatggcaacaatgctgttctgcacagtggtcatagtgggggtgctccaccagaatgcaaaagacacgtccatgcaaaaaaccattcccattgtggctctgcgtacttgggagtcggccat

SEQ ID NO: 449712 - DNA, 140 bp, Artificial Sequence
  Synthetic
atggccgactcccaagtacgcagagccacaatgggaatggttttttgcatggacgtgtcttttgcattctggtggagcacccccactatgaccactgtgcagaacagcattgttgccatcggagacccagcatggcgtat

SEQ ID NO: 449713 - DNA, 140 bp, Artificial Sequence
  Synthetic
atacgccatgctgggtctccacactgacttcatatatgggtctaactcagccttttcttggattgtgtgcctacatgtccacacaagtgtttggcagaagaagcatccctgtaaatgaagcgtacttgggagtcggccat

SEQ ID NO: 449714 - DNA, 140 bp, Artificial Sequence
  Synthetic
atggccgactcccaagtacgcttcatttacagggatgcttcttctgccaaacacttgtgtggacatgtaggcacacaatccaagaaaaggctgagttagacccatatatgaagtcagtgtggagacccagcatggcgtat

SEQ ID NO: 449715 - DNA, 140 bp, Artificial Sequence
  Synthetic
atacgccatgctgggtctccctcttgcagcagccggcctggtaggagtgctggcaggcctagccttccaagacatggaaaattttttaggtccgattgcagtgggtgggatactcatgatcgtacttgggagtcggccat

SEQ ID NO: 449716 - DNA, 140 bp, Artificial Sequence
  Synthetic
atggccgactcccaagtacgatcatgagtatcccacccactgcaatcggacctaaaaaattttccatgtcttggaaggctaggcctgccagcactcctaccaggccggctgctgcaagagggagacccagcatggcgtat

SEQ ID NO: 449717 - DNA, 140 bp, Artificial Sequence
  Synthetic
atacgccatgctgggtctccgctggtcagtgtggcagggaaagttgatggattggaactcaagaagctcggtgaagtctcctgggaagaggaagctgagataagtggaagctccagccgccgtacttgggagtcggccat

SEQ ID NO: 449718 - DNA, 140 bp, Artificial Sequence
  Synthetic
atggccgactcccaagtacggcggctggagcttccacttatctcagcttcctcttcccaggagacttcaccgagcttcttgagttccaatccatcaactttccctgccacactgaccagcggagacccagcatggcgtat

SEQ ID NO: 449719 - DNA, 140 bp, Artificial Sequence
  Synthetic
atacgccatgctgggtctcctatgatgtggcactcagtgaacagggagaattcaagcttctctcagaggataaagtgccctgggaccagattgtcatgacttccttggctctcgttggggcgtacttgggagtcggccat

SEQ ID NO: 449720 - DNA, 140 bp, Artificial Sequence
  Synthetic
atggccgactcccaagtacgccccaacgagagccaaggaagtcatgacaatctggtcccagggcactttatcctctgagagaagcttgaattctccctgttcactgagtgccacatcataggagacccagcatggcgtat

SEQ ID NO: 449721 - DNA, 140 bp, Artificial Sequence
  Synthetic
atacgccatgctgggtctcccagcgatacatccatttgccctattactggtcctaggaggttgggttttacacatcaaaggagctagaaggagcggggatgttctttgggacattcccaccgtacttgggagtcggccat

SEQ ID NO: 449722 - DNA, 140 bp, Artificial Sequence
  Synthetic
atggccgactcccaagtacggtgggaatgtcccaaagaacatccccgctccttctagctcctttgatgtgtaaaacccaacctcctaggaccagtaatagggcaaatggatgtatcgctgggagacccagcatggcgtat

SEQ ID NO: 449723 - DNA, 140 bp, Artificial Sequence
  Synthetic
atacgccatgctgggtctccaccaaaagtcatagaggaatgtgagtatctggaagatggaatttatggcatatttcaatcaacttttcttggagcatcccagagaggagtcggagtggcccgtacttgggagtcggccat

SEQ ID NO: 449724 - DNA, 140 bp, Artificial Sequence
  Synthetic
atggccgactcccaagtacgggccactccgactcctctctgggatgctccaagaaaagttgattgaaatatgccataaattccatcttccagatactcacattcctctatgacttttggtggagacccagcatggcgtat

SEQ ID NO: 449725 - DNA, 140 bp, Artificial Sequence
  Synthetic
atacgccatgctgggtctcccaggggggtgtcttccacacgatgtggcacgtcaccagaggagcgtttctcttgaggaacgggaagaagttagtaccatcctgggcctctgtgaaggaggcgtacttgggagtcggccat

SEQ ID NO: 449726 - DNA, 140 bp, Artificial Sequence
  Synthetic
atggccgactcccaagtacgcctccttcacagaggcccaggatggtactaacttcttcccgttcctcaagagaaacgctcctctggtgacgtgccacatcgtgtggaagacacccccctgggagacccagcatggcgtat

SEQ ID NO: 449727 - DNA, 140 bp, Artificial Sequence
  Synthetic
atacgccatgctgggtctccacttagtggcctatggtggatcttggaagctagatggaaagtgggatggtgaggaagaggtacaactcatagctgctgtgccaggaaaagccgttgtcaacgtacttgggagtcggccat

SEQ ID NO: 449728 - DNA, 140 bp, Artificial Sequence
  Synthetic
atggccgactcccaagtacgttgacaacggcttttcctggcacagcagctatgagttgtacctcttcctcaccatcccactttccatctagcttccaagatccaccataggccactaagtggagacccagcatggcgtat

SEQ ID NO: 449729 - DNA, 140 bp, Artificial Sequence
  Synthetic
atacgccatgctgggtctcctgtgcaaaccaagccaagtgtgttcaaagttagaaatggaggtgagattggagcagttgccttggactatcctagcgggacatctggttcacccattgtgcgtacttgggagtcggccat

SEQ ID NO: 449730 - DNA, 140 bp, Artificial Sequence
  Synthetic
atggccgactcccaagtacgcacaatgggtgaaccagatgtcccgctaggatagtccaaggcaactgctccaatctcacctccatttctaactttgaacacacttggcttggtttgcacaggagacccagcatggcgtat

SEQ ID NO: 449731 - DNA, 140 bp, Artificial Sequence
  Synthetic
aggccctggctgctgatatggagcagttgccttggactatcctagcgggacatctggttcacccattgtgaatcgcagtggtgaagtggtgggactttatggcaatgggatcctggttgggaccttttgggacagcggtg

SEQ ID NO: 449732 - DNA, 140 bp, Artificial Sequence
  Synthetic
caccgctgtcccaaaaggtcccaaccaggatcccattgccataaagtcccaccacttcaccactgcgattcacaatgggtgaaccagatgtcccgctaggatagtccaaggcaactgctccatatcagcagccagggcct

SEQ ID NO: 449733 - DNA, 140 bp, Artificial Sequence
  Synthetic
atacgccatgctgggtctcctgacaattcctttgtgtccgccatctcacaaactgaggtgaaagaggaatccaaagaggaactgcaggaaataccaacaatgttgaaaaaaggaatgacacgtacttgggagtcggccat

SEQ ID NO: 449734 - DNA, 140 bp, Artificial Sequence
  Synthetic
atggccgactcccaagtacgtgtcattccttttttcaacattgttggtatttcctgcagttcctctttggattcctctttcacctcagtttgtgagatggcggacacaaaggaattgtcaggagacccagcatggcgtat

SEQ ID NO: 449735 - DNA, 140 bp, Artificial Sequence
  Synthetic
atacgccatgctgggtctccactatccttgatttccaccctggtgcgggaaagacccgtaggttcttgccccaaatactggcagaatgcgccaggaggcgtctacggacgctagtgctggcgtacttgggagtcggccat

SEQ ID NO: 449736 - DNA, 140 bp, Artificial Sequence
  Synthetic
atggccgactcccaagtacgccagcactagcgtccgtagacgcctcctggcgcattctgccagtatttggggcaagaacctacgggtctttcccgcaccagggtggaaatcaaggatagtggagacccagcatggcgtat

SEQ ID NO: 449737 - DNA, 140 bp, Artificial Sequence
  Synthetic
atacgccatgctgggtctcccgcctactcgggttgtcctgtcagaaatgaaggaagcctttcacggacttgatgtaaagtttcacacgcaggccttttcagcccatgggagtgggaaagacgtacttgggagtcggccat

SEQ ID NO: 449738 - DNA, 140 bp, Artificial Sequence
  Synthetic
atggccgactcccaagtacgtctttcccactcccatgggctgaaaaggcctgcgtgtgaaactttacatcaagtccgtgaaaggcttccttcatttctgacaggacaacccgagtaggcgggagacccagcatggcgtat

SEQ ID NO: 449739 - DNA, 140 bp, Artificial Sequence
  Synthetic
atacgccatgctgggtctccagtcattgatgcaatgtgccacgctaccctcacgtacaggatgctggaaccaacaagagctgttaactgggaggtgatcatcatggatgaggcccacttccgtacttgggagtcggccat

SEQ ID NO: 449740 - DNA, 140 bp, Artificial Sequence
  Synthetic
atggccgactcccaagtacggaagtgggcctcatccatgatgatcacctcccagttaacagctcttgttggttccagcatcctgtacgtgagggtagcgtggcacattgcatcaatgactggagacccagcatggcgtat

SEQ ID NO: 449741 - DNA, 140 bp, Artificial Sequence
  Synthetic
atacgccatgctgggtctccttggatcctgccagcatcgcagcaaggggctgggcagcccatagggcgagagcaaacgagagtgccacaatacttatgacagccactccaccaggcacaacgtacttgggagtcggccat

SEQ ID NO: 449742 - DNA, 140 bp, Artificial Sequence
  Synthetic
atggccgactcccaagtacgttgtgcctggtggagtggctgtcataagtattgtggcactctcgtttgctctcgccctatgggctgcccagccccttgctgcgatgctggcaggatccaaggagacccagcatggcgtat

SEQ ID NO: 449743 - DNA, 140 bp, Artificial Sequence
  Synthetic
atacgccatgctgggtctccgtgatgaatttccccattccaatggtgagattgaggatgtccaaactgacattccaagtgaaccatggacttcaggccatgagtggatcctagccgacaacgtacttgggagtcggccat

SEQ ID NO: 449744 - DNA, 140 bp, Artificial Sequence
  Synthetic
atggccgactcccaagtacgttgtcggctaggatccactcatggcctgaagtccatggttcacttggaatgtcagtttggacatcctcaatctcaccattggaatggggaaattcatcacggagacccagcatggcgtat

SEQ ID NO: 449745 - DNA, 140 bp, Artificial Sequence
  Synthetic
aggccctggctgctgatatgattccaagtgaaccatggacttcaggccatgagtggatcctagccgacaagcgaccaacggcatggtttctcccatcgatcagagcagcaaatgtcatgggaccttttgggacagcggtg

SEQ ID NO: 449746 - DNA, 140 bp, Artificial Sequence
  Synthetic
caccgctgtcccaaaaggtcccatgacatttgctgctctgatcgatgggagaaaccatgccgttggtcgcttgtcggctaggatccactcatggcctgaagtccatggttcacttggaatcatatcagcagccagggcct

SEQ ID NO: 449747 - DNA, 140 bp, Artificial Sequence
  Synthetic
atacgccatgctgggtctccccgcctctttgcggaaggccgggaagagtgtggtggtgttgaataggaagacctttgaaaaggaataccccaccatcaaacaaaagaggccggatttcatcgtacttgggagtcggccat

SEQ ID NO: 449748 - DNA, 140 bp, Artificial Sequence
  Synthetic
atggccgactcccaagtacgatgaaatccggcctcttttgtttgatggtggggtattccttttcaaaggtcttcctattcaacaccaccacactcttcccggccttccgcaaagaggcggggagacccagcatggcgtat

SEQ ID NO: 449749 - DNA, 140 bp, Artificial Sequence
  Synthetic
atacgccatgctgggtctcccctggccacagacattgccgaaatgggagcaaacttgtgcgttgaaagagtgctggactgtaggactgcatataaacctgttctggtggatgaagggaggcgtacttgggagtcggccat

SEQ ID NO: 449750 - DNA, 140 bp, Artificial Sequence
  Synthetic
atggccgactcccaagtacgcctcccttcatccaccagaacaggtttatatgcagtcctacagtccagcactctttcaacgcacaagtttgctcccatttcggcaatgtctgtggccaggggagacccagcatggcgtat

SEQ ID NO: 449751 - DNA, 140 bp, Artificial Sequence
  Synthetic
atacgccatgctgggtctccaaggtggccatcaaagggccactacggatttctgcatcatcggctgctcagagaagagggcgcattggacgaaacccaaacagggatggagattcctactcgtacttgggagtcggccat

SEQ ID NO: 449752 - DNA, 140 bp, Artificial Sequence
  Synthetic
atggccgactcccaagtacgagtaggaatctccatccctgtttgggtttcgtccaatgcgccctcttctctgagcagccgatgatgcagaaatccgtagtggccctttgatggccaccttggagacccagcatggcgtat

SEQ ID NO: 449753 - DNA, 140 bp, Artificial Sequence
  Synthetic
atacgccatgctgggtctccactattcagaacccaccagtgaggacaatgcccatcatgtgtgttggctggaagcttccatgctccttgacaacatggaagttagaggaggaatggttgccgtacttgggagtcggccat

SEQ ID NO: 449754 - DNA, 140 bp, Artificial Sequence
  Synthetic
atggccgactcccaagtacggcaaccattcctcctctaacttccatgttgtcaaggagcatggaagcttccagccaacacacatgatgggcattgtcctcactggtgggttctgaatagtggagacccagcatggcgtat

SEQ ID NO: 449755 - DNA, 140 bp, Artificial Sequence
  Synthetic
atacgccatgctgggtctcccccgctttatggaattgaagggacaaagacccctgtctcccctggggaaatgaggctgagagatgatcaaaggagagtcttcagggagttggtgcgtggacgtacttgggagtcggccat

SEQ ID NO: 449756 - DNA, 140 bp, Artificial Sequence
  Synthetic
atggccgactcccaagtacgtccacgcaccaactccctgaagactctcctttgatcatctctcagcctcatttccccaggggagacaggggtctttgtcccttcaattccataaagcgggggagacccagcatggcgtat

SEQ ID NO: 449757 - DNA, 140 bp, Artificial Sequence
  Synthetic
atacgccatgctgggtctcctgtgacttaccagtctggttatcctggcaggtagcaaagcccggtttaaaaaccaatgaccgcaagtggtgctttgaaggacccgaggaacacgagataccgtacttgggagtcggccat

SEQ ID NO: 449758 - DNA, 140 bp, Artificial Sequence
  Synthetic
atggccgactcccaagtacggtatctcgtgttcctcgggtccttcaaagcaccacttgcggtcattggtttttaaaccgggctttgctacctgccaggataaccagactggtaagtcacaggagacccagcatggcgtat

SEQ ID NO: 449759 - DNA, 140 bp, Artificial Sequence
  Synthetic
atacgccatgctgggtctccttaatgacaacggtgaaactgtgaagtgcaggtcacccggtggagcgaaaaaggcactgagacctagatggtgtgatgaaagagtgtcctcagaccagagcgtacttgggagtcggccat

SEQ ID NO: 449760 - DNA, 140 bp, Artificial Sequence
  Synthetic
atggccgactcccaagtacgctctggtctgaggacactctttcatcacaccatctaggtctcagtgcctttttcgctccaccgggtgacctgcacttcacagtttcaccgttgtcattaaggagacccagcatggcgtat

SEQ ID NO: 449761 - DNA, 140 bp, Artificial Sequence
  Synthetic
atacgccatgctgggtctcccgctttggctgatttcatcaaatttgccgaaggtagaagaggagcagctgagatgcttgtggttctcacggaactgcctgatttcctggcaaaaaaaggtcgtacttgggagtcggccat

SEQ ID NO: 449762 - DNA, 140 bp, Artificial Sequence
  Synthetic
atggccgactcccaagtacgacctttttttgccaggaaatcaggcagttccgtgagaaccacaagcatctcagctgctcctcttctaccttcggcaaatttgatgaaatcagccaaagcgggagacccagcatggcgtat

SEQ ID NO: 449763 - DNA, 140 bp, Artificial Sequence
  Synthetic
atacgccatgctgggtctccggggaggccatggacaccataagtgtgtttctccattctgaggagggatcaagagcttatagaaatgctctgtcaatgatgcctgaagccatgaccatcgcgtacttgggagtcggccat

SEQ ID NO: 449764 - DNA, 140 bp, Artificial Sequence
  Synthetic
atggccgactcccaagtacgcgatggtcatggcttcaggcatcattgacagagcatttctataagctcttgatccctcctcagaatggagaaacacacttatggtgtccatggcctccccggagacccagcatggcgtat

SEQ ID NO: 449765 - DNA, 140 bp, Artificial Sequence
  Synthetic
atacgccatgctgggtctcctaatgcttttcatattggctggtctcttgacctcaggaatggtgattttcttcatgtcgcccaaaggcatgagtaggatgtctatggcaatggggactatcgtacttgggagtcggccat

SEQ ID NO: 449766 - DNA, 140 bp, Artificial Sequence
  Synthetic
atggccgactcccaagtacgatagtccccattgccatagacatcctactcatgcctttgggcgacatgaagaaaatcaccattcctgaggtcaagagaccagccaatatgaaaagcattaggagacccagcatggcgtat

SEQ ID NO: 449767 - DNA, 140 bp, Artificial Sequence
  Synthetic
atacgccatgctgggtctccggctggcagcgggtatctcatgttcttggggggagtgaaaccaacacacatttcatatgttatgttgatctttttcgtccttatggtcgtcataattccacgtacttgggagtcggccat

SEQ ID NO: 449768 - DNA, 140 bp, Artificial Sequence
  Synthetic
atggccgactcccaagtacgtggaattatgacgaccataaggacgaaaaagatcaacataacatatgaaatgtgtgttggtttcactccccccaagaacatgagatacccgctgccagccggagacccagcatggcgtat

SEQ ID NO: 449769 - DNA, 140 bp, Artificial Sequence
  Synthetic
atacgccatgctgggtctccgagccaggacaacagaggaccatccaggacaaccaagtggcctatcttatcattggaatactcacattgctgtccattgtggcagccaatgagttaggaacgtacttgggagtcggccat

SEQ ID NO: 449770 - DNA, 140 bp, Artificial Sequence
  Synthetic
atggccgactcccaagtacgttcctaactcattggctgccacaatggacagcaatgtgagtattccaatgataagataggccacttggttgtcctggatggtcctctgttgtcctggctcggagacccagcatggcgtat

SEQ ID NO: 449771 - DNA, 140 bp, Artificial Sequence
  Synthetic
aggccctggctgctgatatgcattggaatactcacattgctgtccattgtggcagccaatgagttaggaatgctggaaaagaccaaggaagacttttttggaagaaggaatattgcaacagaccttttgggacagcggtg

SEQ ID NO: 449772 - DNA, 140 bp, Artificial Sequence
  Synthetic
caccgctgtcccaaaaggtctgttgcaatattccttcttccaaaaaagtcttccttggtcttttccagcattcctaactcattggctgccacaatggacagcaatgtgagtattccaatgcatatcagcagccagggcct

SEQ ID NO: 449773 - DNA, 140 bp, Artificial Sequence
  Synthetic
atacgccatgctgggtctcctctggtggaacgattccatggagctggcccgacttggatctgaaacctggggccgcttggactgtctatgtgggaattgtgacaatgctgtcaccaatgccgtacttgggagtcggccat

SEQ ID NO: 449774 - DNA, 140 bp, Artificial Sequence
  Synthetic
atggccgactcccaagtacggcattggtgacagcattgtcacaattcccacatagacagtccaagcggccccaggtttcagatccaagtcgggccagctccatggaatcgttccaccagaggagacccagcatggcgtat

SEQ ID NO: 449775 - DNA, 140 bp, Artificial Sequence
  Synthetic
atacgccatgctgggtctccttcatcactggattaaagtggaatatggaaacctctcgctgtcaggaatagctcagtcagcctcagtcctttcattcatggacaaaggaattcctttcatcgtacttgggagtcggccat

SEQ ID NO: 449776 - DNA, 140 bp, Artificial Sequence
  Synthetic
atggccgactcccaagtacgatgaaaggaattcctttgtccatgaatgaaaggactgaggctgactgagctattcctgacagcgagaggtttccatattccactttaatccagtgatgaaggagacccagcatggcgtat

SEQ ID NO: 449777 - DNA, 140 bp, Artificial Sequence
  Synthetic
aggccctggctgctgatatggctcagtcagcctcagtcctttcattcatggacaaaggaattcctttcatgaagatgaacatatctgtggtcatactcctggtcagtggttggaactcaagaccttttgggacagcggtg

SEQ ID NO: 449778 - DNA, 140 bp, Artificial Sequence
  Synthetic
caccgctgtcccaaaaggtcttgagttccaaccactgaccaggagtatgaccacagatatgttcatcttcatgaaaggaattcctttgtccatgaatgaaaggactgaggctgactgagccatatcagcagccagggcct

SEQ ID NO: 449779 - DNA, 140 bp, Artificial Sequence
  Synthetic
atacgccatgctgggtctcctaacagtgatccccctgttatgtggagtgggtggagccatgttgcattggacgctgattcttcctggaatcaaagcccagcagtcaaaactggcacaaaacgtacttgggagtcggccat

SEQ ID NO: 449780 - DNA, 140 bp, Artificial Sequence
  Synthetic
atggccgactcccaagtacgttttgtgccagttttgactgctgggctttgattccaggaagaatcagcgtccaatgcaacatggctccacccactccacataacagggggatcactgttaggagacccagcatggcgtat

SEQ ID NO: 449781 - DNA, 140 bp, Artificial Sequence
  Synthetic
atacgccatgctgggtctccaagagtttttcatggagtggcaaaaaatccagtagttgatggcaatccaaccgctgacattgaagaagcacctgaaatgcctgccttgtatgagaagaaacgtacttgggagtcggccat

SEQ ID NO: 449782 - DNA, 140 bp, Artificial Sequence
  Synthetic
atggccgactcccaagtacgtttcttctcatacaaggcaggcatttcaggtgcttcttcaatgtcagcggttggattgccatcaactactggattttttgccactccatgaaaaactcttggagacccagcatggcgtat

SEQ ID NO: 449783 - DNA, 140 bp, Artificial Sequence
  Synthetic
atacgccatgctgggtctccttggcactgtatcttcttctcgctttgagcctgatgtcagtagccatgtgcagaactcctttttccctagcagaaggcatagtgttgtcatctgctgctccgtacttgggagtcggccat

SEQ ID NO: 449784 - DNA, 140 bp, Artificial Sequence
  Synthetic
atggccgactcccaagtacggagcagcagatgacaacactatgccttctgctagggaaaaaggagttctgcacatggctactgacatcaggctcaaagcgagaagaagatacagtgccaaggagacccagcatggcgtat

SEQ ID NO: 449785 - DNA, 140 bp, Artificial Sequence
  Synthetic
atacgccatgctgggtctccttgggcccctaatagagggaaacacaagcttgctatggaatggtcctatggccgtttccatgactggggtcatgcgcggcaactactacgcttttgtgggcgtacttgggagtcggccat

SEQ ID NO: 449786 - DNA, 140 bp, Artificial Sequence
  Synthetic
atggccgactcccaagtacgcccacaaaagcgtagtagttgccgcgcatgaccccagtcatggaaacggccataggaccattccatagcaagcttgtgtttccctctattaggggcccaaggagacccagcatggcgtat

SEQ ID NO: 449787 - DNA, 140 bp, Artificial Sequence
  Synthetic
atacgccatgctgggtctcctgtgatgtacaacctctggaagatgaaaacagggcgtagagggagcgcaagcggcaagacactaggtgaggtttggaagagggaactcaacctgctagaccgtacttgggagtcggccat

SEQ ID NO: 449788 - DNA, 140 bp, Artificial Sequence
  Synthetic
atggccgactcccaagtacggtctagcaggttgagttccctcttccaaacctcacctagtgtcttgccgcttgcgctccctctacgccctgttttcatcttccagaggttgtacatcacaggagacccagcatggcgtat

SEQ ID NO: 449789 - DNA, 140 bp, Artificial Sequence
  Synthetic
atacgccatgctgggtctccaaacagcaatttgagttgtacaagagaacagacatcaccgaggtggatcgcgacatggctaggcgacatctggcagaggggaaggtggatactggagtggcgtacttgggagtcggccat

SEQ ID NO: 449790 - DNA, 140 bp, Artificial Sequence
  Synthetic
atggccgactcccaagtacgccactccagtatccaccttcccctctgccagatgtcgcctagccatgtcgcgatccacctcggtgatgtctgttctcttgtacaactcaaattgctgtttggagacccagcatggcgtat

SEQ ID NO: 449791 - DNA, 140 bp, Artificial Sequence
  Synthetic
atacgccatgctgggtctccccgtgtcgagggggacagcaaagctgagatggttccacgagcgtggctatgtaaagctggaaggaagagtcatggatttaggatgtggacgtggaggttgcgtacttgggagtcggccat

SEQ ID NO: 449792 - DNA, 140 bp, Artificial Sequence
  Synthetic
atggccgactcccaagtacgcaacctccacgtccacatcctaaatccatgactcttccttccagctttacatagccacgctcgtggaaccatctcagctttgctgtccccctcgacacggggagacccagcatggcgtat

SEQ ID NO: 449793 - DNA, 140 bp, Artificial Sequence
  Synthetic
atacgccatgctgggtctccgtgctattatgcagcagctcagaaagaggtcagtggtgtgaaaggttacaccctgggcagagatggccatgaaaagcccatgaacgtgcaaagtttaggacgtacttgggagtcggccat

SEQ ID NO: 449794 - DNA, 140 bp, Artificial Sequence
  Synthetic
atggccgactcccaagtacgtcctaaactttgcacgttcatgggcttttcatggccatctctgcccagggtgtaacctttcacaccactgacctctttctgagctgctgcataatagcacggagacccagcatggcgtat

SEQ ID NO: 449795 - DNA, 140 bp, Artificial Sequence
  Synthetic
atacgccatgctgggtctcctggaacattgtgaccttcaaggacaagactgacatccacaggctagagccagccaagtgtgaaaccctcctttgtgacattggggaatcctcgccttcttcgtacttgggagtcggccat

SEQ ID NO: 449796 - DNA, 140 bp, Artificial Sequence
  Synthetic
atggccgactcccaagtacgaagaaggcgaggattccccaatgtcacaaaggagggtttcacacttggctggctctagcctgtggatgtcagtcttgtccttgaaggtcacaatgttccaggagacccagcatggcgtat

SEQ ID NO: 449797 - DNA, 140 bp, Artificial Sequence
  Synthetic
atacgccatgctgggtctccccgtgaccgagggtgagaggaccttgagagttcttgaaacaattgaaaagtggctggcttgtggagtggacaacttttgtgtcaaggttttagcaccatacgtacttgggagtcggccat

SEQ ID NO: 449798 - DNA, 140 bp, Artificial Sequence
  Synthetic
atggccgactcccaagtacgtatggtgctaaaaccttgacacaaaagttgtccactccacaagccagccacttttcaattgtttcaagaactctcaaggtcctctcaccctcggtcacggggagacccagcatggcgtat

SEQ ID NO: 449799 - DNA, 140 bp, Artificial Sequence
  Synthetic
atacgccatgctgggtctcccatgcctgatgtgatagagaaattggaacttctccaaagaagatttggcggaactatcatcaggaatcccctttccagaaactcaacccatgagatgtatcgtacttgggagtcggccat

SEQ ID NO: 449800 - DNA, 140 bp, Artificial Sequence
  Synthetic
atggccgactcccaagtacgatacatctcatgggttgagtttctggaaaggggattcctgatgatagttccgccaaatcttctttggagaagttccaatttctctatcacatcaggcatgggagacccagcatggcgtat

SEQ ID NO: 449801 - DNA, 140 bp, Artificial Sequence
  Synthetic
atacgccatgctgggtctcctatgtgtcaggagcaagaagtaacattaccttcacagtcaaccaaacatcacgtctgctgatgaggaggatgagacgaccaacaggcaaagtcactcttgcgtacttgggagtcggccat

SEQ ID NO: 449802 - DNA, 140 bp, Artificial Sequence
  Synthetic
atggccgactcccaagtacgcaagagtgactttgcctgttggtcgtctcatcctcctcatcagcagacgtgatgtttggttgactgtgaaggtaatgttacttcttgctcctgacacataggagacccagcatggcgtat

SEQ ID NO: 449803 - DNA, 140 bp, Artificial Sequence
  Synthetic
atacgccatgctgggtctccagcccgatgtcattcttcccataggcacacgtagtgtggaaactgataagggacccctagacagggatgccattgaagagagggttgagagaattaagaccgtacttgggagtcggccat

SEQ ID NO: 449804 - DNA, 140 bp, Artificial Sequence
  Synthetic
atggccgactcccaagtacggtcttaattctctcaaccctctcttcaatggcatccctgtctaggggtcccttatcagtttccacactacgtgtgcctatgggaagaatgacatcgggctggagacccagcatggcgtat

SEQ ID NO: 449805 - DNA, 140 bp, Artificial Sequence
  Synthetic
atacgccatgctgggtctccagagtatgctgctacatggttctatgacaatgataacccgtatcggacctggcattactgtggctcatatatcaccaagacatcaggcagtgcagccagccgtacttgggagtcggccat

SEQ ID NO: 449806 - DNA, 140 bp, Artificial Sequence
  Synthetic
atggccgactcccaagtacggctggctgcactgcctgatgtcttggtgatatatgagccacagtaatgccaggtccgatacgggttatcattgtcatagaaccatgtagcagcatactctggagacccagcatggcgtat

SEQ ID NO: 449807 - DNA, 140 bp, Artificial Sequence
  Synthetic
atacgccatgctgggtctccatgataaatggagtcattaaaatcttgaccttcccatgggacaggatagaagaggttaccagaatggcaatgactgacaccacgccttttggccaacaaacgtacttgggagtcggccat

SEQ ID NO: 449808 - DNA, 140 bp, Artificial Sequence
  Synthetic
atggccgactcccaagtacgtttgttggccaaaaggcgtggtgtcagtcattgccattctggtaacctcttctatcctgtcccatgggaaggtcaagattttaatgactccatttatcatggagacccagcatggcgtat

SEQ ID NO: 449809 - DNA, 140 bp, Artificial Sequence
  Synthetic
atacgccatgctgggtctccgagtctttaaggaaaaggtggacacaagagccaaagatcctcctgctggaactaggaaaatcatgaaggtggtaaaccgttggttgtttcgacatctggccgtacttgggagtcggccat

SEQ ID NO: 449810 - DNA, 140 bp, Artificial Sequence
  Synthetic
atggccgactcccaagtacggccagatgtcgaaacaaccaacggtttaccaccttcatgattttcctagttccagcaggaggatctttggctcttgtgtccaccttttccttaaagactcggagacccagcatggcgtat

SEQ ID NO: 449811 - DNA, 140 bp, Artificial Sequence
  Synthetic
atacgccatgctgggtctccccgggaaaagaatcccaggctgtgcacaaaggaggaattcatagccaaggtgcgcagtcatgctgcggtaggagccttcttagaggagcaggagcaatggcgtacttgggagtcggccat

SEQ ID NO: 449812 - DNA, 140 bp, Artificial Sequence
  Synthetic
atggccgactcccaagtacgccattgctcctgctcctctaagaaggctcctaccgcagcatgactgcgcaccttggctatgaattcctcctttgtgcacagcctgggattcttttcccggggagacccagcatggcgtat

SEQ ID NO: 449813 - DNA, 140 bp, Artificial Sequence
  Synthetic
atacgccatgctgggtctccaagacagccaatgaagcggttcaagaccctaagttttgggagatggttgatgctgagcgcaagctccatcaacaggggcgatgccagtcttgtgtctatacgtacttgggagtcggccat

SEQ ID NO: 449814 - DNA, 140 bp, Artificial Sequence
  Synthetic
atggccgactcccaagtacgtatagacacaagactggcatcgcccctgttgatggagcttgcgctcagcatcaaccatctcccaaaacttagggtcttgaaccgcttcattggctgtcttggagacccagcatggcgtat

SEQ ID NO: 449815 - DNA, 140 bp, Artificial Sequence
  Synthetic
atacgccatgctgggtctccacatgatgggaaaaagagagaaaaaactatctgagtttggaaaagcaaaaggaagtcgtgcgatctggtacatgtggctgggggcacgtttccttgagttcgtacttgggagtcggccat

SEQ ID NO: 449816 - DNA, 140 bp, Artificial Sequence
  Synthetic
atggccgactcccaagtacgaactcaaggaaacgtgcccccagccacatgtaccagatcgcacgacttccttttgcttttccaaactcagatagttttttctctctttttcccatcatgtggagacccagcatggcgtat

SEQ ID NO: 449817 - DNA, 140 bp, Artificial Sequence
  Synthetic
atacgccatgctgggtctcctgaggctcttgggttcctgaatgaagatcactgggcctccagagagaattcaggagggggtgttgaaggcataggactccaatatctaggctatgtaatccgtacttgggagtcggccat

SEQ ID NO: 449818 - DNA, 140 bp, Artificial Sequence
  Synthetic
atggccgactcccaagtacggattacatagcctagatattggagtcctatgccttcaacaccccctcctgaattctctctggaggcccagtgatcttcattcaggaacccaagagcctcaggagacccagcatggcgtat

SEQ ID NO: 449819 - DNA, 140 bp, Artificial Sequence
  Synthetic
atacgccatgctgggtctccaaggacctgtccaccaaagaagggggaggattctatgcagatgacacagcaggatgggacacacgcatcacggaagctgacctggatgatgaacaggagacgtacttgggagtcggccat

SEQ ID NO: 449820 - DNA, 140 bp, Artificial Sequence
  Synthetic
atggccgactcccaagtacgtctcctgttcatcatccaggtcagcttccgtgatgcgtgtgtcccatcctgctgtgtcatctgcatagaatcctcccccttctttggtggacaggtccttggagacccagcatggcgtat

SEQ ID NO: 449821 - DNA, 140 bp, Artificial Sequence
  Synthetic
aggccctggctgctgatatgaggatgggacacacgcatcacggaagctgacctggatgatgaacaggagatcatgagctacatgaacgctgagcagaggaaactggcctgggcagtgatggaccttttgggacagcggtg

SEQ ID NO: 449822 - DNA, 140 bp, Artificial Sequence
  Synthetic
caccgctgtcccaaaaggtccatcactgcccaggccagtttcctctgctcagcgttcatgtagctcatgatctcctgttcatcatccaggtcagcttccgtgatgcgtgtgtcccatcctcatatcagcagccagggcct

SEQ ID NO: 449823 - DNA, 140 bp, Artificial Sequence
  Synthetic
atacgccatgctgggtctcctcatgagctacatgaacgctgagcagaggaaactggcctgggcagtgatggaaatgacatacaagaacaaagtggtcaaggtccttcgaccagcaccaggcgtacttgggagtcggccat

SEQ ID NO: 449824 - DNA, 140 bp, Artificial Sequence
  Synthetic
atggccgactcccaagtacgcctggtgctggtcgaaggaccttgaccactttgttcttgtatgtcatttccatcactgcccaggccagtttcctctgctcagcgttcatgtagctcatgaggagacccagcatggcgtat

SEQ ID NO: 449825 - DNA, 140 bp, Artificial Sequence
  Synthetic
atacgccatgctgggtctcctggcaaggctttcatggacatcatcagtaggagagatcaaagggggtcagggcaagtggtgacatacgctctcaacactatcaccaatttgaaagtccagcgtacttgggagtcggccat

SEQ ID NO: 449826 - DNA, 140 bp, Artificial Sequence
  Synthetic
atggccgactcccaagtacgctggactttcaaattggtgatagtgttgagagcgtatgtcaccacttgccctgaccccctttgatctctcctactgatgatgtccatgaaagccttgccaggagacccagcatggcgtat

SEQ ID NO: 449827 - DNA, 140 bp, Artificial Sequence
  Synthetic
atacgccatgctgggtctccctcataaggatggctgaagctgagatggtaatcaaccatcagcacgtgaatgaatgtgacgagggcgttttggcacggctggacgcatggcttgctgagacgtacttgggagtcggccat

SEQ ID NO: 449828 - DNA, 140 bp, Artificial Sequence
  Synthetic
atggccgactcccaagtacgtctcagcaagccatgcgtccagccgtgccaaaacgccctcgtcacattcattcacgtgctgatggttgattaccatctcagcttcagccatccttatgagggagacccagcatggcgtat

SEQ ID NO: 449829 - DNA, 140 bp, Artificial Sequence
  Synthetic
atacgccatgctgggtctccatggatgtgacagacttgcccggatggctgtgagtggagatgattgtgtcgtgaggcctgtggatgatagatttggcctggctctttcccatcttaatgccgtacttgggagtcggccat

SEQ ID NO: 449830 - DNA, 140 bp, Artificial Sequence
  Synthetic
atggccgactcccaagtacggcattaagatgggaaagagccaggccaaatctatcatccacaggcctcacgacacaatcatctccactcacagccatccgggcaagtctgtcacatccatggagacccagcatggcgtat

SEQ ID NO: 449831 - DNA, 140 bp, Artificial Sequence
  Synthetic
atacgccatgctgggtctcccatgtcaaaagtcaggaaggacatttcagaatggcagccctccaaggagtggacagattgggaaaatgttcctttctgctcccaccatttccatgaacttcgtacttgggagtcggccat

SEQ ID NO: 449832 - DNA, 140 bp, Artificial Sequence
  Synthetic
atggccgactcccaagtacgaagttcatggaaatggtgggagcagaaaggaacattttcccaatctgtccactccttggagggctgccattctgaaatgtccttcctgacttttgacatgggagacccagcatggcgtat

SEQ ID NO: 449833 - DNA, 140 bp, Artificial Sequence
  Synthetic
atacgccatgctgggtctccgtgttgaaagatggaaggaaagtggtggtgccctgtagagaccaagatgagttgatagggagagggagagtgtctccaggaaatggctggatgattaaagcgtacttgggagtcggccat

SEQ ID NO: 449834 - DNA, 140 bp, Artificial Sequence
  Synthetic
atggccgactcccaagtacgctttaatcatccagccatttcctggagacactctccctctccctatcaactcatcttggtctctacagggcaccaccactttccttccatctttcaacacggagacccagcatggcgtat

SEQ ID NO: 449835 - DNA, 140 bp, Artificial Sequence
  Synthetic
atacgccatgctgggtctccaaacggcttgcctcagcaaggcttatgcaaacatgtggtcactgatgtatttccataagagagacatgaggctgctctcatttgctgtctcatcagccgtcgtacttgggagtcggccat

SEQ ID NO: 449836 - DNA, 140 bp, Artificial Sequence
  Synthetic
atggccgactcccaagtacgacggctgatgagacagcaaatgagagcagcctcatgtctctcttatggaaatacatcagtgaccacatgtttgcataagccttgctgaggcaagccgtttggagacccagcatggcgtat

SEQ ID NO: 449837 - DNA, 140 bp, Artificial Sequence
  Synthetic
atacgccatgctgggtctcctccaatggcatgggtacccagtggaagaacaacatggtctgttcatggaaaaggagagtggatgaccacgcaagacatgttggacgtctggaacagagttcgtacttgggagtcggccat

SEQ ID NO: 449838 - DNA, 140 bp, Artificial Sequence
  Synthetic
atggccgactcccaagtacgaactctgttccagacgtccaacatgtcttgcgtggtcatccactctccttttccatgaacagaccatgttgttcttccactgggtacccatgccattggaggagacccagcatggcgtat

SEQ ID NO: 449839 - DNA, 140 bp, Artificial Sequence
  Synthetic
atacgccatgctgggtctcctgggtcctaaacaacccacacatgaaggacaagaccaccgtaaaggagtggagagatgttccttacctcacaaaaaggcaggacaaactctgtgggtccccgtacttgggagtcggccat

SEQ ID NO: 449840 - DNA, 140 bp, Artificial Sequence
  Synthetic
atggccgactcccaagtacggggacccacagagtttgtcctgcctttttgtgaggtaaggaacatctctccactcctttacggtggtcttgtccttcatgtgtgggttgtttaggacccaggagacccagcatggcgtat

SEQ ID NO: 449841 - DNA, 140 bp, Artificial Sequence
  Synthetic
atacgccatgctgggtctcctgatagggatgacaaacagggccacatgggcctcacacatccacctggtgatccaccgaatccgaaccttaatcggccaagaaaaatacacagattatctcgtacttgggagtcggccat

SEQ ID NO: 449842 - DNA, 140 bp, Artificial Sequence
  Synthetic
atggccgactcccaagtacgagataatctgtgtatttttcttggccgattaaggttcggattcggtggatcaccaggtggatgtgtgaggcccatgtggccctgtttgtcatccctatcaggagacccagcatggcgtat

SEQ ID NO: 449843 - DNA, 140 bp, Artificial Sequence
  Synthetic
atacgccatgctgggtctcccactgtgatggacaggtactcggttgatgctgacctccaaccaggagagctcatctgagaccagccactgtgaaccaaccgggataaaaaccacgggcggcgtacttgggagtcggccat

SEQ ID NO: 449844 - DNA, 140 bp, Artificial Sequence
  Synthetic
atggccgactcccaagtacgccgcccgtggtttttatcccggttggttcacagtggctggtctcagatgagctctcctggttggaggtcagcatcaaccgagtacctgtccatcacagtgggagacccagcatggcgtat

SEQ ID NO: 449845 - DNA, 140 bp, Artificial Sequence
  Synthetic
atacgccatgctgggtctccagaaccggactccccacttccaaagcatcaataagaaaccgggataaaaaccacggatggagaaccggactccacacttaaaaggctattgacgtcagcccgtacttgggagtcggccat

SEQ ID NO: 449846 - DNA, 140 bp, Artificial Sequence
  Synthetic
atggccgactcccaagtacgggctgacgtcaatagccttttaagtgtggagtccggttctccatccgtggtttttatcccggtttcttattgatgctttggaagtggggagtccggttctggagacccagcatggcgtat

SEQ ID NO: 449847 - DNA, 140 bp, Artificial Sequence
  Synthetic
atacgccatgctgggtctcccaggactctagaatcctaggagtcttgccaccgctaagctgtgaggcggtgcgggctgggacagccgtcttccagatcacgataggtctggtttctggaacgtacttgggagtcggccat

SEQ ID NO: 449848 - DNA, 140 bp, Artificial Sequence
  Synthetic
atggccgactcccaagtacgttccagaaaccagacctatcgtgatctggaagacggctgtcccagcccgcaccgcctcacagcttagcggtggcaagactcctaggattctagagtcctgggagacccagcatggcgtat

SEQ ID NO: 449849 - DNA, 140 bp, Artificial Sequence
  Synthetic
aggccctggctgctgatatgtttcccaacccagagtaaaatgatggagcctccgccaccacccacccacggggtggtggaaagatggggtctagaggttagaggagaccctccagggaaagaccttttgggacagcggtg

SEQ ID NO: 449850 - DNA, 140 bp, Artificial Sequence
  Synthetic
caccgctgtcccaaaaggtctttccctggagggtctcctctaacctctagaccccatctttccaccaccccgtgggtgggtggtggcggaggctccatcattttactctgggttgggaaacatatcagcagccagggcct

SEQ ID NO: 449851 - DNA, 140 bp, Artificial Sequence
  Synthetic
atacgccatgctgggtctccttagtgggaccatattgacgcctgggaaagaccggagtggttctctgcttttcctccaggggtctgcgagcacagtttgctctagaagaagcagacctttcgtacttgggagtcggccat

SEQ ID NO: 449852 - DNA, 140 bp, Artificial Sequence
  Synthetic
atggccgactcccaagtacgaaaggtctgcttcttctagagcaaactgtgctcgcagacccctggaggaaaagcagagaaccactccggtctttcccaggcgtcaatatggtcccactaaggagacccagcatggcgtat

SEQ ID NO: 449853 - DNA, 140 bp, Artificial Sequence
  Synthetic
aggccctggctgctgatatggggaaagaccggagtggttctctgcttttcctccaggggtctgcgagcacagtttgctctagaagaagcagacctttggatgacaaaacccaaaaccactgaccttttgggacagcggtg

SEQ ID NO: 449854 - DNA, 140 bp, Artificial Sequence
  Synthetic
caccgctgtcccaaaaggtcagtggttttgggttttgtcatccaaaggtctgcttcttctagagcaaactgtgctcgcagacccctggaggaaaagcagagaaccactccggtctttccccatatcagcagccagggcct

SEQ ID NO: 449855 - DNA, 140 bp, Artificial Sequence
  Synthetic
atacgccatgctgggtctcctgaccacccacctgaaaaggctttggagaatgcttgatccccgacaaggacttactgttctaaggaaagtcaagagagtggtagccagtttgatgagaggcgtacttgggagtcggccat

SEQ ID NO: 449856 - DNA, 140 bp, Artificial Sequence
  Synthetic
atggccgactcccaagtacgcctctcatcaaactggctaccactctcttgactttccttagaacagtaagtccttgtcggggatcaagcattctccaaagccttttcaggtgggtggtcaggagacccagcatggcgtat

SEQ ID NO: 449857 - DNA, 140 bp, Artificial Sequence
  Synthetic
atacgccatgctgggtctccgttgtcttctaggaagcgtcgctccagtgagatgaccatgatgccacttctgatcttgagcatggtgattctaggtggaggggtgacactcgtccggaaacgtacttgggagtcggccat

SEQ ID NO: 449858 - DNA, 140 bp, Artificial Sequence
  Synthetic
atggccgactcccaagtacgtttccggacgagtgtcacccctccacctagaatcaccatgctcaagatcagaagtggcatcatggtcatctcactggagcgacgcttcctagaagacaacggagacccagcatggcgtat

SEQ ID NO: 449859 - DNA, 140 bp, Artificial Sequence
  Synthetic
atacgccatgctgggtctccaatcgatggctgcttttgaatgtcacagctgaggacttgggaaagacgttctcggtgggaaccgggaactgcacaaccaacattcttgaggcaaagtactcgtacttgggagtcggccat

SEQ ID NO: 449860 - DNA, 140 bp, Artificial Sequence
  Synthetic
atggccgactcccaagtacgagtactttgcctcaagaatgttggttgtgcagttcccggttcccaccgagaacgtctttcccaagtcctcagctgtgacattcaaaagcagccatcgattggagacccagcatggcgtat

SEQ ID NO: 449861 - DNA, 140 bp, Artificial Sequence
  Synthetic
atacgccatgctgggtctccggtgtcccgattcaatggaatacaactgtcccaatctcagtcctagagaggagcctgatgacattgactgttggtgttatggagtagaaaacgtcagagtcgtacttgggagtcggccat

SEQ ID NO: 449862 - DNA, 140 bp, Artificial Sequence
  Synthetic
atggccgactcccaagtacgactctgacgttttctactccataacaccaacagtcaatgtcatcaggctcctctctaggactgagattgggacagttgtattccattgaatcgggacaccggagacccagcatggcgtat

SEQ ID NO: 449863 - DNA, 140 bp, Artificial Sequence
  Synthetic
atacgccatgctgggtctccagcctatggaaggtgtgatgcagtgggaaggtcaaaacgttctaggagagcaattgatctgcccacacatgaaaatcacggactgaaaactcgacaggagcgtacttgggagtcggccat

SEQ ID NO: 449864 - DNA, 140 bp, Artificial Sequence
  Synthetic
atggccgactcccaagtacgctcctgtcgagttttcagtccgtgattttcatgtgtgggcagatcaattgctctcctagaacgttttgaccttcccactgcatcacaccttccataggctggagacccagcatggcgtat

SEQ ID NO: 449865 - DNA, 140 bp, Artificial Sequence
  Synthetic
atacgccatgctgggtctccaaatggatgacgggcagaatgggtgagcggcaactccaaaagattgagcggtggctagtgagaaatccattctttgccgtaacagccctggccattgcttcgtacttgggagtcggccat

SEQ ID NO: 449866 - DNA, 140 bp, Artificial Sequence
  Synthetic
atggccgactcccaagtacgaagcaatggccagggctgttacggcaaagaatggatttctcactagccaccgctcaatcttttggagttgccgctcacccattctgcccgtcatccatttggagacccagcatggcgtat

SEQ ID NO: 449867 - DNA, 140 bp, Artificial Sequence
  Synthetic
atacgccatgctgggtctccacttggtgggcaacaacaagacacaacgtgttgttatagctctgttggttttggcagttggtccggcctattctgcacactgcattgggataactgacagcgtacttgggagtcggccat

SEQ ID NO: 449868 - DNA, 140 bp, Artificial Sequence
  Synthetic
atggccgactcccaagtacgctgtcagttatcccaatgcagtgtgcagaataggccggaccaactgccaaaaccaacagagctataacaacacgttgtgtcttgttgttgcccaccaagtggagacccagcatggcgtat

SEQ ID NO: 449869 - DNA, 140 bp, Artificial Sequence
  Synthetic
atacgccatgctgggtctccagacttcattgagggggtccacggaggcacttgggtgtcagcttctctggagcaggacaagtgcgtgactgtcatggcgcctgataaaccatcactggatcgtacttgggagtcggccat

SEQ ID NO: 449870 - DNA, 140 bp, Artificial Sequence
  Synthetic
atggccgactcccaagtacgatccagtgatggtttatcaggcgccatgacagtcacgcacttgtcctgctccagagaagctgacacccaagtgcctccgtggaccccctcaatgaagtctggagacccagcatggcgtat

SEQ ID NO: 449871 - DNA, 140 bp, Artificial Sequence
  Synthetic
atacgccatgctgggtctccatctcgcttcaaacagtggcgatagatgggcctgctgaggcaaggaaggtctgctacagtgcagttctcacccatgtgaaaatcaatgacaaatgcccgacgtacttgggagtcggccat

SEQ ID NO: 449872 - DNA, 140 bp, Artificial Sequence
  Synthetic
atggccgactcccaagtacgtcgggcatttgtcattgattttcacatgggtgagaactgcactgtagcagaccttccttgcctcagcaggcccatctatcgccactgtttgaagcgagatggagacccagcatggcgtat

SEQ ID NO: 449873 - DNA, 140 bp, Artificial Sequence
  Synthetic
atacgccatgctgggtctccgcaccggtgaggctcacctcgctgaggaaaatgatggtgataacgcctgcaaacggacatactcagatagaggctggggcaatggctgtgggctatttggcgtacttgggagtcggccat

SEQ ID NO: 449874 - DNA, 140 bp, Artificial Sequence
  Synthetic
atggccgactcccaagtacgccaaatagcccacagccattgccccagcctctatctgagtatgtccgtttgcaggcgttatcaccatcattttcctcagcgaggtgagcctcaccggtgcggagacccagcatggcgtat

SEQ ID NO: 449875 - DNA, 140 bp, Artificial Sequence
  Synthetic
atacgccatgctgggtctccgaaagggagcattgtggcatgtgccaagttcacgtgtgctaaatccatgagtctttttgaagtggaccagaccaagatccaatacgtcatcagggctcagcgtacttgggagtcggccat

SEQ ID NO: 449876 - DNA, 140 bp, Artificial Sequence
  Synthetic
atggccgactcccaagtacgctgagccctgatgacgtattggatcttggtctggtccacttcaaaaagactcatggatttagcacacgtgaacttggcacatgccacaatgctccctttcggagacccagcatggcgtat

SEQ ID NO: 449877 - DNA, 140 bp, Artificial Sequence
  Synthetic
atacgccatgctgggtctcccttcatgttggtgccaagcaggagaactggaacacagatataaaaacactgaagtttgatgccttatctggctcccaagaggctgaattcactggctatgcgtacttgggagtcggccat

SEQ ID NO: 449878 - DNA, 140 bp, Artificial Sequence
  Synthetic
atggccgactcccaagtacgcatagccagtgaattcagcctcttgggagccagataaggcatcaaacttcagtgtttttatatctgtgttccagttctcctgcttggcaccaacatgaagggagacccagcatggcgtat

SEQ ID NO: 449879 - DNA, 140 bp, Artificial Sequence
  Synthetic
atacgccatgctgggtctccggaaagcaacactggaatgtcaggtccagactgcagtggattttgggaacagttacattgcagagatggaaaaagacagctggattgtcgaccgccagtgcgtacttgggagtcggccat

SEQ ID NO: 449880 - DNA, 140 bp, Artificial Sequence
  Synthetic
atggccgactcccaagtacgcactggcggtcgacaatccagctgtctttttccatctctgcaatgtaactgttcccaaaatccactgcagtctggacctgacattccagtgttgctttccggagacccagcatggcgtat

SEQ ID NO: 449881 - DNA, 140 bp, Artificial Sequence
  Synthetic
atacgccatgctgggtctccggcacaagacttgactctaccatggcagagtgggagtggtggaatatggagggaaatgcatcaccttgttgagtttgaacctccgcatgctgccacaatccgtacttgggagtcggccat

SEQ ID NO: 449882 - DNA, 140 bp, Artificial Sequence
  Synthetic
atggccgactcccaagtacggattgtggcagcatgcggaggttcaaactcaacaaggtgatgcatttccctccatattccaccactcccactctgccatggtagagtcaagtcttgtgccggagacccagcatggcgtat

SEQ ID NO: 449883 - DNA, 140 bp, Artificial Sequence
  Synthetic
atacgccatgctgggtctccagggtgttggccctggggaaccaagaggggtccttgaagacagccctcacaggagctatgcgggttaccaaggacgaaaatgataacaacttgtataagccgtacttgggagtcggccat

SEQ ID NO: 449884 - DNA, 140 bp, Artificial Sequence
  Synthetic
atggccgactcccaagtacggcttatacaagttgttatcattttcgtccttggtaacccgcatagctcctgtgagggctgtcttcaaggacccctcttggttccccagggccaacaccctggagacccagcatggcgtat

SEQ ID NO: 449885 - DNA, 140 bp, Artificial Sequence
  Synthetic
atacgccatgctgggtctcctgcatggtggccatgtctcttgtagggtgaaactttcagctctaacccttaaggggacatcctacaagatgtgcacagataaaatgtcatttgtgaaaaacgtacttgggagtcggccat

SEQ ID NO: 449886 - DNA, 140 bp, Artificial Sequence
  Synthetic
atggccgactcccaagtacgtttttcacaaatgacattttatctgtgcacatcttgtaggatgtccccttaagggttagagctgaaagtttcaccctacaagagacatggccaccatgcaggagacccagcatggcgtat

SEQ ID NO: 449887 - DNA, 140 bp, Artificial Sequence
  Synthetic
atacgccatgctgggtctcccccaacggacacagggcatggcactgttgtcatgcaggtgaaggtccccaaaggagccccatgcaagattcccgtgattgtggccgatgacctaacggctcgtacttgggagtcggccat

SEQ ID NO: 449888 - DNA, 140 bp, Artificial Sequence
  Synthetic
atggccgactcccaagtacgagccgttaggtcatcggccacaatcacgggaatcttgcatggggctcctttggggaccttcacctgcatgacaacagtgccatgccctgtgtccgttgggggagacccagcatggcgtat

SEQ ID NO: 449889 - DNA, 140 bp, Artificial Sequence
  Synthetic
atacgccatgctgggtctccgcagtcaacaagggaatattggtcactgtcaaccccatagcatccacaaatgacgatgaagttctaattgaagtcaatcccccctttggggacagttacacgtacttgggagtcggccat

SEQ ID NO: 449890 - DNA, 140 bp, Artificial Sequence
  Synthetic
atggccgactcccaagtacgtgtaactgtccccaaaggggggattgacttcaattagaacttcatcgtcatttgtggatgctatggggttgacagtgaccaatattcccttgttgactgcggagacccagcatggcgtat

SEQ ID NO: 449891 - DNA, 140 bp, Artificial Sequence
  Synthetic
atacgccatgctgggtctcctcattgttgggactggtgactcaagactgacctatcagtggcacaaagaaggaagttcaataggaaaacttttcactcagacaatgaagggagtagaacgcgtacttgggagtcggccat

SEQ ID NO: 449892 - DNA, 140 bp, Artificial Sequence
  Synthetic
atggccgactcccaagtacgcgttctactcccttcattgtctgagtgaaaagttttcctattgaacttccttctttgtgccactgataggtcagtcttgagtcaccagtcccaacaatgaggagacccagcatggcgtat

SEQ ID NO: 449893 - DNA, 140 bp, Artificial Sequence
  Synthetic
atacgccatgctgggtctcctcttgcagtaatgggtgatgctgcctgggactttagctctgcaggtggcttcttcacgtcagtggggaaaggaattcacactgtgtttggttcagcttttcgtacttgggagtcggccat

SEQ ID NO: 449894 - DNA, 140 bp, Artificial Sequence
  Synthetic
atggccgactcccaagtacgaaaagctgaaccaaacacagtgtgaattcctttccccactgacgtgaagaagccacctgcagagctaaagtcccaggcagcatcacccattactgcaagaggagacccagcatggcgtat

SEQ ID NO: 449895 - DNA, 140 bp, Artificial Sequence
  Synthetic
atacgccatgctgggtctcccaggggttgtttggcggcctgagctggattacaaaggtcatcatgggagccgttctcatctgggttggaatcaacacacgtaatatgaccatgtccatgtcgtacttgggagtcggccat

SEQ ID NO: 449896 - DNA, 140 bp, Artificial Sequence
  Synthetic
atggccgactcccaagtacgacatggacatggtcatattacgtgtgttgattccaacccagatgagaacggctcccatgatgacctttgtaatccagctcaggccgccaaacaacccctgggagacccagcatggcgtat

SEQ ID NO: 449897 - DNA, 140 bp, Artificial Sequence
  Synthetic
atacgccatgctgggtctccctatgattttggtgggtgtgatcatgatgttcctttccctgggtgtcggggcagaccaagggtgtgccgtcaactttgggaagcgggagctcaaatgtggcgtacttgggagtcggccat

SEQ ID NO: 449898 - DNA, 140 bp, Artificial Sequence
  Synthetic
atggccgactcccaagtacgccacatttgagctcccgcttcccaaagttgacggcacacccttggtctgccccgacacccagggaaaggaacatcatgatcacacccaccaaaatcatagggagacccagcatggcgtat

SEQ ID NO: 449899 - DNA, 140 bp, Artificial Sequence
  Synthetic
atacgccatgctgggtctccagatggcatttttgtgttcagagactcagatgactggcttaccaagtattcttattatccagaagaccctgtcaagctggcctccatcatcaaggcctctcgtacttgggagtcggccat

SEQ ID NO: 449900 - DNA, 140 bp, Artificial Sequence
  Synthetic
atggccgactcccaagtacgagaggccttgatgatggaggccagcttgacagggtcttctggataataagaatacttggtaagccagtcatctgagtctctgaacacaaaaatgccatctggagacccagcatggcgtat

SEQ ID NO: 449901 - DNA, 140 bp, Artificial Sequence
  Synthetic
atacgccatgctgggtctcctatgaagagggcaagtgtggactgaactctgtggactcccttgaacatgaaatgtggaggagtagagctgatgagatcaacgccatatttgaggaaaatgcgtacttgggagtcggccat

SEQ ID NO: 449902 - DNA, 140 bp, Artificial Sequence
  Synthetic
atggccgactcccaagtacgcattttcctcaaatatggcgttgatctcatcagctctactcctccacatttcatgttcaagggagtccacagagttcagtccacacttgccctcttcataggagacccagcatggcgtat

SEQ ID NO: 449903 - DNA, 140 bp, Artificial Sequence
  Synthetic
atacgccatgctgggtctccaagtggacatctcgatcgttgtccaagatccaaagaatatctaccaaagagggacgcatcctttctccaggattcgtgatgggttacagtatggatggaacgtacttgggagtcggccat

SEQ ID NO: 449904 - DNA, 140 bp, Artificial Sequence
  Synthetic
atggccgactcccaagtacgttccatccatactgtaacccatcacgaatcctggagaaaggatgcgtccctctttggtagatattctttggatcttggacaacgatcgagatgtccacttggagacccagcatggcgtat

SEQ ID NO: 449905 - DNA, 140 bp, Artificial Sequence
  Synthetic
atacgccatgctgggtctccaacctggggcaagaatctaatcttctcacccggaaggaaaaacggcagcttcatcattgatggaaaatcacggaaggaatgccctttctcaaacagagtgcgtacttgggagtcggccat

SEQ ID NO: 449906 - DNA, 140 bp, Artificial Sequence
  Synthetic
atggccgactcccaagtacgcactctgtttgagaaagggcattccttccgtgattttccatcaatgatgaagctgccgtttttccttccgggtgagaagattagattcttgccccaggttggagacccagcatggcgtat

SEQ ID NO: 449907 - DNA, 140 bp, Artificial Sequence
  Synthetic
atacgccatgctgggtctcctggaactctttccagattgaggagtttggcatgggagtgttcacaacacgggtttttatggatgctgtttttgactattcagtggactgtgatggggccacgtacttgggagtcggccat

SEQ ID NO: 449908 - DNA, 140 bp, Artificial Sequence
  Synthetic
atggccgactcccaagtacgtggccccatcacagtccactgaatagtcaaaaacagcatccataaaaacccgtgttgtgaacactcccatgccaaactcctcaatctggaaagagttccaggagacccagcatggcgtat

SEQ ID NO: 449909 - DNA, 140 bp, Artificial Sequence
  Synthetic
atacgccatgctgggtctcctactgggtgcggctgtgaatgggaagaagagcgcgcatggatcgccaacattctggatgggaagtcatgaggtcaatggaacatggatgatgcacacactcgtacttgggagtcggccat

SEQ ID NO: 449910 - DNA, 140 bp, Artificial Sequence
  Synthetic
atggccgactcccaagtacgagtgtgtgcatcatccatgttccattgacctcatgacttcccatccagaatgttggcgatccatgcgcgctcttcttcccattcacagccgcacccagtaggagacccagcatggcgtat

SEQ ID NO: 449911 - DNA, 140 bp, Artificial Sequence
  Synthetic
atacgccatgctgggtctcctgagacccttgactataaagagtgtgaatggcccctgacacatactataggaacctcagtggaagagagtgacatgtttatgccccgttccattggaggccgtacttgggagtcggccat

SEQ ID NO: 449912 - DNA, 140 bp, Artificial Sequence
  Synthetic
atggccgactcccaagtacggcctccaatggaacggggcataaacatgtcactctcttccactgaggttcctatagtatgtgtcaggggccattcacactctttatagtcaagggtctcaggagacccagcatggcgtat

SEQ ID NO: 449913 - DNA, 140 bp, Artificial Sequence
  Synthetic
atacgccatgctgggtctccccagtgagttcccataatcacatcccaggctataaggttcagacgaatggaccatggatgcaagtccctctggaagtcagaagggagccatgcccagggacgtacttgggagtcggccat

SEQ ID NO: 449914 - DNA, 140 bp, Artificial Sequence
  Synthetic
atggccgactcccaagtacgtccctgggcatggctcccttctgacttccagagggacttgcatccatggtccattcgtctgaaccttatagcctgggatgtgattatgggaactcactggggagacccagcatggcgtat

SEQ ID NO: 449915 - DNA, 140 bp, Artificial Sequence
  Synthetic
atacgccatgctgggtctcccaagcgtggtggtggataccagttgtgatggacgtggcaaatcaaccagatcaactactgacagcgggaaaataattccagaatggtgctgcagatcttgcgtacttgggagtcggccat

SEQ ID NO: 449916 - DNA, 140 bp, Artificial Sequence
  Synthetic
atggccgactcccaagtacgcaagatctgcagcaccattctggaattattttcccgctgtcagtagttgatctggttgatttgccacgtccatcacaactggtatccaccaccacgcttgggagacccagcatggcgtat

SEQ ID NO: 449917 - DNA, 140 bp, Artificial Sequence
  Synthetic
atacgccatgctgggtctcccaccatgcccccagttagcttccacggcagcgatggctgctggtatcccatggaaattagacccatgaaaacccacgagagccatctggtgaggtcatggcgtacttgggagtcggccat

SEQ ID NO: 449918 - DNA, 140 bp, Artificial Sequence
  Synthetic
atggccgactcccaagtacgccatgacctcaccagatggctctcgtgggttttcatgggtctaatttccatgggataccagcagccatcgctgccgtggaagctaactgggggcatggtgggagacccagcatggcgtat

SEQ ID NO: 449919 - DNA, 140 bp, Artificial Sequence
  Synthetic
atacgccatgctgggtctccgtgaccgcaggagaagtgcatgcggtgccttttggattggtgagcatgatgattgccatggaggttgttctacgcaaaagacaagggccaaagcagatgccgtacttgggagtcggccat

SEQ ID NO: 449920 - DNA, 140 bp, Artificial Sequence
  Synthetic
atggccgactcccaagtacggcatctgctttggcccttgtcttttgcgtagaacaacctccatggcaatcatcatgctcaccaatccaaaaggcaccgcatgcacttctcctgcggtcacggagacccagcatggcgtat

SEQ ID NO: 449921 - DNA, 140 bp, Artificial Sequence
  Synthetic
atacgccatgctgggtctcctggtgggaggaattatactacttggagcaatgctagtgggacaagtcacgatgctagacctagtgaaactcattgtggcagtaggtttgcatttccatgacgtacttgggagtcggccat

SEQ ID NO: 449922 - DNA, 140 bp, Artificial Sequence
  Synthetic
atggccgactcccaagtacgtcatggaaatgcaaacctactgccacaatgagtttcactaggtctagcatcgtgacttgtcccactagcattgctccaagtagtataattcctcccaccaggagacccagcatggcgtat

SEQ ID NO: 449923 - DNA, 140 bp, Artificial Sequence
  Synthetic
atacgccatgctgggtctccgatcaacaatggaggagacgctatgtacatggccttgattgcgagcttttccattcgcccaggcttgctcataggttttggactgcgcacactctggagtcgtacttgggagtcggccat

SEQ ID NO: 449924 - DNA, 140 bp, Artificial Sequence
  Synthetic
atggccgactcccaagtacgactccagagtgtgcgcagtccaaaacctatgagcaagcctgggcgaatggaaaagctcgcaatcaaggccatgtacatagcgtctcctccattgttgatcggagacccagcatggcgtat

SEQ ID NO: 449925 - DNA, 140 bp, Artificial Sequence
  Synthetic
atacgccatgctgggtctcccctcgcgagcgtctcgtgatggcattcggagcggccatggtcgaagtggctttgggcgggatgatgggtggactgtggcagtacttgaatgccgtctcaccgtacttgggagtcggccat

SEQ ID NO: 449926 - DNA, 140 bp, Artificial Sequence
  Synthetic
atggccgactcccaagtacggtgagacggcattcaagtactgccacagtccacccatcatcccgcccaaagccacttcgaccatggccgctccgaatgccatcacgagacgctcgcgaggggagacccagcatggcgtat

SEQ ID NO: 449927 - DNA, 140 bp, Artificial Sequence
  Synthetic
atacgccatgctgggtctcctgtgcgtcctcaccatcaatgcaatttcttcaaggaaggcttcaaatacgatccttcccctgatggcactcttaactcctgtgacaatgtatgaagtaagcgtacttgggagtcggccat

SEQ ID NO: 449928 - DNA, 140 bp, Artificial Sequence
  Synthetic
atggccgactcccaagtacgcttacttcatacattgtcacaggagttaagagtgccatcaggggaaggatcgtatttgaagccttccttgaagaaattgcattgatggtgaggacgcacaggagacccagcatggcgtat

SEQ ID NO: 449929 - DNA, 140 bp, Artificial Sequence
  Synthetic
atacgccatgctgggtctccaatggcaacaatgctgttctgtacagtggtcatagtgggggtgcttcaccagaactcaaaagacacgtccatgcagaaaaccattcccattgtggctctgcgtacttgggagtcggccat

SEQ ID NO: 449930 - DNA, 140 bp, Artificial Sequence
  Synthetic
atggccgactcccaagtacgcagagccacaatgggaatggttttctgcatggacgtgtcttttgagttctggtgaagcacccccactatgaccactgtacagaacagcattgttgccattggagacccagcatggcgtat

SEQ ID NO: 449931 - DNA, 140 bp, Artificial Sequence
  Synthetic
atacgccatgctgggtctccacactgacctcatacatgggcttaactcaacctttccttgggctgtgtgcctatatgtccacacaagtatttggcagaagaagcattcctgtgaatgaagcgtacttgggagtcggccat

SEQ ID NO: 449932 - DNA, 140 bp, Artificial Sequence
  Synthetic
atggccgactcccaagtacgcttcattcacaggaatgcttcttctgccaaatacttgtgtggacatataggcacacagcccaaggaaaggttgagttaagcccatgtatgaggtcagtgtggagacccagcatggcgtat

SEQ ID NO: 449933 - DNA, 140 bp, Artificial Sequence
  Synthetic
atacgccatgctgggtctccctcttgcagcagctggcctggtgggagtactggcaggtctagcctttcaagacatggaaaatttcttagggccgattgccgtgggtggaatactcatgatcgtacttgggagtcggccat

SEQ ID NO: 449934 - DNA, 140 bp, Artificial Sequence
  Synthetic
atggccgactcccaagtacgatcatgagtattccacccacggcaatcggccctaagaaattttccatgtcttgaaaggctagacctgccagtactcccaccaggccagctgctgcaagagggagacccagcatggcgtat

SEQ ID NO: 449935 - DNA, 140 bp, Artificial Sequence
  Synthetic
aggccctggctgctgatatggacatggaaaatttcttagggccgattgccgtgggtggaatactcatgatgctggtcagtgtggcagggaaagttgatggattggaactcaaaaagcttggaccttttgggacagcggtg

SEQ ID NO: 449936 - DNA, 140 bp, Artificial Sequence
  Synthetic
caccgctgtcccaaaaggtccaagctttttgagttccaatccatcaactttccctgccacactgaccagcatcatgagtattccacccacggcaatcggccctaagaaattttccatgtccatatcagcagccagggcct

SEQ ID NO: 449937 - DNA, 140 bp, Artificial Sequence
  Synthetic
atacgccatgctgggtctccgtgaggtttcctgggaggaggaggctgagataagtggaagctccagccgctacgatgtggcactaagtgaacagggagaattcaagctcctctcagaggacgtacttgggagtcggccat

SEQ ID NO: 449938 - DNA, 140 bp, Artificial Sequence
  Synthetic
atggccgactcccaagtacgtcctctgagaggagcttgaattctccctgttcacttagtgccacatcgtagcggctggagcttccacttatctcagcctcctcctcccaggaaacctcacggagacccagcatggcgtat

SEQ ID NO: 449939 - DNA, 140 bp, Artificial Sequence
  Synthetic
atacgccatgctgggtctcccaaagtaccctgggatcagattgtcatgacttccttggctcttgtaggggcagcgatacatccatttgctctactactggttttaggaggttgggtcctacgtacttgggagtcggccat

SEQ ID NO: 449940 - DNA, 140 bp, Artificial Sequence
  Synthetic
atggccgactcccaagtacgtaggacccaacctcctaaaaccagtagtagagcaaatggatgtatcgctgcccctacaagagccaaggaagtcatgacaatctgatcccagggtactttgggagacccagcatggcgtat

SEQ ID NO: 449941 - DNA, 140 bp, Artificial Sequence
  Synthetic
atacgccatgctgggtctcccacattaaaggagctaggaggagcggggatgttctttgggacattcccacaccaaaagtcatcgaggaatgtgaacatctggaggatggaatttatggcacgtacttgggagtcggccat

SEQ ID NO: 449942 - DNA, 140 bp, Artificial Sequence
  Synthetic
atggccgactcccaagtacgtgccataaattccatcctccagatgttcacattcctcgatgacttttggtgtgggaatgtcccaaagaacatccccgctcctcctagctcctttaatgtgggagacccagcatggcgtat

SEQ ID NO: 449943 - DNA, 140 bp, Artificial Sequence
  Synthetic
atacgccatgctgggtctcctattccaatcaaccttccttggagcctcccagagaggagtcggagtggcccaagggggtgtcttccacacgatgtggcatgtcaccagaggagcgtttctcgtacttgggagtcggccat

SEQ ID NO: 449944 - DNA, 140 bp, Artificial Sequence
  Synthetic
atggccgactcccaagtacgagaaacgctcctctggtgacatgccacatcgtgtggaagacacccccttgggccactccgactcctctctgggaggctccaaggaaggttgattggaataggagacccagcatggcgtat

SEQ ID NO: 449945 - DNA, 140 bp, Artificial Sequence
  Synthetic
atacgccatgctgggtctcccttgaggaacgggaaaaagctagtaccatcttgggcctctgtgaaggaggatttggtggcctatggtggatcttggaagctagatggaaagtgggatggtcgtacttgggagtcggccat

SEQ ID NO: 449946 - DNA, 140 bp, Artificial Sequence
  Synthetic
atggccgactcccaagtacgaccatcccactttccatctagcttccaagatccaccataggccaccaaatcctccttcacagaggcccaagatggtactagctttttcccgttcctcaagggagacccagcatggcgtat

SEQ ID NO: 449947 - DNA, 140 bp, Artificial Sequence
  Synthetic
atacgccatgctgggtctccgaggaagaggtccaacttatcgctgctgtgccaggaaaagccgttgtcaatgtgcaaaccaagccaagtttgttcaaagtcagaaatggaggtgagattgcgtacttgggagtcggccat

SEQ ID NO: 449948 - DNA, 140 bp, Artificial Sequence
  Synthetic
atggccgactcccaagtacgcaatctcacctccatttctgactttgaacaaacttggcttggtttgcacattgacaacggcttttcctggcacagcagcgataagttggacctcttcctcggagacccagcatggcgtat

SEQ ID NO: 449949 - DNA, 140 bp, Artificial Sequence
  Synthetic
atacgccatgctgggtctccgggcagttgccttggattatcccagcgggacctctggttcacccattgtaaatcgcagtggtgaagtggtgggactctatggtaatggaatcctggtcggcgtacttgggagtcggccat

SEQ ID NO: 449950 - DNA, 140 bp, Artificial Sequence
  Synthetic
atggccgactcccaagtacgccgaccaggattccattaccatagagtcccaccacttcaccactgcgatttacaatgggtgaaccagaggtcccgctgggataatccaaggcaactgcccggagacccagcatggcgtat

SEQ ID NO: 449951 - DNA, 140 bp, Artificial Sequence
  Synthetic
atacgccatgctgggtctcctgacaattcctttgtgtctgccatctcacaaactgaggtgaaagaggaatctaaagaggaactgcaggaaataccaacaatgttgaagaaaggaatgacacgtacttgggagtcggccat

SEQ ID NO: 449952 - DNA, 140 bp, Artificial Sequence
  Synthetic
atggccgactcccaagtacgtgtcattcctttcttcaacattgttggtatttcctgcagttcctctttagattcctctttcacctcagtttgtgagatggcagacacaaaggaattgtcaggagacccagcatggcgtat

SEQ ID NO: 449953 - DNA, 140 bp, Artificial Sequence
  Synthetic
atacgccatgctgggtctccaccatacttgatttccatcccggtgcggggaaaacccgcaggtttttgccccaaatactggccgagtgcgccaggaggcgcctacgaacacttgttctggcgtacttgggagtcggccat

SEQ ID NO: 449954 - DNA, 140 bp, Artificial Sequence
  Synthetic
atggccgactcccaagtacgccagaacaagtgttcgtaggcgcctcctggcgcactcggccagtatttggggcaaaaacctgcgggttttccccgcaccgggatggaaatcaagtatggtggagacccagcatggcgtat

SEQ ID NO: 449955 - DNA, 140 bp, Artificial Sequence
  Synthetic
atacgccatgctgggtctcccgcctactcgggttgtcctgtcagagatgaaggaggcctttcatggacttgatgtgaagttccacacacaggctttctcagctcatgggagtgggaaagacgtacttgggagtcggccat

SEQ ID NO: 449956 - DNA, 140 bp, Artificial Sequence
  Synthetic
atggccgactcccaagtacgtctttcccactcccatgagctgagaaagcctgtgtgtggaacttcacatcaagtccatgaaaggcctccttcatctctgacaggacaacccgagtaggcgggagacccagcatggcgtat

SEQ ID NO: 449957 - DNA, 140 bp, Artificial Sequence
  Synthetic
atacgccatgctgggtctccagtcattgatgcaatgtgccacgcaactctcacgtacaggatgctagaaccaacaagagttgtcaactgggaagtcattatcatggatgaggctcattttcgtacttgggagtcggccat

SEQ ID NO: 449958 - DNA, 140 bp, Artificial Sequence
  Synthetic
atggccgactcccaagtacgaaaatgagcctcatccatgataatgacttcccagttgacaactcttgttggttctagcatcctgtacgtgagagttgcgtggcacattgcatcaatgactggagacccagcatggcgtat

SEQ ID NO: 449959 - DNA, 140 bp, Artificial Sequence
  Synthetic
atacgccatgctgggtctccttggatcctgccagtatcgcagcgaggggctgggcagcccacagggcgagagcaaacgaaagtgccacaatactcatgacagctactccgccaggcacaacgtacttgggagtcggccat

SEQ ID NO: 449960 - DNA, 140 bp, Artificial Sequence
  Synthetic
atggccgactcccaagtacgttgtgcctggcggagtagctgtcatgagtattgtggcactttcgtttgctctcgccctgtgggctgcccagcccctcgctgcgatactggcaggatccaaggagacccagcatggcgtat

SEQ ID NO: 449961 - DNA, 140 bp, Artificial Sequence
  Synthetic
atacgccatgctgggtctccacgaccaacagcatggtttcttccatcgatcagagctgcaaatgtcatggccgcctccctgcgcaaagcggggaaaaatgtggtggtgttgaacaggaagcgtacttgggagtcggccat

SEQ ID NO: 449962 - DNA, 140 bp, Artificial Sequence
  Synthetic
atggccgactcccaagtacgcttcctgttcaacaccaccacatttttccccgctttgcgcagggaggcggccatgacatttgcagctctgatcgatggaagaaaccatgctgttggtcgtggagacccagcatggcgtat

SEQ ID NO: 449963 - DNA, 140 bp, Artificial Sequence
  Synthetic
atacgccatgctgggtctccacctttgaaaaggaataccccaccatcaaacaaaagaggccggatttcatcctggccacagacattgccgagatgggagcgaacctgtgcgttgagagagcgtacttgggagtcggccat

SEQ ID NO: 449964 - DNA, 140 bp, Artificial Sequence
  Synthetic
atggccgactcccaagtacgctctctcaacgcacaggttcgctcccatctcggcaatgtctgtggccaggatgaaatccggcctcttttgtttgatggtggggtattccttttcaaaggtggagacccagcatggcgtat

SEQ ID NO: 449965 - DNA, 140 bp, Artificial Sequence
  Synthetic
atacgccatgctgggtctcctgctagattgtaggactgcatacaaacctgtcctggtggatgaagggagaaaggtagccatcaaagggccgctacggatttccgcatcatcggctgcccacgtacttgggagtcggccat

SEQ ID NO: 449966 - DNA, 140 bp, Artificial Sequence
  Synthetic
atggccgactcccaagtacgtgggcagccgatgatgcggaaatccgtagcggccctttgatggctacctttctcccttcatccaccaggacaggtttgtatgcagtcctacaatctagcaggagacccagcatggcgtat

SEQ ID NO: 449967 - DNA, 140 bp, Artificial Sequence
  Synthetic
atacgccatgctgggtctccgagaagaggacgcattggacggaatccaaacagggatggtgattcctattactactcagaacccactagtgaggataacgcccatcatgtgtgttggctacgtacttgggagtcggccat

SEQ ID NO: 449968 - DNA, 140 bp, Artificial Sequence
  Synthetic
atggccgactcccaagtacgtagccaacacacatgatgggcgttatcctcactagtgggttctgagtagtaataggaatcaccatccctgtttggattccgtccaatgcgtcctcttctcggagacccagcatggcgtat

SEQ ID NO: 449969 - DNA, 140 bp, Artificial Sequence
  Synthetic
atacgccatgctgggtctccgaagcttccatgcttcttgataacatggaagttagaggaggaatggttgctccgctctatggaattgaagggacaaagacccctgtctcccctggggagacgtacttgggagtcggccat

SEQ ID NO: 449970 - DNA, 140 bp, Artificial Sequence
  Synthetic
atggccgactcccaagtacgtctccccaggggagacaggggtctttgtcccttcaattccatagagcggagcaaccattcctcctctaacttccatgttatcaagaagcatggaagcttcggagacccagcatggcgtat

SEQ ID NO: 449971 - DNA, 140 bp, Artificial Sequence
  Synthetic
atacgccatgctgggtctcctgaggctaagagatgatcaaagaagagtcttcagggagttggtgcgtggatgtgacttaccagtttggttatcctggcaggtggcaaaagctggtctaaacgtacttgggagtcggccat

SEQ ID NO: 449972 - DNA, 140 bp, Artificial Sequence
  Synthetic
atggccgactcccaagtacgtttagaccagcttttgccacctgccaggataaccaaactggtaagtcacatccacgcaccaactccctgaagactcttctttgatcatctcttagcctcaggagacccagcatggcgtat

SEQ ID NO: 449973 - DNA, 140 bp, Artificial Sequence
  Synthetic
atacgccatgctgggtctccaaccaatgaccgcaagtggtgctttgaaggacccgaagagcacgagatacttaatgacaacggtgaaactgtgaagtgcaggtcccccggtggagcaaaacgtacttgggagtcggccat

SEQ ID NO: 449974 - DNA, 140 bp, Artificial Sequence
  Synthetic
atggccgactcccaagtacgttttgctccaccgggggacctgcacttcacagtttcaccgttgtcattaagtatctcgtgctcttcgggtccttcaaagcaccacttgcggtcattggttggagacccagcatggcgtat

SEQ ID NO: 449975 - DNA, 140 bp, Artificial Sequence
  Synthetic
atacgccatgctgggtctccaaggcactgagacccagatggtgtgatgaaagagtgtcctcagatcaaagtgctttggctgatttcatcaaatttgccgaaggtagaagaggggctgctgcgtacttgggagtcggccat

SEQ ID NO: 449976 - DNA, 140 bp, Artificial Sequence
  Synthetic
atggccgactcccaagtacgcagcagcccctcttctaccttcggcaaatttgatgaaatcagccaaagcactttgatctgaggacactctttcatcacaccatctgggtctcagtgccttggagacccagcatggcgtat

SEQ ID NO: 449977 - DNA, 140 bp, Artificial Sequence
  Synthetic
atacgccatgctgggtctccagatgcttgtggttctcacggaactgcctgacttcttggcgaaaaaaggaggggaggccatggacaccataagtgtgtttcttcattctgaggaggggtccgtacttgggagtcggccat

SEQ ID NO: 449978 - DNA, 140 bp, Artificial Sequence
  Synthetic
atggccgactcccaagtacggacccctcctcagaatgaagaaacacacttatggtgtccatggcctcccctccttttttcgccaagaagtcaggcagttccgtgagaaccacaagcatctggagacccagcatggcgtat

SEQ ID NO: 449979 - DNA, 140 bp, Artificial Sequence
  Synthetic
atacgccatgctgggtctccgagagcttacagaaatgctctgtcaatgatgcctgaagccatgaccatcgtgatgcttttcatactggctggtctcttgacctcaggaatggtgattttccgtacttgggagtcggccat

SEQ ID NO: 449980 - DNA, 140 bp, Artificial Sequence
  Synthetic
atggccgactcccaagtacggaaaatcaccattcctgaggtcaagagaccagccagtatgaaaagcatcacgatggtcatggcttcaggcatcattgacagagcatttctgtaagctctcggagacccagcatggcgtat

SEQ ID NO: 449981 - DNA, 140 bp, Artificial Sequence
  Synthetic
atacgccatgctgggtctccttcatgtcgcccaaaggtatgagtagaatgtctatggcaatggggactatggctggcagcgggtacctcatgttcctagggggagtgaaaccaacacacacgtacttgggagtcggccat

SEQ ID NO: 449982 - DNA, 140 bp, Artificial Sequence
  Synthetic
atggccgactcccaagtacgtgtgtgttggtttcactccccctaggaacatgaggtacccgctgccagccatagtccccattgccatagacattctactcatacctttgggcgacatgaaggagacccagcatggcgtat

SEQ ID NO: 449983 - DNA, 140 bp, Artificial Sequence
  Synthetic
atacgccatgctgggtctcctctcatatgtcatgctgatcttttttgtcctcatggtcgtcataattccagagccaggacaacagaggtccatccaggacaaccaagtggcctatcttatcgtacttgggagtcggccat

SEQ ID NO: 449984 - DNA, 140 bp, Artificial Sequence
  Synthetic
atggccgactcccaagtacgataagataggccacttggttgtcctggatggacctctgttgtcctggctctggaattatgacgaccatgaggacaaaaaagatcagcatgacatatgagaggagacccagcatggcgtat

SEQ ID NO: 449985 - DNA, 140 bp, Artificial Sequence
  Synthetic
atacgccatgctgggtctcccattggaatactcacattgctgtctgtcgtggcagctaatgagctagggatgttggaaaagaccaaagaagatttttttggaaaaaggaatattgcaacacgtacttgggagtcggccat

SEQ ID NO: 449986 - DNA, 140 bp, Artificial Sequence
  Synthetic
atggccgactcccaagtacgtgttgcaatattcctttttccaaaaaaatcttctttggtcttttccaacatccctagctcattagctgccacgacagacagcaatgtgagtattccaatgggagacccagcatggcgtat

SEQ ID NO: 449987 - DNA, 140 bp, Artificial Sequence
  Synthetic
atacgccatgctgggtctcctaacagtgatcccccttctatgtggtgtgggtggagctatgctgcattggacactgattcttcctggaatcaaagcccagcagtcaaaactagcacaaaacgtacttgggagtcggccat

SEQ ID NO: 449988 - DNA, 140 bp, Artificial Sequence
  Synthetic
atggccgactcccaagtacgttttgtgctagttttgactgctgggctttgattccaggaagaatcagtgtccaatgcagcatagctccacccacaccacatagaagggggatcactgttaggagacccagcatggcgtat

SEQ ID NO: 449989 - DNA, 140 bp, Artificial Sequence
  Synthetic
atacgccatgctgggtctccaagagtttttcatggagtggcaaaaaatccggttgttgatggtaatccaaccgctgacattgaagaagcacctgaaatgcctgccctgtacgagaagaaacgtacttgggagtcggccat

SEQ ID NO: 449990 - DNA, 140 bp, Artificial Sequence
  Synthetic
atggccgactcccaagtacgtttcttctcgtacagggcaggcatttcaggtgcttcttcaatgtcagcggttggattaccatcaacaaccggattttttgccactccatgaaaaactcttggagacccagcatggcgtat

SEQ ID NO: 449991 - DNA, 140 bp, Artificial Sequence
  Synthetic
atacgccatgctgggtctccttggcactgtaccttctcctcgccttgagccttatgtcagtagccatgtgccgaacccctttttccttagcggagggaatagtattgtcatccgctgctccgtacttgggagtcggccat

SEQ ID NO: 449992 - DNA, 140 bp, Artificial Sequence
  Synthetic
atggccgactcccaagtacggagcagcggatgacaatactattccctccgctaaggaaaaaggggttcggcacatggctactgacataaggctcaaggcgaggagaaggtacagtgccaaggagacccagcatggcgtat

SEQ ID NO: 449993 - DNA, 140 bp, Artificial Sequence
  Synthetic
atacgccatgctgggtctcctagggcccctgatagagggaaacacaagcctgctgtggaatggtcctatggccgtttccatgactggggttatgcgcggcaattactatgcttttgtgggcgtacttgggagtcggccat

SEQ ID NO: 449994 - DNA, 140 bp, Artificial Sequence
  Synthetic
atggccgactcccaagtacgcccacaaaagcatagtaattgccgcgcataaccccagtcatggaaacggccataggaccattccacagcaggcttgtgtttccctctatcaggggccctaggagacccagcatggcgtat

SEQ ID NO: 449995 - DNA, 140 bp, Artificial Sequence
  Synthetic
atacgccatgctgggtctcctgtgatgtataacctctggaagatgaagacagggcgtagagggagtgcaaatggcaagacactgggtgaggtttggaagagggaactcaacctgctagaccgtacttgggagtcggccat

SEQ ID NO: 449996 - DNA, 140 bp, Artificial Sequence
  Synthetic
atggccgactcccaagtacggtctagcaggttgagttccctcttccaaacctcacccagtgtcttgccatttgcactccctctacgccctgtcttcatcttccagaggttatacatcacaggagacccagcatggcgtat

SEQ ID NO: 449997 - DNA, 140 bp, Artificial Sequence
  Synthetic
atacgccatgctgggtctccaaacagcaatttgagctgtataagagaacagatatcaccgaggtggatcgcgacatggctagacgacatttggccgaggggaaggtggacactggagtggcgtacttgggagtcggccat

SEQ ID NO: 449998 - DNA, 140 bp, Artificial Sequence
  Synthetic
atggccgactcccaagtacgccactccagtgtccaccttcccctcggccaaatgtcgtctagccatgtcgcgatccacctcggtgatatctgttctcttatacagctcaaattgctgtttggagacccagcatggcgtat

SEQ ID NO: 449999 - DNA, 140 bp, Artificial Sequence
  Synthetic
atacgccatgctgggtctccctgtgtcgagggggacagcgaagctgaggtggttccacgagcgtggctatgtaaagctggaaggaagggtcatggatttgggatgtggacgtggaggttgcgtacttgggagtcggccat

SEQ ID NO: 450000 - DNA, 140 bp, Artificial Sequence
  Synthetic
atggccgactcccaagtacgcaacctccacgtccacatcccaaatccatgacccttccttccagctttacatagccacgctcgtggaaccacctcagcttcgctgtccccctcgacacagggagacccagcatggcgtat

SEQ ID NO: 450001 - DNA, 140 bp, Artificial Sequence
  Synthetic
atacgccatgctgggtctccgtgctactacgcagcagctcagaaagaggtcagcggtgtgaaaggttacactttgggcagagatggccatgaaaagcccatgaatgtacaaagcttaggacgtacttgggagtcggccat

SEQ ID NO: 450002 - DNA, 140 bp, Artificial Sequence
  Synthetic
atggccgactcccaagtacgtcctaagctttgtacattcatgggcttttcatggccatctctgcccaaagtgtaacctttcacaccgctgacctctttctgagctgctgcgtagtagcacggagacccagcatggcgtat

SEQ ID NO: 450003 - DNA, 140 bp, Artificial Sequence
  Synthetic
atacgccatgctgggtctcctggaacattgtgaccttcaaggataagactgacatccacagactagagccagccaagtgtgaaactctcctttgtgacatcggggagtcctcgccttcttcgtacttgggagtcggccat

SEQ ID NO: 450004 - DNA, 140 bp, Artificial Sequence
  Synthetic
atggccgactcccaagtacgaagaaggcgaggactccccgatgtcacaaaggagagtttcacacttggctggctctagtctgtggatgtcagtcttatccttgaaggtcacaatgttccaggagacccagcatggcgtat

SEQ ID NO: 450005 - DNA, 140 bp, Artificial Sequence
  Synthetic
atacgccatgctgggtctccccgtaaccgagggtgagaggactttgagagttcttgaaacagttgaaaagtggctggcttgtggagtggacaatttttgtgtcaaggttctggcaccatacgtacttgggagtcggccat

SEQ ID NO: 450006 - DNA, 140 bp, Artificial Sequence
  Synthetic
atggccgactcccaagtacgtatggtgccagaaccttgacacaaaaattgtccactccacaagccagccacttttcaactgtttcaagaactctcaaagtcctctcaccctcggttacggggagacccagcatggcgtat

SEQ ID NO: 450007 - DNA, 140 bp, Artificial Sequence
  Synthetic
atacgccatgctgggtctcccatgcctgatgtgatagagaaattggaacttcttcaaaggagatttggtggaactgtcattaggaatcccctttccagaaattcaacccatgagatgtaccgtacttgggagtcggccat

SEQ ID NO: 450008 - DNA, 140 bp, Artificial Sequence
  Synthetic
atggccgactcccaagtacggtacatctcatgggttgaatttctggaaaggggattcctaatgacagttccaccaaatctcctttgaagaagttccaatttctctatcacatcaggcatgggagacccagcatggcgtat

SEQ ID NO: 450009 - DNA, 140 bp, Artificial Sequence
  Synthetic
atacgccatgctgggtctcctatgtgtcaggagcaagaagtaacatcaccttcacggtcaaccaaacatcacgtctactgatgaggagaatgagacgaccaacaggcaaagtcaccttggcgtacttgggagtcggccat

SEQ ID NO: 450010 - DNA, 140 bp, Artificial Sequence
  Synthetic
atggccgactcccaagtacgccaaggtgactttgcctgttggtcgtctcattctcctcatcagtagacgtgatgtttggttgaccgtgaaggtgatgttacttcttgctcctgacacataggagacccagcatggcgtat

SEQ ID NO: 450011 - DNA, 140 bp, Artificial Sequence
  Synthetic
atacgccatgctgggtctccagcccgatgtaatcctccccataggcacacgcagtgtggaaactgataagggacccctggataggggtgctattgaagagagggttgagaggatcaagaccgtacttgggagtcggccat

SEQ ID NO: 450012 - DNA, 140 bp, Artificial Sequence
  Synthetic
atggccgactcccaagtacggtcttgatcctctcaaccctctcttcaatagcacccctatccaggggtcccttatcagtttccacactgcgtgtgcctatggggaggattacatcgggctggagacccagcatggcgtat

SEQ ID NO: 450013 - DNA, 140 bp, Artificial Sequence
  Synthetic
atacgccatgctgggtctcctgagtatgccgcaacatggtttcatgacaatgacaacccgtaccggacctggcactattgcggctcatacattaccaagacatcaggcagtgcagccagccgtacttgggagtcggccat

SEQ ID NO: 450014 - DNA, 140 bp, Artificial Sequence
  Synthetic
atggccgactcccaagtacggctggctgcactgcctgatgtcttggtaatgtatgagccgcaatagtgccaggtccggtacgggttgtcattgtcatgaaaccatgttgcggcatactcaggagacccagcatggcgtat

SEQ ID NO: 450015 - DNA, 140 bp, Artificial Sequence
  Synthetic
atacgccatgctgggtctccatgataaatggagtcatcaaaattttgaccttcccatgggacaggatagaagaggtcaccagaatggcaatgactgacaccacgccttttggccaacaaacgtacttgggagtcggccat

SEQ ID NO: 450016 - DNA, 140 bp, Artificial Sequence
  Synthetic
atggccgactcccaagtacgtttgttggccaaaaggcgtggtgtcagtcattgccattctggtgacctcttctatcctgtcccatgggaaggtcaaaattttgatgactccatttatcatggagacccagcatggcgtat

SEQ ID NO: 450017 - DNA, 140 bp, Artificial Sequence
  Synthetic
atacgccatgctgggtctccgagtcttcaaggaaaaggtggacacgagggccaaagaccctcctgctggaaccaggaagatcatgagggtggtaaaccgatggttgtttcgacacctagccgtacttgggagtcggccat

SEQ ID NO: 450018 - DNA, 140 bp, Artificial Sequence
  Synthetic
atggccgactcccaagtacggctaggtgtcgaaacaaccatcggtttaccaccctcatgatcttcctggttccagcaggagggtctttggccctcgtgtccaccttttccttgaagactcggagacccagcatggcgtat

SEQ ID NO: 450019 - DNA, 140 bp, Artificial Sequence
  Synthetic
atacgccatgctgggtctcctcgggaaaagaaacccaggttgtgcacaaaggaagagttcatagccaaggtgcgcagtcatgctgcgataggggccttcttagaggagcaggagcaatggcgtacttgggagtcggccat

SEQ ID NO: 450020 - DNA, 140 bp, Artificial Sequence
  Synthetic
atggccgactcccaagtacgccattgctcctgctcctctaagaaggcccctatcgcagcatgactgcgcaccttggctatgaactcttcctttgtgcacaacctgggtttcttttcccgaggagacccagcatggcgtat

SEQ ID NO: 450021 - DNA, 140 bp, Artificial Sequence
  Synthetic
atacgccatgctgggtctccaagacagccaatgaagcagtccaagaccccaagttttgggagatggttgacgctgagcgcaagctccatcaacaggggcggtgccagtcttgtgtctatacgtacttgggagtcggccat

SEQ ID NO: 450022 - DNA, 140 bp, Artificial Sequence
  Synthetic
atggccgactcccaagtacgtatagacacaagactggcaccgcccctgttgatggagcttgcgctcagcgtcaaccatctcccaaaacttggggtcttggactgcttcattggctgtcttggagacccagcatggcgtat

SEQ ID NO: 450023 - DNA, 140 bp, Artificial Sequence
  Synthetic
atacgccatgctgggtctccacatgatgggaaagagagagaaaaaattatctgaatttggtaaagcaaaaggaagccgtgccatctggtacatgtggctgggggcgcgtttcctcgagttcgtacttgggagtcggccat

SEQ ID NO: 450024 - DNA, 140 bp, Artificial Sequence
  Synthetic
atggccgactcccaagtacgaactcgaggaaacgcgcccccagccacatgtaccagatggcacggcttccttttgctttaccaaattcagataattttttctctctctttcccatcatgtggagacccagcatggcgtat

SEQ ID NO: 450025 - DNA, 140 bp, Artificial Sequence
  Synthetic
atacgccatgctgggtctcctgaagctcttgggttcctgaatgaagaccactgggcatccagagagaattcaggaggaggtgttgaaggcataggactccaatatctaggctatgtaatccgtacttgggagtcggccat

SEQ ID NO: 450026 - DNA, 140 bp, Artificial Sequence
  Synthetic
atggccgactcccaagtacggattacatagcctagatattggagtcctatgccttcaacacctcctcctgaattctctctggatgcccagtggtcttcattcaggaacccaagagcttcaggagacccagcatggcgtat

SEQ ID NO: 450027 - DNA, 140 bp, Artificial Sequence
  Synthetic
atacgccatgctgggtctccaaggacctatccaccaaagaagggggaggattctatgctgatgacacagcaggatgggacacacgtatcacggaagctgacctagacgatgagcaggagacgtacttgggagtcggccat

SEQ ID NO: 450028 - DNA, 140 bp, Artificial Sequence
  Synthetic
atggccgactcccaagtacgtctcctgctcatcgtctaggtcagcttccgtgatacgtgtgtcccatcctgctgtgtcatcagcatagaatcctcccccttctttggtggataggtccttggagacccagcatggcgtat

SEQ ID NO: 450029 - DNA, 140 bp, Artificial Sequence
  Synthetic
atacgccatgctgggtctccaggcaaggctttcatggacatcatcagtaggagagatcaaaggggatcagggcaagttgtgacatatgcccttaacaccatcaccaatctgaaagttcagcgtacttgggagtcggccat

SEQ ID NO: 450030 - DNA, 140 bp, Artificial Sequence
  Synthetic
atggccgactcccaagtacgctgaactttcagattggtgatggtgttaagggcatatgtcacaacttgccctgatcccctttgatctctcctactgatgatgtccatgaaagccttgcctggagacccagcatggcgtat

SEQ ID NO: 450031 - DNA, 140 bp, Artificial Sequence
  Synthetic
atacgccatgctgggtctccctcataaggatggctgaagctgagatggtaatcaaccaccagcacgtgaatgaatgtgacgagagcgctttggcacggctagacgcgtggctcgctgaaacgtacttgggagtcggccat

SEQ ID NO: 450032 - DNA, 140 bp, Artificial Sequence
  Synthetic
atggccgactcccaagtacgtttcagcgagccacgcgtctagccgtgccaaagcgctctcgtcacattcattcacgtgctggtggttgattaccatctcagcttcagccatccttatgagggagacccagcatggcgtat

SEQ ID NO: 450033 - DNA, 140 bp, Artificial Sequence
  Synthetic
atacgccatgctgggtctccatggatgtgacagacttgcccggatggctgtgagtggagatgattgtgtcgtgaagcctgtggatgacagatttggcttggctctttctcatctcaatgccgtacttgggagtcggccat

SEQ ID NO: 450034 - DNA, 140 bp, Artificial Sequence
  Synthetic
atggccgactcccaagtacggcattgagatgagaaagagccaagccaaatctgtcatccacaggcttcacgacacaatcatctccactcacagccatccgggcaagtctgtcacatccatggagacccagcatggcgtat

SEQ ID NO: 450035 - DNA, 140 bp, Artificial Sequence
  Synthetic
atacgccatgctgggtctcccatgtcaaaagttaggaaggacatctcagaatggcagccctccaaagggtggacagactgggaaagtgtcccattctgctcccatcatttccatgaacttcgtacttgggagtcggccat

SEQ ID NO: 450036 - DNA, 140 bp, Artificial Sequence
  Synthetic
atggccgactcccaagtacgaagttcatggaaatgatgggagcagaatgggacactttcccagtctgtccaccctttggagggctgccattctgagatgtccttcctaacttttgacatgggagacccagcatggcgtat

SEQ ID NO: 450037 - DNA, 140 bp, Artificial Sequence
  Synthetic
atacgccatgctgggtctccgtgttgaaagatggaaggaaagttgtggtgccctgtagagaccaagatgagttaataggaagagggagagtgtctccaggaaatggctggatgatcaaagcgtacttgggagtcggccat

SEQ ID NO: 450038 - DNA, 140 bp, Artificial Sequence
  Synthetic
atggccgactcccaagtacgctttgatcatccagccatttcctggagacactctccctcttcctattaactcatcttggtctctacagggcaccacaactttccttccatctttcaacacggagacccagcatggcgtat

SEQ ID NO: 450039 - DNA, 140 bp, Artificial Sequence
  Synthetic
atacgccatgctgggtctccagacagcttgccttagcaaggcttatgcgaacatgtggtcactgatgtatttccacaagagagacatgaggctactctcattcgctgtctcatctgccgtcgtacttgggagtcggccat

SEQ ID NO: 450040 - DNA, 140 bp, Artificial Sequence
  Synthetic
atggccgactcccaagtacgacggcagatgagacagcgaatgagagtagcctcatgtctctcttgtggaaatacatcagtgaccacatgttcgcataagccttgctaaggcaagctgtctggagacccagcatggcgtat

SEQ ID NO: 450041 - DNA, 140 bp, Artificial Sequence
  Synthetic
atacgccatgctgggtctcctccaacggcatgggtacccagtggaagaacaacatggtctgttcatggaaaaggagagtggatgaccactgaggacatgttagacgtctggaacagggttcgtacttgggagtcggccat

SEQ ID NO: 450042 - DNA, 140 bp, Artificial Sequence
  Synthetic
atggccgactcccaagtacgaaccctgttccagacgtctaacatgtcctcagtggtcatccactctccttttccatgaacagaccatgttgttcttccactgggtacccatgccgttggaggagacccagcatggcgtat

SEQ ID NO: 450043 - DNA, 140 bp, Artificial Sequence
  Synthetic
atacgccatgctgggtctcctgggtattaaataacccacacatgaaggacaagactactgtaaaggagtggagggatgttccttaccttacaaaaagacaagacaaactttgtgggtccccgtacttgggagtcggccat

SEQ ID NO: 450044 - DNA, 140 bp, Artificial Sequence
  Synthetic
atggccgactcccaagtacggggacccacaaagtttgtcttgtctttttgtaaggtaaggaacatccctccactcctttacagtagtcttgtccttcatgtgtgggttatttaatacccaggagacccagcatggcgtat

SEQ ID NO: 450045 - DNA, 140 bp, Artificial Sequence
  Synthetic
atacgccatgctgggtctcctgatagggatgacaaacagggccacatgggcctcacacatccacctggtgatccaccgaatccggaacttaatcggccaagaaaaatacacagattacctcgtacttgggagtcggccat

SEQ ID NO: 450046 - DNA, 140 bp, Artificial Sequence
  Synthetic
atggccgactcccaagtacgaggtaatctgtgtatttttcttggccgattaagttccggattcggtggatcaccaggtggatgtgtgaggcccatgtggccctgtttgtcatccctatcaggagacccagcatggcgtat

SEQ ID NO: 450047 - DNA, 140 bp, Artificial Sequence
  Synthetic
atacgccatgctgggtctcccactgtgatggacaggtactctgttgatgctgacctccaaccaggagagctcatctgatacctgccattgcaaaaacaaccgggataaaaactacgggtgcgtacttgggagtcggccat

SEQ ID NO: 450048 - DNA, 140 bp, Artificial Sequence
  Synthetic
atggccgactcccaagtacgcacccgtagtttttatcccggttgtttttgcaatggcaggtatcagatgagctctcctggttggaggtcagcatcaacagagtacctgtccatcacagtgggagacccagcatggcgtat

SEQ ID NO: 450049 - DNA, 140 bp, Artificial Sequence
  Synthetic
aggccctggctgctgatatgtcatctgatacctgccattgcaaaaacaaccgggataaaaactacgggtggagaaccggactccccacttccaaagcatcaataagaaaccgggataaaagaccttttgggacagcggtg

SEQ ID NO: 450050 - DNA, 140 bp, Artificial Sequence
  Synthetic
caccgctgtcccaaaaggtcttttatcccggtttcttattgatgctttggaagtggggagtccggttctccacccgtagtttttatcccggttgtttttgcaatggcaggtatcagatgacatatcagcagccagggcct

SEQ ID NO: 450051 - DNA, 140 bp, Artificial Sequence
  Synthetic
aggccctggctgctgatatgactacggatggagaaccggactccacaattaaaaggctattgacgtcagcccaggactctagaatttagggagtcttgccaccgctaagctgtgaggcgggaccttttgggacagcggtg

SEQ ID NO: 450052 - DNA, 140 bp, Artificial Sequence
  Synthetic
caccgctgtcccaaaaggtcccgcctcacagcttagcggtggcaagactccctaaattctagagtcctgggctgacgtcaatagccttttaattgtggagtccggttctccatccgtagtcatatcagcagccagggcct

SEQ ID NO: 450053 - DNA, 140 bp, Artificial Sequence
  Synthetic
atacgccatgctgggtctcctgcgggctgggacagccgttttccagatcacgacaaatctggtttctgggatttcccaacccagagtaaaatgatggagcctccgccaccacccacccaccgtacttgggagtcggccat

SEQ ID NO: 450054 - DNA, 140 bp, Artificial Sequence
  Synthetic
atggccgactcccaagtacggtgggtgggtggtggcggaggctccatcattttactctgggttgggaaatcccagaaaccagatttgtcgtgatctggaaaacggctgtcccagcccgcaggagacccagcatggcgtat

SEQ ID NO: 450055 - DNA, 140 bp, Artificial Sequence
  Synthetic
atacgccatgctgggtctccggggtggtggaaagatggggtctagaggttagaggagaccctccagggaaattagtgggaccatattgacgccagggaaagaccggagtggtctctgcttcgtacttgggagtcggccat

SEQ ID NO: 450056 - DNA, 140 bp, Artificial Sequence
  Synthetic
atggccgactcccaagtacgaagcagagaccactccggtctttccctggcgtcaatatggtcccactaatttccctggagggtctcctctaacctctagaccccatctttccaccaccccggagacccagcatggcgtat

SEQ ID NO: 450057 - DNA, 140 bp, Artificial Sequence
  Synthetic
aggccctggctgctgatatgagggaaagaccggagtggtctctgcttttcctccaagggtctgcgagcacagtttgctttaaaagaagcagaccttttggatgaaaaacacaaaaccactgaccttttgggacagcggtg

SEQ ID NO: 450058 - DNA, 140 bp, Artificial Sequence
  Synthetic
caccgctgtcccaaaaggtcagtggttttgtgtttttcatccaaaaggtctgcttcttttaaagcaaactgtgctcgcagacccttggaggaaaagcagagaccactccggtctttccctcatatcagcagccagggcct

SEQ ID NO: 450059 - DNA, 140 bp, Artificial Sequence
  Synthetic
atacgccatgctgggtctccagtaaatccctgggtgctaattgaggtgcattggtctgcaaatcgagttgctaggcaataaacacatttggattaattttaatcgttcgttgagcgattacgtacttgggagtcggccat

SEQ ID NO: 450060 - DNA, 140 bp, Artificial Sequence
  Synthetic
atggccgactcccaagtacgtaatcgctcaacgaacgattaaaattaatccaaatgtgtttattgcctagcaactcgatttgcagaccaatgcacctcaattagcacccagggatttactggagacccagcatggcgtat

SEQ ID NO: 450061 - DNA, 140 bp, Artificial Sequence
  Synthetic
aggccctggctgctgatatgaaaacaaaaaacaaaacagattggaaacagacctggcccttcaagaggtgttcaaggatttattttcttctttttgtttaacattctgactgggaaaaaggaccttttgggacagcggtg

SEQ ID NO: 450062 - DNA, 140 bp, Artificial Sequence
  Synthetic
caccgctgtcccaaaaggtcctttttcccagtcagaatgttaaacaaaaagaagaaaataaatccttgaacacctcttgaagggccaggtctgtttccaatctgttttgttttttgttttcatatcagcagccagggcct

SEQ ID NO: 450063 - DNA, 140 bp, Artificial Sequence
  Synthetic
atacgccatgctgggtctccttgactgctcatctaaaaaaactttggaggatgcttgatccaaggcagggacttgctgtactgcggaaggtcaaaagagttgtagctagcttaatgagagcgtacttgggagtcggccat

SEQ ID NO: 450064 - DNA, 140 bp, Artificial Sequence
  Synthetic
atggccgactcccaagtacgctctcattaagctagctacaactcttttgaccttccgcagtacagcaagtccctgccttggatcaagcatcctccaaagtttttttagatgagcagtcaaggagacccagcatggcgtat

SEQ ID NO: 450065 - DNA, 140 bp, Artificial Sequence
  Synthetic
atacgccatgctgggtctccgactgtcttccaggaaacgtagatccaatgaaatggccttgtttccactcttgttactgggtttgttggctctatcaggaggagtgaccctcgtcagaaacgtacttgggagtcggccat

SEQ ID NO: 450066 - DNA, 140 bp, Artificial Sequence
  Synthetic
atggccgactcccaagtacgtttctgacgagggtcactcctcctgatagagccaacaaacccagtaacaagagtggaaacaaggccatttcattggatctacgtttcctggaagacagtcggagacccagcatggcgtat

SEQ ID NO: 450067 - DNA, 140 bp, Artificial Sequence
  Synthetic
atacgccatgctgggtctccgaacagatggttgctcttgaatgtaactgctgaagatctggggaaaacgttttcagtgggaactgggaattgcaccacgaatattctggaagcaaaataccgtacttgggagtcggccat

SEQ ID NO: 450068 - DNA, 140 bp, Artificial Sequence
  Synthetic
atggccgactcccaagtacggtattttgcttccagaatattcgtggtgcaattcccagttcccactgaaaacgttttccccagatcttcagcagttacattcaagagcaaccatctgttcggagacccagcatggcgtat

SEQ ID NO: 450069 - DNA, 140 bp, Artificial Sequence
  Synthetic
atacgccatgctgggtctcctggtgccccgactcaatggagtacaattgtcccaatctcagtccaagagaagagccagatgacatagattgctggtgttatggagtggaaaatgtcagagcgtacttgggagtcggccat

SEQ ID NO: 450070 - DNA, 140 bp, Artificial Sequence
  Synthetic
atggccgactcccaagtacgctctgacattttccactccataacaccagcaatctatgtcatctggctcttctcttggactgagattgggacaattgtactccattgagtcggggcaccaggagacccagcatggcgtat

SEQ ID NO: 450071 - DNA, 140 bp, Artificial Sequence
  Synthetic
atacgccatgctgggtctcctggcctatggaagatgtgatgcggtagggcgatcaaaacgttctaggagagcgattgatctacccacacatgagaaccatggactaaagactcggcaggacgtacttgggagtcggccat

SEQ ID NO: 450072 - DNA, 140 bp, Artificial Sequence
  Synthetic
atggccgactcccaagtacgtcctgccgagtctttagtccatggttctcatgtgtgggtagatcaatcgctctcctagaacgttttgatcgccctaccgcatcacatcttccataggccaggagacccagcatggcgtat

SEQ ID NO: 450073 - DNA, 140 bp, Artificial Sequence
  Synthetic
atacgccatgctgggtctccgaagtggatgactggcagaatgggtgagaggcagctccagaagattgaaagatggctggttaggaatccattttttgcggtcacagcattggcaatagcccgtacttgggagtcggccat

SEQ ID NO: 450074 - DNA, 140 bp, Artificial Sequence
  Synthetic
atggccgactcccaagtacgggctattgccaatgctgtgaccgcaaaaaatggattcctaaccagccatctttcaatcttctggagctgcctctcacccattctgccagtcatccacttcggagacccagcatggcgtat

SEQ ID NO: 450075 - DNA, 140 bp, Artificial Sequence
  Synthetic
atacgccatgctgggtctcctatctggtgggtaacaacacgacgcaacgagtggtaatagcactactggttctagcggttggtccagcgtactctgcccattgcatagggataaccgacacgtacttgggagtcggccat

SEQ ID NO: 450076 - DNA, 140 bp, Artificial Sequence
  Synthetic
atggccgactcccaagtacgtgtcggttatccctatgcaatgggcagagtacgctggaccaaccgctagaaccagtagtgctattaccactcgttgcgtcgtgttgttacccaccagataggagacccagcatggcgtat

SEQ ID NO: 450077 - DNA, 140 bp, Artificial Sequence
  Synthetic
atacgccatgctgggtctccgagatttcattgaaggtgtccatgggggcacttgggtgtcagccactctggagcaggacaaatgcgtgactgtaatggcccctgacaaaccttctctagacgtacttgggagtcggccat

SEQ ID NO: 450078 - DNA, 140 bp, Artificial Sequence
  Synthetic
atggccgactcccaagtacgtctagagaaggtttgtcaggggccattacagtcacgcatttgtcctgctccagagtggctgacacccaagtgcccccatggacaccttcaatgaaatctcggagacccagcatggcgtat

SEQ ID NO: 450079 - DNA, 140 bp, Artificial Sequence
  Synthetic
atacgccatgctgggtctcccatctcactacagacagtggcaatcgatggaccggctgaagcgaggaaggtttgctacagtgcagtcctaacccatgtgaaaatcaatgacaaatgcccgcgtacttgggagtcggccat

SEQ ID NO: 450080 - DNA, 140 bp, Artificial Sequence
  Synthetic
atggccgactcccaagtacgcgggcatttgtcattgattttcacatgggttaggactgcactgtagcaaaccttcctcgcttcagccggtccatcgattgccactgtctgtagtgagatgggagacccagcatggcgtat

SEQ ID NO: 450081 - DNA, 140 bp, Artificial Sequence
  Synthetic
atacgccatgctgggtctccagcactggtgaggctcaccttgcagaggaaaatgatggtgacaatgcttgcaaacggacatattctgacagaggctggggcaatggctgtggtctatttgcgtacttgggagtcggccat

SEQ ID NO: 450082 - DNA, 140 bp, Artificial Sequence
  Synthetic
atggccgactcccaagtacgcaaatagaccacagccattgccccagcctctgtcagaatatgtccgtttgcaagcattgtcaccatcattttcctctgcaaggtgagcctcaccagtgctggagacccagcatggcgtat

SEQ ID NO: 450083 - DNA, 140 bp, Artificial Sequence
  Synthetic
atacgccatgctgggtctccggaaagggagcattgtggcttgtgctaagttcacatgtgccaaatctatgagtctctttgaggtggatcagaccaagattcaatatgtcatcagggctcacgtacttgggagtcggccat

SEQ ID NO: 450084 - DNA, 140 bp, Artificial Sequence
  Synthetic
atggccgactcccaagtacgtgagccctgatgacatattgaatcttggtctgatccacctcaaagagactcatagatttggcacatgtgaacttagcacaagccacaatgctccctttccggagacccagcatggcgtat

SEQ ID NO: 450085 - DNA, 140 bp, Artificial Sequence
  Synthetic
atacgccatgctgggtctccgctccatgtgggtgccaaacaggaaaactggaacacagacataaaaacgctgaaatttgatgctctttctggctcacaggaggctgaattcactggttatcgtacttgggagtcggccat

SEQ ID NO: 450086 - DNA, 140 bp, Artificial Sequence
  Synthetic
atggccgactcccaagtacgataaccagtgaattcagcctcctgtgagccagaaagagcatcaaatttcagcgtttttatgtctgtgttccagttttcctgtttggcacccacatggagcggagacccagcatggcgtat

SEQ ID NO: 450087 - DNA, 140 bp, Artificial Sequence
  Synthetic
atacgccatgctgggtctccggaaaagcaacactggagtgtcaggtccagactgccgtggactttgggaacagctacatcgcagagatggaaaaagatagctggatcgttgaccgccaatcgtacttgggagtcggccat

SEQ ID NO: 450088 - DNA, 140 bp, Artificial Sequence
  Synthetic
atggccgactcccaagtacgattggcggtcaacgatccagctatctttttccatctctgcgatgtagctgttcccaaagtccacggcagtctggacctgacactccagtgttgcttttccggagacccagcatggcgtat

SEQ ID NO: 450089 - DNA, 140 bp, Artificial Sequence
  Synthetic
atacgccatgctgggtctccgggcacaggacttgacactgccatggcagagtgggagtggtggcatatggagagaaatgcaccaccttgttgagtttgagcccccacatgctgccacaatcgtacttgggagtcggccat

SEQ ID NO: 450090 - DNA, 140 bp, Artificial Sequence
  Synthetic
atggccgactcccaagtacgattgtggcagcatgtgggggctcaaactcaacaaggtggtgcatttctctccatatgccaccactcccactctgccatggcagtgtcaagtcctgtgcccggagacccagcatggcgtat

SEQ ID NO: 450091 - DNA, 140 bp, Artificial Sequence
  Synthetic
atacgccatgctgggtctcctagggtgctggccttgggcaatcaagaaggctccttgaagaccgctctcacaggcgccatgcgcgtcaccaaggatgagaatgacaacaacttgtacaaacgtacttgggagtcggccat

SEQ ID NO: 450092 - DNA, 140 bp, Artificial Sequence
  Synthetic
atggccgactcccaagtacgtttgtacaagttgttgtcattctcatccttggtgacgcgcatggcgcctgtgagagcggtcttcaaggagccttcttgattgcccaaggccagcaccctaggagacccagcatggcgtat

SEQ ID NO: 450093 - DNA, 140 bp, Artificial Sequence
  Synthetic
atacgccatgctgggtctccctgcacggtggtcacgtctcctgtagagtgaaactgtcagctctcactctcaaaggaacatcctacaagatgtgtacagacaagatgtcatttgtcaagacgtacttgggagtcggccat

SEQ ID NO: 450094 - DNA, 140 bp, Artificial Sequence
  Synthetic
atggccgactcccaagtacgtcttgacaaatgacatcttgtctgtacacatcttgtaggatgttcctttgagagtgagagctgacagtttcactctacaggagacgtgaccaccgtgcagggagacccagcatggcgtat

SEQ ID NO: 450095 - DNA, 140 bp, Artificial Sequence
  Synthetic
atacgccatgctgggtctccatccgacggatacagggcatggcacagttgtcatgcaagtaaaggtccccaaaggggccccatgcaagattcccgtgattgtggcagatgacctaacggccgtacttgggagtcggccat

SEQ ID NO: 450096 - DNA, 140 bp, Artificial Sequence
  Synthetic
atggccgactcccaagtacggccgttaggtcatctgccacaatcacgggaatcttgcatggggcccctttggggacctttacttgcatgacaactgtgccatgccctgtatccgtcggatggagacccagcatggcgtat

SEQ ID NO: 450097 - DNA, 140 bp, Artificial Sequence
  Synthetic
atacgccatgctgggtctcctgcggtgaacaaaggcatcttggtcactgtcaatcctattgcatccacaaatgatgatgaagttctgattgaggtcaatcccccttttggggatagctaccgtacttgggagtcggccat

SEQ ID NO: 450098 - DNA, 140 bp, Artificial Sequence
  Synthetic
atggccgactcccaagtacggtagctatccccaaaagggggattgacctcaatcagaacttcatcatcatttgtggatgcaataggattgacagtgaccaagatgcctttgttcaccgcaggagacccagcatggcgtat

SEQ ID NO: 450099 - DNA, 140 bp, Artificial Sequence
  Synthetic
atacgccatgctgggtctccatcatagttgggactggagattcacgactgacctatcagtggcacaaagaagggagttcaataggaaaattgtttacacagacaatgaaaggagctgaaccgtacttgggagtcggccat

SEQ ID NO: 450100 - DNA, 140 bp, Artificial Sequence
  Synthetic
atggccgactcccaagtacggttcagctcctttcattgtctgtgtaaacaattttcctattgaactcccttctttgtgccactgataggtcagtcgtgaatctccagtcccaactatgatggagacccagcatggcgtat

SEQ ID NO: 450101 - DNA, 140 bp, Artificial Sequence
  Synthetic
atacgccatgctgggtctccgtcttgcagtgatgggtgatgctgcttgggattttagttctgctggggggttcttcacatctgtgggaaaaggaatccataccgtgtttggctcggccttcgtacttgggagtcggccat

SEQ ID NO: 450102 - DNA, 140 bp, Artificial Sequence
  Synthetic
atggccgactcccaagtacgaaggccgagccaaacacggtatggattccttttcccacagatgtgaagaaccccccagcagaactaaaatcccaagcagcatcacccatcactgcaagacggagacccagcatggcgtat

SEQ ID NO: 450103 - DNA, 140 bp, Artificial Sequence
  Synthetic
atacgccatgctgggtctccccaggggctgtttggtggcttgagttggattacgaaagtcatcatgggagccgtactcatctgggtgggaataaacacccgcaacatgaccatgtccatgcgtacttgggagtcggccat

SEQ ID NO: 450104 - DNA, 140 bp, Artificial Sequence
  Synthetic
atggccgactcccaagtacgcatggacatggtcatgttgcgggtgtttattcccacccagatgagtacggctcccatgatgactttcgtaatccaactcaagccaccaaacagcccctggggagacccagcatggcgtat

SEQ ID NO: 450105 - DNA, 140 bp, Artificial Sequence
  Synthetic
atacgccatgctgggtctcctccatgatcttggtaggtgtgatcatgatgtttctttcattgggagttggggctgaccaaggatgtgctgtcaactttgggaaacgcgagctcaaatgcgcgtacttgggagtcggccat

SEQ ID NO: 450106 - DNA, 140 bp, Artificial Sequence
  Synthetic
atggccgactcccaagtacgcgcatttgagctcgcgtttcccaaagttgacagcacatccttggtcagccccaactcccaatgaaagaaacatcatgatcacacctaccaagatcatggaggagacccagcatggcgtat

SEQ ID NO: 450107 - DNA, 140 bp, Artificial Sequence
  Synthetic
atacgccatgctgggtctccgagatggcatctttgtgtttagagactctgatgattggctcacaaagtactcatactatcctgaagaccctgtcaaattggcatccattattaaagcctccgtacttgggagtcggccat

SEQ ID NO: 450108 - DNA, 140 bp, Artificial Sequence
  Synthetic
atggccgactcccaagtacggaggctttaataatggatgccaatttgacagggtcttcaggatagtatgagtactttgtgagccaatcatcagagtctctaaacacaaagatgccatctcggagacccagcatggcgtat

SEQ ID NO: 450109 - DNA, 140 bp, Artificial Sequence
  Synthetic
atacgccatgctgggtctccccacgaggagggcaaatgtggattgaattcagttgattccctcgaacacgagatgtggaggagtagggcggatgagatcaacgccatttttgaagaaaatcgtacttgggagtcggccat

SEQ ID NO: 450110 - DNA, 140 bp, Artificial Sequence
  Synthetic
atggccgactcccaagtacgattttcttcaaaaatggcgttgatctcatccgccctactcctccacatctcgtgttcgagggaatcaactgaattcaatccacatttgccctcctcgtggggagacccagcatggcgtat

SEQ ID NO: 450111 - DNA, 140 bp, Artificial Sequence
  Synthetic
atacgccatgctgggtctccgaggtagacatctcggtcgtcgtccaagacccaaagaacatctatcaaagagggacccacccgttctcaaggatccgtgacggattgcagtatgggtggacgtacttgggagtcggccat

SEQ ID NO: 450112 - DNA, 140 bp, Artificial Sequence
  Synthetic
atggccgactcccaagtacgtccacccatactgcaatccgtcacggatccttgagaacgggtgggtccctctttgatagatgttctttgggtcttggacgacgaccgagatgtctacctcggagacccagcatggcgtat

SEQ ID NO: 450113 - DNA, 140 bp, Artificial Sequence
  Synthetic
atacgccatgctgggtctccagacctggggaaaaaaccttgttttctcaccagggaggaagaacggcagcttcatcattgacgggaagtcacgaaaggagtgccccttctctaacagagtcgtacttgggagtcggccat

SEQ ID NO: 450114 - DNA, 140 bp, Artificial Sequence
  Synthetic
atggccgactcccaagtacgactctgttagagaaggggcactcctttcgtgacttcccgtcaatgatgaagctgccgttcttcctccctggtgagaaaacaaggttttttccccaggtctggagacccagcatggcgtat

SEQ ID NO: 450115 - DNA, 140 bp, Artificial Sequence
  Synthetic
atacgccatgctgggtctccgtggaactcattccagattgaggagtttggcatgggggtcttcacaacacgagtttttatggacgcgacctttgactattcagtggactgtgatggagcccgtacttgggagtcggccat

SEQ ID NO: 450116 - DNA, 140 bp, Artificial Sequence
  Synthetic
atggccgactcccaagtacgggctccatcacagtccactgaatagtcaaaggtcgcgtccataaaaactcgtgttgtgaagacccccatgccaaactcctcaatctggaatgagttccacggagacccagcatggcgtat

SEQ ID NO: 450117 - DNA, 140 bp, Artificial Sequence
  Synthetic
atacgccatgctgggtctccatcctgggtgcagcggtaaatggaaagaagagtgcccatggatcacccacattttggatgggaagtcatgaagtcaatggaacgtggatgatacacactccgtacttgggagtcggccat

SEQ ID NO: 450118 - DNA, 140 bp, Artificial Sequence
  Synthetic
atggccgactcccaagtacggagtgtgtatcatccacgttccattgacttcatgacttcccatccaaaatgtgggtgatccatgggcactcttctttccatttaccgctgcacccaggatggagacccagcatggcgtat

SEQ ID NO: 450119 - DNA, 140 bp, Artificial Sequence
  Synthetic
atacgccatgctgggtctcctggaaactcttgattacaaggagtgtgaatggccactgacacacactattggaacctcagtagaagaaagtgacatgttcatgccccggtccattggaggcgtacttgggagtcggccat

SEQ ID NO: 450120 - DNA, 140 bp, Artificial Sequence
  Synthetic
atggccgactcccaagtacgcctccaatggaccggggcatgaacatgtcactttcttctactgaggttccaatagtgtgtgtcagtggccattcacactccttgtaatcaagagtttccaggagacccagcatggcgtat

SEQ ID NO: 450121 - DNA, 140 bp, Artificial Sequence
  Synthetic
atacgccatgctgggtctcctccggtgagctcccacaaccgcatcccgggttacaaggtgcaaactaatgggccatggatgcaagtccctctggaagtaaaaagggaagtctgtccagggcgtacttgggagtcggccat

SEQ ID NO: 450122 - DNA, 140 bp, Artificial Sequence
  Synthetic
atggccgactcccaagtacgccctggacagacttccctttttacttccagagggacttgcatccatggcccattagtttgcaccttgtaacccgggatgcggttgtgggagctcaccggaggagacccagcatggcgtat

SEQ ID NO: 450123 - DNA, 140 bp, Artificial Sequence
  Synthetic
atacgccatgctgggtctccacaagcgtggtggtggactccaactgtgatggacgtggaaaatcaacaagatcaaccactgacagtgggaaaataatcccggaatggtgttgcagatcctcgtacttgggagtcggccat

SEQ ID NO: 450124 - DNA, 140 bp, Artificial Sequence
  Synthetic
atggccgactcccaagtacgaggatctgcaacaccattccgggattattttcccactgtcagtggttgatcttgttgattttccacgtccatcacagttggagtccaccaccacgcttgtggagacccagcatggcgtat

SEQ ID NO: 450125 - DNA, 140 bp, Artificial Sequence
  Synthetic
atacgccatgctgggtctccgtaccatgcctccagtcagcttccatggaagcgatggttgttggtatcctatggagatcagacccatgaaaacatccgacagccacctagtgaggtcctgcgtacttgggagtcggccat

SEQ ID NO: 450126 - DNA, 140 bp, Artificial Sequence
  Synthetic
atggccgactcccaagtacgcaggacctcactaggtggctgtcggatgttttcatgggtctgatctccataggataccaacaaccatcgcttccatggaagctgactggaggcatggtacggagacccagcatggcgtat

SEQ ID NO: 450127 - DNA, 140 bp, Artificial Sequence
  Synthetic
atacgccatgctgggtctccggtgactgcaggagaagttcatgcagtaccctttgggctggtgagcatgatgattgccatggaggtggtgttgcgcagaaggcaaggaccaaaacaaatgcgtacttgggagtcggccat

SEQ ID NO: 450128 - DNA, 140 bp, Artificial Sequence
  Synthetic
atggccgactcccaagtacgcatttgttttggtccttgccttctgcgcaacaccacctccatggcaatcatcatgctcaccagcccaaagggtactgcatgaacttctcctgcagtcaccggagacccagcatggcgtat

SEQ ID NO: 450129 - DNA, 140 bp, Artificial Sequence
  Synthetic
atacgccatgctgggtctccctggtaggaggagttgtgctgcttggagcgatgttagtgggacaagtcacagtcttagaccttgtgaagtttgttgtggcagtgggattgcacttccatgcgtacttgggagtcggccat

SEQ ID NO: 450130 - DNA, 140 bp, Artificial Sequence
  Synthetic
atggccgactcccaagtacgcatggaagtgcaatcccactgccacaacaaacttcacaaggtctaagactgtgacttgtcccactaacatcgctccaagcagcacaactcctcctaccagggagacccagcatggcgtat

SEQ ID NO: 450131 - DNA, 140 bp, Artificial Sequence
  Synthetic
atacgccatgctgggtctccagattaacaacggaggagatgccatgtacatggcattaattgccagcttttccatccggccaggcctgctcatgggctttgggctgcgcacactgtggagcgtacttgggagtcggccat

SEQ ID NO: 450132 - DNA, 140 bp, Artificial Sequence
  Synthetic
atggccgactcccaagtacgctccacagtgtgcgcagcccaaagcccatgagcaggcctggccggatggaaaagctggcaattaatgccatgtacatggcatctcctccgttgttaatctggagacccagcatggcgtat

SEQ ID NO: 450133 - DNA, 140 bp, Artificial Sequence
  Synthetic
atacgccatgctgggtctcctcctcgggagcgacttgtaatggcatttggagcagccatggttgagattgccctaggtggaatgatgggtgggctttggcagtacttgaacgccgtttcacgtacttgggagtcggccat

SEQ ID NO: 450134 - DNA, 140 bp, Artificial Sequence
  Synthetic
atggccgactcccaagtacgtgaaacggcgttcaagtactgccaaagcccacccatcattccacctagggcaatctcaaccatggctgctccaaatgccattacaagtcgctcccgaggaggagacccagcatggcgtat

SEQ ID NO: 450135 - DNA, 140 bp, Artificial Sequence
  Synthetic
atacgccatgctgggtctccctgtgtgtgctcaccataaatgcaatctcatcaaggaaggcctcaaatatgatcctccccctgatggcactcatgactcccatgacaatgcatgaggtgacgtacttgggagtcggccat

SEQ ID NO: 450136 - DNA, 140 bp, Artificial Sequence
  Synthetic
atggccgactcccaagtacgtcacctcatgcattgtcatgggagtcatgagtgccatcagggggaggatcatatttgaggccttccttgatgagattgcatttatggtgagcacacacagggagacccagcatggcgtat

SEQ ID NO: 450137 - DNA, 140 bp, Artificial Sequence
  Synthetic
atacgccatgctgggtctccggatggcgacgatgctgttctgcactgttgtcataataggggtgcttcatcagaattcaaaagacacatctatgcaaaagaccattcccattgtagccctcgtacttgggagtcggccat

SEQ ID NO: 450138 - DNA, 140 bp, Artificial Sequence
  Synthetic
atggccgactcccaagtacgagggctacaatgggaatggtcttttgcatagatgtgtcttttgaattctgatgaagcacccctattatgacaacagtgcagaacagcatcgtcgccatccggagacccagcatggcgtat

SEQ ID NO: 450139 - DNA, 140 bp, Artificial Sequence
  Synthetic
atacgccatgctgggtctccgacactgacctcatacatgggcttgacccagccctttctagggctgtgtgcatacatgtccacgcaggtgtttggcagaaggagtatacctgtgaatgaacgtacttgggagtcggccat

SEQ ID NO: 450140 - DNA, 140 bp, Artificial Sequence
  Synthetic
atggccgactcccaagtacgttcattcacaggtatactccttctgccaaacacctgcgtggacatgtatgcacacagccctagaaagggctgggtcaagcccatgtatgaggtcagtgtcggagacccagcatggcgtat

SEQ ID NO: 450141 - DNA, 140 bp, Artificial Sequence
  Synthetic
atacgccatgctgggtctccgccttggcagcggctggcttggtgggagtgctagcagggctagccttccaagacatggaaaactttttgggtccaatagcggtgggggggatcctcatgacgtacttgggagtcggccat

SEQ ID NO: 450142 - DNA, 140 bp, Artificial Sequence
  Synthetic
atggccgactcccaagtacgtcatgaggatcccccccaccgctattggacccaaaaagttttccatgtcttggaaggctagccctgctagcactcccaccaagccagccgctgccaaggcggagacccagcatggcgtat

SEQ ID NO: 450143 - DNA, 140 bp, Artificial Sequence
  Synthetic
atacgccatgctgggtctcctgctagttagtgtggcagggagagttgatggactagagctcaagaaacttggtgaaatctcctgggaagaagaagctgaaataagcggaagctctagccgcgtacttgggagtcggccat

SEQ ID NO: 450144 - DNA, 140 bp, Artificial Sequence
  Synthetic
atggccgactcccaagtacgcggctagagcttccgcttatttcagcttcttcttcccaggagatttcaccaagtttcttgagctctagtccatcaactctccctgccacactaactagcaggagacccagcatggcgtat

SEQ ID NO: 450145 - DNA, 140 bp, Artificial Sequence
  Synthetic
atacgccatgctgggtctccctatgatgtggcactcagtgagcagggtgaatttaaactcctctcagaggacaaagtgccctgggaccagatagtaatgacatccctagccctcgtgggacgtacttgggagtcggccat

SEQ ID NO: 450146 - DNA, 140 bp, Artificial Sequence
  Synthetic
atggccgactcccaagtacgtcccacgagggctagggatgtcattactatctggtcccagggcactttgtcctctgagaggagtttaaattcaccctgctcactgagtgccacatcatagggagacccagcatggcgtat

SEQ ID NO: 450147 - DNA, 140 bp, Artificial Sequence
  Synthetic
atacgccatgctgggtctccgcagccatacatccatttgccctcttgctggtcctgggaggatggatcctgcacattaaaggtgctaggaggagtggggatgttctttgggacattcccacgtacttgggagtcggccat

SEQ ID NO: 450148 - DNA, 140 bp, Artificial Sequence
  Synthetic
atggccgactcccaagtacgtgggaatgtcccaaagaacatccccactcctcctagcacctttaatgtgcaggatccatcctcccaggaccagcaagagggcaaatggatgtatggctgcggagacccagcatggcgtat

SEQ ID NO: 450149 - DNA, 140 bp, Artificial Sequence
  Synthetic
atacgccatgctgggtctcccgccaaaggtgattgaggaatgtgagcacctggaggatggaatctatggcatattccagtcaaccttccttggagcctcgcagcgaggtgttggagtggccgtacttgggagtcggccat

SEQ ID NO: 450150 - DNA, 140 bp, Artificial Sequence
  Synthetic
atggccgactcccaagtacggccactccaacacctcgctgcgaggctccaaggaaggttgactggaatatgccatagattccatcctccaggtgctcacattcctcaatcacctttggcgggagacccagcatggcgtat

SEQ ID NO: 450151 - DNA, 140 bp, Artificial Sequence
  Synthetic
atacgccatgctgggtctccgcagggaggggtcttccacacaatgtggcatgtcactaggggagcattcctcttgaggaatggaaagaaactggttccgtcttgggcttctgtgaaggaacgtacttgggagtcggccat

SEQ ID NO: 450152 - DNA, 140 bp, Artificial Sequence
  Synthetic
atggccgactcccaagtacgttccttcacagaagcccaagacggaaccagtttctttccattcctcaagaggaatgctcccctagtgacatgccacattgtgtggaagacccctccctgcggagacccagcatggcgtat

SEQ ID NO: 450153 - DNA, 140 bp, Artificial Sequence
  Synthetic
atacgccatgctgggtctccgatctggtggcttatggtggttcctggaaactagacgggagatgggatggtgaggaggaagtccaactcatcgctgctgtgcctggaaaatctgttgtcacgtacttgggagtcggccat

SEQ ID NO: 450154 - DNA, 140 bp, Artificial Sequence
  Synthetic
atggccgactcccaagtacgtgacaacagattttccaggcacagcagcgatgagttggacttcctcctcaccatcccatctcccgtctagtttccaggaaccaccataagccaccagatcggagacccagcatggcgtat

SEQ ID NO: 450155 - DNA, 140 bp, Artificial Sequence
  Synthetic
atacgccatgctgggtctccacgttcaaacaaaaccaagcttgttcagagtgaaaaatggtggtgagattggagcagttgctctggactaccccagtggaacctcaggctcccccattgtcgtacttgggagtcggccat

SEQ ID NO: 450156 - DNA, 140 bp, Artificial Sequence
  Synthetic
atggccgactcccaagtacgacaatgggggagcctgaggttccactggggtagtccagagcaactgctccaatctcaccaccatttttcactctgaacaagcttggttttgtttgaacgtggagacccagcatggcgtat

SEQ ID NO: 450157 - DNA, 140 bp, Artificial Sequence
  Synthetic
atacgccatgctgggtctccgaaccgaaatggtgaagtggtcgggctctatggcaatggaattctggtgggtgataactcctttgtgtctgccatctcacaaactgaattgaaggaagaacgtacttgggagtcggccat

SEQ ID NO: 450158 - DNA, 140 bp, Artificial Sequence
  Synthetic
atggccgactcccaagtacgttcttccttcaattcagtttgtgagatggcagacacaaaggagttatcacccaccagaattccattgccatagagcccgaccacttcaccatttcggttcggagacccagcatggcgtat

SEQ ID NO: 450159 - DNA, 140 bp, Artificial Sequence
  Synthetic
atacgccatgctgggtctcctccaaagaagaactgcaagaaataccaactatgctgaagaaaggaatgaccaccatccttgacttccaccctggggcggggaaaacccgtaggttcctgccgtacttgggagtcggccat

SEQ ID NO: 450160 - DNA, 140 bp, Artificial Sequence
  Synthetic
atggccgactcccaagtacggcaggaacctacgggttttccccgccccagggtggaagtcaaggatggtggtcattcctttcttcagcatagttggtatttcttgcagttcttctttggaggagacccagcatggcgtat

SEQ ID NO: 450161 - DNA, 140 bp, Artificial Sequence
  Synthetic
atacgccatgctgggtctccctcaaatattggcggagtgtgccagaaggcgtttgcgcactctggtattagcacccaccagggttgttttgtcagagatgaaagaagcttttcaggggttcgtacttgggagtcggccat

SEQ ID NO: 450162 - DNA, 140 bp, Artificial Sequence
  Synthetic
atggccgactcccaagtacgaacccctgaaaagcttctttcatctctgacaaaacaaccctggtgggtgctaataccagagtgcgcaaacgccttctggcacactccgccaatatttgagggagacccagcatggcgtat

SEQ ID NO: 450163 - DNA, 140 bp, Artificial Sequence
  Synthetic
atacgccatgctgggtctccggatgtgaaattccacacacaagctttctcagcccatgggagtgggaaggaggtcattgatgcaatgtgccatgcaacccttacatatagaatgctggaacgtacttgggagtcggccat

SEQ ID NO: 450164 - DNA, 140 bp, Artificial Sequence
  Synthetic
atggccgactcccaagtacgttccagcattctatatgtaagggttgcatggcacattgcatcaatgacctccttcccactcccatgggctgagaaagcttgtgtgtggaatttcacatccggagacccagcatggcgtat

SEQ ID NO: 450165 - DNA, 140 bp, Artificial Sequence
  Synthetic
atacgccatgctgggtctccccaacaagggtagtcaactgggaggtcattatcatggatgaggcgcacttcctggaccctgctagcatagcagcgagaggctgggcggctcatagagcaacgtacttgggagtcggccat

SEQ ID NO: 450166 - DNA, 140 bp, Artificial Sequence
  Synthetic
atggccgactcccaagtacgttgctctatgagccgcccagcctctcgctgctatgctagcagggtccaggaagtgcgcctcatccatgataatgacctcccagttgactacccttgttggggagacccagcatggcgtat

SEQ ID NO: 450167 - DNA, 140 bp, Artificial Sequence
  Synthetic
atacgccatgctgggtctccgagcaaatgagagcgccaccatacttatgaccgccaccccaccaggcaccagtgacgagttccctcactccaatggtgagattgaggacgtccagactgacgtacttgggagtcggccat

SEQ ID NO: 450168 - DNA, 140 bp, Artificial Sequence
  Synthetic
atggccgactcccaagtacgtcagtctggacgtcctcaatctcaccattggagtgagggaactcgtcactggtgcctggtggggtggcggtcataagtatggtggcgctctcatttgctcggagacccagcatggcgtat

SEQ ID NO: 450169 - DNA, 140 bp, Artificial Sequence
  Synthetic
atacgccatgctgggtctcccatccccagcgagccatggaccgcaggacatgaatggatcttggcggacaagcgaccaactgcatggttccttccatcgatcagagcagcaaatgtcatgcgtacttgggagtcggccat

SEQ ID NO: 450170 - DNA, 140 bp, Artificial Sequence
  Synthetic
atggccgactcccaagtacgcatgacatttgctgctctgatcgatggaaggaaccatgcagttggtcgcttgtccgccaagatccattcatgtcctgcggtccatggctcgctggggatgggagacccagcatggcgtat

SEQ ID NO: 450171 - DNA, 140 bp, Artificial Sequence
  Synthetic
atacgccatgctgggtctccgcagcctcgctgcggaaagcggggaaaaatgtggtggtgctgaataggaaaacctttgaaaaggagtaccccaccattaagcagaagaaaccggatttcacgtacttgggagtcggccat

SEQ ID NO: 450172 - DNA, 140 bp, Artificial Sequence
  Synthetic
atggccgactcccaagtacgtgaaatccggtttcttctgcttaatggtggggtactccttttcaaaggttttcctattcagcaccaccacatttttccccgctttccgcagcgaggctgcggagacccagcatggcgtat

SEQ ID NO: 450173 - DNA, 140 bp, Artificial Sequence
  Synthetic
atacgccatgctgggtctcctacttgccaccgatatcgctgagatgggagcaaacctgtgtgtggagagagtcttggactgcagaactgcctacaagcctgtcctggttgatgaagggaacgtacttgggagtcggccat

SEQ ID NO: 450174 - DNA, 140 bp, Artificial Sequence
  Synthetic
atggccgactcccaagtacgttcccttcatcaaccaggacaggcttgtaggcagttctgcagtccaagactctctccacacacaggtttgctcccatctcagcgatatcggtggcaagtaggagacccagcatggcgtat

SEQ ID NO: 450175 - DNA, 140 bp, Artificial Sequence
  Synthetic
atacgccatgctgggtctccgaaggtggccatcaaagggccgctacgaatctcagcgtcatcggccgctcagaggagaggacgcattggacgcaatcccaacagagatggtgactcttaccgtacttgggagtcggccat

SEQ ID NO: 450176 - DNA, 140 bp, Artificial Sequence
  Synthetic
atggccgactcccaagtacggtaagagtcaccatctctgttgggattgcgtccaatgcgtcctctcctctgagcggccgatgacgctgagattcgtagcggccctttgatggccaccttcggagacccagcatggcgtat

SEQ ID NO: 450177 - DNA, 140 bp, Artificial Sequence
  Synthetic
atacgccatgctgggtctcctactactcagaacctaccagtgaggacaatgcacaccatgtgtgctggctggaggcttccatgctcctggataacatggaggttagaggggggatggttgcgtacttgggagtcggccat

SEQ ID NO: 450178 - DNA, 140 bp, Artificial Sequence
  Synthetic
atggccgactcccaagtacgcaaccatcccccctctaacctccatgttatccaggagcatggaagcctccagccagcacacatggtgtgcattgtcctcactggtaggttctgagtagtaggagacccagcatggcgtat

SEQ ID NO: 450179 - DNA, 140 bp, Artificial Sequence
  Synthetic
atacgccatgctgggtctccctccactttatggcattgagggaacaaagactcccgtctctccaggagaaatgaggctaagagatgatcagagaagggtctttagagagttggtgcgaggcgtacttgggagtcggccat

SEQ ID NO: 450180 - DNA, 140 bp, Artificial Sequence
  Synthetic
atggccgactcccaagtacgcctcgcaccaactctctaaagacccttctctgatcatctcttagcctcatttctcctggagagacgggagtctttgttccctcaatgccataaagtggagggagacccagcatggcgtat

SEQ ID NO: 450181 - DNA, 140 bp, Artificial Sequence
  Synthetic
atacgccatgctgggtctccgtgtgatttgccagtgtggttggcatggcaagtggcaaaagctggcctgaagaccaatgaccgcaaatggtgttttgagggtcctgaagagcatgaaatacgtacttgggagtcggccat

SEQ ID NO: 450182 - DNA, 140 bp, Artificial Sequence
  Synthetic
atggccgactcccaagtacgtatttcatgctcttcaggaccctcaaaacaccatttgcggtcattggtcttcaggccagcttttgccacttgccatgccaaccacactggcaaatcacacggagacccagcatggcgtat

SEQ ID NO: 450183 - DNA, 140 bp, Artificial Sequence
  Synthetic
atacgccatgctgggtctccctcaatgacaatggtgaaacagtaaagtgtagatctccgggcggagcaaaaagagcattgagacctagatggtgtgacgagagagtttcctcagaccagacgtacttgggagtcggccat

SEQ ID NO: 450184 - DNA, 140 bp, Artificial Sequence
  Synthetic
atggccgactcccaagtacgtctggtctgaggaaactctctcgtcacaccatctaggtctcaatgctctttttgctccgcccggagatctacactttactgtttcaccattgtcattgagggagacccagcatggcgtat

SEQ ID NO: 450185 - DNA, 140 bp, Artificial Sequence
  Synthetic
atacgccatgctgggtctccgtgccttggctgacttcatcaagtttgcagaaggcagaagaggggctgctgagatgcttgtgatcctcacggagttgcccgatttcctggcaaagaagggcgtacttgggagtcggccat

SEQ ID NO: 450186 - DNA, 140 bp, Artificial Sequence
  Synthetic
atggccgactcccaagtacgcccttctttgccaggaaatcgggcaactccgtgaggatcacaagcatctcagcagcccctcttctgccttctgcaaacttgatgaagtcagccaaggcacggagacccagcatggcgtat

SEQ ID NO: 450187 - DNA, 140 bp, Artificial Sequence
  Synthetic
atacgccatgctgggtctcctggggaggccatggataccatcagtgtgttcctacattctgaagagggttcaagagcgtacagaaatgccctgtcaatgatgccagaagccatgaccattcgtacttgggagtcggccat

SEQ ID NO: 450188 - DNA, 140 bp, Artificial Sequence
  Synthetic
atggccgactcccaagtacgaatggtcatggcttctggcatcattgacagggcatttctgtacgctcttgaaccctcttcagaatgtaggaacacactgatggtatccatggcctccccaggagacccagcatggcgtat

SEQ ID NO: 450189 - DNA, 140 bp, Artificial Sequence
  Synthetic
atacgccatgctgggtctccgtcatgctcttcctgcttgccggactcttgacctcaggagcggtgattttcttcatgtcgcctaaaggcatgagtagaatgtcaatggcaatgggtaccacgtacttgggagtcggccat

SEQ ID NO: 450190 - DNA, 140 bp, Artificial Sequence
  Synthetic
atggccgactcccaagtacgtggtacccattgccattgacattctactcatgcctttaggcgacatgaagaaaatcaccgctcctgaggtcaagagtccggcaagcaggaagagcatgacggagacccagcatggcgtat

SEQ ID NO: 450191 - DNA, 140 bp, Artificial Sequence
  Synthetic
atacgccatgctgggtctcctggctggcagtggatatctcatgtttttggggggagtaaaaccaacccacatctcttacgtcatgttaatattctttgtcctcatggtcgtcgtaattcccgtacttgggagtcggccat

SEQ ID NO: 450192 - DNA, 140 bp, Artificial Sequence
  Synthetic
atggccgactcccaagtacgggaattacgacgaccatgaggacaaagaatattaacatgacgtaagagatgtgggttggttttactccccccaaaaacatgagatatccactgccagccaggagacccagcatggcgtat

SEQ ID NO: 450193 - DNA, 140 bp, Artificial Sequence
  Synthetic
atacgccatgctgggtctcccgaaccaggacagcagagaacaatccaggataaccaagttgcctatctcataattgggatcttgacattgctatcagttgtggcagctaatgaactagggcgtacttgggagtcggccat

SEQ ID NO: 450194 - DNA, 140 bp, Artificial Sequence
  Synthetic
atggccgactcccaagtacgccctagttcattagctgccacaactgatagcaatgtcaagatcccaattatgagataggcaacttggttatcctggattgttctctgctgtcctggttcgggagacccagcatggcgtat

SEQ ID NO: 450195 - DNA, 140 bp, Artificial Sequence
  Synthetic
atacgccatgctgggtctccatgctggagaagaccaaggaagatttttttggaaagagagacatcacaacaccaagtggggctatcccatggagttggcctgacctggatctgaaacctgcgtacttgggagtcggccat

SEQ ID NO: 450196 - DNA, 140 bp, Artificial Sequence
  Synthetic
atggccgactcccaagtacgcaggtttcagatccaggtcaggccaactccatgggatagccccacttggtgttgtgatgtctctctttccaaaaaaatcttccttggtcttctccagcatggagacccagcatggcgtat

SEQ ID NO: 450197 - DNA, 140 bp, Artificial Sequence
  Synthetic
atacgccatgctgggtctccgggcagcctggacagtctatgtgggaatcgtgacgatgttgtctcccatgttacatcattggataaaagttgagtatggcaatttgtcactatcgggaatcgtacttgggagtcggccat

SEQ ID NO: 450198 - DNA, 140 bp, Artificial Sequence
  Synthetic
atggccgactcccaagtacgattcccgatagtgacaaattgccatactcaacttttatccaatgatgtaacatgggagacaacatcgtcacgattcccacatagactgtccaggctgcccggagacccagcatggcgtat

SEQ ID NO: 450199 - DNA, 140 bp, Artificial Sequence
  Synthetic
atacgccatgctgggtctccagcccaatctgcctcagttctttcatttatggacaaaggaattcccttcatgaaaatgaacatatctgtggtcatacttttggtcagtggctggaattcacgtacttgggagtcggccat

SEQ ID NO: 450200 - DNA, 140 bp, Artificial Sequence
  Synthetic
atggccgactcccaagtacgtgaattccagccactgaccaaaagtatgaccacagatatgttcattttcatgaagggaattcctttgtccataaatgaaagaactgaggcagattgggctggagacccagcatggcgtat

SEQ ID NO: 450201 - DNA, 140 bp, Artificial Sequence
  Synthetic
atacgccatgctgggtctccatcacagtgatccctctgttgtgcggcattggtggagccatgttgcactggacgctcatacttcctgggattaaagcccagcaatcaaagctggctcaaacgtacttgggagtcggccat

SEQ ID NO: 450202 - DNA, 140 bp, Artificial Sequence
  Synthetic
atggccgactcccaagtacgtttgagccagctttgattgctgggctttaatcccaggaagtatgagcgtccagtgcaacatggctccaccaatgccgcacaacagagggatcactgtgatggagacccagcatggcgtat

SEQ ID NO: 450203 - DNA, 140 bp, Artificial Sequence
  Synthetic
atacgccatgctgggtctccaaagagtttttcatggagtggcaaaaaatccagttgttgatggtaatccaactgctgacattgaggaagccccagaaatgccagctttatatgaaaagaacgtacttgggagtcggccat

SEQ ID NO: 450204 - DNA, 140 bp, Artificial Sequence
  Synthetic
atggccgactcccaagtacgttcttttcatataaagctggcatttctggggcttcctcaatgtcagcagttggattaccatcaacaactggattttttgccactccatgaaaaactctttggagacccagcatggcgtat

SEQ ID NO: 450205 - DNA, 140 bp, Artificial Sequence
  Synthetic
atacgccatgctgggtctccgctggctctttacctccttctggccctaagcctcatgtcagttgccatgtgcagaacccctttttccttagcggaaggaatagtattgtcatctgccgcccgtacttgggagtcggccat

SEQ ID NO: 450206 - DNA, 140 bp, Artificial Sequence
  Synthetic
atggccgactcccaagtacgggcggcagatgacaatactattccttccgctaaggaaaaaggggttctgcacatggcaactgacatgaggcttagggccagaaggaggtaaagagccagcggagacccagcatggcgtat

SEQ ID NO: 450207 - DNA, 140 bp, Artificial Sequence
  Synthetic
atacgccatgctgggtctcccttggacctctcattgaggggaacactagtctgttgtggaatggcccaatggccgtttccatgactggagtcatgcgtggcaactactatgcttttgtggcgtacttgggagtcggccat

SEQ ID NO: 450208 - DNA, 140 bp, Artificial Sequence
  Synthetic
atggccgactcccaagtacgccacaaaagcatagtagttgccacgcatgactccagtcatggaaacggccattgggccattccacaacagactagtgttcccctcaatgagaggtccaagggagacccagcatggcgtat

SEQ ID NO: 450209 - DNA, 140 bp, Artificial Sequence
  Synthetic
atacgccatgctgggtctccgagtcatgtacaatctctggaaaatgaaaacagagcgtagagggagtgcaagtggaaaaacattgggtgaggtctggaagcgtgaactcaacttgctagacgtacttgggagtcggccat

SEQ ID NO: 450210 - DNA, 140 bp, Artificial Sequence
  Synthetic
atggccgactcccaagtacgtctagcaagttgagttcacgcttccagacctcacccaatgtttttccacttgcactccctctacgctctgttttcattttccagagattgtacatgactcggagacccagcatggcgtat

SEQ ID NO: 450211 - DNA, 140 bp, Artificial Sequence
  Synthetic
atacgccatgctgggtctcccaaacaacaatttgaaatgtacaaaagaacagacatcattgaggtggaccgagacatggcacgacgacacttggcagagggaaaggtggacacgggagtgcgtacttgggagtcggccat

SEQ ID NO: 450212 - DNA, 140 bp, Artificial Sequence
  Synthetic
atggccgactcccaagtacgcactcccgtgtccacctttccctctgccaagtgtcgtcgtgccatgtctcggtccacctcaatgatgtctgttcttttgtacatttcaaattgttgtttgggagacccagcatggcgtat

SEQ ID NO: 450213 - DNA, 140 bp, Artificial Sequence
  Synthetic
atacgccatgctgggtctccgccgtgtcgagagggactgcaaagctgagatggttccacgagcgtggctatgtgaagctagaaggaagggtcaccgatcttgggtgtggacgtggaggctcgtacttgggagtcggccat

SEQ ID NO: 450214 - DNA, 140 bp, Artificial Sequence
  Synthetic
atggccgactcccaagtacgagcctccacgtccacacccaagatcggtgacccttccttctagcttcacatagccacgctcgtggaaccatctcagctttgcagtccctctcgacacggcggagacccagcatggcgtat

SEQ ID NO: 450215 - DNA, 140 bp, Artificial Sequence
  Synthetic
atacgccatgctgggtctccggtgctactatgcagcagctcaaaaagaagttagtggtgtgaaggggtatacccttggcagagatggtcatgagaaacctatgaatgtccaaagcttgggcgtacttgggagtcggccat

SEQ ID NO: 450216 - DNA, 140 bp, Artificial Sequence
  Synthetic
atggccgactcccaagtacgcccaagctttggacattcataggtttctcatgaccatctctgccaagggtataccccttcacaccactaacttctttttgagctgctgcatagtagcaccggagacccagcatggcgtat

SEQ ID NO: 450217 - DNA, 140 bp, Artificial Sequence
  Synthetic
atacgccatgctgggtctccatggaatattgtgacttttaaggacaagactgatgttcaccgactggagccactcaagtgtgaaactctcctctgtgacattggagaatcgtccccatcccgtacttgggagtcggccat

SEQ ID NO: 450218 - DNA, 140 bp, Artificial Sequence
  Synthetic
atggccgactcccaagtacgggatggggacgattctccaatgtcacagaggagagtttcacacttgagtggctccagtcggtgaacatcagtcttgtccttaaaagtcacaatattccatggagacccagcatggcgtat

SEQ ID NO: 450219 - DNA, 140 bp, Artificial Sequence
  Synthetic
atacgccatgctgggtctcctccgcaactgagggtgagaggaccttaagagttctggacacagttgaaaagtggttggcttgtggagtggacaacttttgcatcaaagttctggcaccatcgtacttgggagtcggccat

SEQ ID NO: 450220 - DNA, 140 bp, Artificial Sequence
  Synthetic
atggccgactcccaagtacgatggtgccagaactttgatgcaaaagttgtccactccacaagccaaccacttttcaactgtgtccagaactcttaaggtcctctcaccctcagttgcggaggagacccagcatggcgtat

SEQ ID NO: 450221 - DNA, 140 bp, Artificial Sequence
  Synthetic
atacgccatgctgggtctccacatgcccgatgtgatagagaaactggagcttcttcaaagaagattcggtggaaccgtcattaggaatcctctttccaggaattccactcatgaaatgtacgtacttgggagtcggccat

SEQ ID NO: 450222 - DNA, 140 bp, Artificial Sequence
  Synthetic
atggccgactcccaagtacgtacatttcatgagtggaattcctggaaagaggattcctaatgacggttccaccgaatcttctttgaagaagctccagtttctctatcacatcgggcatgtggagacccagcatggcgtat

SEQ ID NO: 450223 - DNA, 140 bp, Artificial Sequence
  Synthetic
atacgccatgctgggtctccctacgtgtcaggagcaagaagtaacatcacattcacagtcaatcagacatcacgcctgctgatgcgaaggatgaggcggcccacaggcaaagttaccttgcgtacttgggagtcggccat

SEQ ID NO: 450224 - DNA, 140 bp, Artificial Sequence
  Synthetic
atggccgactcccaagtacgcaaggtaactttgcctgtgggccgcctcatccttcgcatcagcaggcgtgatgtctgattgactgtgaatgtgatgttacttcttgctcctgacacgtagggagacccagcatggcgtat

SEQ ID NO: 450225 - DNA, 140 bp, Artificial Sequence
  Synthetic
atacgccatgctgggtctccgaagctgatgttattcttccgataggcacgcgcagtgtggaaactgataaaggcccattggataaggatgctattgaggaaagagttgagagaatcaagacgtacttgggagtcggccat

SEQ ID NO: 450226 - DNA, 140 bp, Artificial Sequence
  Synthetic
atggccgactcccaagtacgtcttgattctctcaactctttcctcaatagcatccttatccaatgggcctttatcagtttccacactgcgcgtgcctatcggaagaataacatcagcttcggagacccagcatggcgtat

SEQ ID NO: 450227 - DNA, 140 bp, Artificial Sequence
  Synthetic
atacgccatgctgggtctccatgaatatgccactacatggttctatgacaatgacaacccgtatagaacgtggcattattgtggctcctatgtgaccaaaacgtcaggaagtgcagccagcgtacttgggagtcggccat

SEQ ID NO: 450228 - DNA, 140 bp, Artificial Sequence
  Synthetic
atggccgactcccaagtacgctggctgcacttcctgacgttttggtcacataggagccacaataatgccacgttctatacgggttgtcattgtcatagaaccatgtagtggcatattcatggagacccagcatggcgtat

SEQ ID NO: 450229 - DNA, 140 bp, Artificial Sequence
  Synthetic
atacgccatgctgggtctcccatgataaatggagttatcaaaatcttaacttttccatgggacagaatagaagaagtcacaagaatggcaatgactgacaccacaccttttggacaacaacgtacttgggagtcggccat

SEQ ID NO: 450230 - DNA, 140 bp, Artificial Sequence
  Synthetic
atggccgactcccaagtacgttgttgtccaaaaggtgtggtgtcagtcattgccattcttgtgacttcttctattctgtcccatggaaaagttaagattttgataactccatttatcatgggagacccagcatggcgtat

SEQ ID NO: 450231 - DNA, 140 bp, Artificial Sequence
  Synthetic
atacgccatgctgggtctccagagttttcaaggagaaagtagacacaagagcaaaagaccctcctgctggaacaaggaagatcatgaaggtggtgaatagatggttgtttcggcatctgtcgtacttgggagtcggccat

SEQ ID NO: 450232 - DNA, 140 bp, Artificial Sequence
  Synthetic
atggccgactcccaagtacgacagatgccgaaacaaccatctattcaccaccttcatgatcttccttgttccagcaggagggtcttttgctcttgtgtctactttctccttgaaaactctggagacccagcatggcgtat

SEQ ID NO: 450233 - DNA, 140 bp, Artificial Sequence
  Synthetic
atacgccatgctgggtctccccagggagaagaaccctaggttgtgcaccaaagaagagttcattgccaaagtgcggagccatgccgcagtgggggcttttctagaggagcaagagcagtgcgtacttgggagtcggccat

SEQ ID NO: 450234 - DNA, 140 bp, Artificial Sequence
  Synthetic
atggccgactcccaagtacgcactgctcttgctcctctagaaaagcccccactgcggcatggctccgcactttggcaatgaactcttctttggtgcacaacctagggttcttctccctggggagacccagcatggcgtat

SEQ ID NO: 450235 - DNA, 140 bp, Artificial Sequence
  Synthetic
atacgccatgctgggtctccgaaaacggccaatgaggcagtccaggatccaaagttttgggagatggtcgatgcagaacgcaaacttcatcagcaggggcgatgccagtcctgtgtgtaccgtacttgggagtcggccat

SEQ ID NO: 450236 - DNA, 140 bp, Artificial Sequence
  Synthetic
atggccgactcccaagtacggtacacacaggactggcatcgcccctgctgatgaagtttgcgttctgcatcgaccatctcccaaaactttggatcctggactgcctcattggccgttttcggagacccagcatggcgtat

SEQ ID NO: 450237 - DNA, 140 bp, Artificial Sequence
  Synthetic
atacgccatgctgggtctccaacatgatgggaaagagggaaaagaaactctctgaatttggaaaggccaaagggagccgtgctatctggtacatgtggcttggggcacggtttcttgagtcgtacttgggagtcggccat

SEQ ID NO: 450238 - DNA, 140 bp, Artificial Sequence
  Synthetic
atggccgactcccaagtacgactcaagaaaccgtgccccaagccacatgtaccagatagcacggctccctttggcctttccaaattcagagagtttcttttccctctttcccatcatgttggagacccagcatggcgtat

SEQ ID NO: 450239 - DNA, 140 bp, Artificial Sequence
  Synthetic
atacgccatgctgggtctccttgaggctcttgggttcttaaatgaagatcactgggcctcccgggagaactcggggggaggagttgagggcacaggactccagtacttgggctatgttatcgtacttgggagtcggccat

SEQ ID NO: 450240 - DNA, 140 bp, Artificial Sequence
  Synthetic
atggccgactcccaagtacgataacatagcccaagtactggagtcctgtgccctcaactcctccccccgagttctcccgggaggcccagtgatcttcatttaagaacccaagagcctcaaggagacccagcatggcgtat

SEQ ID NO: 450241 - DNA, 140 bp, Artificial Sequence
  Synthetic
atacgccatgctgggtctcccagggacttgtcagccaaagaaggtggagggttttatgctgatgacaccgccggctgggacacacgcatcacagaagctgacctggatgacgagcaagagcgtacttgggagtcggccat

SEQ ID NO: 450242 - DNA, 140 bp, Artificial Sequence
  Synthetic
atggccgactcccaagtacgctcttgctcgtcatccaggtcagcttctgtgatgcgtgtgtcccagccggcggtgtcatcagcataaaaccctccaccttctttggctgacaagtccctgggagacccagcatggcgtat

SEQ ID NO: 450243 - DNA, 140 bp, Artificial Sequence
  Synthetic
atacgccatgctgggtctccatcatgagttacatgagccctgaacaaaggaagctggcctgggccataatggaaatgacatacaagaacaaagtggtcaaggtgctgaggccagccccagcgtacttgggagtcggccat

SEQ ID NO: 450244 - DNA, 140 bp, Artificial Sequence
  Synthetic
atggccgactcccaagtacgctggggctggcctcagcaccttgaccactttgttcttgtatgtcatttccattatggcccaggccagcttcctttgttcagggctcatgtaactcatgatggagacccagcatggcgtat

SEQ ID NO: 450245 - DNA, 140 bp, Artificial Sequence
  Synthetic
atacgccatgctgggtctccgaggcaaggccttcatggacatcatcagccggagagaccaaagggggtcaggacaagttgtgacatacgccctcaacaccataaccaatctaaaagtccacgtacttgggagtcggccat

SEQ ID NO: 450246 - DNA, 140 bp, Artificial Sequence
  Synthetic
atggccgactcccaagtacgtggacttttagattggttatggtgttgagggcgtatgtcacaacttgtcctgaccccctttggtctctccggctgatgatgtccatgaaggccttgcctcggagacccagcatggcgtat

SEQ ID NO: 450247 - DNA, 140 bp, Artificial Sequence
  Synthetic
atacgccatgctgggtctccgctcataagaatggctgaagctgaaatggtgattaaccatcagcatgtgcaggagtgtggtgaaaatgtcttagagcggctcgaaacttggcttgctgaacgtacttgggagtcggccat

SEQ ID NO: 450248 - DNA, 140 bp, Artificial Sequence
  Synthetic
atggccgactcccaagtacgttcagcaagccaagtttcgagccgctctaagacattttcaccacactcctgcacatgctgatggttaatcaccatttcagcttcagccattcttatgagcggagacccagcatggcgtat

SEQ ID NO: 450249 - DNA, 140 bp, Artificial Sequence
  Synthetic
atacgccatgctgggtctccaatggatgtgacagattgagccgaatggctgtgagtggagatgattgtgtggtgagaccggtggatgacagatttggtctggccctttcccatctcaatgcgtacttgggagtcggccat

SEQ ID NO: 450250 - DNA, 140 bp, Artificial Sequence
  Synthetic
atggccgactcccaagtacgcattgagatgggaaagggccagaccaaatctgtcatccaccggtctcaccacacaatcatctccactcacagccattcggctcaatctgtcacatccattggagacccagcatggcgtat

SEQ ID NO: 450251 - DNA, 140 bp, Artificial Sequence
  Synthetic
atacgccatgctgggtctcccaatgtccaaagttaggaaggacatatcagaatggcaaccctccaaaggatggacagattgggaaaatgttcctttctgctctcaccacttccatgaactcgtacttgggagtcggccat

SEQ ID NO: 450252 - DNA, 140 bp, Artificial Sequence
  Synthetic
atggccgactcccaagtacgagttcatggaagtggtgagagcagaaaggaacattttcccaatctgtccatcctttggagggttgccattctgatatgtccttcctaactttggacattgggagacccagcatggcgtat

SEQ ID NO: 450253 - DNA, 140 bp, Artificial Sequence
  Synthetic
atacgccatgctgggtctccggtgttgaaagatgggaggaagatagtggtgccttgcagagaccaagatgaactgatagggagagggagagtgtccccaggaaatggctggatgatcaagcgtacttgggagtcggccat

SEQ ID NO: 450254 - DNA, 140 bp, Artificial Sequence
  Synthetic
atggccgactcccaagtacgcttgatcatccagccatttcctggggacactctccctctccctatcagttcatcttggtctctgcaaggcaccactatcttcctcccatctttcaacaccggagacccagcatggcgtat

SEQ ID NO: 450255 - DNA, 140 bp, Artificial Sequence
  Synthetic
atacgccatgctgggtctccgaaacagcctgcctcagcaaagcttatgcaaacatgtggtcactgatgtacttccacaagagggacatgaggctactttcatttgctgtttcctccgctgcgtacttgggagtcggccat

SEQ ID NO: 450256 - DNA, 140 bp, Artificial Sequence
  Synthetic
atggccgactcccaagtacgcagcggaggaaacagcaaatgaaagtagcctcatgtccctcttgtggaagtacatcagtgaccacatgtttgcataagctttgctgaggcaggctgtttcggagacccagcatggcgtat

SEQ ID NO: 450257 - DNA, 140 bp, Artificial Sequence
  Synthetic
atacgccatgctgggtctccttccaacagcctgggtgcccagtggaaggacgacgtggtctgtccacggaagaggggagtggatgaccactgaggacatgctagatgtctggaacagggtcgtacttgggagtcggccat

SEQ ID NO: 450258 - DNA, 140 bp, Artificial Sequence
  Synthetic
atggccgactcccaagtacgaccctgttccagacatctagcatgtcctcagtggtcatccactcccctcttccgtggacagaccacgtcgtccttccactgggcacccaggctgttggaaggagacccagcatggcgtat

SEQ ID NO: 450259 - DNA, 140 bp, Artificial Sequence
  Synthetic
atacgccatgctgggtctccgtgggtgttgaataacccgcacatgacggacaaaacaaccatcaaggagtggagagatgttccctacctcacaaagagacaggataagctttgcgggtcacgtacttgggagtcggccat

SEQ ID NO: 450260 - DNA, 140 bp, Artificial Sequence
  Synthetic
atggccgactcccaagtacgtgacccgcaaagcttatcctgtctctttgtgaggtagggaacatctctccactccttgatggttgttttgtccgtcatgtgcgggttattcaacacccacggagacccagcatggcgtat

SEQ ID NO: 450261 - DNA, 140 bp, Artificial Sequence
  Synthetic
atacgccatgctgggtctccctgataggaatgacaaacagggccacatgggcatctcacatccaccttgtgatccaccggatcagaactctaataggtcaagagaagttcacagactacccgtacttgggagtcggccat

SEQ ID NO: 450262 - DNA, 140 bp, Artificial Sequence
  Synthetic
atggccgactcccaagtacgggtagtctgtgaacttctcttgacctattagagttctgatccggtggatcacaaggtggatgtgagatgcccatgtggccctgtttgtcattcctatcagggagacccagcatggcgtat

SEQ ID NO: 450263 - DNA, 140 bp, Artificial Sequence
  Synthetic
atacgccatgctgggtctcctcaccgtcatggacaggtattctgttgatgctgaccttcagccaggagagcttatttgagacatgacaacatggaaaaccgggataaaaactacgggtggcgtacttgggagtcggccat

SEQ ID NO: 450264 - DNA, 140 bp, Artificial Sequence
  Synthetic
atggccgactcccaagtacgccacccgtagtttttatcccggttttccatgttgtcatgtctcaaataagctctcctggctgaaggtcagcatcaacagaatacctgtccatgacggtgaggagacccagcatggcgtat

SEQ ID NO: 450265 - DNA, 140 bp, Artificial Sequence
  Synthetic
atacgccatgctgggtctccagaaccggactccccacttgagaaatgtaaataagaaaccgggataaaaacaacggatggagaaccggactccacactgaataggttataaacgtcagcccgtacttgggagtcggccat

SEQ ID NO: 450266 - DNA, 140 bp, Artificial Sequence
  Synthetic
atggccgactcccaagtacgggctgacgtttataacctattcagtgtggagtccggttctccatccgttgtttttatcccggtttcttatttacatttctcaagtggggagtccggttctggagacccagcatggcgtat

SEQ ID NO: 450267 - DNA, 140 bp, Artificial Sequence
  Synthetic
atacgccatgctgggtctcccaggatccaaaatttgaatgggtcttgccaccgctaagctgtgaggcggtgcgggctgggacagccgtttcccgggcaacgacatgcctggtttctgggacgtacttgggagtcggccat

SEQ ID NO: 450268 - DNA, 140 bp, Artificial Sequence
  Synthetic
atggccgactcccaagtacgtcccagaaaccaggcatgtcgttgcccgggaaacggctgtcccagcccgcaccgcctcacagcttagcggtggcaagacccattcaaattttggatcctgggagacccagcatggcgtat

SEQ ID NO: 450269 - DNA, 140 bp, Artificial Sequence
  Synthetic
atacgccatgctgggtctcccttcccaacccggagtaaaatgaaggagcctccgccaccaccctcccacggggtgttggaaagatggggtctagaggttagaggagaccctccagggaaacgtacttgggagtcggccat

SEQ ID NO: 450270 - DNA, 140 bp, Artificial Sequence
  Synthetic
atggccgactcccaagtacgtttccctggagggtctcctctaacctctagaccccatctttccaacaccccgtgggagggtggtggcggaggctccttcattttactccgggttgggaagggagacccagcatggcgtat

SEQ ID NO: 450271 - DNA, 140 bp, Artificial Sequence
  Synthetic
aggccctggctgctgatatgttacagctggagaaatacatgctgtcccttttggtttggtgagcatgatgatagcaatggaagtggtcctaaggaaaagacagggaccaaagcaaatgttgaccttttgggacagcggtg

SEQ ID NO: 450272 - DNA, 140 bp, Artificial Sequence
  Synthetic
caccgctgtcccaaaaggtcaacatttgctttggtccctgtcttttccttaggaccacttccattgctatcatcatgctcaccaaaccaaaagggacagcatgtatttctccagctgtaacatatcagcagccagggcct

SEQ ID NO: 450273 - DNA, 140 bp, Artificial Sequence
  Synthetic
atacgccatgctgggtctccgacaactccttcgtgtccgccatatcccagactgaggtgaaggaagaaggaaaggaggagctccaagagatcccgacaatgctaaagaaaggaatgacaacgtacttgggagtcggccat

SEQ ID NO: 450274 - DNA, 140 bp, Artificial Sequence
  Synthetic
atggccgactcccaagtacgttgtcattcctttctttagcattgtcgggatctcttggagctcctcctttccttcttccttcacctcagtctgggatatggcggacacgaaggagttgtcggagacccagcatggcgtat

SEQ ID NO: 450275 - DNA, 140 bp, Artificial Sequence
  Synthetic
aggccctggctgctgatatgagggaaagaccggagtggttctctgcttttcctccagaggtctgtgagcacagtttgctcaagaataagcagacctttggatgacaaacacaaaaccactgaccttttgggacagcggtg

SEQ ID NO: 450276 - DNA, 140 bp, Artificial Sequence
  Synthetic
caccgctgtcccaaaaggtcagtggttttgtgtttgtcatccaaaggtctgcttattcttgagcaaactgtgctcacagacctctggaggaaaagcagagaaccactccggtctttccctcatatcagcagccagggcct

SEQ ID NO: 450277 - DNA, 140 bp, Artificial Sequence
  Synthetic
atacgccatgctgggtctcccaaggatttatttttttctttttgtttaacattctgactgggaaaaagatcacggctcacctaaagaggttgtggaaaatgttggacccaagacagggctcgtacttgggagtcggccat

SEQ ID NO: 450278 - DNA, 140 bp, Artificial Sequence
  Synthetic
atggccgactcccaagtacgagccctgtcttgggtccaacattttccacaacctctttaggtgagccgtgatctttttcccagtcagaatgttaaacaaaaagaaaaaaataaatccttgggagacccagcatggcgtat

SEQ ID NO: 450279 - DNA, 140 bp, Artificial Sequence
  Synthetic
atacgccatgctgggtctcctggttgttctaaggaaagtcaagagagtggtggccagtttgatgagaggattgtcctcaaggaagcgccgctctcatgatgttctgactgtgcaattcctcgtacttgggagtcggccat

SEQ ID NO: 450280 - DNA, 140 bp, Artificial Sequence
  Synthetic
atggccgactcccaagtacgaggaattgcacagtcagaacatcatgagagcggcgcttccttgaggacaatcctctcatcaaactggccaccactctcttgactttccttagaacaaccaggagacccagcatggcgtat

SEQ ID NO: 450281 - DNA, 140 bp, Artificial Sequence
  Synthetic
aggccctggctgctgatatgtccgtgggcacaggcaactgcactacaaacatcttggaagctaagtactggtgcccagattcaatggaatacaactgtcctaatctcagtccaagagagggaccttttgggacagcggtg

SEQ ID NO: 450282 - DNA, 140 bp, Artificial Sequence
  Synthetic
caccgctgtcccaaaaggtccctctcttggactgagattaggacagttgtattccattgaatctgggcaccagtacttagcttccaagatgtttgtagtgcagttgcctgtgcccacggacatatcagcagccagggcct

SEQ ID NO: 450283 - DNA, 140 bp, Artificial Sequence
  Synthetic
atacgccatgctgggtctccccttgtgggaagcaacatgacgcaacgagtcgtgattgccctactggtcttggctgttggtccggcctactcagctcactgcattggaattaccgacaggcgtacttgggagtcggccat

SEQ ID NO: 450284 - DNA, 140 bp, Artificial Sequence
  Synthetic
atggccgactcccaagtacgcctgtcggtaattccaatgcagtgagctgagtaggccggaccaacagccaagaccagtagggcaatcacgactcgttgcgtcatgttgcttcccacaaggggagacccagcatggcgtat

SEQ ID NO: 450285 - DNA, 140 bp, Artificial Sequence
  Synthetic
atacgccatgctgggtctcctgttacaatgcagttctcacccatgtgaagattaatgacaagtgtcccagcaccggagaggctcacctagttgaagagaacgaaggggacaatgcgtgcacgtacttgggagtcggccat

SEQ ID NO: 450286 - DNA, 140 bp, Artificial Sequence
  Synthetic
atggccgactcccaagtacgtgcacgcattgtccccttcgttctcttcaactaggtgagcctctccggtgctgggacacttgtcattaatcttcacatgggtgagaactgcattgtaacaggagacccagcatggcgtat

SEQ ID NO: 450287 - DNA, 140 bp, Artificial Sequence
  Synthetic
aggccctggctgctgatatgcaccggagaggctcacctagttgaagagaacgaaggggacaatgcgtgcaagcgtacctattctgatagaggctggggtaatggctgtggcctgtttggggaccttttgggacagcggtg

SEQ ID NO: 450288 - DNA, 140 bp, Artificial Sequence
  Synthetic
caccgctgtcccaaaaggtccccaaacaggccacagccattaccccagcctctatcagaataggtacgcttgcacgcattgtccccttcgttctcttcaactaggtgagcctctccggtgcatatcagcagccagggcct

SEQ ID NO: 450289 - DNA, 140 bp, Artificial Sequence
  Synthetic
aggccctggctgctgatatgagcgtacctattctgatagaggctggggtaatggctgtggcctgtttgggaaagggagcattgtggcatgcgccaaattcacttgtgccaaatccatgaggaccttttgggacagcggtg

SEQ ID NO: 450290 - DNA, 140 bp, Artificial Sequence
  Synthetic
caccgctgtcccaaaaggtcctcatggatttggcacaagtgaatttggcgcatgccacaatgctccctttcccaaacaggccacagccattaccccagcctctatcagaataggtacgctcatatcagcagccagggcct

SEQ ID NO: 450291 - DNA, 140 bp, Artificial Sequence
  Synthetic
atacgccatgctgggtctccgctcaggacttgaccctgccatggcagagtggaagtggcggggtgtggagagagatgcatcatcttgttgaatttgaacctccgcatgccgcaactatcacgtacttgggagtcggccat

SEQ ID NO: 450292 - DNA, 140 bp, Artificial Sequence
  Synthetic
atggccgactcccaagtacgtgatagttgcggcatgcggaggttcaaattcaacaagatgatgcatctctctccacaccccgccacttccactctgccatggcagggtcaagtcctgagcggagacccagcatggcgtat

SEQ ID NO: 450293 - DNA, 140 bp, Artificial Sequence
  Synthetic
atacgccatgctgggtctccgagtgctggctctgggaaaccaggaaggctccttgaaaacagctcttaccggtgcaatgagggtcacaaaggatacaaatgacaacaacctttacaaactcgtacttgggagtcggccat

SEQ ID NO: 450294 - DNA, 140 bp, Artificial Sequence
  Synthetic
atggccgactcccaagtacgagtttgtaaaggttgttgtcatttgtatcctttgtgaccctcattgcaccggtaagagctgttttcaaggagccttcctggtttcccagagccagcactcggagacccagcatggcgtat

SEQ ID NO: 450295 - DNA, 140 bp, Artificial Sequence
  Synthetic
aggccctggctgctgatatgaggagccccctgtaagattccagtgatagtagctgatgatcttacagcggcaatcaataaaggcattttggttacagtcaatcccatcgcttcaaccaatgaccttttgggacagcggtg

SEQ ID NO: 450296 - DNA, 140 bp, Artificial Sequence
  Synthetic
caccgctgtcccaaaaggtcattggttgaagcgatgggattgactgtaaccaaaatgcctttattgattgccgctgtaagatcatcagctactatcactggaatcttacagggggctcctcatatcagcagccagggcct

SEQ ID NO: 450297 - DNA, 140 bp, Artificial Sequence
  Synthetic
atacgccatgctgggtctccgatgatgaagtgctgattgaggtgaacccaccctttggagatagctacatcatcgttgggacaggagattcacgtctcacctaccagtggcacaaagaggcgtacttgggagtcggccat

SEQ ID NO: 450298 - DNA, 140 bp, Artificial Sequence
  Synthetic
atggccgactcccaagtacgcctctttgtgccactggtaggtgagacgtgaatctcctgtcccaacgatgatgtagctatctccaaagggtgggttcacctcaatcagcacttcatcatcggagacccagcatggcgtat

SEQ ID NO: 450299 - DNA, 140 bp, Artificial Sequence
  Synthetic
aggccctggctgctgatatgcatcgttgggacaggagattcacgtctcacctaccagtggcacaaagagggaagctcaataggaaagctgttcactcagaccatgaaaggcgcggaacgcgaccttttgggacagcggtg

SEQ ID NO: 450300 - DNA, 140 bp, Artificial Sequence
  Synthetic
caccgctgtcccaaaaggtcgcgttccgcgcctttcatggtctgagtgaacagctttcctattgagcttccctctttgtgccactggtaggtgagacgtgaatctcctgtcccaacgatgcatatcagcagccagggcct

SEQ ID NO: 450301 - DNA, 140 bp, Artificial Sequence
  Synthetic
aggccctggctgctgatatggtactcatatgggttggcatcaatacaagaaacatgacaatgtccatgagcatgatcttggtaggagtgatcatgatgttcctgtccctgggagttgggggaccttttgggacagcggtg

SEQ ID NO: 450302 - DNA, 140 bp, Artificial Sequence
  Synthetic
caccgctgtcccaaaaggtcccccaactcccagggacaggaacatcatgatcactcctaccaagatcatgctcatggacattgtcatgtttcttgtattgatgccaacccatatgagtaccatatcagcagccagggcct

SEQ ID NO: 450303 - DNA, 140 bp, Artificial Sequence
  Synthetic
atacgccatgctgggtctccgatggtatcttcatatttagagactctgatgactggctaaacaagtactcatactatccagaagaccctgtgaagcttgcatcaatagtgaaagcctcttcgtacttgggagtcggccat

SEQ ID NO: 450304 - DNA, 140 bp, Artificial Sequence
  Synthetic
atggccgactcccaagtacgaagaggctttcactattgatgcaagcttcacagggtcttctggatagtatgagtacttgtttagccagtcatcagagtctctaaatatgaagataccatcggagacccagcatggcgtat

SEQ ID NO: 450305 - DNA, 140 bp, Artificial Sequence
  Synthetic
aggccctggctgctgatatgagtggacatctctgttgttgtgcaggatccaaagaatgtttaccagagaggaacgcatccattttccagaattcgggatggtttgcagtacggttggaaggaccttttgggacagcggtg

SEQ ID NO: 450306 - DNA, 140 bp, Artificial Sequence
  Synthetic
caccgctgtcccaaaaggtccttccaaccgtactgcaaaccatcccgaattctggaaaatggatgcgttcctctctggtaaacattctttggatcctgcacaacaacagagatgtccactcatatcagcagccagggcct

SEQ ID NO: 450307 - DNA, 140 bp, Artificial Sequence
  Synthetic
aggccctggctgctgatatggtgtacatggacgcagtctttgaatacaccatagactgcgatgggtccatcttgggggcagcagtgaacgggaaaaagagtgcccatgggtctccaacatgaccttttgggacagcggtg

SEQ ID NO: 450308 - DNA, 140 bp, Artificial Sequence
  Synthetic
caccgctgtcccaaaaggtcatgttggagacccatgggcactctttttcccgttcactgctgcccccaagatggacccatcgcagtctatggtgtattcaaagactgcgtccatgtacaccatatcagcagccagggcct

SEQ ID NO: 450309 - DNA, 140 bp, Artificial Sequence
  Synthetic
aggccctggctgctgatatgtttggatgggaagtcatgaagtaaatgggacgtggatgatccacaccttggaggcattagattacaaggagtgcgagtggccactgacacacacgattgggaccttttgggacagcggtg

SEQ ID NO: 450310 - DNA, 140 bp, Artificial Sequence
  Synthetic
caccgctgtcccaaaaggtcccaatcgtgtgtgtcagtggccactcgcactccttgtaatctaatgcctccaaggtgtggatcatccacgtcccatttacttcatgacttcccatccaaacatatcagcagccagggcct

SEQ ID NO: 450311 - DNA, 140 bp, Artificial Sequence
  Synthetic
aggccctggctgctgatatgcagttagctctcacaatcatatccctgggtataaggttcagacgaacggaccttggatgcaggtaccactagaagtgaggagagaagcttgcccagggacgaccttttgggacagcggtg

SEQ ID NO: 450312 - DNA, 140 bp, Artificial Sequence
  Synthetic
caccgctgtcccaaaaggtcgtccctgggcaagcttctctcctcacttctagtggtacctgcatccaaggtccgttcgtctgaaccttatacccagggatatgattgtgagagctaactgcatatcagcagccagggcct

SEQ ID NO: 450313 - DNA, 140 bp, Artificial Sequence
  Synthetic
atacgccatgctgggtctccacaatgccgcctgtaagcttccatggtagtgatgggtgttggtatcccatggaaatcaggccaaggaaaacacatgaaagccacttggtgcgttcctgggcgtacttgggagtcggccat

SEQ ID NO: 450314 - DNA, 140 bp, Artificial Sequence
  Synthetic
atggccgactcccaagtacgcccaggaacgcaccaagtggctttcatgtgttttccttggcctgatttccatgggataccaacacccatcactaccatggaagcttacaggcggcattgtggagacccagcatggcgtat

SEQ ID NO: 450315 - DNA, 140 bp, Artificial Sequence
  Synthetic
atacgccatgctgggtctccggttggaggagtggtgctcttgggagcaatgctggtcgggcaggtaactctccttgatttgctgaaactcatagtggctgtgggattgcacttccatgagcgtacttgggagtcggccat

SEQ ID NO: 450316 - DNA, 140 bp, Artificial Sequence
  Synthetic
atggccgactcccaagtacgctcatggaagtgcaatcccacagccactatgagtttcagcaaatcaaggagagttacctgcccgaccagcattgctcccaagagcaccactcctccaaccggagacccagcatggcgtat

SEQ ID NO: 450317 - DNA, 140 bp, Artificial Sequence
  Synthetic
aggccctggctgctgatatgtccttgatttgctgaaactcatagtggctgtgggattgcacttccatgagatgaataacggaggagacgccatgtacatggcgttgattgctgccttttcgaccttttgggacagcggtg

SEQ ID NO: 450318 - DNA, 140 bp, Artificial Sequence
  Synthetic
caccgctgtcccaaaaggtcgaaaaggcagcaatcaacgccatgtacatggcgtctcctccgttattcatctcatggaagtgcaatcccacagccactatgagtttcagcaaatcaaggacatatcagcagccagggcct

SEQ ID NO: 450319 - DNA, 140 bp, Artificial Sequence
  Synthetic
aggccctggctgctgatatgctcgggaacgccttgtgctgaccctgggagcagccatggtggagattgctctgggtggtatgatgggtggcctgtggaagtatctgaatgcagtttctctgaccttttgggacagcggtg

SEQ ID NO: 450320 - DNA, 140 bp, Artificial Sequence
  Synthetic
caccgctgtcccaaaaggtcagagaaactgcattcagatacttccacaggccacccatcataccacccagagcaatctccaccatggctgctcccagggtcagcacaaggcgttcccgagcatatcagcagccagggcct

SEQ ID NO: 450321 - DNA, 140 bp, Artificial Sequence
  Synthetic
aggccctggctgctgatatgtcctgcccctcatggctctgttgacacctgtcactatggcagaggtgagacttgccacaatgcttttttgcaccgtggttattataggggtccttcaccagaccttttgggacagcggtg

SEQ ID NO: 450322 - DNA, 140 bp, Artificial Sequence
  Synthetic
caccgctgtcccaaaaggtctggtgaaggacccctataataaccacggtgcaaaaaagcattgtggcaagtctcacctctgccatagtgacaggtgtcaacagagccatgaggggcaggacatatcagcagccagggcct

SEQ ID NO: 450323 - DNA, 140 bp, Artificial Sequence
  Synthetic
atacgccatgctgggtctccactcacagcagctggtctggtgggagtgctggcaggactggctttccaggagatggagaacttccttggtccgattgcagttggaggaattctgatgatgcgtacttgggagtcggccat

SEQ ID NO: 450324 - DNA, 140 bp, Artificial Sequence
  Synthetic
atggccgactcccaagtacgcatcatcagaattcctccaactgcaatcggaccaaggaagttctccatctcctggaaagccagtcctgccagcactcccaccagaccagctgctgtgagtggagacccagcatggcgtat

SEQ ID NO: 450325 - DNA, 140 bp, Artificial Sequence
  Synthetic
aggccctggctgctgatatgccttgtcgcctatggtggctcatggaagctggaaggcagatgggatggagaggaagaggttcagttgattgctgctgttccaggaaagaacgtggtcaatgaccttttgggacagcggtg

SEQ ID NO: 450326 - DNA, 140 bp, Artificial Sequence
  Synthetic
caccgctgtcccaaaaggtcattgaccacgttctttcctggaacagcagcaatcaactgaacctcttcctctccatcccatctgccttccagcttccatgagccaccataggcgacaaggcatatcagcagccagggcct

SEQ ID NO: 450327 - DNA, 140 bp, Artificial Sequence
  Synthetic
atacgccatgctgggtctccattcagacaaaaccgagcttgttcaaagtgaggaacgggggagaaatcggggctgtcgctcttgactacccaagtggcacctcaggatctcccattgtcacgtacttgggagtcggccat

SEQ ID NO: 450328 - DNA, 140 bp, Artificial Sequence
  Synthetic
atggccgactcccaagtacgtgacaatgggagatcctgaggtgccacttgggtagtcaagagcgacagccccgatttctcccccgttcctcactttgaacaagctcggttttgtctgaatggagacccagcatggcgtat

SEQ ID NO: 450329 - DNA, 140 bp, Artificial Sequence
  Synthetic
aggccctggctgctgatatgggctgtcgctcttgactacccaagtggcacctcaggatctcccattgtcaacagaaacggagaggtgattgggctgtacggcaatggcatccttgttggtgaccttttgggacagcggtg

SEQ ID NO: 450330 - DNA, 140 bp, Artificial Sequence
  Synthetic
caccgctgtcccaaaaggtcaccaacaaggatgccattgccgtacagcccaatcacctctccgtttctgttgacaatgggagatcctgaggtgccacttgggtagtcaagagcgacagcccatatcagcagccagggcct

SEQ ID NO: 450331 - DNA, 140 bp, Artificial Sequence
  Synthetic
aggccctggctgctgatatgctatccttgattttcatcctggagctgggaagacaagacggtttctcccacagatcttggctgagtgtgcacggagacgcttgcgcactcttgtgctggcgaccttttgggacagcggtg

SEQ ID NO: 450332 - DNA, 140 bp, Artificial Sequence
  Synthetic
caccgctgtcccaaaaggtcgccagcacaagagtgcgcaagcgtctccgtgcacactcagccaagatctgtgggagaaaccgtcttgtcttcccagctccaggatgaaaatcaaggatagcatatcagcagccagggcct

SEQ ID NO: 450333 - DNA, 140 bp, Artificial Sequence
  Synthetic
atacgccatgctgggtctccccccaccagggttgttctctctgaaatgaaggaagcttttcacggcttggacgtgaaattccacacacaggccttttccgctcacggcagcgggagagaacgtacttgggagtcggccat

SEQ ID NO: 450334 - DNA, 140 bp, Artificial Sequence
  Synthetic
atggccgactcccaagtacgttctctcccgctgccgtgagcggaaaaggcctgtgtgtggaatttcacgtccaagccgtgaaaagcttccttcatttcagagagaacaaccctggtggggggagacccagcatggcgtat

SEQ ID NO: 450335 - DNA, 140 bp, Artificial Sequence
  Synthetic
  misc_feature (38)..(38): n is a, c, g, or t
aggccctggctgctgatatggtcattgacgccatgtgncatgccaccctaacttatagaatgttggaaccaactaggattgtcaactgggaagtgatcatcatggatgaagcccattttcgaccttttgggacagcggtg

SEQ ID NO: 450336 - DNA, 140 bp, Artificial Sequence
  Synthetic
  misc_feature (103)..(103): n is a, c, g, or t
caccgctgtcccaaaaggtcgaaaatgggcttcatccatgatgatcacttcccagttgacaatcctagttggttccaacattctataagttagggtggcatgncacatggcgtcaatgaccatatcagcagccagggcct

SEQ ID NO: 450337 - DNA, 140 bp, Artificial Sequence
  Synthetic
atacgccatgctgggtctcctggatccagctagcatagccgccaggggttgggcagcgcacagagctagggcaaatgaaagcgcaacaatcttgatgacagccacgccgccagggactagcgtacttgggagtcggccat

SEQ ID NO: 450338 - DNA, 140 bp, Artificial Sequence
  Synthetic
atggccgactcccaagtacgctagtccctggcggcgtggctgtcatcaagattgttgcgctttcatttgccctagctctgtgcgctgcccaacccctggcggctatgctagctggatccaggagacccagcatggcgtat

SEQ ID NO: 450339 - DNA, 140 bp, Artificial Sequence
  Synthetic
atacgccatgctgggtctcccttttgagagagaataccccacgataaagcagaagaaacctgacttcatattggctactgacatagctgaaatgggagccaacctatgtgtggagcgagtcgtacttgggagtcggccat

SEQ ID NO: 450340 - DNA, 140 bp, Artificial Sequence
  Synthetic
atggccgactcccaagtacgactcgctccacacataggttggctcccatttcagctatgtcagtagccaatatgaagtcaggtttcttctgctttatcgtggggtattctctctcaaaagggagacccagcatggcgtat

SEQ ID NO: 450341 - DNA, 140 bp, Artificial Sequence
  Synthetic
aggccctggctgctgatatgttggctactgacatagctgaaatgggagccaacctatgtgtggagcgagtgctggattgcaggacggcattcaagcctgtgcttgtggatgaagggaggagaccttttgggacagcggtg

SEQ ID NO: 450342 - DNA, 140 bp, Artificial Sequence
  Synthetic
caccgctgtcccaaaaggtctcctcccttcatccacaagcacaggcttgaatgccgtcctgcaatccagcactcgctccacacataggttggctcccatttcagctatgtcagtagccaacatatcagcagccagggcct

SEQ ID NO: 450343 - DNA, 140 bp, Artificial Sequence
  Synthetic
aggccctggctgctgatatgaggcctcaatgctcttggacaacatggaggtaaggggtggaatggttgccccactctatggcgttgaaggaacaaaaacaccagtttcccctggtgaaatgaccttttgggacagcggtg

SEQ ID NO: 450344 - DNA, 140 bp, Artificial Sequence
  Synthetic
caccgctgtcccaaaaggtcatttcaccaggggaaactggtgtttttgttccttcaacgccatagagtggggcaaccattccaccccttacctccatgttgtccaagagcattgaggcctcatatcagcagccagggcct

SEQ ID NO: 450345 - DNA, 140 bp, Artificial Sequence
  Synthetic
atacgccatgctgggtctccgtgatctgcccgtctggctctcgtggcaagtggccaaggctggtttgaagacgaatgatcgtaagtggtgttttgaaggccctgaggagcatgagatcttcgtacttgggagtcggccat

SEQ ID NO: 450346 - DNA, 140 bp, Artificial Sequence
  Synthetic
atggccgactcccaagtacgaagatctcatgctcctcagggccttcaaaacaccacttacgatcattcgtcttcaaaccagccttggccacttgccacgagagccagacgggcagatcacggagacccagcatggcgtat

SEQ ID NO: 450347 - DNA, 140 bp, Artificial Sequence
  Synthetic
atacgccatgctgggtctccgaacgacagtggtgaaacagtgaagtgcagggctcctggaggagcaaagaagcctctgcgcccaaggtggtgtgatgaaagggtgtcatctgaccagagccgtacttgggagtcggccat

SEQ ID NO: 450348 - DNA, 140 bp, Artificial Sequence
  Synthetic
atggccgactcccaagtacggctctggtcagatgacaccctttcatcacaccaccttgggcgcagaggcttctttgctcctccaggagccctgcacttcactgtttcaccactgtcgttcggagacccagcatggcgtat

SEQ ID NO: 450349 - DNA, 140 bp, Artificial Sequence
  Synthetic
atacgccatgctgggtctccgcgcttgctgactttatcaagtttgctgaaggtaggaggggagctgcggaagtgctagttgtgctgagtgaactccctgattttttggctaagaaaggtgcgtacttgggagtcggccat

SEQ ID NO: 450350 - DNA, 140 bp, Artificial Sequence
  Synthetic
atggccgactcccaagtacgcacctttcttagccaaaaaatcagggagttcactcagcacaactagcacttccgcagctcccctcctaccttcagcaaacttgataaagtcagcaagcgcggagacccagcatggcgtat

SEQ ID NO: 450351 - DNA, 140 bp, Artificial Sequence
  Synthetic
atacgccatgctgggtctccttatgtctcctaaaggcatcagtagaatgtccatggcgatgggcacaatggccggctgtggatatctcatgttccttggaggcgttaaacccacgcacatcgtacttgggagtcggccat

SEQ ID NO: 450352 - DNA, 140 bp, Artificial Sequence
  Synthetic
atggccgactcccaagtacgatgtgcgtgggtttaacgcctccaaggaacatgagatatccacagccggccattgtgcccatcgccatggacattctactgatgcctttaggagacataaggagacccagcatggcgtat

SEQ ID NO: 450353 - DNA, 140 bp, Artificial Sequence
  Synthetic
atacgccatgctgggtctccgcctggacagtgtatgttggcattgtcacaatgctctctccaatgttgcaccactggatcaaagtcgaatatggcaacctgtctctgtctggaatagccccgtacttgggagtcggccat

SEQ ID NO: 450354 - DNA, 140 bp, Artificial Sequence
  Synthetic
atggccgactcccaagtacggggctattccagacagagacaggttgccatattcgactttgatccagtggtgcaacattggagagagcattgtgacaatgccaacatacactgtccaggcggagacccagcatggcgtat

SEQ ID NO: 450355 - DNA, 140 bp, Artificial Sequence
  Synthetic
atacgccatgctgggtctccccctatatctccttcttgctctcagcctggcctctgttgccatgtgcagaacgcccttttcactggctgaaggcattgtcctagcatcagctgccttaggcgtacttgggagtcggccat

SEQ ID NO: 450356 - DNA, 140 bp, Artificial Sequence
  Synthetic
atggccgactcccaagtacgcctaaggcagctgatgctaggacaatgccttcagccagtgaaaagggcgttctgcacatggcaacagaggccaggctgagagcaagaaggagatatagggggagacccagcatggcgtat

SEQ ID NO: 450357 - DNA, 140 bp, Artificial Sequence
  Synthetic
aggccctggctgctgatatgacgcccttttcactggctgaaggcattgtcctagcatcagctgccttagggccgcttatagagggaaacaccagccttctctggaatggacccatggcaggaccttttgggacagcggtg

SEQ ID NO: 450358 - DNA, 140 bp, Artificial Sequence
  Synthetic
caccgctgtcccaaaaggtcctgccatgggtccattccagagaaggctggtgtttccctctataagcggccctaaggcagctgatgctaggacaatgccttcagccagtgaaaagggcgtcatatcagcagccagggcct

SEQ ID NO: 450359 - DNA, 140 bp, Artificial Sequence
  Synthetic
aggccctggctgctgatatgatgtacaatctatggaagatgaatactggacgccgagggagagcgaatggaaaaactctgggtgaagtctggaagagggaactgaacctgctggacaagcgaccttttgggacagcggtg

SEQ ID NO: 450360 - DNA, 140 bp, Artificial Sequence
  Synthetic
caccgctgtcccaaaaggtcgcttgtccagcaggttcagttccctcttccagacttcacccagagtttttccattcgctctccctcggcgtccagtattcatcttccatagattgtacatcatatcagcagccagggcct

SEQ ID NO: 450361 - DNA, 140 bp, Artificial Sequence
  Synthetic
atacgccatgctgggtctccaaaaactctgggtgaagtctggaagagggaactgaacctgctggacaagcaacagtttgagctgtacaaaaggactgacattgtggaggtggatcgtgaccgtacttgggagtcggccat

SEQ ID NO: 450362 - DNA, 140 bp, Artificial Sequence
  Synthetic
atggccgactcccaagtacggtcacgatccacctccacaatgtcagtccttttgtacagctcaaactgttgcttgtccagcaggttcagttccctcttccagacttcacccagagtttttggagacccagcatggcgtat

SEQ ID NO: 450363 - DNA, 140 bp, Artificial Sequence
  Synthetic
aggccctggctgctgatatgacggcacgcaggcatctggccgaagggaaggtggacaccggggtggcggtctccagggggaccgcaaagttgaggtggttccatgagcgtggctatgtcagaccttttgggacagcggtg

SEQ ID NO: 450364 - DNA, 140 bp, Artificial Sequence
  Synthetic
caccgctgtcccaaaaggtctgacatagccacgctcatggaaccacctcaactttgcggtccccctggagaccgccaccccggtgtccaccttcccttcggccagatgcctgcgtgccgtcatatcagcagccagggcct

SEQ ID NO: 450365 - DNA, 140 bp, Artificial Sequence
  Synthetic
aggccctggctgctgatatgtggaagagacggccatgagaaacctatgaatgtgcaaagtctgggttggaacattattaccttcaaggacaaaactgacatccaccgcctggaaccagtggaccttttgggacagcggtg

SEQ ID NO: 450366 - DNA, 140 bp, Artificial Sequence
  Synthetic
caccgctgtcccaaaaggtccactggttccaggcggtggatgtcagttttgtccttgaaggtaataatgttccaacccagactttgcacattcataggtttctcatggccgtctcttccacatatcagcagccagggcct

SEQ ID NO: 450367 - DNA, 140 bp, Artificial Sequence
  Synthetic
aggccctggctgctgatatgagtgatcaggaaccctctctccaggaattccacccatgaaatgtactatgtgtctggagcccgcagcaatgtcacgtttactgtgaaccaaacatcacgcgaccttttgggacagcggtg

SEQ ID NO: 450368 - DNA, 140 bp, Artificial Sequence
  Synthetic
caccgctgtcccaaaaggtcgcgtgatgtttggttcacagtaaacgtgacattgctgcgggctccagacacatagtacatttcatgggtggaattcctggagagagggttcctgatcactcatatcagcagccagggcct

SEQ ID NO: 450369 - DNA, 140 bp, Artificial Sequence
  Synthetic
aggccctggctgctgatatgctcctgatgaggagaatgaggcgtccaactggaaaagtgaccttggaggctgatgtcatcctcccaattgggacacgcagtgttgagacagacaagggacgaccttttgggacagcggtg

SEQ ID NO: 450370 - DNA, 140 bp, Artificial Sequence
  Synthetic
caccgctgtcccaaaaggtcgtcccttgtctgtctcaacactgcgtgtcccaattgggaggatgacatcagcctccaaggtcacttttccagttggacgcctcattctcctcatcaggagcatatcagcagccagggcct

SEQ ID NO: 450371 - DNA, 140 bp, Artificial Sequence
  Synthetic
atacgccatgctgggtctccccctggacagagaggccatagaagaaagggtcgagaggataaaatctgagtacatgaccacctggttttatgacaatgacaacccctacaggacctggcacgtacttgggagtcggccat

SEQ ID NO: 450372 - DNA, 140 bp, Artificial Sequence
  Synthetic
atggccgactcccaagtacgtgccaggtcctgtaggggttgtcattgtcataaaaccaggtggtcatgtactcagattttatcctctcgaccctttcttctatggcctctctgtccagggggagacccagcatggcgtat

SEQ ID NO: 450373 - DNA, 140 bp, Artificial Sequence
  Synthetic
aggccctggctgctgatatgctactgtggctcctatgttacaaaaacctcaggaagtgcggctagcatggtaaatggtgtcatcaaaattctgacatacccatgggacaggatagaggaggaccttttgggacagcggtg

SEQ ID NO: 450374 - DNA, 140 bp, Artificial Sequence
  Synthetic
caccgctgtcccaaaaggtcctcctctatcctgtcccatgggtatgtcagaattttgatgacaccatttaccatgctagccgcacttcctgaggtttttgtaacataggagccacagtagcatatcagcagccagggcct

SEQ ID NO: 450375 - DNA, 140 bp, Artificial Sequence
  Synthetic
atacgccatgctgggtctccgtcacaagaatggcaatgactgacacaaccccttttggacagcaaagagtgtttaaagaaaaagttgacaccagagcaaaggatccaccagcaggaactacgtacttgggagtcggccat

SEQ ID NO: 450376 - DNA, 140 bp, Artificial Sequence
  Synthetic
atggccgactcccaagtacgtagttcctgctggtggatcctttgctctggtgtcaactttttctttaaacactctttgctgtccaaaaggggttgtgtcagtcattgccattcttgtgacggagacccagcatggcgtat

SEQ ID NO: 450377 - DNA, 140 bp, Artificial Sequence
  Synthetic
aggccctggctgctgatatggaaaagaaccccagactgtgtacaaaggaagaatttattgcaaaagtccgcagtcatgcagccattggagcttacctggaagaacaagaacagtggaagagaccttttgggacagcggtg

SEQ ID NO: 450378 - DNA, 140 bp, Artificial Sequence
  Synthetic
caccgctgtcccaaaaggtctcttccactgttcttgttcttccaggtaagctccaatggctgcatgactgcggacttttgcaataaattcttcctttgtacacagtctggggttcttttccatatcagcagccagggcct

SEQ ID NO: 450379 - DNA, 140 bp, Artificial Sequence
  Synthetic
aggccctggctgctgatatggaaagaaagctgcaccaacaaggcaggtgtcggacttgtgtgtacaacatgatgggaaaaagagagaagaagctgtcagagtttgggaaagcgaagggaagaccttttgggacagcggtg

SEQ ID NO: 450380 - DNA, 140 bp, Artificial Sequence
  Synthetic
caccgctgtcccaaaaggtcttcccttcgctttcccaaactctgacagcttcttctctctttttcccatcatgttgtacacacaagtccgacacctgccttgttggtgcagctttctttccatatcagcagccagggcct

SEQ ID NO: 450381 - DNA, 140 bp, Artificial Sequence
  Synthetic
aggccctggctgctgatatggccgagccatatggtacatgtggctgggagcgcggtatcttgagtttgaggccctagggttcctgaatgaggaccattgggcttctagggaaaactcagggaccttttgggacagcggtg

SEQ ID NO: 450382 - DNA, 140 bp, Artificial Sequence
  Synthetic
caccgctgtcccaaaaggtccctgagttttccctagaagcccaatggtcctcattcaggaaccctagggcctcaaactcaagataccgcgctcccagccacatgtaccatatggctcggccatatcagcagccagggcct

SEQ ID NO: 450383 - DNA, 140 bp, Artificial Sequence
  Synthetic
atacgccatgctgggtctccaaagcctacatggacatcataagtcgacgagaccagagaggatccgggcaggtggtgacttatgctctgaacaccatcaccaatttaaaagtccaattgacgtacttgggagtcggccat

SEQ ID NO: 450384 - DNA, 140 bp, Artificial Sequence
  Synthetic
atggccgactcccaagtacgtcaattggacttttaaattggtgatggtgttcagagcataagtcaccacctgcccggatcctctctggtctcgtcgacttatgatgtccatgtaggctttggagacccagcatggcgtat

SEQ ID NO: 450385 - DNA, 140 bp, Artificial Sequence
  Synthetic
aggccctggctgctgatatgtgtgatgaatcagctctgaccaggctggaggcatggctcactgagcacggatgtgacagactgaagaggatggcggtgagtggagacgattgtgttgtccgaccttttgggacagcggtg

SEQ ID NO: 450386 - DNA, 140 bp, Artificial Sequence
  Synthetic
caccgctgtcccaaaaggtcggacaacacaatcgtctccactcaccgccatcctcttcagtctgtcacatccgtgctcagtgagccatgcctccagcctggtcagagctgattcatcacacatatcagcagccagggcct

SEQ ID NO: 450387 - DNA, 140 bp, Artificial Sequence
  Synthetic
atacgccatgctgggtctcctgaaggatggcaggaggattgtggtgccttgccgagaacaggacgagctcattgggagaggaagggtgtctccaggaaacggctggatgatcaaagaaaccgtacttgggagtcggccat

SEQ ID NO: 450388 - DNA, 140 bp, Artificial Sequence
  Synthetic
atggccgactcccaagtacggtttctttgatcatccagccgtttcctggagacacccttcctctcccaatgagctcgtcctgttctcggcaaggcaccacaatcctcctgccatccttcaggagacccagcatggcgtat

SEQ ID NO: 450389 - DNA, 140 bp, Artificial Sequence
  Synthetic
aggccctggctgctgatatgacctcatgggtcccacaaggacgtacaacatggtcgattcatgggaaaggggagtggatgaccacggaagacatgcttggggtgtggaatagagtgtggagaccttttgggacagcggtg

SEQ ID NO: 450390 - DNA, 140 bp, Artificial Sequence
  Synthetic
caccgctgtcccaaaaggtctccacactctattccacaccccaagcatgtcttccgtggtcatccactcccctttcccatgaatcgaccatgttgtacgtccttgtgggacccatgaggtcatatcagcagccagggcct

SEQ ID NO: 450391 - DNA, 140 bp, Artificial Sequence
  Synthetic
atacgccatgctgggtctccctgaaacaccatacaatagaaacaaccgggatacaaaccacgggtggagaaccggactccccacaacctgaaaccgggatacaaaccacggctggagaaccgtacttgggagtcggccat

SEQ ID NO: 450392 - DNA, 140 bp, Artificial Sequence
  Synthetic
atggccgactcccaagtacggttctccagccgtggtttgtatcccggtttcaggttgtggggagtccggttctccacccgtggtttgtatcccggttgtttctattgtatggtgtttcagggagacccagcatggcgtat

SEQ ID NO: 450393 - DNA, 140 bp, Artificial Sequence
  Synthetic
aggccctggctgctgatatgaccggactccccacaacctgaaaccgggatacaaaccacggctggagaaccggactccgcactcaacatgaaacaaaaaccgggataaaaactacggatggaccttttgggacagcggtg

SEQ ID NO: 450394 - DNA, 140 bp, Artificial Sequence
  Synthetic
caccgctgtcccaaaaggtccatccgtagtttttatcccggtttttgtttcatgttgagtgcggagtccggttctccagccgtggtttgtatcccggtttcaggttgtggggagtccggtcatatcagcagccagggcct

SEQ ID NO: 450395 - DNA, 140 bp, Artificial Sequence
  Synthetic
aggccctggctgctgatatggagaaccggactccacacattgaaacagaagaagttgtcagcccagaactccacacgagttttgccactgctaagctgtgaggcagtgcaggctgggacagaccttttgggacagcggtg

SEQ ID NO: 450396 - DNA, 140 bp, Artificial Sequence
  Synthetic
caccgctgtcccaaaaggtctgtcccagcctgcactgcctcacagcttagcagtggcaaaactcgtgtggagttctgggctgacaacttcttctgtttcaatgtgtggagtccggttctccatatcagcagccagggcct

SEQ ID NO: 450397 - DNA, 140 bp, Artificial Sequence
  Synthetic
aggccctggctgctgatatggtaaatcctgtgtgctaattgaggtgcattggtctgcaaatcgagttgctaggcaataaacacatttggattaattttaatcgttcgttgagcgattagcgaccttttgggacagcggtg

SEQ ID NO: 450398 - DNA, 140 bp, Artificial Sequence
  Synthetic
caccgctgtcccaaaaggtcgctaatcgctcaacgaacgattaaaattaatccaaatgtgtttattgcctagcaactcgatttgcagaccaatgcacctcaattagcacacaggatttaccatatcagcagccagggcct

SEQ ID NO: 450399 - DNA, 140 bp, Artificial Sequence
  Synthetic
aggccctggctgctgatatgcagatggttgctcctaaatgtgacatctgaggacctcgggaaaacattctccgtgggcacaggcaactgcactacaaacatcttggaagccaagtactgggaccttttgggacagcggtg

SEQ ID NO: 450400 - DNA, 140 bp, Artificial Sequence
  Synthetic
caccgctgtcccaaaaggtcccagtacttggcttccaagatgtttgtagtgcagttgcctgtgcccacggagaatgttttcccgaggtcctcagatgtcacatttaggagcaaccatctgcatatcagcagccagggcct

SEQ ID NO: 450401 - DNA, 140 bp, Artificial Sequence
  Synthetic
  misc_feature (109)..(109): n is a, c, g, or t
aggccctggctgctgatatgcaagacaagtgtgtcactgttatggcccctgacaagccttcattggacatttcactagagacagtagccattgatggacctgctgaggngaggaaagtgtgaccttttgggacagcggtg

SEQ ID NO: 450402 - DNA, 140 bp, Artificial Sequence
  Synthetic
  misc_feature (32)..(32): n is a, c, g, or t
caccgctgtcccaaaaggtcacactttcctcncctcagcaggtccatcaatggctactgtctctagtgaaatgtccaatgaaggcttgtcaggggccataacagtgacacacttgtcttgcatatcagcagccagggcct

SEQ ID NO: 450403 - DNA, 140 bp, Artificial Sequence
  Synthetic
aggccctggctgctgatatgttcacctcggttgggaaaggaattcatacggtgtttggctctgcctttcaggggctatttggtggcttgagctggataacgaaggtcatcatgggggcgggaccttttgggacagcggtg

SEQ ID NO: 450404 - DNA, 140 bp, Artificial Sequence
  Synthetic
caccgctgtcccaaaaggtcccgcccccatgatgaccttcgttatccagctcaagccaccaaatagcccctgaaaggcagagccaaacaccgtatgaattcctttcccaaccgaggtgaacatatcagcagccagggcct

SEQ ID NO: 450405 - DNA, 140 bp, Artificial Sequence
  Synthetic
atacgccatgctgggtctccggggctatttggtggcttgagctggataacgaaggtcatcatgggggcggtactcatatgggttggcatcaatacaagaaacatgacaatgtccatgagccgtacttgggagtcggccat

SEQ ID NO: 450406 - DNA, 140 bp, Artificial Sequence
  Synthetic
atggccgactcccaagtacggctcatggacattgtcatgtttcttgtattgatgccaacccatatgagtaccgcccccatgatgaccttcgttatccagctcaagccaccaaatagccccggagacccagcatggcgtat

SEQ ID NO: 450407 - DNA, 140 bp, Artificial Sequence
  Synthetic
atacgccatgctgggtctcctactatccagaagaccctgtgaagcttgcatcaatagtgaaagcctcttttgaagaagggaagtgcggcctaaattcagttgactcccttgaacatgagacgtacttgggagtcggccat

SEQ ID NO: 450408 - DNA, 140 bp, Artificial Sequence
  Synthetic
atggccgactcccaagtacgtctcatgttcaagggagtcaactgaatttaggccgcacttcccttcttcaaaagaggctttcactattgatgcaagcttcacagggtcttctggatagtaggagacccagcatggcgtat

SEQ ID NO: 450409 - DNA, 140 bp, Artificial Sequence
  Synthetic
aggccctggctgctgatatgcttggatgcaggtaccactagaagtgaggagagaagcttgcccagggactagtgtgatcattgatggcaactgtgatggacggggaaaatcaaccagatcgaccttttgggacagcggtg

SEQ ID NO: 450410 - DNA, 140 bp, Artificial Sequence
  Synthetic
caccgctgtcccaaaaggtcgatctggttgattttccccgtccatcacagttgccatcaatgatcacactagtccctgggcaagcttctctcctcacttctagtggtacctgcatccaagcatatcagcagccagggcct

SEQ ID NO: 450411 - DNA, 140 bp, Artificial Sequence
  Synthetic
aggccctggctgctgatatgctcgcagcagctggtctggtgggagtgctggcaggactggctttccaggagatggagaacttccttggtccgattgcagttggaggaattctgatgatgcgaccttttgggacagcggtg

SEQ ID NO: 450412 - DNA, 140 bp, Artificial Sequence
  Synthetic
caccgctgtcccaaaaggtcgcatcatcagaattcctccaactgcaatcggaccaaggaagttctccatctcctggaaagccagtcctgccagcactcccaccagaccagctgctgcgagcatatcagcagccagggcct

SEQ ID NO: 450413 - DNA, 140 bp, Artificial Sequence
  Synthetic
aggccctggctgctgatatgcgcttgctgactttatcaagtttgctgaaggtaggaggggagctgcggaagtgctagttgtgctgagtgaactccctgattttttggctaagaaaggtgggaccttttgggacagcggtg

SEQ ID NO: 450414 - DNA, 140 bp, Artificial Sequence
  Synthetic
caccgctgtcccaaaaggtcccacctttcttagccaaaaaatcagggagttcactcagcacaactagcacttccgcagctcccctcctaccttcagcaaacttgataaagtcagcaagcgcatatcagcagccagggcct

SEQ ID NO: 450415 - DNA, 140 bp, Artificial Sequence
  Synthetic
aggccctggctgctgatatgccggctgtggatatctcatgttccttggaggcgtcaaacccacgcacatttcctatatcatgctcatattctttgtcctgatggtggttgtgatccccgagaccttttgggacagcggtg

SEQ ID NO: 450416 - DNA, 140 bp, Artificial Sequence
  Synthetic
caccgctgtcccaaaaggtctcggggatcacaaccaccatcaggacaaagaatatgagcatgatataggaaatgtgcgtgggtttgacgcctccaaggaacatgagatatccacagccggcatatcagcagccagggcct

SEQ ID NO: 450417 - DNA, 140 bp, Artificial Sequence
  Synthetic
atacgccatgctgggtctcctcctatatcatgctcatattctttgtcctgatggtggttgtgatccccgagccagggcaacaaaggtccatccaagacaaccaagtggcatacctcattacgtacttgggagtcggccat

SEQ ID NO: 450418 - DNA, 140 bp, Artificial Sequence
  Synthetic
atggccgactcccaagtacgtaatgaggtatgccacttggttgtcttggatggacctttgttgccctggctcggggatcacaaccaccatcaggacaaagaatatgagcatgatataggaggagacccagcatggcgtat

SEQ ID NO: 450419 - DNA, 140 bp, Artificial Sequence
  Synthetic
atacgccatgctgggtctccgtcagcctcagtcctttctttcatggacaaggggataccattcatgaagatgaacatctcggtcataatactgctggtcagtggctggaattcaataacacgtacttgggagtcggccat

SEQ ID NO: 450420 - DNA, 140 bp, Artificial Sequence
  Synthetic
atggccgactcccaagtacgtgttattgaattccagccactgaccagcagtattatgaccgagatgttcatcttcatgaatggtatccccttgtccatgaaagaaaggactgaggctgacggagacccagcatggcgtat

SEQ ID NO: 450421 - DNA, 140 bp, Artificial Sequence
  Synthetic
atacgccatgctgggtctccccgcttatagagggaaacaccagccttctctggaatggacccatggctgtctctatgacgggagttatgcgggggaactactatgcctttgtgggagtcacgtacttgggagtcggccat

SEQ ID NO: 450422 - DNA, 140 bp, Artificial Sequence
  Synthetic
atggccgactcccaagtacgtgactcccacaaaggcatagtagttcccccgcataactcccgtcatagagacagccatgggtccattccagagaaggctggtgtttccctctataagcggggagacccagcatggcgtat

SEQ ID NO: 450423 - DNA, 140 bp, Artificial Sequence
  Synthetic
atacgccatgctgggtctccactatgctgctgcgcaaaaggaagtgagtggggtcaaaggattcacccttggaagagacggccatgagaaacctatgaatgtgcaaagtctgggttggaacgtacttgggagtcggccat

SEQ ID NO: 450424 - DNA, 140 bp, Artificial Sequence
  Synthetic
atggccgactcccaagtacgttccaacccagactttgcacattcataggtttctcatggccgtctcttccaagggtgaatcctttgaccccactcacttccttttgcgcagcagcatagtggagacccagcatggcgtat

SEQ ID NO: 450425 - DNA, 140 bp, Artificial Sequence
  Synthetic
atacgccatgctgggtctccggcttgtggggttgacaacttctgtgtgaaggtgttagctccatacatgccagatgttctcgagaaattggaattgctccaaaggaggtttggcggaacacgtacttgggagtcggccat

SEQ ID NO: 450426 - DNA, 140 bp, Artificial Sequence
  Synthetic
atggccgactcccaagtacgtgttccgccaaacctcctttggagcaattccaatttctcgagaacatctggcatgtatggagctaacaccttcacacagaagttgtcaaccccacaagccggagacccagcatggcgtat

SEQ ID NO: 450427 - DNA, 140 bp, Artificial Sequence
  Synthetic
atacgccatgctgggtctccagtcatgcagccattggagcttacctggaagaacaagaacagtggaagactgccaatgaggctgtccaagacccaaagttctgggaactggtggatgaagcgtacttgggagtcggccat

SEQ ID NO: 450428 - DNA, 140 bp, Artificial Sequence
  Synthetic
atggccgactcccaagtacgcttcatccaccagttcccagaactttgggtcttggacagcctcattggcagtcttccactgttcttgttcttccaggtaagctccaatggctgcatgactggagacccagcatggcgtat

SEQ ID NO: 450429 - DNA, 140 bp, Artificial Sequence
  Synthetic
aggccctggctgctgatatgttgggagaggaagggtgtctccaggaaacggctggatgatcaaagaaacggcctgcctcagcaaggcctatgccaacatgtggtcactgatgtattttcagaccttttgggacagcggtg

SEQ ID NO: 450430 - DNA, 140 bp, Artificial Sequence
  Synthetic
caccgctgtcccaaaaggtctgaaaatacatcagtgaccacatgttggcataggccttgctgaggcaggccgtttctttgatcatccagccgtttcctggagacacccttcctctcccaacatatcagcagccagggcct

SEQ ID NO: 450431 - DNA, 140 bp, Artificial Sequence
  Synthetic
atacgccatgctgggtctccgagtggatgaccacggaagacatgcttggggtgtggaacagagtgtggataaccaacaacccacacatgcaggataagacagtggtgaaagaatggagagcgtacttgggagtcggccat

SEQ ID NO: 450432 - DNA, 140 bp, Artificial Sequence
  Synthetic
atggccgactcccaagtacgctctccattctttcaccactgtcttatcctgcatgtgtgggttgttggttatccacactctgttccacaccccaagcatgtcttccgtggtcatccactcggagacccagcatggcgtat

SEQ ID NO: 450433 - DNA, 140 bp, Artificial Sequence
  Synthetic
atacgccatgctgggtctccatgtcccttatttaaccaagagacaagacaagctgtgcggatcactgattggaatgaccaacagggccacctgggcctcccacatccacttggttatccacgtacttgggagtcggccat

SEQ ID NO: 450434 - DNA, 140 bp, Artificial Sequence
  Synthetic
atggccgactcccaagtacgtggataaccaagtggatgtgggaggcccaggtggccctgttggtcattccaatcagtgatccgcacagcttgtcttgtctcttggttaaataagggacatggagacccagcatggcgtat

SEQ ID NO: 450435 - DNA, 140 bp, Artificial Sequence
  Synthetic
aggccctggctgctgatatgccagggaaagaccggagtggttctctgcttttcctccagaggtctgtgagcacagtttgctcaagaataagcagacctttggatgacaaacacaaaaccagaccttttgggacagcggtg

SEQ ID NO: 450436 - DNA, 140 bp, Artificial Sequence
  Synthetic
caccgctgtcccaaaaggtctggttttgtgtttgtcatccaaaggtctgcttattcttgagcaaactgtgctcacagacctctggaggaaaagcagagaaccactccggtctttccctggcatatcagcagccagggcct

SEQ ID NO: 450437 - DNA, 140 bp, Artificial Sequence
  Synthetic
aggccctggctgctgatatgtgcccagattcaatggaatacaactgtcccaatctcagtccaagagaggagccagatgacattgattgctggtgctatggggtggaaaacgttagagtcggaccttttgggacagcggtg

SEQ ID NO: 450438 - DNA, 140 bp, Artificial Sequence
  Synthetic
caccgctgtcccaaaaggtccgactctaacgttttccaccccatagcaccagcaatcaatgtcatctggctcctctcttggactgagattgggacagttgtattccattgaatctgggcacatatcagcagccagggcct

SEQ ID NO: 450439 - DNA, 140 bp, Artificial Sequence
  Synthetic
atacgccatgctgggtctccattgacttgcctacgcatgaaaaccatggcttgaagacccggcaagaaaaatggatgactggaagaatgggtgaaaggcagctccaaaagattgagagatcgtacttgggagtcggccat

SEQ ID NO: 450440 - DNA, 140 bp, Artificial Sequence
  Synthetic
atggccgactcccaagtacgatctctcaatcttttggagctgcctttcacccattcttccagtcatccatttttcttgccgggtcttcaagccatggttttcatgcgtaggcaagtcaatggagacccagcatggcgtat

SEQ ID NO: 450441 - DNA, 140 bp, Artificial Sequence
  Synthetic
aggccctggctgctgatatgatggatgactggaagaatgggtgaaaggcagctccaaaagattgagagatggcttgtgaggaatcccttttttgcagtgacggctttgactattgcctacgaccttttgggacagcggtg

SEQ ID NO: 450442 - DNA, 140 bp, Artificial Sequence
  Synthetic
caccgctgtcccaaaaggtcgtaggcaatagtcaaagccgtcactgcaaaaaagggattcctcacaagccatctctcaatcttttggagctgcctttcacccattcttccagtcatccatcatatcagcagccagggcct

SEQ ID NO: 450443 - DNA, 140 bp, Artificial Sequence
  Synthetic
atacgccatgctgggtctccgttacaatgcagtcctcacccatgtgaagattaatgacaagtgccccagcaccggagaggctcacctagctgaagagaacgagggggacaatgcgtgcaacgtacttgggagtcggccat

SEQ ID NO: 450444 - DNA, 140 bp, Artificial Sequence
  Synthetic
atggccgactcccaagtacgttgcacgcattgtccccctcgttctcttcagctaggtgagcctctccggtgctggggcacttgtcattaatcttcacatgggtgaggactgcattgtaacggagacccagcatggcgtat

SEQ ID NO: 450445 - DNA, 140 bp, Artificial Sequence
  Synthetic
aggccctggctgctgatatgaagggagcattgtggcatgcgccaaattcacttgtgccaaatccatgagcttgtttgaggttgatcagaccaagatccagtatgtcatcagagcacaattgaccttttgggacagcggtg

SEQ ID NO: 450446 - DNA, 140 bp, Artificial Sequence
  Synthetic
caccgctgtcccaaaaggtcaattgtgctctgatgacatactggatcttggtctgatcaacctcaaacaagctcatggatttggcacaagtgaatttggcgcatgccacaatgctcccttcatatcagcagccagggcct

SEQ ID NO: 450447 - DNA, 140 bp, Artificial Sequence
  Synthetic
atacgccatgctgggtctccgcatgttggggctaagcaggaaaattggaataccgatatcaaaactctcaagtttgatgccctatcaggctcccaggaggccaagttcactgggtatggacgtacttgggagtcggccat

SEQ ID NO: 450448 - DNA, 140 bp, Artificial Sequence
  Synthetic
atggccgactcccaagtacgtccatacccagtgaacttggcctcctgggagcctgatagggcatcaaacttgagagttttgatatcggtattccaattttcctgcttagccccaacatgcggagacccagcatggcgtat

SEQ ID NO: 450449 - DNA, 140 bp, Artificial Sequence
  Synthetic
aggccctggctgctgatatgagtttgatgccctatcaggctcccaggaggccaagttcactgggtatggaaaagccacactcgaatgccaggtgcaaactgcggtggactttggcaataggaccttttgggacagcggtg

SEQ ID NO: 450450 - DNA, 140 bp, Artificial Sequence
  Synthetic
caccgctgtcccaaaaggtcctattgccaaagtccaccgcagtttgcacctggcattcgagtgtggcttttccatacccagtgaacttggcctcctgggagcctgatagggcatcaaactcatatcagcagccagggcct

SEQ ID NO: 450451 - DNA, 140 bp, Artificial Sequence
  Synthetic
atacgccatgctgggtctccggagccccctgcaagatcccagtgatagtagctgatgatctcacagcggcaatcaataaaggtatcctggttacagtcaatcccatcgcttcaaccaatgcgtacttgggagtcggccat

SEQ ID NO: 450452 - DNA, 140 bp, Artificial Sequence
  Synthetic
atggccgactcccaagtacgcattggttgaagcgatgggattgactgtaaccaggatacctttattgattgccgctgtgagatcatcagctactatcactgggatcttgcagggggctccggagacccagcatggcgtat

SEQ ID NO: 450453 - DNA, 140 bp, Artificial Sequence
  Synthetic
atacgccatgctgggtctccatgatgaagtgctgattgaggtgaacccaccctttggagatagctacatcatcgtcgggacaggagattcacgtctcacctatcagtggcataaagagggcgtacttgggagtcggccat

SEQ ID NO: 450454 - DNA, 140 bp, Artificial Sequence
  Synthetic
atggccgactcccaagtacgccctctttatgccactgataggtgagacgtgaatctcctgtcccgacgatgatgtagctatctccaaagggtgggttcacctcaatcagcacttcatcatggagacccagcatggcgtat

SEQ ID NO: 450455 - DNA, 140 bp, Artificial Sequence
  Synthetic
atacgccatgctgggtctccgagttcaataggaaagctgttcactcagaccatgaaaggcgcggaacgcctagctgtcatgggagacgccgcctgggattttagctcagctggagggttccgtacttgggagtcggccat

SEQ ID NO: 450456 - DNA, 140 bp, Artificial Sequence
  Synthetic
atggccgactcccaagtacggaaccctccagctgagctaaaatcccaggcggcgtctcccatgacagctaggcgttccgcgcctttcatggtctgagtgaacagctttcctattgaactcggagacccagcatggcgtat

SEQ ID NO: 450457 - DNA, 140 bp, Artificial Sequence
  Synthetic
aggccctggctgctgatatgtagctgtcatgggagacgccgcctgggattttagctcagctggagggttctttacctcggttgggaaaggaattcatacggtgtttggctctgcctttcagaccttttgggacagcggtg

SEQ ID NO: 450458 - DNA, 140 bp, Artificial Sequence
  Synthetic
caccgctgtcccaaaaggtctgaaaggcagagccaaacaccgtatgaattcctttcccaaccgaggtaaagaaccctccagctgagctaaaatcccaggcggcgtctcccatgacagctacatatcagcagccagggcct

SEQ ID NO: 450459 - DNA, 140 bp, Artificial Sequence
  Synthetic
atacgccatgctgggtctcctactcatatgggttggcatcaacacaagaaatatgacaatgtccatgagcatgatcttggtaggagtgatcatgatgtttctgtctctgggagttggggccgtacttgggagtcggccat

SEQ ID NO: 450460 - DNA, 140 bp, Artificial Sequence
  Synthetic
atggccgactcccaagtacggccccaactcccagagacagaaacatcatgatcactcctaccaagatcatgctcatggacattgtcatatttcttgtgttgatgccaacccatatgagtaggagacccagcatggcgtat

SEQ ID NO: 450461 - DNA, 140 bp, Artificial Sequence
  Synthetic
atacgccatgctgggtctcctgtggagaagcagggcagatgagatcaatgccattcttgaggaaaacgaggtggacatctctgttgttgtgcaggatccaaagaatgtttaccagagaggcgtacttgggagtcggccat

SEQ ID NO: 450462 - DNA, 140 bp, Artificial Sequence
  Synthetic
atggccgactcccaagtacgcctctctggtaaacattctttggatcctgcacaacaacagagatgtccacctcgttttcctcaagaatggcattgatctcatctgccctgcttctccacaggagacccagcatggcgtat

SEQ ID NO: 450463 - DNA, 140 bp, Artificial Sequence
  Synthetic
aggccctggctgctgatatgatcatagatggaaagtctaggaaagaatgcccattttcaaaccgggtttggaactctttccagatagaggagtttgggacgggagtgttcaccacacgcggaccttttgggacagcggtg

SEQ ID NO: 450464 - DNA, 140 bp, Artificial Sequence
  Synthetic
caccgctgtcccaaaaggtccgcgtgtggtgaacactcccgtcccaaactcctctatctggaaagagttccaaacccggtttgaaaatgggcattctttcctagactttccatctatgatcatatcagcagccagggcct

SEQ ID NO: 450465 - DNA, 140 bp, Artificial Sequence
  Synthetic
aggccctggctgctgatatgttgggtgcagcagtgaacggaaaaaagagtgcccatgggtctccaacattttggatgggaagtcatgaagtaaatgggacatggatgatccacaccttgggaccttttgggacagcggtg

SEQ ID NO: 450466 - DNA, 140 bp, Artificial Sequence
  Synthetic
caccgctgtcccaaaaggtcccaaggtgtggatcatccatgtcccatttacttcatgacttcccatccaaaatgttggagacccatgggcactcttttttccgttcactgctgcacccaacatatcagcagccagggcct

SEQ ID NO: 450467 - DNA, 140 bp, Artificial Sequence
  Synthetic
atacgccatgctgggtctccaggcattagattacaaggagtgtgagtggccactgacacatacgattggaacatcagttgaagagagtgaaatgttcatgccgagatcaattggaggccccgtacttgggagtcggccat

SEQ ID NO: 450468 - DNA, 140 bp, Artificial Sequence
  Synthetic
atggccgactcccaagtacggggcctccaattgatctcggcatgaacatttcactctcttcaactgatgttccaatcgtatgtgtcagtggccactcacactccttgtaatctaatgcctggagacccagcatggcgtat

SEQ ID NO: 450469 - DNA, 140 bp, Artificial Sequence
  Synthetic
aggccctggctgctgatatgacatcagttgaagagagtgaaatgttcatgccgagatcaattggaggcccagttagctcccacaatcatatccctgggtacaaggtccagacgaacggacgaccttttgggacagcggtg

SEQ ID NO: 450470 - DNA, 140 bp, Artificial Sequence
  Synthetic
caccgctgtcccaaaaggtcgtccgttcgtctggaccttgtacccagggatatgattgtgggagctaactgggcctccaattgatctcggcatgaacatttcactctcttcaactgatgtcatatcagcagccagggcct

SEQ ID NO: 450471 - DNA, 140 bp, Artificial Sequence
  Synthetic
aggccctggctgctgatatgtgaacaacggaggagacgccatgtatatggcgttgattgctgccttttcaatcagaccagggctgctcatcggctttgggctcaggaccctatggagcccgaccttttgggacagcggtg

SEQ ID NO: 450472 - DNA, 140 bp, Artificial Sequence
  Synthetic
caccgctgtcccaaaaggtcgggctccatagggtcctgagcccaaagccgatgagcagccctggtctgattgaaaaggcagcaatcaacgccatatacatggcgtctcctccgttgttcacatatcagcagccagggcct

SEQ ID NO: 450473 - DNA, 140 bp, Artificial Sequence
  Synthetic
atacgccatgctgggtctcctcgggaacgccttgtgctgaccctgggagcagccatggtggagattgccctgggtggcatgatgggaggcctgtggaagtacctaaatgcagtttctctccgtacttgggagtcggccat

SEQ ID NO: 450474 - DNA, 140 bp, Artificial Sequence
  Synthetic
atggccgactcccaagtacggagagaaactgcatttaggtacttccacaggcctcccatcatgccacccagggcaatctccaccatggctgctcccagggtcagcacaaggcgttcccgaggagacccagcatggcgtat

SEQ ID NO: 450475 - DNA, 140 bp, Artificial Sequence
  Synthetic
atacgccatgctgggtctcccctgcccctcatggctctgttgacccctgtcactatggcagaggtgagacttgccacaatgctcttttgcaccgtggttatcataggggtccttcaccagcgtacttgggagtcggccat

SEQ ID NO: 450476 - DNA, 140 bp, Artificial Sequence
  Synthetic
atggccgactcccaagtacgctggtgaaggacccctatgataaccacggtgcaaaagagcattgtggcaagtctcacctctgccatagtgacaggggtcaacagagccatgaggggcaggggagacccagcatggcgtat

SEQ ID NO: 450477 - DNA, 140 bp, Artificial Sequence
  Synthetic
aggccctggctgctgatatgaagtgccatgggaccaggttgtgatgacctcactggccttggttggagctgccattcatccatttgctcttctgctggtccttgctgggtggctgtttcagaccttttgggacagcggtg

SEQ ID NO: 450478 - DNA, 140 bp, Artificial Sequence
  Synthetic
caccgctgtcccaaaaggtctgaaacagccacccagcaaggaccagcagaagagcaaatggatgaatggcagctccaaccaaggccagtgaggtcatcacaacctggtcccatggcacttcatatcagcagccagggcct

SEQ ID NO: 450479 - DNA, 140 bp, Artificial Sequence
  Synthetic
atacgccatgctgggtctccgccattcatccatttgctcttctgctggtccttgctgggtggctgtttcatgtcaagggagctaggagaagtggggatgttttgtgggatattcccactccgtacttgggagtcggccat

SEQ ID NO: 450480 - DNA, 140 bp, Artificial Sequence
  Synthetic
atggccgactcccaagtacggagtgggaatatcccacaaaacatccccacttctcctagctcccttgacatgaaacagccacccagcaaggaccagcagaagagcaaatggatgaatggcggagacccagcatggcgtat

SEQ ID NO: 450481 - DNA, 140 bp, Artificial Sequence
  Synthetic
aggccctggctgctgatatggctgtcgctcttgactacccgagtggcacttcaggatctcctattgtcaacaggaacggagaggtgattgggctgtacggcaatggcattcttgttggtggaccttttgggacagcggtg

SEQ ID NO: 450482 - DNA, 140 bp, Artificial Sequence
  Synthetic
caccgctgtcccaaaaggtccaccaacaagaatgccattgccgtacagcccaatcacctctccgttcctgttgacaataggagatcctgaagtgccactcgggtagtcaagagcgacagccatatcagcagccagggcct

SEQ ID NO: 450483 - DNA, 140 bp, Artificial Sequence
  Synthetic
atacgccatgctgggtctccctttgagagagaataccccacgataaagcagaagaaacctgacttcatactggccactgacatagctgaaatgggagccaacctttgtgtggagcgagtgcgtacttgggagtcggccat

SEQ ID NO: 450484 - DNA, 140 bp, Artificial Sequence
  Synthetic
atggccgactcccaagtacgcactcgctccacacaaaggttggctcccatttcagctatgtcagtggccagtatgaagtcaggtttcttctgctttatcgtggggtattctctctcaaagggagacccagcatggcgtat

SEQ ID NO: 450485 - DNA, 140 bp, Artificial Sequence
  Synthetic
atacgccatgctgggtctccggagggggcgcattggaagaaaccccaacagagatggagactcatactactattccgagcccacaagtgaagataatgcccaccacgtctgctggttggacgtacttgggagtcggccat

SEQ ID NO: 450486 - DNA, 140 bp, Artificial Sequence
  Synthetic
atggccgactcccaagtacgtccaaccagcagacgtggtgggcattatcttcacttgtgggctcggaatagtagtatgagtctccatctctgttggggtttcttccaatgcgccccctccggagacccagcatggcgtat

SEQ ID NO: 450487 - DNA, 140 bp, Artificial Sequence
  Synthetic
atacgccatgctgggtctccagaggcaatggataccatcagtgtgttcctccactctgaggaaggctctagggcttaccgcaatgcactatcaatgatgcctgaggcaatgacaatagtccgtacttgggagtcggccat

SEQ ID NO: 450488 - DNA, 140 bp, Artificial Sequence
  Synthetic
atggccgactcccaagtacggactattgtcattgcctcaggcatcattgatagtgcattgcggtaagccctagagccttcctcagagtggaggaacacactgatggtatccattgcctctggagacccagcatggcgtat

SEQ ID NO: 450489 - DNA, 140 bp, Artificial Sequence
  Synthetic
atacgccatgctgggtctccatgctgtttatactggctggactactgacatcgggaatggtcattttctttatgtctcccaaaggcatcagtagaatgtccatggcgatgggcacaatggcgtacttgggagtcggccat

SEQ ID NO: 450490 - DNA, 140 bp, Artificial Sequence
  Synthetic
atggccgactcccaagtacgccattgtgcccatcgccatggacattctactgatgcctttgggagacataaagaaaatgaccattcccgatgtcagtagtccagccagtataaacagcatggagacccagcatggcgtat

SEQ ID NO: 450491 - DNA, 140 bp, Artificial Sequence
  Synthetic
aggccctggctgctgatatgtatgtctcccaaaggcatcagtagaatgtccatggcgatgggcacaatggctggctgtgggtatctcatgttccttggaggcgtcaaacccacacacatcgaccttttgggacagcggtg

SEQ ID NO: 450492 - DNA, 140 bp, Artificial Sequence
  Synthetic
caccgctgtcccaaaaggtcgatgtgtgtgggtttgacgcctccaaggaacatgagatacccacagccagccattgtgcccatcgccatggacattctactgatgcctttgggagacatacatatcagcagccagggcct

SEQ ID NO: 450493 - DNA, 140 bp, Artificial Sequence
  Synthetic
aggccctggctgctgatatgccgcttatagagggaaacaccagccttctttggaatggacccatggctgtctctatgacgggagtcatgcgggggaactactatgcctttgtaggagtcagaccttttgggacagcggtg

SEQ ID NO: 450494 - DNA, 140 bp, Artificial Sequence
  Synthetic
caccgctgtcccaaaaggtctgactcctacaaaggcatagtagttcccccgcatgactcccgtcatagagacagccatgggtccattccaaagaaggctggtgtttccctctataagcggcatatcagcagccagggcct

SEQ ID NO: 450495 - DNA, 140 bp, Artificial Sequence
  Synthetic
atacgccatgctgggtctcctgtacaatctatggaagatgaaaactggacgccgagggagagcgaatggaaaaactctgggtgaagtctggaagagggaactgaatctgctggacaaacacgtacttgggagtcggccat

SEQ ID NO: 450496 - DNA, 140 bp, Artificial Sequence
  Synthetic
atggccgactcccaagtacgtgtttgtccagcagattcagttccctcttccagacttcacccagagtttttccattcgctctccctcggcgtccagttttcatcttccatagattgtacaggagacccagcatggcgtat

SEQ ID NO: 450497 - DNA, 140 bp, Artificial Sequence
  Synthetic
atacgccatgctgggtctccacagtttgagttgtataaaaggactgacattgtggaggtggatcgtgatacggcacgcaggcacttggccgaagggaaggtggacaccggggtggcggtccgtacttgggagtcggccat

SEQ ID NO: 450498 - DNA, 140 bp, Artificial Sequence
  Synthetic
atggccgactcccaagtacggaccgccaccccggtgtccaccttcccttcggccaagtgcctgcgtgccgtatcacgatccacctccacaatgtcagtccttttatacaactcaaactgtggagacccagcatggcgtat

SEQ ID NO: 450499 - DNA, 140 bp, Artificial Sequence
  Synthetic
atacgccatgctgggtctcctccagggggaccgcaaagttaaggtggttccatgagcgtggctatgtcaagctggaaggtagggtgactgacctggggtgtggccgcggaggctggtgttcgtacttgggagtcggccat

SEQ ID NO: 450500 - DNA, 140 bp, Artificial Sequence
  Synthetic
atggccgactcccaagtacgaacaccagcctccgcggccacaccccaggtcagtcaccctaccttccagcttgacatagccacgctcatggaaccaccttaactttgcggtccccctggaggagacccagcatggcgtat

SEQ ID NO: 450501 - DNA, 140 bp, Artificial Sequence
  Synthetic
atacgccatgctgggtctccactatgctgctgcgcagaaggaagtgagtggggtgaaagggttcactcttggaagagacggccatgagaaacccatgaatgtgcaaagtctgggttggaacgtacttgggagtcggccat

SEQ ID NO: 450502 - DNA, 140 bp, Artificial Sequence
  Synthetic
atggccgactcccaagtacgttccaacccagactttgcacattcatgggtttctcatggccgtctcttccaagagtgaaccctttcaccccactcacttccttctgcgcagcagcatagtggagacccagcatggcgtat

SEQ ID NO: 450503 - DNA, 140 bp, Artificial Sequence
  Synthetic
aggccctggctgctgatatgggaagagacggccatgagaaacccatgaatgtgcaaagtctgggttggaatattattacctttaaggataaaactgatatccaccgcctggaaccagtgagaccttttgggacagcggtg

SEQ ID NO: 450504 - DNA, 140 bp, Artificial Sequence
  Synthetic
caccgctgtcccaaaaggtctcactggttccaggcggtggatatcagttttatccttaaaggtaataatattccaacccagactttgcacattcatgggtttctcatggccgtctcttcccatatcagcagccagggcct

SEQ ID NO: 450505 - DNA, 140 bp, Artificial Sequence
  Synthetic
atacgccatgctgggtctccaatgtgacaccctcttgtgtgacattggagagtcatcatcgtcatcggtcacagagggggaaaggaccatgagagttcttgacactgtggagaaatggctcgtacttgggagtcggccat

SEQ ID NO: 450506 - DNA, 140 bp, Artificial Sequence
  Synthetic
atggccgactcccaagtacgagccatttctccacagtgtcaagaactctcatggtcctttccccctctgtgaccgatgacgatgatgactctccaatgtcacacaagagggtgtcacattggagacccagcatggcgtat

SEQ ID NO: 450507 - DNA, 140 bp, Artificial Sequence
  Synthetic
atacgccatgctgggtctccgtgatcaggaaccctctctccaggaattccacccatgaaatgtactatgtgtctggagcccgcagcaacgtcacgttcactgtgaaccaaacatctcgcccgtacttgggagtcggccat

SEQ ID NO: 450508 - DNA, 140 bp, Artificial Sequence
  Synthetic
atggccgactcccaagtacgggcgagatgtttggttcacagtgaacgtgacgttgctgcgggctccagacacatagtacatttcatgggtggaattcctggagagagggttcctgatcacggagacccagcatggcgtat

SEQ ID NO: 450509 - DNA, 140 bp, Artificial Sequence
  Synthetic
atacgccatgctgggtctcctcttgatgaggagaatgaggcgtccaactggaaaagtgaccttggaggctgatgtcatactcccaattgggacacgcagtgttgagacagataagggacccgtacttgggagtcggccat

SEQ ID NO: 450510 - DNA, 140 bp, Artificial Sequence
  Synthetic
atggccgactcccaagtacgggtcccttatctgtctcaacactgcgtgtcccaattgggagtatgacatcagcctccaaggtcacttttccagttggacgcctcattctcctcatcaagaggagacccagcatggcgtat

SEQ ID NO: 450511 - DNA, 140 bp, Artificial Sequence
  Synthetic
aggccctggctgctgatatggatgtcatactcccaattgggacacgcagtgttgagacagataagggacccttggacagagaggccatagaagaaagggttgagaggataaaatctgagtgaccttttgggacagcggtg

SEQ ID NO: 450512 - DNA, 140 bp, Artificial Sequence
  Synthetic
caccgctgtcccaaaaggtcactcagattttatcctctcaaccctttcttctatggcctctctgtccaagggtcccttatctgtctcaacactgcgtgtcccaattgggagtatgacatccatatcagcagccagggcct

SEQ ID NO: 450513 - DNA, 140 bp, Artificial Sequence
  Synthetic
aggccctggctgctgatatgggaggagtggaaggcattggcttacaatacctaggatatgtgatcagagacctggctgcaatggatggtggtggattctacgcggatgacaccgctggatgaccttttgggacagcggtg

SEQ ID NO: 450514 - DNA, 140 bp, Artificial Sequence
  Synthetic
caccgctgtcccaaaaggtcatccagcggtgtcatccgcgtagaatccaccaccatccattgcagccaggtctctgatcacatatcctaggtattgtaagccaatgccttccactcctcccatatcagcagccagggcct

SEQ ID NO: 450515 - DNA, 140 bp, Artificial Sequence
  Synthetic
atacgccatgctgggtctccgggacacgcgcatcacagaggcagaccttgatgatgaacaggaaatcctgaactacatgagcccacatcacaaaaaactggcacaggcagtgatggaaatcgtacttgggagtcggccat

SEQ ID NO: 450516 - DNA, 140 bp, Artificial Sequence
  Synthetic
atggccgactcccaagtacgatttccatcactgcctgtgccagttttttgtgatgtgggctcatgtagttcaggatttcctgttcatcatcaaggtctgcctctgtgatgcgcgtgtcccggagacccagcatggcgtat

SEQ ID NO: 450517 - DNA, 140 bp, Artificial Sequence
  Synthetic
aggccctggctgctgatatgaactacatgagcccacatcacaaaaaactggcacaggcagtgatggaaatgacatacaagaacaaagtagtgaaagtgctgagaccagccccaggagggagaccttttgggacagcggtg

SEQ ID NO: 450518 - DNA, 140 bp, Artificial Sequence
  Synthetic
caccgctgtcccaaaaggtctccctcctggggctggtctcagcactttcactactttgttcttgtatgtcatttccatcactgcctgtgccagttttttgtgatgtgggctcatgtagttcatatcagcagccagggcct

SEQ ID NO: 450519 - DNA, 140 bp, Artificial Sequence
  Synthetic
aggccctggctgctgatatggtggtgacttatgctctgaacactatcaccaacttgaaagtccaattgatcagaatggcagaagcagagatggtgatacatcaccaacatgttcaagattgaccttttgggacagcggtg

SEQ ID NO: 450520 - DNA, 140 bp, Artificial Sequence
  Synthetic
caccgctgtcccaaaaggtcaatcttgaacatgttggtgatgtatcaccatctctgcttctgccattctgatcaattggactttcaagttggtgatagtgttcagagcataagtcaccaccatatcagcagccagggcct

SEQ ID NO: 450521 - DNA, 140 bp, Artificial Sequence
  Synthetic
aggccctggctgctgatatgttgggagaggaagggtgtctccaggaaacggctggatgatcaaagaaacggcttgcctcagcaaggcctatgccaacatgtggtcactgatgtactttcagaccttttgggacagcggtg

SEQ ID NO: 450522 - DNA, 140 bp, Artificial Sequence
  Synthetic
caccgctgtcccaaaaggtctgaaagtacatcagtgaccacatgttggcataggccttgctgaggcaagccgtttctttgatcatccagccgtttcctggagacacccttcctctcccaacatatcagcagccagggcct

SEQ ID NO: 450523 - DNA, 140 bp, Artificial Sequence
  Synthetic
aggccctggctgctgatatgcgccagggaaagaccggagtggttctctgcttttcctccagaggtctgtgagcacagtttgctcaagaataagcagacctttggatgacaaacacaaaacgaccttttgggacagcggtg

SEQ ID NO: 450524 - DNA, 140 bp, Artificial Sequence
  Synthetic
caccgctgtcccaaaaggtcgttttgtgtttgtcatccaaaggtctgcttattcttgagcaaactgtgctcacagacctctggaggaaaagcagagaaccactccggtctttccctggcgcatatcagcagccagggcct

SEQ ID NO: 450525 - DNA, 140 bp, Artificial Sequence
  Synthetic
aggccctggctgctgatatggagatgcatcatcttgttgaatttgaacctccgcatgccgcaactatcagagtgctggccctggggaaccaggaaggctccttgaaaacagctcttaccggaccttttgggacagcggtg

SEQ ID NO: 450526 - DNA, 140 bp, Artificial Sequence
  Synthetic
caccgctgtcccaaaaggtccggtaagagctgttttcaaggagccttcctggttccccagggccagcactctgatagttgcggcatgcggaggttcaaattcaacaagatgatgcatctccatatcagcagccagggcct

SEQ ID NO: 450527 - DNA, 140 bp, Artificial Sequence
  Synthetic
aggccctggctgctgatatgggggacatcctacaaaatgtgcactgacaaaatgtcctttgtcaagaacccaactgacactggtcatggcactgttgtgatgcaggtgaaagtgccaaaagaccttttgggacagcggtg

SEQ ID NO: 450528 - DNA, 140 bp, Artificial Sequence
  Synthetic
caccgctgtcccaaaaggtcttttggcactttcacctgcatcacaacagtgccatgaccagtgtcagttgggttcttgacaaaggacattttgtcagtgcacattttgtaggatgtcccccatatcagcagccagggcct

SEQ ID NO: 450529 - DNA, 140 bp, Artificial Sequence
  Synthetic
aggccctggctgctgatatgggaagaggttcagttgattgctgctgtcccaggaaagaacgtggttaatgtccagacaaaaccgagcttgttcaaagtgaggaatgggggagaaatcggggaccttttgggacagcggtg

SEQ ID NO: 450530 - DNA, 140 bp, Artificial Sequence
  Synthetic
caccgctgtcccaaaaggtccccgatttctcccccattcctcactttgaacaagctcggttttgtctggacattaaccacgttctttcctgggacagcagcaatcaactgaacctcttcccatatcagcagccagggcct

SEQ ID NO: 450531 - DNA, 140 bp, Artificial Sequence
  Synthetic
atacgccatgctgggtctccctggactgcaggacagcttttaagcctgtgcttgtggatgaagggaggaaggtggcaataaaggggccactccgcatctccgcatcctctgctgcgcaaacgtacttgggagtcggccat

SEQ ID NO: 450532 - DNA, 140 bp, Artificial Sequence
  Synthetic
atggccgactcccaagtacgtttgcgcagcagaggatgcggagatgcggagtggcccctttattgccaccttcctcccttcatccacaagcacaggcttaaaagctgtcctgcagtccagggagacccagcatggcgtat

SEQ ID NO: 450533 - DNA, 140 bp, Artificial Sequence
  Synthetic
aggccctggctgctgatatgatgtcccttatctaaccaagagacaagacaagctgtgcggatcactgattggaatgaccaatagggccacctgggcctcccacatccacttggtcatccagaccttttgggacagcggtg

SEQ ID NO: 450534 - DNA, 140 bp, Artificial Sequence
  Synthetic
caccgctgtcccaaaaggtctggatgaccaagtggatgtgggaggcccaggtggccctattggtcattccaatcagtgatccgcacagcttgtcttgtctcttggttagataagggacatcatatcagcagccagggcct

SEQ ID NO: 450535 - DNA, 140 bp, Artificial Sequence
  Synthetic
atacgccatgctgggtctcctggctgttctaaggaaagttaagagggtggtggccagtttgatgagaggactgtcctcaaggaaacgccgttcccatgacgctctgactgtgcaactcctcgtacttgggagtcggccat

SEQ ID NO: 450536 - DNA, 140 bp, Artificial Sequence
  Synthetic
atggccgactcccaagtacgaggagttgcacagtcagagcgtcatgggaacggcgtttccttgaggacagtcctctcatcaaactggccaccaccctcttaactttccttagaacagccaggagacccagcatggcgtat

SEQ ID NO: 450537 - DNA, 140 bp, Artificial Sequence
  Synthetic
atacgccatgctgggtctccaattctgggaatgatattgatggcgggtggagtgaccttggtgcggaaaaacagatggttgctcctaaatgtgacatctgaggacctcgggaaaacattccgtacttgggagtcggccat

SEQ ID NO: 450538 - DNA, 140 bp, Artificial Sequence
  Synthetic
atggccgactcccaagtacggaatgttttcccgaggtcctcagatgtcacatttaggagcaaccatctgtttttccgcaccaaggtcactccacccgccatcaatatcattcccagaattggagacccagcatggcgtat

SEQ ID NO: 450539 - DNA, 140 bp, Artificial Sequence
  Synthetic
atacgccatgctgggtctccagccagatgacattgattgctggtgctatggggtggaaaacgttagagtcgcatatggcaagtgtgactcagcaggcaggtctaggaggtcaagaagggccgtacttgggagtcggccat

SEQ ID NO: 450540 - DNA, 140 bp, Artificial Sequence
  Synthetic
atggccgactcccaagtacggcccttcttgacctcctagacctgcctgctgagtcacacttgccatatgcgactctaacgttttccaccccatagcaccagcaatcaatgtcatctggctggagacccagcatggcgtat

SEQ ID NO: 450541 - DNA, 140 bp, Artificial Sequence
  Synthetic
atacgccatgctgggtctccacttggggaaagagccttgtgttctccccagggaggaagaatggaagttttatcatagatggaaagtctaggaaagaatgcccattttcaaaccgggtttcgtacttgggagtcggccat

SEQ ID NO: 450542 - DNA, 140 bp, Artificial Sequence
  Synthetic
atggccgactcccaagtacgaaacccggtttgaaaatgggcattctttcctagactttccatctatgataaaacttccattcttcctccctggggagaacacaaggctctttccccaagtggagacccagcatggcgtat

SEQ ID NO: 450543 - DNA, 140 bp, Artificial Sequence
  Synthetic
aggccctggctgctgatatgggaactctttccagatagaggagtttgggacgggagtgttcaccacacgcgtgtacatggacgcagtctttgaatacaccatagactgcgatggatccatgaccttttgggacagcggtg

SEQ ID NO: 450544 - DNA, 140 bp, Artificial Sequence
  Synthetic
caccgctgtcccaaaaggtcatggatccatcgcagtctatggtgtattcaaagactgcgtccatgtacacgcgtgtggtgaacactcccgtcccaaactcctctatctggaaagagttcccatatcagcagccagggcct

SEQ ID NO: 450545 - DNA, 140 bp, Artificial Sequence
  Synthetic
aggccctggctgctgatatggaactccaaggacacctccatgcagaagaccatacctttggtggccctcacactcacatcttacctgggcttgacacaaccttttttgggcctgtgtgcagaccttttgggacagcggtg

SEQ ID NO: 450546 - DNA, 140 bp, Artificial Sequence
  Synthetic
caccgctgtcccaaaaggtctgcacacaggcccaaaaaaggttgtgtcaagcccaggtaagatgtgagtgtgagggccaccaaaggtatggtcttctgcatggaggtgtccttggagttccatatcagcagccagggcct

SEQ ID NO: 450547 - DNA, 140 bp, Artificial Sequence
  Synthetic
atacgccatgctgggtctccactcgcggcagctggtctggtgggagtgctggcaggactggctttccaggaaatggagaacttccttggtccgattgcagttggaggaatcctgatgatgcgtacttgggagtcggccat

SEQ ID NO: 450548 - DNA, 140 bp, Artificial Sequence
  Synthetic
atggccgactcccaagtacgcatcatcaggattcctccaactgcaatcggaccaaggaagttctccatttcctggaaagccagtcctgccagcactcccaccagaccagctgccgcgagtggagacccagcatggcgtat

SEQ ID NO: 450549 - DNA, 140 bp, Artificial Sequence
  Synthetic
aggccctggctgctgatatgctggtcagcgtggctgggagagtggatgggctagagctcaggaagcttggtgaagtttcatgggaagaggaggcagagattagcggaagctccgcccgctgaccttttgggacagcggtg

SEQ ID NO: 450550 - DNA, 140 bp, Artificial Sequence
  Synthetic
caccgctgtcccaaaaggtcagcgggcggagcttccgctaatctctgcctcctcttcccatgaaacttcaccaagcttcctgagctctagcccatccactctcccagccacgctgaccagcatatcagcagccagggcct

SEQ ID NO: 450551 - DNA, 140 bp, Artificial Sequence
  Synthetic
atacgccatgctgggtctcctcccactagggttgttctttctgaaatgaaagaggcttttcacggcttggacgtgaaattccacacacaagccttctcagcccacggtagcgggagagaacgtacttgggagtcggccat

SEQ ID NO: 450552 - DNA, 140 bp, Artificial Sequence
  Synthetic
atggccgactcccaagtacgttctctcccgctaccgtgggctgagaaggcttgtgtgtggaatttcacgtccaagccgtgaaaagcctctttcatttcagaaagaacaaccctagtgggaggagacccagcatggcgtat

SEQ ID NO: 450553 - DNA, 140 bp, Artificial Sequence
  Synthetic
atacgccatgctgggtctcctggatccagctagcatagccgccagaggttgggcagcgcatagagctagggcaaatgaaagtgcaacaattttgatgacagccacaccgccagggactagcgtacttgggagtcggccat

SEQ ID NO: 450554 - DNA, 140 bp, Artificial Sequence
  Synthetic
atggccgactcccaagtacgctagtccctggcggtgtggctgtcatcaaaattgttgcactttcatttgccctagctctatgcgctgcccaacctctggcggctatgctagctggatccaggagacccagcatggcgtat

SEQ ID NO: 450555 - DNA, 140 bp, Artificial Sequence
  Synthetic
atacgccatgctgggtctcctgatgaatttccacattcaaatggtgaaatagaagatgttcaaacggacatacccagcgagccctggaacacagggcatgactggatcctggctgacaaacgtacttgggagtcggccat

SEQ ID NO: 450556 - DNA, 140 bp, Artificial Sequence
  Synthetic
atggccgactcccaagtacgtttgtcagccaggatccagtcatgccctgtgttccagggctcgctgggtatgtccgtttgaacatcttctatttcaccatttgaatgtggaaattcatcaggagacccagcatggcgtat

SEQ ID NO: 450557 - DNA, 140 bp, Artificial Sequence
  Synthetic
aggccctggctgctgatatggtgttccatggtgttgccaagaaccctgttgttgatgggaatccaacagttgacattgaggaagctcctgaaatgcctgccctctatgagaagaaactgggaccttttgggacagcggtg

SEQ ID NO: 450558 - DNA, 140 bp, Artificial Sequence
  Synthetic
caccgctgtcccaaaaggtcccagtttcttctcatagagggcaggcatttcaggagcttcctcaatgtcaactgttggattcccatcaacaacagggttcttggcaacaccatggaacaccatatcagcagccagggcct

SEQ ID NO: 450559 - DNA, 140 bp, Artificial Sequence
  Synthetic
atacgccatgctgggtctccggaagatcatgaaagttgtcaataggtggctgttccgccacctggccagagaaaagaaccccagactgtgtacaaaggaagaatttattgcaaaagtccgcgtacttgggagtcggccat

SEQ ID NO: 450560 - DNA, 140 bp, Artificial Sequence
  Synthetic
atggccgactcccaagtacgcggacttttgcaataaattcttcctttgtacacagtctggggttcttttctctggccaggtggcggaacagccacctattgacaactttcatgatcttccggagacccagcatggcgtat

SEQ ID NO: 450561 - DNA, 140 bp, Artificial Sequence
  Synthetic
atacgccatgctgggtctccaaagcctacatggatgtcataagtcgacgagatcagagaggatccgggcaggtggtgacttatgctctgaacactatcaccaacttgaaagtccaattgacgtacttgggagtcggccat

SEQ ID NO: 450562 - DNA, 140 bp, Artificial Sequence
  Synthetic
atggccgactcccaagtacgtcaattggactttcaagttggtgatagtgttcagagcataagtcaccacctgcccggatcctctctgatctcgtcgacttatgacatccatgtaggctttggagacccagcatggcgtat

SEQ ID NO: 450563 - DNA, 140 bp, Artificial Sequence
  Synthetic
aggccctggctgctgatatgatcgttgggacaggagattcacgtctcacttaccagtggcacaaagagggaagctcaataggaaagttgttcactcagaccatgaaaggcgcggaacgccgaccttttgggacagcggtg

SEQ ID NO: 450564 - DNA, 140 bp, Artificial Sequence
  Synthetic
caccgctgtcccaaaaggtcggcgttccgcgcctttcatggtctgagtgaacaactttcctattgagcttccctctttgtgccactggtaagtgagacgtgaatctcctgtcccaacgatcatatcagcagccagggcct

SEQ ID NO: 450565 - DNA, 140 bp, Artificial Sequence
  Synthetic
atacgccatgctgggtctccagttagctctcacaatcatatccctggatacaaggttcagacgaacggaccttggatgcaggtaccactagaagtgaagagagaagcttgcccagggactcgtacttgggagtcggccat

SEQ ID NO: 450566 - DNA, 140 bp, Artificial Sequence
  Synthetic
atggccgactcccaagtacgagtccctgggcaagcttctctcttcacttctagtggtacctgcatccaaggtccgttcgtctgaaccttgtatccagggatatgattgtgagagctaactggagacccagcatggcgtat

SEQ ID NO: 450567 - DNA, 140 bp, Artificial Sequence
  Synthetic
aggccctggctgctgatatgtgaacaatggaggagacgccatgtatatggcgttgattgctgccttttcagtcagaccagggctgctcatcggctttgggctcaggaccctatggagcccgaccttttgggacagcggtg

SEQ ID NO: 450568 - DNA, 140 bp, Artificial Sequence
  Synthetic
caccgctgtcccaaaaggtcgggctccatagggtcctgagcccaaagccgatgagcagccctggtctgactgaaaaggcagcaatcaacgccatatacatggcgtctcctccattgttcacatatcagcagccagggcct

SEQ ID NO: 450569 - DNA, 140 bp, Artificial Sequence
  Synthetic
atacgccatgctgggtctcctcgggagcgccttgtgctggccctgggagcagccatggtggagattgccttgggtggcatgatgggcggcctgtggaagtatctaaatgcagtttctctccgtacttgggagtcggccat

SEQ ID NO: 450570 - DNA, 140 bp, Artificial Sequence
  Synthetic
atggccgactcccaagtacggagagaaactgcatttagatacttccacaggccgcccatcatgccacccaaggcaatctccaccatggctgctcccagggccagcacaaggcgctcccgaggagacccagcatggcgtat

SEQ ID NO: 450571 - DNA, 140 bp, Artificial Sequence
  Synthetic
atacgccatgctgggtctcctgcatcctgacaataaatgctgttgcttctaggaaagcatcaaataccatcctgcccctcatggctctgttgacacctgtcactatggctgaggtgagaccgtacttgggagtcggccat

SEQ ID NO: 450572 - DNA, 140 bp, Artificial Sequence
  Synthetic
atggccgactcccaagtacggtctcacctcagccatagtgacaggtgtcaacagagccatgaggggcaggatggtatttgatgctttcctagaagcaacagcatttattgtcaggatgcaggagacccagcatggcgtat

SEQ ID NO: 450573 - DNA, 140 bp, Artificial Sequence
  Synthetic
atacgccatgctgggtctccggagggggcgcattgggagaaatcccaacagagatggagactcatactactattctgagcctacaagtgaagataatgcccaccacgtctgctggttggacgtacttgggagtcggccat

SEQ ID NO: 450574 - DNA, 140 bp, Artificial Sequence
  Synthetic
atggccgactcccaagtacgtccaaccagcagacgtggtgggcattatcttcacttgtaggctcagaatagtagtatgagtctccatctctgttgggatttctcccaatgcgccccctccggagacccagcatggcgtat

SEQ ID NO: 450575 - DNA, 140 bp, Artificial Sequence
  Synthetic
atacgccatgctgggtctcccgctgtctgaatttattaagtttgctgaaggtaggaggggagctgcggaagtgctagttgtgctgagtgaactccctgatttcctggctaaaaaaggtggcgtacttgggagtcggccat

SEQ ID NO: 450576 - DNA, 140 bp, Artificial Sequence
  Synthetic
atggccgactcccaagtacgccaccttttttagccaggaaatcagggagttcactcagcacaactagcacttccgcagctcccctcctaccttcagcaaacttaataaattcagacagcgggagacccagcatggcgtat

SEQ ID NO: 450577 - DNA, 140 bp, Artificial Sequence
  Synthetic
aggccctggctgctgatatggggcttaccgcaatgcactatcaatgatgcctgaggcaatgacaatagtcatgctgtttatactggctggactactgacatcgggaatggtcatctttttgaccttttgggacagcggtg

SEQ ID NO: 450578 - DNA, 140 bp, Artificial Sequence
  Synthetic
caccgctgtcccaaaaggtcaaaaagatgaccattcccgatgtcagtagtccagccagtataaacagcatgactattgtcattgcctcaggcatcattgatagtgcattgcggtaagccccatatcagcagccagggcct

SEQ ID NO: 450579 - DNA, 140 bp, Artificial Sequence
  Synthetic
atacgccatgctgggtctccactacgctgctgcgcaaaaggaagtgagtggggtcaaaggattcactcttggaagagacggccatgagaaacccatgaatgtgcaaagtctgggatggaacgtacttgggagtcggccat

SEQ ID NO: 450580 - DNA, 140 bp, Artificial Sequence
  Synthetic
atggccgactcccaagtacgttccatcccagactttgcacattcatgggtttctcatggccgtctcttccaagagtgaatcctttgaccccactcacttccttttgcgcagcagcgtagtggagacccagcatggcgtat

SEQ ID NO: 450581 - DNA, 140 bp, Artificial Sequence
  Synthetic
atacgccatgctgggtctccgtgatcaggaaccctctctccaggaattccactcatgaaatgtactacgtgtctggagcccgcagcaatgtcacatttactgtgaaccaaacatcccgcccgtacttgggagtcggccat

SEQ ID NO: 450582 - DNA, 140 bp, Artificial Sequence
  Synthetic
atggccgactcccaagtacgggcgggatgtttggttcacagtaaatgtgacattgctgcgggctccagacacgtagtacatttcatgagtggaattcctggagagagggttcctgatcacggagacccagcatggcgtat

SEQ ID NO: 450583 - DNA, 140 bp, Artificial Sequence
  Synthetic
aggccctggctgctgatatgtactgtggctcctatgtcacaaaaacctcaggaagtgcggcgagcatggtaaatggtgttattaaaattctgacatacccatgggacaagatagaggagggaccttttgggacagcggtg

SEQ ID NO: 450584 - DNA, 140 bp, Artificial Sequence
  Synthetic
caccgctgtcccaaaaggtccctcctctatcttgtcccatgggtatgtcagaattttaataacaccatttaccatgctcgccgcacttcctgaggtttttgtgacataggagccacagtacatatcagcagccagggcct

SEQ ID NO: 450585 - DNA, 140 bp, Artificial Sequence
  Synthetic
aggccctggctgctgatatggaagatcatgaaagttgtcaacaggtggctgttccgccacctggccagagaaaagaaccccagactgtgcacaaaggaagaatttattgcaaaagtccgagaccttttgggacagcggtg

SEQ ID NO: 450586 - DNA, 140 bp, Artificial Sequence
  Synthetic
caccgctgtcccaaaaggtctcggacttttgcaataaattcttcctttgtgcacagtctggggttcttttctctggccaggtggcggaacagccacctgttgacaactttcatgatcttccatatcagcagccagggcct

SEQ ID NO: 450587 - DNA, 140 bp, Artificial Sequence
  Synthetic
aggccctggctgctgatatgaaagggagcattgtggcatgcgccaaattcacttgtgccaaatccatgagcttgtttgaggttgatcagaccaaaatccagtatgtcatcagagcacaatgaccttttgggacagcggtg

SEQ ID NO: 450588 - DNA, 140 bp, Artificial Sequence
  Synthetic
caccgctgtcccaaaaggtcattgtgctctgatgacatactggattttggtctgatcaacctcaaacaagctcatggatttggcacaagtgaatttggcgcatgccacaatgctccctttcatatcagcagccagggcct

SEQ ID NO: 450589 - DNA, 140 bp, Artificial Sequence
  Synthetic
atacgccatgctgggtctcctgcatgttggggccaagcaggaaaattggaataccgacattaaaactctcaagtttgatgccctatcaggctcccaggaggccgagttcactgggtatggcgtacttgggagtcggccat

SEQ ID NO: 450590 - DNA, 140 bp, Artificial Sequence
  Synthetic
atggccgactcccaagtacgccatacccagtgaactcggcctcctgggagcctgatagggcatcaaacttgagagttttaatgtcggtattccaattttcctgcttggccccaacatgcaggagacccagcatggcgtat

SEQ ID NO: 450591 - DNA, 140 bp, Artificial Sequence
  Synthetic
atacgccatgctgggtctccaggagccccctgcaagatcccagtgatagtagctgatgaccttacagcggcaatcaataaaggtattctggtcacagtcaatcccatagcttcaactaatcgtacttgggagtcggccat

SEQ ID NO: 450592 - DNA, 140 bp, Artificial Sequence
  Synthetic
atggccgactcccaagtacgattagttgaagctatgggattgactgtgaccagaatacctttattgattgccgctgtaaggtcatcagctactatcactgggatcttgcagggggctcctggagacccagcatggcgtat

SEQ ID NO: 450593 - DNA, 140 bp, Artificial Sequence
  Synthetic
atacgccatgctgggtctccggagttcaataggaaaactgttcactcagaccatgaaaggtgcggaacgcctggccgtcatgggagacgccgcctgggattttagctcagctggaggtttcgtacttgggagtcggccat

SEQ ID NO: 450594 - DNA, 140 bp, Artificial Sequence
  Synthetic
atggccgactcccaagtacgaaacctccagctgagctaaaatcccaggcggcgtctcccatgacggccaggcgttccgcacctttcatggtctgagtgaacagttttcctattgaactccggagacccagcatggcgtat

SEQ ID NO: 450595 - DNA, 140 bp, Artificial Sequence
  Synthetic
aggccctggctgctgatatgctggccgtcatgggagacgccgcctgggattttagctcagctggaggtttcttcacttcggttgggaaaggaattcatacggtgtttggctctgcctttcgaccttttgggacagcggtg

SEQ ID NO: 450596 - DNA, 140 bp, Artificial Sequence
  Synthetic
caccgctgtcccaaaaggtcgaaaggcagagccaaacaccgtatgaattcctttcccaaccgaagtgaagaaacctccagctgagctaaaatcccaggcggcgtctcccatgacggccagcatatcagcagccagggcct

SEQ ID NO: 450597 - DNA, 140 bp, Artificial Sequence
  Synthetic
atacgccatgctgggtctccggtggacatctctgttgtcgtgcaggatccaaagaatgtttaccagagaggaacgcatccattttccagaattcgggatggtctgcagtatggttggaagcgtacttgggagtcggccat

SEQ ID NO: 450598 - DNA, 140 bp, Artificial Sequence
  Synthetic
atggccgactcccaagtacgcttccaaccatactgcagaccatcccgaattctggaaaatggatgcgttcctctctggtaaacattctttggatcctgcacgacaacagagatgtccaccggagacccagcatggcgtat

SEQ ID NO: 450599 - DNA, 140 bp, Artificial Sequence
  Synthetic
atacgccatgctgggtctccccttggatgcaggtaccactagaagtgaggagagaagcgtgtccagggacaagtgtgatcattgatggcaactgcgatggacggggaaaatcaaccagatcgtacttgggagtcggccat

SEQ ID NO: 450600 - DNA, 140 bp, Artificial Sequence
  Synthetic
atggccgactcccaagtacgatctggttgattttccccgtccatcgcagttgccatcaatgatcacacttgtccctggacacgcttctctcctcacttctagtggtacctgcatccaaggggagacccagcatggcgtat

SEQ ID NO: 450601 - DNA, 140 bp, Artificial Sequence
  Synthetic
atacgccatgctgggtctccggttggaggagtggtgctcctgggagcaatgctggtcgggcaggtaactctccttgacttgctgaaactcacagtggctgtgggattgcacttccatgaacgtacttgggagtcggccat

SEQ ID NO: 450602 - DNA, 140 bp, Artificial Sequence
  Synthetic
atggccgactcccaagtacgttcatggaagtgcaatcccacagccactgtgagtttcagcaagtcaaggagagttacctgcccgaccagcattgctcccaggagcaccactcctccaaccggagacccagcatggcgtat

SEQ ID NO: 450603 - DNA, 140 bp, Artificial Sequence
  Synthetic
aggccctggctgctgatatgcactcacatcttacctgggcttgacacaaccttttttgggcctgtgtgcatttctggcaacccgcctatttgggcgaaggagcatcccagtgaatgaggcgaccttttgggacagcggtg

SEQ ID NO: 450604 - DNA, 140 bp, Artificial Sequence
  Synthetic
caccgctgtcccaaaaggtcgcctcattcactgggatgctccttcgcccaaataggcgggttgccagaaatgcacacaggcccaaaaaaggttgtgtcaagcccaggtaagatgtgagtgcatatcagcagccagggcct

SEQ ID NO: 450605 - DNA, 140 bp, Artificial Sequence
  Synthetic
atacgccatgctgggtctccctggttagcgtggctgggagagtggatgggctagagctcaggaagcttggtgaagtttcatgggaagaggaggcagagatcagcggaagctccgcccgctcgtacttgggagtcggccat

SEQ ID NO: 450606 - DNA, 140 bp, Artificial Sequence
  Synthetic
atggccgactcccaagtacgagcgggcggagcttccgctgatctctgcctcctcttcccatgaaacttcaccaagcttcctgagctctagcccatccactctcccagccacgctaaccagggagacccagcatggcgtat

SEQ ID NO: 450607 - DNA, 140 bp, Artificial Sequence
  Synthetic
aggccctggctgctgatatgatgtcaagggagctaggagaagtggggatgttctgtgggatattcccactcctaagatcattgaggaatgcgagcatctggaggatgggatttatggcatgaccttttgggacagcggtg

SEQ ID NO: 450608 - DNA, 140 bp, Artificial Sequence
  Synthetic
caccgctgtcccaaaaggtcatgccataaatcccatcctccagatgctcgcattcctcaatgatcttaggagtgggaatatcccacagaacatccccacttctcctagctcccttgacatcatatcagcagccagggcct

SEQ ID NO: 450609 - DNA, 140 bp, Artificial Sequence
  Synthetic
atacgccatgctgggtctccccatccttgattttcatcctggagctgggaagacaagacggttcctcccacagatcttggccgagtgtgcacggagacgcttgcgcactcttgtgctggccgtacttgggagtcggccat

SEQ ID NO: 450610 - DNA, 140 bp, Artificial Sequence
  Synthetic
atggccgactcccaagtacggccagcacaagagtgcgcaagcgtctccgtgcacactcggccaagatctgtgggaggaaccgtcttgtcttcccagctccaggatgaaaatcaaggatggggagacccagcatggcgtat

SEQ ID NO: 450611 - DNA, 140 bp, Artificial Sequence
  Synthetic
atacgccatgctgggtctcctcccactagggttgttctttctgaaatgaaggaggcttttcacggcttggacgtgaaattccacacacaagccttttccgcccacggtagcgggagagaacgtacttgggagtcggccat

SEQ ID NO: 450612 - DNA, 140 bp, Artificial Sequence
  Synthetic
atggccgactcccaagtacgttctctcccgctaccgtgggcggaaaaggcttgtgtgtggaatttcacgtccaagccgtgaaaagcctccttcatttcagaaagaacaaccctagtgggaggagacccagcatggcgtat

SEQ ID NO: 450613 - DNA, 140 bp, Artificial Sequence
  Synthetic
  misc_feature (38)..(38): n is a, c, g, or t
atacgccatgctgggtctccgtcattgacgccatgtgncatgccaccctaacttataggatgttggaaccaactaggattgtcaactgggaagtgatcatcatggatgaagcccatttttcgtacttgggagtcggccat

SEQ ID NO: 450614 - DNA, 140 bp, Artificial Sequence
  Synthetic
  misc_feature (103)..(103): n is a, c, g, or t
atggccgactcccaagtacgaaaaatgggcttcatccatgatgatcacttcccagttgacaatcctagttggttccaacatcctataagttagggtggcatgncacatggcgtcaatgacggagacccagcatggcgtat

SEQ ID NO: 450615 - DNA, 140 bp, Artificial Sequence
  Synthetic
aggccctggctgctgatatgacgaatgatcgcaagtggtgttttgaaggccctgaggaacacgagatcttgaatgacagtggtgaaacagtgaagtgcagggctcccggaggagcaaagagaccttttgggacagcggtg

SEQ ID NO: 450616 - DNA, 140 bp, Artificial Sequence
  Synthetic
caccgctgtcccaaaaggtctctttgctcctccgggagccctgcacttcactgtttcaccactgtcattcaagatctcgtgttcctcagggccttcaaaacaccacttgcgatcattcgtcatatcagcagccagggcct

SEQ ID NO: 450617 - DNA, 140 bp, Artificial Sequence
  Synthetic
atacgccatgctgggtctccgaatgacagtggtgaaacagtgaagtgcagggctcccggaggagcaaagaagcctctgcgcccaaggtggtgtgatgaaagggtgtcatctgaccagagtcgtacttgggagtcggccat

SEQ ID NO: 450618 - DNA, 140 bp, Artificial Sequence
  Synthetic
atggccgactcccaagtacgactctggtcagatgacaccctttcatcacaccaccttgggcgcagaggcttctttgctcctccgggagccctgcacttcactgtttcaccactgtcattcggagacccagcatggcgtat

SEQ ID NO: 450619 - DNA, 140 bp, Artificial Sequence
  Synthetic
aggccctggctgctgatatgagtgatgcctttgctctgtggcatagggtgcgccacgctccactggtctctcattttacctggaatcaaagcgcagcagtcaaagcttgcacagagaagggaccttttgggacagcggtg

SEQ ID NO: 450620 - DNA, 140 bp, Artificial Sequence
  Synthetic
caccgctgtcccaaaaggtcccttctctgtgcaagctttgactgctgcgctttgattccaggtaaaatgagagaccagtggagcgtggcgcaccctatgccacagagcaaaggcatcactcatatcagcagccagggcct

SEQ ID NO: 450621 - DNA, 140 bp, Artificial Sequence
  Synthetic
atacgccatgctgggtctccaccgcttatagagggaaacaccagccttctttggaatggacccatggctgtctctatgacgggagtcatgcggggaaactactatgcctttgtgggagtccgtacttgggagtcggccat

SEQ ID NO: 450622 - DNA, 140 bp, Artificial Sequence
  Synthetic
atggccgactcccaagtacggactcccacaaaggcatagtagtttccccgcatgactcccgtcatagagacagccatgggtccattccaaagaaggctggtgtttccctctataagcggtggagacccagcatggcgtat

SEQ ID NO: 450623 - DNA, 140 bp, Artificial Sequence
  Synthetic
aggccctggctgctgatatgacattattacctttaaggacaaaactgacatccaccgcctggaaccaatgaaatgtgacaccctcctgtgtgacattggagagtcatcatcgtcatcggtgaccttttgggacagcggtg

SEQ ID NO: 450624 - DNA, 140 bp, Artificial Sequence
  Synthetic
caccgctgtcccaaaaggtcaccgatgacgatgatgactctccaatgtcacacaggagggtgtcacatttcattggttccaggcggtggatgtcagttttgtccttaaaggtaataatgtcatatcagcagccagggcct

SEQ ID NO: 450625 - DNA, 140 bp, Artificial Sequence
  Synthetic
atacgccatgctgggtctccacaaaagggacatgagactgctgtcattggccgtttcctcagctgttcccacctcatgggtcccacaaggacgcacaacatggtcgattcatgggaaaggcgtacttgggagtcggccat

SEQ ID NO: 450626 - DNA, 140 bp, Artificial Sequence
  Synthetic
atggccgactcccaagtacgcctttcccatgaatcgaccatgttgtgcgtccttgtgggacccatgaggtgggaacagctgaggaaacggccaatgacagcagtctcatgtcccttttgtggagacccagcatggcgtat

SEQ ID NO: 450627 - DNA, 140 bp, Artificial Sequence
  Synthetic
atacgccatgctgggtctcccaaggatttatctttttctttttgttcaacattctgactggaaagaagatcacggctcacctaaagaggttgtggaaaatgctggacccaagacaaggcccgtacttgggagtcggccat

SEQ ID NO: 450628 - DNA, 140 bp, Artificial Sequence
  Synthetic
atggccgactcccaagtacgggccttgtcttgggtccagcattttccacaacctctttaggtgagccgtgatcttctttccagtcagaatgttgaacaaaaagaaaaagataaatccttgggagacccagcatggcgtat

SEQ ID NO: 450629 - DNA, 140 bp, Artificial Sequence
  Synthetic
atacgccatgctgggtctcctggctgtcctgaggaaagtcaaaagagtggtagccagtttgatgagagggttgtcctcaaggaaacgccgttcccacgatgtcctgactgtgcaatttttcgtacttgggagtcggccat

SEQ ID NO: 450630 - DNA, 140 bp, Artificial Sequence
  Synthetic
atggccgactcccaagtacgaaaaattgcacagtcaggacatcgtgggaacggcgtttccttgaggacaaccctctcatcaaactggctaccactcttttgactttcctcaggacagccaggagacccagcatggcgtat

SEQ ID NO: 450631 - DNA, 140 bp, Artificial Sequence
  Synthetic
atacgccatgctgggtctccgattctgggaatgctgctgatggcgggtggagtaaccttggtgcggaaaaacagatggctactcctgaatgtgacatctgaggaccttgggaagacctttcgtacttgggagtcggccat

SEQ ID NO: 450632 - DNA, 140 bp, Artificial Sequence
  Synthetic
atggccgactcccaagtacgaaaggtcttcccaaggtcctcagatgtcacattcaggagtagccatctgtttttccgcaccaaggttactccacccgccatcagcagcattcccagaatcggagacccagcatggcgtat

SEQ ID NO: 450633 - DNA, 140 bp, Artificial Sequence
  Synthetic
atacgccatgctgggtctcctctgtgggtacgggcaactgcacaacaaacatcttggaagccaagtattggtgtccagattcaatggaatacaactgtcccaacctcagtccaagagaggcgtacttgggagtcggccat

SEQ ID NO: 450634 - DNA, 140 bp, Artificial Sequence
  Synthetic
atggccgactcccaagtacgcctctcttggactgaggttgggacagttgtattccattgaatctggacaccaatacttggcttccaagatgtttgttgtgcagttgcccgtacccacagaggagacccagcatggcgtat

SEQ ID NO: 450635 - DNA, 140 bp, Artificial Sequence
  Synthetic
atacgccatgctgggtctccagccggatgacattgattgttggtgttacggagtggaaaatgtcagagttgcatatggcaagtgtgactcagcaggcaggtcaagaaggtcaagaagagccgtacttgggagtcggccat

SEQ ID NO: 450636 - DNA, 140 bp, Artificial Sequence
  Synthetic
atggccgactcccaagtacggctcttcttgaccttcttgacctgcctgctgagtcacacttgccatatgcaactctgacattttccactccgtaacaccaacaatcaatgtcatccggctggagacccagcatggcgtat

SEQ ID NO: 450637 - DNA, 140 bp, Artificial Sequence
  Synthetic
aggccctggctgctgatatggcatatggcaagtgtgactcagcaggcaggtcaagaaggtcaagaagagctattgacttgcccacacatgaaaaccatggcctgaagactcggcaagaaagaccttttgggacagcggtg

SEQ ID NO: 450638 - DNA, 140 bp, Artificial Sequence
  Synthetic
caccgctgtcccaaaaggtctttcttgccgagtcttcaggccatggttttcatgtgtgggcaagtcaatagctcttcttgaccttcttgacctgcctgctgagtcacacttgccatatgccatatcagcagccagggcct

SEQ ID NO: 450639 - DNA, 140 bp, Artificial Sequence
  Synthetic
atacgccatgctgggtctccaatggatgactggaagaatgggggagaggcaactccaaaagattgagagatggcttgtgaggaatcccttctttgcagtaacagccttgaccatcgcctacgtacttgggagtcggccat

SEQ ID NO: 450640 - DNA, 140 bp, Artificial Sequence
  Synthetic
atggccgactcccaagtacgtaggcgatggtcaaggctgttactgcaaagaagggattcctcacaagccatctctcaatcttttggagttgcctctcccccattcttccagtcatccattggagacccagcatggcgtat

SEQ ID NO: 450641 - DNA, 140 bp, Artificial Sequence
  Synthetic
atacgccatgctgggtctcctcttgtgggtagcaacatgacgcagcgagtcgtgattgccctcctggttttggctgttggtccggcttactcagcccactgcattggaatcactgataggcgtacttgggagtcggccat

SEQ ID NO: 450642 - DNA, 140 bp, Artificial Sequence
  Synthetic
atggccgactcccaagtacgcctatcagtgattccaatgcagtgggctgagtaagccggaccaacagccaaaaccaggagggcaatcacgactcgctgcgtcatgttgctacccacaagaggagacccagcatggcgtat

SEQ ID NO: 450643 - DNA, 140 bp, Artificial Sequence
  Synthetic
atacgccatgctgggtctccgatttcattgagggggtgcatggaggaacctgggtttcagccaccttggagcaagacaagtgtgtcactgtcatggcccctgacaagccttcactggatacgtacttgggagtcggccat

SEQ ID NO: 450644 - DNA, 140 bp, Artificial Sequence
  Synthetic
atggccgactcccaagtacgtatccagtgaaggcttgtcaggggccatgacagtgacacacttgtcttgctccaaggtggctgaaacccaggttcctccatgcaccccctcaatgaaatcggagacccagcatggcgtat

SEQ ID NO: 450645 - DNA, 140 bp, Artificial Sequence
  Synthetic
atacgccatgctgggtctcctttcactagagacagtggccattgacggaccagctgaggcgagaaaggtgtgttacaatgcagtcctcactcatgtgaagatcaatgacaagtgccctagcgtacttgggagtcggccat

SEQ ID NO: 450646 - DNA, 140 bp, Artificial Sequence
  Synthetic
atggccgactcccaagtacgctagggcacttgtcattgatcttcacatgagtgaggactgcattgtaacacacctttctcgcctcagctggtccgtcaatggccactgtctctagtgaaaggagacccagcatggcgtat

SEQ ID NO: 450647 - DNA, 140 bp, Artificial Sequence
  Synthetic
atacgccatgctgggtctcccactggtgaggcccacctagctgaggaaaatgagggggacaatgcgtgtaagcgcacttattcggatagaggctggggaaacggctgtggcctgttcgggcgtacttgggagtcggccat

SEQ ID NO: 450648 - DNA, 140 bp, Artificial Sequence
  Synthetic
atggccgactcccaagtacgcccgaacaggccacagccgtttccccagcctctatccgaataagtgcgcttacacgcattgtccccctcattttcctcagctaggtgggcctcaccagtgggagacccagcatggcgtat

SEQ ID NO: 450649 - DNA, 140 bp, Artificial Sequence
  Synthetic
atacgccatgctgggtctccaaaggaagcattgtggcatgcgccaaattcacttgtgccaaatccatgagcttgtttgaggttgaccagacaaagatccagtacgtcatcagagcacaaccgtacttgggagtcggccat

SEQ ID NO: 450650 - DNA, 140 bp, Artificial Sequence
  Synthetic
atggccgactcccaagtacggttgtgctctgatgacgtactggatctttgtctggtcaacctcaaacaagctcatggatttggcacaagtgaatttggcgcatgccacaatgcttcctttggagacccagcatggcgtat

SEQ ID NO: 450651 - DNA, 140 bp, Artificial Sequence
  Synthetic
atacgccatgctgggtctcctgcatgttggggcaaagcaggaaaattggaacaccgacatcaaaactctcaagtttgatgcattgtcaggctctcaggaagccgagttcactgggtatggcgtacttgggagtcggccat

SEQ ID NO: 450652 - DNA, 140 bp, Artificial Sequence
  Synthetic
atggccgactcccaagtacgccatacccagtgaactcggcttcctgagagcctgacaatgcatcaaacttgagagttttgatgtcggtgttccaattttcctgctttgccccaacatgcaggagacccagcatggcgtat

SEQ ID NO: 450653 - DNA, 140 bp, Artificial Sequence
  Synthetic
atacgccatgctgggtctccaaaagctactctggaatgccaggtgcaaactgcagtagactttggcaacagttacatcgctgagatggaaaaggagagctggatagtggacaggcaatggcgtacttgggagtcggccat

SEQ ID NO: 450654 - DNA, 140 bp, Artificial Sequence
  Synthetic
atggccgactcccaagtacgccattgcctgtccactatccagctctccttttccatctcagcgatgtaactgttgccaaagtctactgcagtttgcacctggcattccagagtagcttttggagacccagcatggcgtat

SEQ ID NO: 450655 - DNA, 140 bp, Artificial Sequence
  Synthetic
atacgccatgctgggtctccgctcaggacttaaccttaccatggcagagcggcagtggtggggtgtggagggaaatgcaccaccttgttgaatttgaacctccccatgctgcaaccatcacgtacttgggagtcggccat

SEQ ID NO: 450656 - DNA, 140 bp, Artificial Sequence
  Synthetic
atggccgactcccaagtacgtgatggttgcagcatggggaggttcaaattcaacaaggtggtgcatttccctccacaccccaccactgccgctctgccatggtaaggttaagtcctgagcggagacccagcatggcgtat

SEQ ID NO: 450657 - DNA, 140 bp, Artificial Sequence
  Synthetic
atacgccatgctgggtctccgagtgctggccctaggaaaccaggaaggctctttaaaaacagccctcacaggtgcaatgagggttacaaaggacacgaatgacaacaatctgtacaaactcgtacttgggagtcggccat

SEQ ID NO: 450658 - DNA, 140 bp, Artificial Sequence
  Synthetic
atggccgactcccaagtacgagtttgtacagattgttgtcattcgtgtcctttgtaaccctcattgcacctgtgagggctgtttttaaagagccttcctggtttcctagggccagcactcggagacccagcatggcgtat

SEQ ID NO: 450659 - DNA, 140 bp, Artificial Sequence
  Synthetic
atacgccatgctgggtctccacatggcggacatgtctcctgtagagtgaaattgtcagctttaacactcaaagggacatcctacaagatgtgcactgacaagatgtcttttgtcaagaaccgtacttgggagtcggccat

SEQ ID NO: 450660 - DNA, 140 bp, Artificial Sequence
  Synthetic
atggccgactcccaagtacggttcttgacaaaagacatcttgtcagtgcacatcttgtaggatgtccctttgagtgttaaagctgacaatttcactctacaggagacatgtccgccatgtggagacccagcatggcgtat

SEQ ID NO: 450661 - DNA, 140 bp, Artificial Sequence
  Synthetic
atacgccatgctgggtctccccgactgacactggccatggcactgttgtgatgcaggttaaagtgccaaaaggagctccctgcaagatcccagtgatagtagctgatgatcttacagcggcgtacttgggagtcggccat

SEQ ID NO: 450662 - DNA, 140 bp, Artificial Sequence
  Synthetic
atggccgactcccaagtacgccgctgtaagatcatcagctactatcactgggatcttgcagggagctccttttggcactttaacctgcatcacaacagtgccatggccagtgtcagtcggggagacccagcatggcgtat

SEQ ID NO: 450663 - DNA, 140 bp, Artificial Sequence
  Synthetic
atacgccatgctgggtctcccagtcaacaaaggcattttggttacagtcaaccccatcgcctcaaccaatgatgatgaagtgttgatcgaagtgaatccaccctttggagatagttacatcgtacttgggagtcggccat

SEQ ID NO: 450664 - DNA, 140 bp, Artificial Sequence
  Synthetic
atggccgactcccaagtacgatgtaactatctccaaagggtggattcacttcgatcaacacttcatcatcattggttgaggcgatggggttgactgtaaccaaaatgcctttgttgactgggagacccagcatggcgtat

SEQ ID NO: 450665 - DNA, 140 bp, Artificial Sequence
  Synthetic
atacgccatgctgggtctcccatagttggaacaggagattcacgtctcacctatcagtggcacaaagagggaagttcaataggaaagctgttcacccagactatgaaaggcgcagagcgccgtacttgggagtcggccat

SEQ ID NO: 450666 - DNA, 140 bp, Artificial Sequence
  Synthetic
atggccgactcccaagtacggcgctctgcgcctttcatagtctgggtgaacagctttcctattgaacttccctctttgtgccactgataggtgagacgtgaatctcctgttccaactatgggagacccagcatggcgtat

SEQ ID NO: 450667 - DNA, 140 bp, Artificial Sequence
  Synthetic
atacgccatgctgggtctccctggctgtcatgggagacgctgcctgggatttcagctctgctggagggttcttcacttcgattgggaaaggaattcacacggtgtttggctctgcctttccgtacttgggagtcggccat

SEQ ID NO: 450668 - DNA, 140 bp, Artificial Sequence
  Synthetic
atggccgactcccaagtacggaaaggcagagccaaacaccgtgtgaattcctttcccaatcgaagtgaagaaccctccagcagagctgaaatcccaggcagcgtctcccatgacagccagggagacccagcatggcgtat

SEQ ID NO: 450669 - DNA, 140 bp, Artificial Sequence
  Synthetic
atacgccatgctgggtctccagggactttttggtggcttgagctggataacgaaggtcatcatgggcgcggtcctcatatgggtcggcatcaacacaaggaatatgacaatgtccatgagcgtacttgggagtcggccat

SEQ ID NO: 450670 - DNA, 140 bp, Artificial Sequence
  Synthetic
atggccgactcccaagtacgctcatggacattgtcatattccttgtgttgatgccgacccatatgaggaccgcgcccatgatgaccttcgttatccagctcaagccaccaaaaagtccctggagacccagcatggcgtat

SEQ ID NO: 450671 - DNA, 140 bp, Artificial Sequence
  Synthetic
atacgccatgctgggtctcccatgatcttagtaggagtgattatgatgttcttgtctctgggagttggggcggatcaaggatgcgcaatcaactttggcaagagggagctcaagtgcgggcgtacttgggagtcggccat

SEQ ID NO: 450672 - DNA, 140 bp, Artificial Sequence
  Synthetic
atggccgactcccaagtacgcccgcacttgagctccctcttgccaaagttgattgcgcatccttgatccgccccaactcccagagacaagaacatcataatcactcctactaagatcatgggagacccagcatggcgtat

SEQ ID NO: 450673 - DNA, 140 bp, Artificial Sequence
  Synthetic
atacgccatgctgggtctccgatggtatcttcatctttagagactctgatgactggctgaacaagtactcatattacccagaagaccctgtgaagcttgcatcaatagtgaaagcctcctcgtacttgggagtcggccat

SEQ ID NO: 450674 - DNA, 140 bp, Artificial Sequence
  Synthetic
atggccgactcccaagtacgaggaggctttcactattgatgcaagcttcacagggtcttctgggtaatatgagtacttgttcagccagtcatcagagtctctaaagatgaagataccatcggagacccagcatggcgtat

SEQ ID NO: 450675 - DNA, 140 bp, Artificial Sequence
  Synthetic
atacgccatgctgggtctccttgaggaaggaaagtgcggcctaaactcagttgactccctcgagcatgaaatgtggagaagcagggcagatgagatcaatgccattctcgaggaaaatgacgtacttgggagtcggccat

SEQ ID NO: 450676 - DNA, 140 bp, Artificial Sequence
  Synthetic
atggccgactcccaagtacgtcattttcctcgagaatggcattgatctcatctgccctgcttctccacatttcatgctcgagggagtcaactgagtttaggccgcactttccttcctcaaggagacccagcatggcgtat

SEQ ID NO: 450677 - DNA, 140 bp, Artificial Sequence
  Synthetic
atacgccatgctgggtctccggttgacatttctgttgtcgtacaggacccaaaaaatgtttaccagagaggaacgcatccattttccaggattcgggatggcttgcagtatggctggaagcgtacttgggagtcggccat

SEQ ID NO: 450678 - DNA, 140 bp, Artificial Sequence
  Synthetic
atggccgactcccaagtacgcttccagccatactgcaagccatcccgaatcctggaaaatggatgcgttcctctctggtaaacattttttgggtcctgtacgacaacagaaatgtcaaccggagacccagcatggcgtat

SEQ ID NO: 450679 - DNA, 140 bp, Artificial Sequence
  Synthetic
atacgccatgctgggtctccacttggggtaagaaccttgtgttctctccagggagaaagaatggaagtttcatcatagacggaaagtccagaaaagaatgcccgttctcaaaccgagtttcgtacttgggagtcggccat

SEQ ID NO: 450680 - DNA, 140 bp, Artificial Sequence
  Synthetic
atggccgactcccaagtacgaaactcggtttgagaacgggcattcttttctggactttccgtctatgatgaaacttccattctttctccctggagagaacacaaggttcttaccccaagtggagacccagcatggcgtat

SEQ ID NO: 450681 - DNA, 140 bp, Artificial Sequence
  Synthetic
atacgccatgctgggtctccggaattccttccagatagaagaatttgggacgggagtgttcaccacacgcgtgtacatggatgcagtctttgaatacaccatagactgtgatggatccatcgtacttgggagtcggccat

SEQ ID NO: 450682 - DNA, 140 bp, Artificial Sequence
  Synthetic
atggccgactcccaagtacgatggatccatcacagtctatggtgtattcaaagactgcatccatgtacacgcgtgtggtgaacactcccgtcccaaattcttctatctggaaggaattccggagacccagcatggcgtat

SEQ ID NO: 450683 - DNA, 140 bp, Artificial Sequence
  Synthetic
atacgccatgctgggtctcctctgggtgcagcagtgaacgggaaaaagagcgcccatgggtccccaacattttggatgggaagccatgaggtgaatgggacatggatgattcacaccttacgtacttgggagtcggccat

SEQ ID NO: 450684 - DNA, 140 bp, Artificial Sequence
  Synthetic
atggccgactcccaagtacgtaaggtgtgaatcatccatgtcccattcacctcatggcttcccatccaaaatgttggggacccatgggcgctctttttcccgttcactgctgcacccagaggagacccagcatggcgtat

SEQ ID NO: 450685 - DNA, 140 bp, Artificial Sequence
  Synthetic
atacgccatgctgggtctccgagacgctggattataaggagtgcgagtggccattgacacacacgataggaacatcagttgaagaaagtgacatgttcatgccaagatcaattggaggcccgtacttgggagtcggccat

SEQ ID NO: 450686 - DNA, 140 bp, Artificial Sequence
  Synthetic
atggccgactcccaagtacgggcctccaattgatcttggcatgaacatgtcactttcttcaactgatgttcctatcgtgtgtgtcaatggccactcgcactccttataatccagcgtctcggagacccagcatggcgtat

SEQ ID NO: 450687 - DNA, 140 bp, Artificial Sequence
  Synthetic
aggccctggctgctgatatgaacatcagttgaagaaagtgacatgttcatgccaagatcaattggaggcccagttagctcccacaatcatattcctggatataaggtccagacgaacggagaccttttgggacagcggtg

SEQ ID NO: 450688 - DNA, 140 bp, Artificial Sequence
  Synthetic
caccgctgtcccaaaaggtctccgttcgtctggaccttatatccaggaatatgattgtgggagctaactgggcctccaattgatcttggcatgaacatgtcactttcttcaactgatgttcatatcagcagccagggcct

SEQ ID NO: 450689 - DNA, 140 bp, Artificial Sequence
  Synthetic
atacgccatgctgggtctccccttggatgcaggtgccactggaagtgaagagagaagcctgcccaggaaccagtgtgatcattgatggcaattgtgatggacggggaaaatcaactagatcgtacttgggagtcggccat

SEQ ID NO: 450690 - DNA, 140 bp, Artificial Sequence
  Synthetic
atggccgactcccaagtacgatctagttgattttccccgtccatcacaattgccatcaatgatcacactggttcctgggcaggcttctctcttcacttccagtggcacctgcatccaaggggagacccagcatggcgtat

SEQ ID NO: 450691 - DNA, 140 bp, Artificial Sequence
  Synthetic
aggccctggctgctgatatgcagtgtgatcattgatggcaattgtgatggacggggaaaatcaactagatccaccacagacagcgggaaaatcattcctgaatggtgttgccgctcttgcgaccttttgggacagcggtg

SEQ ID NO: 450692 - DNA, 140 bp, Artificial Sequence
  Synthetic
caccgctgtcccaaaaggtcgcaagagcggcaacaccattcaggaatgattttcccgctgtctgtggtggatctagttgattttccccgtccatcacaattgccatcaatgatcacactgcatatcagcagccagggcct

SEQ ID NO: 450693 - DNA, 140 bp, Artificial Sequence
  Synthetic
atacgccatgctgggtctccacaatgccacccgtgagttttcacgggaatgatggatgctggtaccccatggaaattaggccaaggaaaacacatgaaagccacttggtacgatcatgggcgtacttgggagtcggccat

SEQ ID NO: 450694 - DNA, 140 bp, Artificial Sequence
  Synthetic
atggccgactcccaagtacgcccatgatcgtaccaagtggctttcatgtgttttccttggcctaatttccatggggtaccagcatccatcattcccgtgaaaactcacgggtggcattgtggagacccagcatggcgtat

SEQ ID NO: 450695 - DNA, 140 bp, Artificial Sequence
  Synthetic
atacgccatgctgggtctcctaacagctggagaagtacatgcagtcccttttgggctagtgagcatgatgatagcaatggaagtggtcctaaggaaaagacagggaccaaagcaaatgctcgtacttgggagtcggccat

SEQ ID NO: 450696 - DNA, 140 bp, Artificial Sequence
  Synthetic
atggccgactcccaagtacgagcatttgctttggtccctgtcttttccttaggaccacttccattgctatcatcatgctcactagcccaaaagggactgcatgtacttctccagctgttaggagacccagcatggcgtat

SEQ ID NO: 450697 - DNA, 140 bp, Artificial Sequence
  Synthetic
atacgccatgctgggtctcctgttggaggaatggtgctcctgggagcaatgctggttgggcaggtaactctccttgacttgctgaaactcacagtggctgtgggattacactttcatgagcgtacttgggagtcggccat

SEQ ID NO: 450698 - DNA, 140 bp, Artificial Sequence
  Synthetic
atggccgactcccaagtacgctcatgaaagtgtaatcccacagccactgtgagtttcagcaagtcaaggagagttacctgcccaaccagcattgctcccaggagcaccattcctccaacaggagacccagcatggcgtat

SEQ ID NO: 450699 - DNA, 140 bp, Artificial Sequence
  Synthetic
atacgccatgctgggtctccatgaacaatggaggagacgctatgtacatggcgttgattgctgccttttcaatcaggccagggttgctcatcggctttgggcttaggacgctgtggagcccgtacttgggagtcggccat

SEQ ID NO: 450700 - DNA, 140 bp, Artificial Sequence
  Synthetic
atggccgactcccaagtacgggctccacagcgtcctaagcccaaagccgatgagcaaccctggcctgattgaaaaggcagcaatcaacgccatgtacatagcgtctcctccattgttcatggagacccagcatggcgtat

SEQ ID NO: 450701 - DNA, 140 bp, Artificial Sequence
  Synthetic
atacgccatgctgggtctccctcgggaacgccttgtgctgaccctgggagccgccatggtggagatagccctgggtggtatgatgggcggcctgtggaaatacctgaatgcagtctctctcgtacttgggagtcggccat

SEQ ID NO: 450702 - DNA, 140 bp, Artificial Sequence
  Synthetic
atggccgactcccaagtacgagagagactgcattcaggtatttccacaggccgcccatcataccacccagggctatctccaccatggcggctcccagggtcagcacaaggcgttcccgagggagacccagcatggcgtat

SEQ ID NO: 450703 - DNA, 140 bp, Artificial Sequence
  Synthetic
atacgccatgctgggtctccctgcatcctgaccataaatgctgttgcttctaggaaagcatcaaatgtcatcttgcccctcatggccttgttaacacccgtgaccatggcagaggtgaggcgtacttgggagtcggccat

SEQ ID NO: 450704 - DNA, 140 bp, Artificial Sequence
  Synthetic
atggccgactcccaagtacgcctcacctctgccatggtcacgggtgttaacaaggccatgaggggcaagatgacatttgatgctttcctagaagcaacagcatttatggtcaggatgcagggagacccagcatggcgtat

SEQ ID NO: 450705 - DNA, 140 bp, Artificial Sequence
  Synthetic
atacgccatgctgggtctcccttgccacaatgcttttttgcactgtggttatcataggagtccttcaccagaactccaaggacacctccatgcagaagaccatacccttggtggctctcacgtacttgggagtcggccat

SEQ ID NO: 450706 - DNA, 140 bp, Artificial Sequence
  Synthetic
atggccgactcccaagtacgtgagagccaccaagggtatggtcttctgcatggaggtgtccttggagttctggtgaaggactcctatgataaccacagtgcaaaaaagcattgtggcaagggagacccagcatggcgtat

SEQ ID NO: 450707 - DNA, 140 bp, Artificial Sequence
  Synthetic
atacgccatgctgggtctcccacttacatcttacctgggcttgacacaacctttcttgggcctgtgtgcatttctggcaacccgcatatttgggcgaaggagtattccagtgaacgaggccgtacttgggagtcggccat

SEQ ID NO: 450708 - DNA, 140 bp, Artificial Sequence
  Synthetic
atggccgactcccaagtacggcctcgttcactggaatactccttcgcccaaatatgcgggttgccagaaatgcacacaggcccaagaaaggttgtgtcaagcccaggtaagatgtaagtgggagacccagcatggcgtat

SEQ ID NO: 450709 - DNA, 140 bp, Artificial Sequence
  Synthetic
atacgccatgctgggtctccactcgcggcagctggtttggtgggagtgctggcaggactggccttccaggagatggagaacttccttggtccaatcgcagttggtggaatcctgatgatgcgtacttgggagtcggccat

SEQ ID NO: 450710 - DNA, 140 bp, Artificial Sequence
  Synthetic
atggccgactcccaagtacgcatcatcaggattccaccaactgcgattggaccaaggaagttctccatctcctggaaggccagtcctgccagcactcccaccaaaccagctgccgcgagtggagacccagcatggcgtat

SEQ ID NO: 450711 - DNA, 140 bp, Artificial Sequence
  Synthetic
atacgccatgctgggtctccctggtcagcgtggctgggagagtagatgggcttgagctcaggaaacttggtgaagtctcatgggaagaggaagcagagatcagcgggagctccgctcgctcgtacttgggagtcggccat

SEQ ID NO: 450712 - DNA, 140 bp, Artificial Sequence
  Synthetic
atggccgactcccaagtacgagcgagcggagctcccgctgatctctgcttcctcttcccatgagacttcaccaagtttcctgagctcaagcccatctactctcccagccacgctgaccagggagacccagcatggcgtat

SEQ ID NO: 450713 - DNA, 140 bp, Artificial Sequence
  Synthetic
atacgccatgctgggtctccatgatgtggcactcagtgaacaaggggagttcaagctgctttctgaagaaaaagtgccatgggaccaggttgtgatgacctcactggccttagttggggccgtacttgggagtcggccat

SEQ ID NO: 450714 - DNA, 140 bp, Artificial Sequence
  Synthetic
atggccgactcccaagtacggccccaactaaggccagtgaggtcatcacaacctggtcccatggcactttttcttcagaaagcagcttgaactccccttgttcactgagtgccacatcatggagacccagcatggcgtat

SEQ ID NO: 450715 - DNA, 140 bp, Artificial Sequence
  Synthetic
atacgccatgctgggtctcctgctatccacccatttgctctcctgttagtccttgctggctggctgtttcatgtcaaaggagctaggagaagtggggatgtcctgtgggacattcccactcgtacttgggagtcggccat

SEQ ID NO: 450716 - DNA, 140 bp, Artificial Sequence
  Synthetic
atggccgactcccaagtacgagtgggaatgtcccacaggacatccccacttctcctagctcctttgacatgaaacagccagccagcaaggactaacaggagagcaaatgggtggatagcaggagacccagcatggcgtat

SEQ ID NO: 450717 - DNA, 140 bp, Artificial Sequence
  Synthetic
atacgccatgctgggtctccaaggaggggtattccacacaatgtggcatgtcacaagaggagctttcctcgtcaggaatggcaagaagctgattccatcctgggcttcagtgaaagaggacgtacttgggagtcggccat

SEQ ID NO: 450718 - DNA, 140 bp, Artificial Sequence
  Synthetic
atggccgactcccaagtacgtcctctttcactgaagcccaggatggaatcagcttcttgccattcctgacgaggaaagctcctcttgtgacatgccacattgtgtggaatacccctccttggagacccagcatggcgtat

SEQ ID NO: 450719 - DNA, 140 bp, Artificial Sequence
  Synthetic
atacgccatgctgggtctccccttgttgcctatggtggttcatggaaattggaaggcagatgggatggagaagaagaggttcaactgattgctgctgtcccaggaaagaatgtggtcaatcgtacttgggagtcggccat

SEQ ID NO: 450720 - DNA, 140 bp, Artificial Sequence
  Synthetic
atggccgactcccaagtacgattgaccacattctttcctgggacagcagcaatcagttgaacctcttcttctccatcccatctgccttccaatttccatgaaccaccataggcaacaaggggagacccagcatggcgtat

SEQ ID NO: 450721 - DNA, 140 bp, Artificial Sequence
  Synthetic
atacgccatgctgggtctccgtccagacaaaaccgagcttgtttaaagtgaggaatggaggagaaatcggggcggttgcccttgattacccgagtggcacttctggatctcctattgttacgtacttgggagtcggccat

SEQ ID NO: 450722 - DNA, 140 bp, Artificial Sequence
  Synthetic
atggccgactcccaagtacgtaacaataggagatccagaagtgccactcgggtaatcaagggcaaccgccccgatttctcctccattcctcactttaaacaagctcggttttgtctggacggagacccagcatggcgtat

SEQ ID NO: 450723 - DNA, 140 bp, Artificial Sequence
  Synthetic
atacgccatgctgggtctccacaggaatggagaggtgattggtctgtatggcaatggcattcttgtcggtgataactccttcgtgtccgccatatcccagaccgaggtgaaggaggaaggcgtacttgggagtcggccat

SEQ ID NO: 450724 - DNA, 140 bp, Artificial Sequence
  Synthetic
atggccgactcccaagtacgccttcctccttcacctcggtctgggatatggcggacacgaaggagttatcaccgacaagaatgccattgccatacagaccaatcacctctccattcctgtggagacccagcatggcgtat

SEQ ID NO: 450725 - DNA, 140 bp, Artificial Sequence
  Synthetic
atacgccatgctgggtctccaaaggaggagcttcaagagatcccgacaatgttgaaaaaaggaatgacaactatcctcgacttccatcctggagctgggaagacgcgacgtttcctcccacgtacttgggagtcggccat

SEQ ID NO: 450726 - DNA, 140 bp, Artificial Sequence
  Synthetic
atggccgactcccaagtacgtgggaggaaacgtcgcgtcttcccagctccaggatggaagtcgaggatagttgtcattccttttttcaacattgtcgggatctcttgaagctcctcctttggagacccagcatggcgtat

SEQ ID NO: 450727 - DNA, 140 bp, Artificial Sequence
  Synthetic
atacgccatgctgggtctcccagatcttggctgaatgcgcacggagacgtctacgcacgcttgtgctggcccccaccagggttgttctttctgaaatgaaggaggctttccatggcttggcgtacttgggagtcggccat

SEQ ID NO: 450728 - DNA, 140 bp, Artificial Sequence
  Synthetic
atggccgactcccaagtacgccaagccatggaaagcctccttcatttcagaaagaacaaccctggtgggggccagcacaagcgtgcgtagacgtctccgtgcgcattcagccaagatctgggagacccagcatggcgtat

SEQ ID NO: 450729 - DNA, 140 bp, Artificial Sequence
  Synthetic
atacgccatgctgggtctccacgtgaaattccacacacaggctttctccgcccatggcagtggaagagaagtcatcgatgccatgtgccatgctactctaacatacaggatgttggaacccgtacttgggagtcggccat

SEQ ID NO: 450730 - DNA, 140 bp, Artificial Sequence
  Synthetic
atggccgactcccaagtacgggttccaacatcctgtatgttagagtagcatggcacatggcatcgatgacttctcttccactgccatgggcggagaaagcctgtgtgtggaatttcacgtggagacccagcatggcgtat

SEQ ID NO: 450731 - DNA, 140 bp, Artificial Sequence
  Synthetic
atacgccatgctgggtctccaaccaggattgtcaactgggaagtgatcatcatggatgaagctcattttttggatccagctagcatagcagctagaggttgggcagcacacagagctaggcgtacttgggagtcggccat

SEQ ID NO: 450732 - DNA, 140 bp, Artificial Sequence
  Synthetic
atggccgactcccaagtacgcctagctctgtgtgctgcccaacctctagctgctatgctagctggatccaaaaaatgagcttcatccatgatgatcacttcccagttgacaatcctggttggagacccagcatggcgtat

SEQ ID NO: 450733 - DNA, 140 bp, Artificial Sequence
  Synthetic
atacgccatgctgggtctccgcaaatgaaagtgcaacaatcttgatgacggccacaccgccagggaccagtgatgaatttccacactcaaatggtgagatagaagatgtccaaacggacacgtacttgggagtcggccat

SEQ ID NO: 450734 - DNA, 140 bp, Artificial Sequence
  Synthetic
atggccgactcccaagtacgtgtccgtttggacatcttctatctcaccatttgagtgtggaaattcatcactggtccctggcggtgtggccgtcatcaagattgttgcactttcatttgcggagacccagcatggcgtat

SEQ ID NO: 450735 - DNA, 140 bp, Artificial Sequence
  Synthetic
atacgccatgctgggtctcctacccagtgagccctggaatacagggcatgattggatcctggcggacaaaaggcccacggcatggttcctcccatcaatcagggctgcaaatgtcatggccgtacttgggagtcggccat

SEQ ID NO: 450736 - DNA, 140 bp, Artificial Sequence
  Synthetic
atggccgactcccaagtacggccatgacatttgcagccctgattgatgggaggaaccatgccgtgggccttttgtccgccaggatccaatcatgccctgtattccagggctcactgggtaggagacccagcatggcgtat

SEQ ID NO: 450737 - DNA, 140 bp, Artificial Sequence
  Synthetic
atacgccatgctgggtctcctgcctctttgcgcaaggctggaaagagcgtggtggtcctgaacagaaaaacctttgagaaagaataccccacgataaaacagaagaaacctgatttcatccgtacttgggagtcggccat

SEQ ID NO: 450738 - DNA, 140 bp, Artificial Sequence
  Synthetic
atggccgactcccaagtacggatgaaatcaggtttcttctgttttatcgtggggtattctttctcaaaggtttttctgttcaggaccaccacgctctttccagccttgcgcaaagaggcaggagacccagcatggcgtat

SEQ ID NO: 450739 - DNA, 140 bp, Artificial Sequence
  Synthetic
atacgccatgctgggtctccttggccactgacatagctgagatgggagccaacctctgtgtggagagagtgctggactgcaggacggcttttaagcctgtgcttgtggatgaaggaaggacgtacttgggagtcggccat

SEQ ID NO: 450740 - DNA, 140 bp, Artificial Sequence
  Synthetic
atggccgactcccaagtacgtccttccttcatccacaagcacaggcttaaaagccgtcctgcagtccagcactctctccacacagaggttggctcccatctcagctatgtcagtggccaaggagacccagcatggcgtat

SEQ ID NO: 450741 - DNA, 140 bp, Artificial Sequence
  Synthetic
atacgccatgctgggtctccaggtggcaataaaggggccacttcgtatctcggcatcctctgctgcccaaagaagaggacgcattgggagaaatcccaatagagatggagactcatactacgtacttgggagtcggccat

SEQ ID NO: 450742 - DNA, 140 bp, Artificial Sequence
  Synthetic
atggccgactcccaagtacgtagtatgagtctccatctctattgggatttctcccaatgcgtcctcttctttgggcagcagaggatgccgagatacgaagtggcccctttattgccacctggagacccagcatggcgtat

SEQ ID NO: 450743 - DNA, 140 bp, Artificial Sequence
  Synthetic
aggccctggctgctgatatgagaagaggacgcattgggagaaatcccaatagagatggagactcatactactattctgagcccacaagtgaagacaatgcccaccatgtctgctggttgggaccttttgggacagcggtg

SEQ ID NO: 450744 - DNA, 140 bp, Artificial Sequence
  Synthetic
caccgctgtcccaaaaggtcccaaccagcagacatggtgggcattgtcttcacttgtgggctcagaatagtagtatgagtctccatctctattgggatttctcccaatgcgtcctcttctcatatcagcagccagggcct

SEQ ID NO: 450745 - DNA, 140 bp, Artificial Sequence
  Synthetic
atacgccatgctgggtctccaggcctcaatgctcctggacaacatggaggtgagaggtggaatggttgccccactctatggcattgaagggacaaaaacaccagtttcccctggtgaaatcgtacttgggagtcggccat

SEQ ID NO: 450746 - DNA, 140 bp, Artificial Sequence
  Synthetic
atggccgactcccaagtacgatttcaccaggggaaactggtgtttttgtcccttcaatgccatagagtggggcaaccattccacctctcacctccatgttgtccaggagcattgaggcctggagacccagcatggcgtat

SEQ ID NO: 450747 - DNA, 140 bp, Artificial Sequence
  Synthetic
aggccctggctgctgatatgccactctatggcattgaagggacaaaaacaccagtttcccctggtgaaatgagacttagagatgaccagaggagagtcttcagagaattggtgaggaactgaccttttgggacagcggtg

SEQ ID NO: 450748 - DNA, 140 bp, Artificial Sequence
  Synthetic
caccgctgtcccaaaaggtcagttcctcaccaattctctgaagactctcctctggtcatctctaagtctcatttcaccaggggaaactggtgtttttgtcccttcaatgccatagagtggcatatcagcagccagggcct

SEQ ID NO: 450749 - DNA, 140 bp, Artificial Sequence
  Synthetic
atacgccatgctgggtctccgtgatctgcccgtctggctgtcctggcaagtggccaaggctggtttgaagacgaatgaccggaaatggtgttttgaaggccctgaggaacatgagatcttcgtacttgggagtcggccat

SEQ ID NO: 450750 - DNA, 140 bp, Artificial Sequence
  Synthetic
atggccgactcccaagtacgaagatctcatgttcctcagggccttcaaaacaccatttccggtcattcgtcttcaaaccagccttggccacttgccaggacagccagacgggcagatcacggagacccagcatggcgtat

SEQ ID NO: 450751 - DNA, 140 bp, Artificial Sequence
  Synthetic
atacgccatgctgggtctccgaacgacagtggtgaaacagtgaagtgccgggctcctggcggggcgaagaggcctctgcgcccaaggtggtgcgatgaaagggtgtcgtctgaccagagtcgtacttgggagtcggccat

SEQ ID NO: 450752 - DNA, 140 bp, Artificial Sequence
  Synthetic
atggccgactcccaagtacgactctggtcagacgacaccctttcatcgcaccaccttgggcgcagaggcctcttcgccccgccaggagcccggcacttcactgtttcaccactgtcgttcggagacccagcatggcgtat

SEQ ID NO: 450753 - DNA, 140 bp, Artificial Sequence
  Synthetic
atacgccatgctgggtctccgcgcttgctgatttcataaaatttgctgaaggtagaaggggagccgcagaagtgctggttgtgctgagtgaacttcctgactttctggcgaagaaaggtgcgtacttgggagtcggccat

SEQ ID NO: 450754 - DNA, 140 bp, Artificial Sequence
  Synthetic
atggccgactcccaagtacgcacctttcttcgccagaaagtcaggaagttcactcagcacaaccagcacttctgcggctccccttctaccttcagcaaattttatgaaatcagcaagcgcggagacccagcatggcgtat

SEQ ID NO: 450755 - DNA, 140 bp, Artificial Sequence
  Synthetic
atacgccatgctgggtctccgagaggcaatggacactatcagtgtgttcctgcattctgaggaaggctccagggcttaccgcaatgctctgtcaatgatgcctgaagcaatgacaatagtcgtacttgggagtcggccat

SEQ ID NO: 450756 - DNA, 140 bp, Artificial Sequence
  Synthetic
atggccgactcccaagtacgactattgtcattgcttcaggcatcattgacagagcattgcggtaagccctggagccttcctcagaatgcaggaacacactgatagtgtccattgcctctcggagacccagcatggcgtat

SEQ ID NO: 450757 - DNA, 140 bp, Artificial Sequence
  Synthetic
atacgccatgctgggtctcccatgctgttcatactagctggactgttgacatcgggaatggttatcttcttcatgtctcccaaaggtatcagcagaatgtccatggcgatgggcacaatgcgtacttgggagtcggccat

SEQ ID NO: 450758 - DNA, 140 bp, Artificial Sequence
  Synthetic
atggccgactcccaagtacgcattgtgcccatcgccatggacattctgctgatacctttgggagacatgaagaagataaccattcccgatgtcaacagtccagctagtatgaacagcatgggagacccagcatggcgtat

SEQ ID NO: 450759 - DNA, 140 bp, Artificial Sequence
  Synthetic
atacgccatgctgggtctccgccggctgtggatatctcatgttccttggaggcgtcaaacctactcacatctcctacatcatgctcatattctttgttctgatggtagttgtgatccccgcgtacttgggagtcggccat

SEQ ID NO: 450760 - DNA, 140 bp, Artificial Sequence
  Synthetic
atggccgactcccaagtacgcggggatcacaactaccatcagaacaaagaatatgagcatgatgtaggagatgtgagtaggtttgacgcctccaaggaacatgagatatccacagccggcggagacccagcatggcgtat

SEQ ID NO: 450761 - DNA, 140 bp, Artificial Sequence
  Synthetic
atacgccatgctgggtctccagccagggcaacaaaggtccatccaagacaatcaggtggcatatctcatcattggcatcctgacgctggtctcagtagtggcagccaatgaattgggcatcgtacttgggagtcggccat

SEQ ID NO: 450762 - DNA, 140 bp, Artificial Sequence
  Synthetic
atggccgactcccaagtacgatgcccaattcattggctgccactactgagaccagcgtcaggatgccaatgatgagatatgccacctgattgtcttggatggacctttgttgccctggctggagacccagcatggcgtat

SEQ ID NO: 450763 - DNA, 140 bp, Artificial Sequence
  Synthetic
atacgccatgctgggtctccgctggagagaactaaagaagatctatttgggaggaagaacttgatcccgtcaagcgcctcgccctggagttggccggatcttgacctgaaaccaggagcgcgtacttgggagtcggccat

SEQ ID NO: 450764 - DNA, 140 bp, Artificial Sequence
  Synthetic
atggccgactcccaagtacgcgctcctggtttcaggtcaagatccggccaactccagggcgaggcgcttgacgggatcaagttcttcctcccaaatagatcttctttagttctctccagcggagacccagcatggcgtat

SEQ ID NO: 450765 - DNA, 140 bp, Artificial Sequence
  Synthetic
atacgccatgctgggtctccgcttggactgtgtatgttggcattgtcacgatgctctctccaatgttgcaccactggattaaggtcgaatatggcaatctgtctctgtctggaatagccccgtacttgggagtcggccat

SEQ ID NO: 450766 - DNA, 140 bp, Artificial Sequence
  Synthetic
atggccgactcccaagtacggggctattccagacagagacagattgccatattcgaccttaatccagtggtgcaacattggagagagcatcgtgacaatgccaacatacacagtccaagcggagacccagcatggcgtat

SEQ ID NO: 450767 - DNA, 140 bp, Artificial Sequence
  Synthetic
atacgccatgctgggtctccagtcagcctcagttctttctttcatggacaagggaataccattcatgaagatgaacatctcggtcataatactgctggttagtggctggaattcaataaccgtacttgggagtcggccat

SEQ ID NO: 450768 - DNA, 140 bp, Artificial Sequence
  Synthetic
atggccgactcccaagtacggttattgaattccagccactaaccagcagtattatgaccgagatgttcatcttcatgaatggtattcccttgtccatgaaagaaagaactgaggctgactggagacccagcatggcgtat

SEQ ID NO: 450769 - DNA, 140 bp, Artificial Sequence
  Synthetic
atacgccatgctgggtctccagtgatgcctctgctttgtggcatagggtgtgccatgctccattggactctcatcctacctgggattaaggcgcaacagtcaaagcttgcacaaagaaggcgtacttgggagtcggccat

SEQ ID NO: 450770 - DNA, 140 bp, Artificial Sequence
  Synthetic
atggccgactcccaagtacgccttctttgtgcaagctttgactgttgcgccttaatcccaggtaggatgagagtccaatggagcatggcacaccctatgccacaaagcagaggcatcactggagacccagcatggcgtat

SEQ ID NO: 450771 - DNA, 140 bp, Artificial Sequence
  Synthetic
atacgccatgctgggtctccgtgtttcatggtgtagccaagaacccggtggttgatggaaacccaacagttgacattgaagaagcccctgaaatgcctgctctctatgaaaagaaattggcgtacttgggagtcggccat

SEQ ID NO: 450772 - DNA, 140 bp, Artificial Sequence
  Synthetic
atggccgactcccaagtacgccaatttcttttcatagagagcaggcatttcaggggcttcttcaatgtcaactgttgggtttccatcaaccaccgggttcttggctacaccatgaaacacggagacccagcatggcgtat

SEQ ID NO: 450773 - DNA, 140 bp, Artificial Sequence
  Synthetic
  misc_feature (83)..(83): n is a, c, g, or t
atacgccatgctgggtctccccttataccttcttcttgctcttagcttagcctctgttgccatgtgcagaacgcctttttcantggctgaaggcattgtcctagcatcagctgccttgggcgtacttgggagtcggccat

SEQ ID NO: 450774 - DNA, 140 bp, Artificial Sequence
  Synthetic
  misc_feature (58)..(58): n is a, c, g, or t
atggccgactcccaagtacgcccaaggcagctgatgctaggacaatgccttcagccantgaaaaaggcgttctgcacatggcaacagaggctaagctaagagcaagaagaaggtataaggggagacccagcatggcgtat

SEQ ID NO: 450775 - DNA, 140 bp, Artificial Sequence
  Synthetic
atacgccatgctgggtctccgccgctcatagagggaaacactagccttctttggaacggacccatggctgtttccatgacaggagttatgcggggaaactactatgcctttgtaggggtccgtacttgggagtcggccat

SEQ ID NO: 450776 - DNA, 140 bp, Artificial Sequence
  Synthetic
atggccgactcccaagtacggacccctacaaaggcatagtagtttccccgcataactcctgtcatggaaacagccatgggtccgttccaaagaaggctagtgtttccctctatgagcggcggagacccagcatggcgtat

SEQ ID NO: 450777 - DNA, 140 bp, Artificial Sequence
  Synthetic
atacgccatgctgggtctccatgtacaatctgtggaagatggaaactggacgcagggggagggcgaatggaaaaaccctgggtgaggtctggaagagggagctgaacctgctggacaagccgtacttgggagtcggccat

SEQ ID NO: 450778 - DNA, 140 bp, Artificial Sequence
  Synthetic
atggccgactcccaagtacggcttgtccagcaggttcagctccctcttccagacctcacccagggtttttccattcgccctccccctgcgtccagtttccatcttccacagattgtacatggagacccagcatggcgtat

SEQ ID NO: 450779 - DNA, 140 bp, Artificial Sequence
  Synthetic
atacgccatgctgggtctccagcaatttgagttgtacaaaaggactgatattgtggaggtggatcgtgacacggcacgcagacatctggctgaaggaaaagtggacaccggggtggctgtcgtacttgggagtcggccat

SEQ ID NO: 450780 - DNA, 140 bp, Artificial Sequence
  Synthetic
atggccgactcccaagtacgacagccaccccggtgtccacttttccttcagccagatgtctgcgtgccgtgtcacgatccacctccacaatatcagtccttttgtacaactcaaattgctggagacccagcatggcgtat

SEQ ID NO: 450781 - DNA, 140 bp, Artificial Sequence
  Synthetic
atacgccatgctgggtctccctcgagggggaccgcaaagctgaggtggtttcatgagcgtggctatgtcaagctggaaggtagggtgactgacttgggatgcggacgcgggggctggtgccgtacttgggagtcggccat

SEQ ID NO: 450782 - DNA, 140 bp, Artificial Sequence
  Synthetic
atggccgactcccaagtacggcaccagcccccgcgtccgcatcccaagtcagtcaccctaccttccagcttgacatagccacgctcatgaaaccacctcagctttgcggtccccctcgagggagacccagcatggcgtat

SEQ ID NO: 450783 - DNA, 140 bp, Artificial Sequence
  Synthetic
atacgccatgctgggtctcctactacgctgctgcacagaaggaagtgagtggggtcaaaggattcactcttggaagagaaggccatgagaaacccatgaacgtgcaaagcctgggatggacgtacttgggagtcggccat

SEQ ID NO: 450784 - DNA, 140 bp, Artificial Sequence
  Synthetic
atggccgactcccaagtacgtccatcccaggctttgcacgttcatgggtttctcatggccttctcttccaagagtgaatcctttgaccccactcacttccttctgtgcagcagcgtagtaggagacccagcatggcgtat

SEQ ID NO: 450785 - DNA, 140 bp, Artificial Sequence
  Synthetic
atacgccatgctgggtctccacatcattaccttcaaggacaaaactgacatccaccgcctggaaccagtgaaatgtgacacccttttgtgcgacattggagagtcatcatcgtcatcagtcgtacttgggagtcggccat

SEQ ID NO: 450786 - DNA, 140 bp, Artificial Sequence
  Synthetic
atggccgactcccaagtacgactgatgacgatgatgactctccaatgtcgcacaaaagggtgtcacatttcactggttccaggcggtggatgtcagttttgtccttgaaggtaatgatgtggagacccagcatggcgtat

SEQ ID NO: 450787 - DNA, 140 bp, Artificial Sequence
  Synthetic
atacgccatgctgggtctccgacagaaggggaaaggaccgtgagggttcttgataccgttgagaaatggctggcttgtggcgttgacaatttctgtgtgaaggtgttggctccgtacatgcgtacttgggagtcggccat

SEQ ID NO: 450788 - DNA, 140 bp, Artificial Sequence
  Synthetic
atggccgactcccaagtacgcatgtacggagccaacaccttcacacagaaattgtcaacgccacaagccagccatttctcaacggtatcaagaaccctcacggtcctttccccttctgtcggagacccagcatggcgtat

SEQ ID NO: 450789 - DNA, 140 bp, Artificial Sequence
  Synthetic
atacgccatgctgggtctccccagatgttctcgagaaactagaactgctccaaaggaggtttgggggaacagtgatcaggaaccctctttccagaaattccactcatgagatgtactacgcgtacttgggagtcggccat

SEQ ID NO: 450790 - DNA, 140 bp, Artificial Sequence
  Synthetic
atggccgactcccaagtacgcgtagtacatctcatgagtggaatttctggaaagagggttcctgatcactgttcccccaaacctcctttggagcagttctagtttctcgagaacatctggggagacccagcatggcgtat

SEQ ID NO: 450791 - DNA, 140 bp, Artificial Sequence
  Synthetic
atacgccatgctgggtctcctgtctggagcccgcagcaatgtcacgtttactgtgaatcaaacatcccgtctcctgatgaggagaatgagacgtccaactggtaaagtgaccctggaggccgtacttgggagtcggccat

SEQ ID NO: 450792 - DNA, 140 bp, Artificial Sequence
  Synthetic
atggccgactcccaagtacggcctccagggtcactttaccagttggacgtctcattctcctcatcaggagacgggatgtttgattcacagtaaacgtgacattgctgcgggctccagacaggagacccagcatggcgtat

SEQ ID NO: 450793 - DNA, 140 bp, Artificial Sequence
  Synthetic
atacgccatgctgggtctcctgatgtcattcttccaatcggcacacgtagtgtcgagacagacaaaggacccctagatagagaggccatagaagagagagttgagagaataaaatctgagcgtacttgggagtcggccat

SEQ ID NO: 450794 - DNA, 140 bp, Artificial Sequence
  Synthetic
atggccgactcccaagtacgctcagattttattctctcaactctctcttctatggcctctctatctaggggtcctttgtctgtctcgacactacgtgtgccgattggaagaatgacatcaggagacccagcatggcgtat

SEQ ID NO: 450795 - DNA, 140 bp, Artificial Sequence
  Synthetic
atacgccatgctgggtctcctacatgaccacctggttttatgacaatgacaacccctacaggacctggcactactgcggctcctatgtcacgaaaacttcagggagtgcagcaagcatggcgtacttgggagtcggccat

SEQ ID NO: 450796 - DNA, 140 bp, Artificial Sequence
  Synthetic
atggccgactcccaagtacgccatgcttgctgcactccctgaagttttcgtgacataggagccgcagtagtgccaggtcctgtaggggttgtcattgtcataaaaccaggtggtcatgtaggagacccagcatggcgtat

SEQ ID NO: 450797 - DNA, 140 bp, Artificial Sequence
  Synthetic
atacgccatgctgggtctcctcaatggtgtcatcaaaattttgacatatccatgggacaggatagaggaggtcacaaggatggcaatgactgacacaactccctttggacagcaaagggtcgtacttgggagtcggccat

SEQ ID NO: 450798 - DNA, 140 bp, Artificial Sequence
  Synthetic
atggccgactcccaagtacgaccctttgctgtccaaagggagttgtgtcagtcattgccatccttgtgacctcctctatcctgtcccatggatatgtcaaaattttgatgacaccattgaggagacccagcatggcgtat

SEQ ID NO: 450799 - DNA, 140 bp, Artificial Sequence
  Synthetic
atacgccatgctgggtctccgtttaaagagaaagttgataccagagctaaggatccaccagcgggaactaggaaaatcatgaaagttgtcaacaggtggcttttccgtcatctggccagacgtacttgggagtcggccat

SEQ ID NO: 450800 - DNA, 140 bp, Artificial Sequence
  Synthetic
atggccgactcccaagtacgtctggccagatgacggaaaagccacctgttgacaactttcatgattttcctagttcccgctggtggatccttagctctggtatcaactttctctttaaacggagacccagcatggcgtat

SEQ ID NO: 450801 - DNA, 140 bp, Artificial Sequence
  Synthetic
atacgccatgctgggtctccgaaaagaatcccagattgtgcacaaaggaagaattcattgcaaaagtccgtagccatgcagccattggagcctacctggaagaacaagaacagtggaagacgtacttgggagtcggccat

SEQ ID NO: 450802 - DNA, 140 bp, Artificial Sequence
  Synthetic
atggccgactcccaagtacgtcttccactgttcttgttcttccaggtaggctccaatggctgcatggctacggacttttgcaatgaattcttcctttgtgcacaatctgggattcttttcggagacccagcatggcgtat

SEQ ID NO: 450803 - DNA, 140 bp, Artificial Sequence
  Synthetic
atacgccatgctgggtctccctgccaacgaggctgttcaggacccaaagttttgggaactggtggacgaggaaagaaagctgcaccaacaaggcaggtgtcggacttgtgtgtacaacatcgtacttgggagtcggccat

SEQ ID NO: 450804 - DNA, 140 bp, Artificial Sequence
  Synthetic
atggccgactcccaagtacgatgttgtacacacaagtccgacacctgccttgttggtgcagctttctttcctcgtccaccagttcccaaaactttgggtcctgaacagcctcgttggcagggagacccagcatggcgtat

SEQ ID NO: 450805 - DNA, 140 bp, Artificial Sequence
  Synthetic
atacgccatgctgggtctccgatggggaaaagagagaagaagctgtcagagtttgggaaagcaaaaggaagccgtgccatctggtacatgtggctgggagcgcggtatcttgagtttgaacgtacttgggagtcggccat

SEQ ID NO: 450806 - DNA, 140 bp, Artificial Sequence
  Synthetic
atggccgactcccaagtacgttcaaactcaagataccgcgctcccagccacatgtaccagatggcacggcttccttttgctttcccaaactctgacagcttcttctctcttttccccatcggagacccagcatggcgtat

SEQ ID NO: 450807 - DNA, 140 bp, Artificial Sequence
  Synthetic
atacgccatgctgggtctccgccctaggatttctgaatgaggaccattgggcatccagggagaactcggggggaggagttgaaggcattggtttacagtacctaggatatgtgatcagagcgtacttgggagtcggccat

SEQ ID NO: 450808 - DNA, 140 bp, Artificial Sequence
  Synthetic
atggccgactcccaagtacgctctgatcacatatcctaggtactgtaaaccaatgccttcaactcctccccccgagttctccctggatgcccaatggtcctcattcagaaatcctagggcggagacccagcatggcgtat

SEQ ID NO: 450809 - DNA, 140 bp, Artificial Sequence
  Synthetic
atacgccatgctgggtctccacttggctgcaatggatggtggaggattctatgcggatgacaccgctggatgggacacacgcatcacagaggcagaccttgatgatgaacaggaaatcttcgtacttgggagtcggccat

SEQ ID NO: 450810 - DNA, 140 bp, Artificial Sequence
  Synthetic
atggccgactcccaagtacgaagatttcctgttcatcatcaaggtctgcctctgtgatgcgtgtgtcccatccagcggtgtcatccgcatagaatcctccaccatccattgcagccaagtggagacccagcatggcgtat

SEQ ID NO: 450811 - DNA, 140 bp, Artificial Sequence
  Synthetic
atacgccatgctgggtctccgaattacatgagtccacatcacaaaaaactggcacaagcagtgatggaaatgacatacaagaacaaggtggtgaaagtgctgagaccagcaccaggcgggcgtacttgggagtcggccat

SEQ ID NO: 450812 - DNA, 140 bp, Artificial Sequence
  Synthetic
atggccgactcccaagtacgcccgcctggtgctggtctcagcactttcaccaccttgttcttgtatgtcatttccatcactgcttgtgccagttttttgtgatgtggactcatgtaattcggagacccagcatggcgtat

SEQ ID NO: 450813 - DNA, 140 bp, Artificial Sequence
  Synthetic
atacgccatgctgggtctccaaagcttacatggatgtcataagccggagagaccagagagggtctgggcaggtggtaacctatgccctgaacaccatcactaacctgaaagtccaattgacgtacttgggagtcggccat

SEQ ID NO: 450814 - DNA, 140 bp, Artificial Sequence
  Synthetic
atggccgactcccaagtacgtcaattggactttcaggttagtgatggtgttcagggcataggttaccacctgcccagaccctctctggtctctccggcttatgacatccatgtaagctttggagacccagcatggcgtat

SEQ ID NO: 450815 - DNA, 140 bp, Artificial Sequence
  Synthetic
atacgccatgctgggtctcctcaggatggcagaagcagagatggtgatacatcatcaacacgtccaggattgtgatgactcggccttggccaggctggaggcatggctcattgagcatggcgtacttgggagtcggccat

SEQ ID NO: 450816 - DNA, 140 bp, Artificial Sequence
  Synthetic
atggccgactcccaagtacgccatgctcaatgagccatgcctccagcctggccaaggccgagtcatcacaatcctggacgtgttgatgatgtatcaccatctctgcttctgccatcctgaggagacccagcatggcgtat

SEQ ID NO: 450817 - DNA, 140 bp, Artificial Sequence
  Synthetic
atacgccatgctgggtctccatgtgacagactgaagaggatggcggtgagtggagacgactgcgtggtccggcctattgatgataggttcggcatggccctgtcccacctcaatgctatgcgtacttgggagtcggccat

SEQ ID NO: 450818 - DNA, 140 bp, Artificial Sequence
  Synthetic
atggccgactcccaagtacgcatagcattgaggtgggacagggccatgccgaacctatcatcaataggccggaccacgcagtcgtctccactcaccgccatcctcttcagtctgtcacatggagacccagcatggcgtat

SEQ ID NO: 450819 - DNA, 140 bp, Artificial Sequence
  Synthetic
atacgccatgctgggtctcctccaaggttagaaaggatatatctgaatggcagccatcaaaaggatggaatgactgggagaacgtgcccttttgctcccaccacttccatgaattgcagccgtacttgggagtcggccat

SEQ ID NO: 450820 - DNA, 140 bp, Artificial Sequence
  Synthetic
atggccgactcccaagtacggctgcaattcatggaagtggtgggagcaaaagggcacgttctcccagtcattccatccttttgatggctgccattcagatatatcctttctaaccttggaggagacccagcatggcgtat

SEQ ID NO: 450821 - DNA, 140 bp, Artificial Sequence
  Synthetic
atacgccatgctgggtctcctgaaggatggcagaaggattgtggtgccctgccgggaacaagatgagctcatcgggagaggaagggtgtccccaggaaatggttggatgatcaaggagaccgtacttgggagtcggccat

SEQ ID NO: 450822 - DNA, 140 bp, Artificial Sequence
  Synthetic
atggccgactcccaagtacggtctccttgatcatccaaccatttcctggggacacccttcctctcccgatgagctcatcttgttcccggcagggcaccacaatccttctgccatccttcaggagacccagcatggcgtat

SEQ ID NO: 450823 - DNA, 140 bp, Artificial Sequence
  Synthetic
atacgccatgctgggtctccggcatgcctcagcaaggcctacgccaacatgtggtcactgatgtactttcataagagggacatgagattgctgtcattggctgtttcttcggccgtcccccgtacttgggagtcggccat

SEQ ID NO: 450824 - DNA, 140 bp, Artificial Sequence
  Synthetic
atggccgactcccaagtacgggggacggccgaagaaacagccaatgacagcaatctcatgtccctcttatgaaagtacatcagtgaccacatgttggcgtaggccttgctgaggcatgccggagacccagcatggcgtat

SEQ ID NO: 450825 - DNA, 140 bp, Artificial Sequence
  Synthetic
atacgccatgctgggtctccacctcatgggtcccacaaggacgcacgacatggtcgattcatgggaagggggagtggatgaccccagaagacatgcttgaggtgtggaacagagtgtggacgtacttgggagtcggccat

SEQ ID NO: 450826 - DNA, 140 bp, Artificial Sequence
  Synthetic
atggccgactcccaagtacgtccacactctgttccacacctcaagcatgtcttctggggtcatccactcccccttcccatgaatcgaccatgtcgtgcgtccttgtgggacccatgaggtggagacccagcatggcgtat

SEQ ID NO: 450827 - DNA, 140 bp, Artificial Sequence
  Synthetic
aggccctggctgctgatatgggagtggatgaccccagaagacatgcttgaggtgtggaacagagtgtggataaccaacaacccacacatgcaggacaagacagtggtgaaagaatggagggaccttttgggacagcggtg

SEQ ID NO: 450828 - DNA, 140 bp, Artificial Sequence
  Synthetic
caccgctgtcccaaaaggtccctccattctttcaccactgtcttgtcctgcatgtgtgggttgttggttatccacactctgttccacacctcaagcatgtcttctggggtcatccactcccatatcagcagccagggcct

SEQ ID NO: 450829 - DNA, 140 bp, Artificial Sequence
  Synthetic
atacgccatgctgggtctccgatgtcccctatttgaccaagagacaagacaagctgtgcggatcactgattggaatgaccaacagggccacctgggcctcccacatccatctggtaatcccgtacttgggagtcggccat

SEQ ID NO: 450830 - DNA, 140 bp, Artificial Sequence
  Synthetic
atggccgactcccaagtacgggattaccagatggatgtgggaggcccaggtggccctgttggtcattccaatcagtgatccgcacagcttgtcttgtctcttggtcaaataggggacatcggagacccagcatggcgtat

SEQ ID NO: 450831 - DNA, 140 bp, Artificial Sequence
  Synthetic
atacgccatgctgggtctccatcgcatccgaacactgattggacaggagaaatacactgactacttaacagtcatggatagatactctgttgatgctgacctgcaaccaggtgagctcatcgtacttgggagtcggccat

SEQ ID NO: 450832 - DNA, 140 bp, Artificial Sequence
  Synthetic
atggccgactcccaagtacgatgagctcacctggttgcaggtcagcatcaacagagtatctatccatgactgttaagtagtcagtgtatttctcctgtccaatcagtgttcggatgcgatggagacccagcatggcgtat

SEQ ID NO: 450833 - DNA, 140 bp, Artificial Sequence
  Synthetic
aggccctggctgctgatatggtcatggatagatactctgttgatgctgacctgcaaccaggtgagctcatttgaaaacaccattcaatagaaacaaccgggatacaaaccacgggtggaggaccttttgggacagcggtg

SEQ ID NO: 450834 - DNA, 140 bp, Artificial Sequence
  Synthetic
caccgctgtcccaaaaggtcctccacccgtggtttgtatcccggttgtttctattgaatggtgttttcaaatgagctcacctggttgcaggtcagcatcaacagagtatctatccatgaccatatcagcagccagggcct

SEQ ID NO: 450835 - DNA, 140 bp, Artificial Sequence
  Synthetic
atacgccatgctgggtctccaaccggactccccacaactgaaaaccgggatacaaaccacggctggagaaccggactccgcactcaaaatgaaacagaaaccgggataaaaactacggatcgtacttgggagtcggccat

SEQ ID NO: 450836 - DNA, 140 bp, Artificial Sequence
  Synthetic
atggccgactcccaagtacgatccgtagtttttatcccggtttctgtttcattttgagtgcggagtccggttctccagccgtggtttgtatcccggttttcagttgtggggagtccggttggagacccagcatggcgtat

SEQ ID NO: 450837 - DNA, 140 bp, Artificial Sequence
  Synthetic
atacgccatgctgggtctccggagaaccggactccacacattgaatagaagatgttgtcagcccagagccctacgtgggttctgccactgctaagctgtgaggcagtgcaggctgggacacgtacttgggagtcggccat

SEQ ID NO: 450838 - DNA, 140 bp, Artificial Sequence
  Synthetic
atggccgactcccaagtacgtgtcccagcctgcactgcctcacagcttagcagtggcagaacccacgtagggctctgggctgacaacatcttctattcaatgtgtggagtccggttctccggagacccagcatggcgtat

SEQ ID NO: 450839 - DNA, 140 bp, Artificial Sequence
  Synthetic
atacgccatgctgggtctccgccgacttccaggttgcgaaaaacctggtttccgggacctcccaccccagagtaaaaagaaaggagcctccgctaccaccttcccacgtggtggtagaaacgtacttgggagtcggccat

SEQ ID NO: 450840 - DNA, 140 bp, Artificial Sequence
  Synthetic
atggccgactcccaagtacgtttctaccaccacgtgggaaggtggtagcggaggctcctttctttttactctggggtgggaggtcccggaaaccaggtttttcgcaacctggaagtcggcggagacccagcatggcgtat

SEQ ID NO: 450841 - DNA, 140 bp, Artificial Sequence
  Synthetic
aggccctggctgctgatatgaccatattgacgccagggaaagaccggagtggttctctgcttttcctccagaggtctgtgagcacagtttgctcaagaataagcagacctttggatgacagaccttttgggacagcggtg

SEQ ID NO: 450842 - DNA, 140 bp, Artificial Sequence
  Synthetic
caccgctgtcccaaaaggtctgtcatccaaaggtctgcttattcttgagcaaactgtgctcacagacctctggaggaaaagcagagaaccactccggtctttccctggcgtcaatatggtcatatcagcagccagggcct

SEQ ID NO: 450843 - DNA, 140 bp, Artificial Sequence
  Synthetic
atacgccatgctgggtctcctggctgttctaaggaaagttaagagagtggtggccagtttgatgagaggattgtcctcaaggaaacgccgttcccatgacgctctggctgtgcaattcctcgtacttgggagtcggccat

SEQ ID NO: 450844 - DNA, 140 bp, Artificial Sequence
  Synthetic
atggccgactcccaagtacgaggaattgcacagccagagcgtcatgggaacggcgtttccttgaggacaatcctctcatcaaactggccaccactctcttaactttccttagaacagccaggagacccagcatggcgtat

SEQ ID NO: 450845 - DNA, 140 bp, Artificial Sequence
  Synthetic
atacgccatgctgggtctcccttgggtgcagcagtgaacgggaaaaagagtgcccatgggtctccaacattttggatgggaagtcatgaagtaaatgggacatggatgatccacaccttgcgtacttgggagtcggccat

SEQ ID NO: 450846 - DNA, 140 bp, Artificial Sequence
  Synthetic
atggccgactcccaagtacgcaaggtgtggatcatccatgtcccatttacttcatgacttcccatccaaaatgttggagacccatgggcactctttttcccgttcactgctgcacccaagggagacccagcatggcgtat

SEQ ID NO: 450847 - DNA, 140 bp, Artificial Sequence
  Synthetic
aggccctggctgctgatatgaacatcagttgaagagagtgaaatgttcatgccgagatcaattggaggcccagttagctctcacaatcatattcctgggtacaaggttcagacgaacggagaccttttgggacagcggtg

SEQ ID NO: 450848 - DNA, 140 bp, Artificial Sequence
  Synthetic
caccgctgtcccaaaaggtctccgttcgtctgaaccttgtacccaggaatatgattgtgagagctaactgggcctccaattgatctcggcatgaacatttcactctcttcaactgatgttcatatcagcagccagggcct

SEQ ID NO: 450849 - DNA, 140 bp, Artificial Sequence
  Synthetic
aggccctggctgctgatatgcttgccacgatgctcttttgcaccgtggttatcataggggtccttcatcagaactccaaggacacctccatgcaaaagaccatacctttggtggccctcagaccttttgggacagcggtg

SEQ ID NO: 450850 - DNA, 140 bp, Artificial Sequence
  Synthetic
caccgctgtcccaaaaggtctgagggccaccaaaggtatggtcttttgcatggaggtgtccttggagttctgatgaaggacccctatgataaccacggtgcaaaagagcatcgtggcaagcatatcagcagccagggcct

SEQ ID NO: 450851 - DNA, 140 bp, Artificial Sequence
  Synthetic
atacgccatgctgggtctccatgatgtggcactcagtgagcaaggggagtttaagctgctttctgaagagaaagtgccatgggaccaggttgtgatgacctcactggccttggttggagccgtacttgggagtcggccat

SEQ ID NO: 450852 - DNA, 140 bp, Artificial Sequence
  Synthetic
atggccgactcccaagtacggctccaaccaaggccagtgaggtcatcacaacctggtcccatggcactttctcttcagaaagcagcttaaactccccttgctcactgagtgccacatcatggagacccagcatggcgtat

SEQ ID NO: 450853 - DNA, 140 bp, Artificial Sequence
  Synthetic
aggccctggctgctgatatgtaggcaataaacacatttggattaattttgatcgttcgttgagcgattagcagagaattgaccagaaaatgtctggtcgtaaagctcagggaaaaaccctgaccttttgggacagcggtg

SEQ ID NO: 450854 - DNA, 140 bp, Artificial Sequence
  Synthetic
caccgctgtcccaaaaggtcagggtttttccctgagctttacgaccagacattttctggtcaattctctgctaatcgctcaacgaacgatcaaaattaatccaaatgtgtttattgcctacatatcagcagccagggcct

SEQ ID NO: 450855 - DNA, 140 bp, Artificial Sequence
  Synthetic
atacgccatgctgggtctccgggcgtcaatatggttcgacgaggagtccgctccttgtcaagcaaaataaaacaaaaaacaaaacaaattggaagtagacctggaccttcaagaggcgttcgtacttgggagtcggccat

SEQ ID NO: 450856 - DNA, 140 bp, Artificial Sequence
  Synthetic
atggccgactcccaagtacgaacgcctcttgaaggtccaggtctacttccaatttgttttgttttttgttttattttgcttgacaaggagcggactcctcgtcgaaccatattgacgcccggagacccagcatggcgtat

SEQ ID NO: 450857 - DNA, 140 bp, Artificial Sequence
  Synthetic
atacgccatgctgggtctccttgtcctcgaggaaacgccgatcccaagatgttttaactgtacaatttttgattctgggaatgctgctgatggttggtggagtgaccttggtacgcagaacgtacttgggagtcggccat

SEQ ID NO: 450858 - DNA, 140 bp, Artificial Sequence
  Synthetic
atggccgactcccaagtacgttctgcgtaccaaggtcactccaccaaccatcagcagcattcccagaatcaaaaattgtacagttaaaacatcttgggatcggcgtttcctcgaggacaaggagacccagcatggcgtat

SEQ ID NO: 450859 - DNA, 140 bp, Artificial Sequence
  Synthetic
aggccctggctgctgatatgacagatggttactcctgaatgttacatctgaggaccttgggaaaaccttctctgttggcacaggcaactgcacaaccaacattctggaggccaaatattggaccttttgggacagcggtg

SEQ ID NO: 450860 - DNA, 140 bp, Artificial Sequence
  Synthetic
caccgctgtcccaaaaggtccaatatttggcctccagaatgttggttgtgcagttgcctgtgccaacagagaaggttttcccaaggtcctcagatgtaacattcaggagtaaccatctgtcatatcagcagccagggcct

SEQ ID NO: 450861 - DNA, 140 bp, Artificial Sequence
  Synthetic
atacgccatgctgggtctcctggctggtgaggaaccccttctttgcggcaacagccttggccattgcctacctggtggggagcaacatgacgcaacgagttgtcatagccctgctggtctcgtacttgggagtcggccat

SEQ ID NO: 450862 - DNA, 140 bp, Artificial Sequence
  Synthetic
atggccgactcccaagtacgagaccagcagggctatgacaactcgttgcgtcatgttgctccccaccaggtaggcaatggccaaggctgttgccgcaaagaaggggttcctcaccagccaggagacccagcatggcgtat

SEQ ID NO: 450863 - DNA, 140 bp, Artificial Sequence
  Synthetic
atacgccatgctgggtctcccctggtggggagcaacatgacgcaacgagttgtcatagccctgctggtcttggctgttggcccagcctattcggctcactgtataggaataaccgacaggcgtacttgggagtcggccat

SEQ ID NO: 450864 - DNA, 140 bp, Artificial Sequence
  Synthetic
atggccgactcccaagtacgcctgtcggttattcctatacagtgagccgaataggctgggccaacagccaagaccagcagggctatgacaactcgttgcgtcatgttgctccccaccaggggagacccagcatggcgtat

SEQ ID NO: 450865 - DNA, 140 bp, Artificial Sequence
  Synthetic
atacgccatgctgggtctcctggctgttggcccagcctattcggctcactgtataggaataaccgacagggatttcattgagggggtgcatgggggaacctgggtttcagccaccttggacgtacttgggagtcggccat

SEQ ID NO: 450866 - DNA, 140 bp, Artificial Sequence
  Synthetic
atggccgactcccaagtacgtccaaggtggctgaaacccaggttcccccatgcaccccctcaatgaaatccctgtcggttattcctatacagtgagccgaataggctgggccaacagccaggagacccagcatggcgtat

SEQ ID NO: 450867 - DNA, 140 bp, Artificial Sequence
  Synthetic
aggccctggctgctgatatggatttcattgagggggtgcatgggggaacctgggtttcagccaccttggaacaggacaagtgtgtcactgtgatggcccccgacaagccttcactagacagaccttttgggacagcggtg

SEQ ID NO: 450868 - DNA, 140 bp, Artificial Sequence
  Synthetic
caccgctgtcccaaaaggtctgtctagtgaaggcttgtcgggggccatcacagtgacacacttgtcctgttccaaggtggctgaaacccaggttcccccatgcaccccctcaatgaaatccatatcagcagccagggcct

SEQ ID NO: 450869 - DNA, 140 bp, Artificial Sequence
  Synthetic
aggccctggctgctgatatgcactggtgaagcccacttggaagaagaaaatgaaggagacaatgcttgcaagcgaacttactccgatagaggttggggaaatggttgtggcttgtttggagaccttttgggacagcggtg

SEQ ID NO: 450870 - DNA, 140 bp, Artificial Sequence
  Synthetic
caccgctgtcccaaaaggtctccaaacaagccacaaccatttccccaacctctatcggagtaagttcgcttgcaagcattgtctccttcattttcttcttccaagtgggcttcaccagtgcatatcagcagccagggcct

SEQ ID NO: 450871 - DNA, 140 bp, Artificial Sequence
  Synthetic
atacgccatgctgggtctccgagggccacactggagtgccaggtacagaccgcagtggacttcagtaacagttacattgcagagatggagaaggagagctggattgtggataaacagtggcgtacttgggagtcggccat

SEQ ID NO: 450872 - DNA, 140 bp, Artificial Sequence
  Synthetic
atggccgactcccaagtacgccactgtttatccacaatccagctctccttctccatctctgcaatgtaactgttactgaagtccactgcggtctgtacctggcactccagtgtggccctcggagacccagcatggcgtat

SEQ ID NO: 450873 - DNA, 140 bp, Artificial Sequence
  Synthetic
atacgccatgctgggtctccgcccaagacctgaccctaccttggcagagtggaagtggcggcgtgtggagagagatgcatcatctcgtggaatttgagcctccacatgctgcaaccatcacgtacttgggagtcggccat

SEQ ID NO: 450874 - DNA, 140 bp, Artificial Sequence
  Synthetic
atggccgactcccaagtacgtgatggttgcagcatgtggaggctcaaattccacgagatgatgcatctctctccacacgccgccacttccactctgccaaggtagggtcaggtcttgggcggagacccagcatggcgtat

SEQ ID NO: 450875 - DNA, 140 bp, Artificial Sequence
  Synthetic
atacgccatgctgggtctccggtgcaatgcgagtcacaaaagacacaaataacagcaagctgtataagctgcatggggggcacgtcgcgtgtagggtgaagttgtcagctctcacacttacgtacttgggagtcggccat

SEQ ID NO: 450876 - DNA, 140 bp, Artificial Sequence
  Synthetic
atggccgactcccaagtacgtaagtgtgagagctgacaacttcaccctacacgcgacgtgccccccatgcagcttatacagcttgctgttatttgtgtcttttgtgactcgcattgcaccggagacccagcatggcgtat

SEQ ID NO: 450877 - DNA, 140 bp, Artificial Sequence
  Synthetic
aggccctggctgctgatatggcatggggggcacgtcgcgtgtagggtgaagttgtcagctctcacacttaagggaacatcctacaagatgtgtaccgacaaaatgtcttttgtcaagaacgaccttttgggacagcggtg

SEQ ID NO: 450878 - DNA, 140 bp, Artificial Sequence
  Synthetic
caccgctgtcccaaaaggtcgttcttgacaaaagacattttgtcggtacacatcttgtaggatgttcccttaagtgtgagagctgacaacttcaccctacacgcgacgtgccccccatgccatatcagcagccagggcct

SEQ ID NO: 450879 - DNA, 140 bp, Artificial Sequence
  Synthetic
atacgccatgctgggtctccagggaacatcctacaagatgtgtaccgacaaaatgtcttttgtcaagaacccaactgacactggacatggcactgcagtgatgcaagtgaaggtgccaaacgtacttgggagtcggccat

SEQ ID NO: 450880 - DNA, 140 bp, Artificial Sequence
  Synthetic
atggccgactcccaagtacgtttggcaccttcacttgcatcactgcagtgccatgtccagtgtcagttgggttcttgacaaaagacattttgtcggtacacatcttgtaggatgttccctggagacccagcatggcgtat

SEQ ID NO: 450881 - DNA, 140 bp, Artificial Sequence
  Synthetic
aggccctggctgctgatatgccaactgacactggacatggcactgcagtgatgcaagtgaaggtgccaaaaggagcaccctgcaggattccagtaatggtcgccgatgatctcacagcgggaccttttgggacagcggtg

SEQ ID NO: 450882 - DNA, 140 bp, Artificial Sequence
  Synthetic
caccgctgtcccaaaaggtcccgctgtgagatcatcggcgaccattactggaatcctgcagggtgctccttttggcaccttcacttgcatcactgcagtgccatgtccagtgtcagttggcatatcagcagccagggcct

SEQ ID NO: 450883 - DNA, 140 bp, Artificial Sequence
  Synthetic
atacgccatgctgggtctcccagtcaacaagggcattttggtcacagtcaatccaatagcctccaccaatgatgatgaagtgttgatcgaggtgaatcctccctttggggatagttacatcgtacttgggagtcggccat

SEQ ID NO: 450884 - DNA, 140 bp, Artificial Sequence
  Synthetic
atggccgactcccaagtacgatgtaactatccccaaagggaggattcacctcgatcaacacttcatcatcattggtggaggctattggattgactgtgaccaaaatgcccttgttgactgggagacccagcatggcgtat

SEQ ID NO: 450885 - DNA, 140 bp, Artificial Sequence
  Synthetic
aggccctggctgctgatatggatgatgaagtgttgatcgaggtgaatcctccctttggggatagttacatcatagttgggacaggggattcacgcctgacttaccagtggcacaaggaaggaccttttgggacagcggtg

SEQ ID NO: 450886 - DNA, 140 bp, Artificial Sequence
  Synthetic
caccgctgtcccaaaaggtccttccttgtgccactggtaagtcaggcgtgaatcccctgtcccaactatgatgtaactatccccaaagggaggattcacctcgatcaacacttcatcatccatatcagcagccagggcct

SEQ ID NO: 450887 - DNA, 140 bp, Artificial Sequence
  Synthetic
atacgccatgctgggtctccgcagctcaatagggaagttgtttactcagaccatgaagggcgcagagcgcctggccgtcatgggggatgctgcctgggactttggttctgctggaggattcgtacttgggagtcggccat

SEQ ID NO: 450888 - DNA, 140 bp, Artificial Sequence
  Synthetic
atggccgactcccaagtacgaatcctccagcagaaccaaagtcccaggcagcatcccccatgacggccaggcgctctgcgcccttcatggtctgagtaaacaacttccctattgagctgcggagacccagcatggcgtat

SEQ ID NO: 450889 - DNA, 140 bp, Artificial Sequence
  Synthetic
aggccctggctgctgatatgcttcacatcagtcggaaaaggcatacacactgtgtttggctctgccttccaaggattgtttggtggcttgagctggataacaaaggtcatcatgggggtagaccttttgggacagcggtg

SEQ ID NO: 450890 - DNA, 140 bp, Artificial Sequence
  Synthetic
caccgctgtcccaaaaggtctacccccatgatgacctttgttatccagctcaagccaccaaacaatccttggaaggcagagccaaacacagtgtgtatgccttttccgactgatgtgaagcatatcagcagccagggcct

SEQ ID NO: 450891 - DNA, 140 bp, Artificial Sequence
  Synthetic
aggccctggctgctgatatgaaggattgtttggtggcttgagctggataacaaaggtcatcatgggggtagtcctcatatgggttggcattaacacaaggaatatgacaatgtccatgaggaccttttgggacagcggtg

SEQ ID NO: 450892 - DNA, 140 bp, Artificial Sequence
  Synthetic
caccgctgtcccaaaaggtcctcatggacattgtcatattccttgtgttaatgccaacccatatgaggactacccccatgatgacctttgttatccagctcaagccaccaaacaatccttcatatcagcagccagggcct

SEQ ID NO: 450893 - DNA, 140 bp, Artificial Sequence
  Synthetic
aggccctggctgctgatatgttgaggaaggaaagtgtggcctgaactcagtcgactccctggaacatgagatgtggagaagcagggcagatgagatcaatgccattcttgaggaaaatgagaccttttgggacagcggtg

SEQ ID NO: 450894 - DNA, 140 bp, Artificial Sequence
  Synthetic
caccgctgtcccaaaaggtctcattttcctcaagaatggcattgatctcatctgccctgcttctccacatctcatgttccagggagtcgactgagttcaggccacactttccttcctcaacatatcagcagccagggcct

SEQ ID NO: 450895 - DNA, 140 bp, Artificial Sequence
  Synthetic
aggccctggctgctgatatgggtagatatctcagtggtggtccaagactcaaaaaacatttatcagagagggacacatccgttttccagaatacgtgatggcctacaatacggctggaaggaccttttgggacagcggtg

SEQ ID NO: 450896 - DNA, 140 bp, Artificial Sequence
  Synthetic
caccgctgtcccaaaaggtccttccagccgtattgtaggccatcacgtattctggaaaacggatgtgtccctctctgataaatgttttttgagtcttggaccaccactgagatatctacccatatcagcagccagggcct

SEQ ID NO: 450897 - DNA, 140 bp, Artificial Sequence
  Synthetic
atacgccatgctgggtctccacttggggcaaaaaccttgtgttctctccaggaagaaagaatggaagcttcatcatagatgggaagtccaggaaagagtgtccgttttcaaacagagtgtcgtacttgggagtcggccat

SEQ ID NO: 450898 - DNA, 140 bp, Artificial Sequence
  Synthetic
atggccgactcccaagtacgacactctgtttgaaaacggacactctttcctggacttcccatctatgatgaagcttccattctttcttcctggagagaacacaaggtttttgccccaagtggagacccagcatggcgtat

SEQ ID NO: 450899 - DNA, 140 bp, Artificial Sequence
  Synthetic
atacgccatgctgggtctcccagttagctcccacaaccacattccgggatataaggtccagacaaacggaccctggatgcaggtgccactagaggtgaaaagggaagcttgcccaggaaccgtacttgggagtcggccat

SEQ ID NO: 450900 - DNA, 140 bp, Artificial Sequence
  Synthetic
atggccgactcccaagtacggttcctgggcaagcttcccttttcacctctagtggcacctgcatccagggtccgtttgtctggaccttatatcccggaatgtggttgtgggagctaactgggagacccagcatggcgtat

SEQ ID NO: 450901 - DNA, 140 bp, Artificial Sequence
  Synthetic
atacgccatgctgggtctcccgaccactgacagcgggaagatcattcctgaatggtgttgccgctcatgcacaatgccaccagtgagcttccacgggagtgatggttgctggtatcctatcgtacttgggagtcggccat

SEQ ID NO: 450902 - DNA, 140 bp, Artificial Sequence
  Synthetic
atggccgactcccaagtacgataggataccagcaaccatcactcccgtggaagctcactggtggcattgtgcatgagcggcaacaccattcaggaatgatcttcccgctgtcagtggtcgggagacccagcatggcgtat

SEQ ID NO: 450903 - DNA, 140 bp, Artificial Sequence
  Synthetic
aggccctggctgctgatatgacaatgccaccagtgagcttccacgggagtgatggttgctggtatcctatggagattagaccaaagaagacacatgacagccacttggtccgctcatggggaccttttgggacagcggtg

SEQ ID NO: 450904 - DNA, 140 bp, Artificial Sequence
  Synthetic
caccgctgtcccaaaaggtccccatgagcggaccaagtggctgtcatgtgtcttctttggtctaatctccataggataccagcaaccatcactcccgtggaagctcactggtggcattgtcatatcagcagccagggcct

SEQ ID NO: 450905 - DNA, 140 bp, Artificial Sequence
  Synthetic
atacgccatgctgggtctccggttggaggcatggtgcttctaggagccatgttagttggacaggtgactgtcttggacttgctgaagctcacagtggcggttggactgcactttcatgagcgtacttgggagtcggccat

SEQ ID NO: 450906 - DNA, 140 bp, Artificial Sequence
  Synthetic
atggccgactcccaagtacgctcatgaaagtgcagtccaaccgccactgtgagcttcagcaagtccaagacagtcacctgtccaactaacatggctcctagaagcaccatgcctccaaccggagacccagcatggcgtat

SEQ ID NO: 450907 - DNA, 140 bp, Artificial Sequence
  Synthetic
atacgccatgctgggtctccatgaataatggaggggatgccatgtatatggccctgatcgctgctttctcaatcagaccagggctgctcatcggctttggattgaggacgctgtggagcccgtacttgggagtcggccat

SEQ ID NO: 450908 - DNA, 140 bp, Artificial Sequence
  Synthetic
atggccgactcccaagtacgggctccacagcgtcctcaatccaaagccgatgagcagccctggtctgattgagaaagcagcgatcagggccatatacatggcatcccctccattattcatggagacccagcatggcgtat

SEQ ID NO: 450909 - DNA, 140 bp, Artificial Sequence
  Synthetic
atacgccatgctgggtctcccccgagaacgcctcgtgctgaccctgggggccgccatggtggagattgctttgggtggcatgatgggaggtttgtggaagtacctgaacgcagtatccctcgtacttgggagtcggccat

SEQ ID NO: 450910 - DNA, 140 bp, Artificial Sequence
  Synthetic
atggccgactcccaagtacgagggatactgcgttcaggtacttccacaaacctcccatcatgccacccaaagcaatctccaccatggcggcccccagggtcagcacgaggcgttctcgggggagacccagcatggcgtat

SEQ ID NO: 450911 - DNA, 140 bp, Artificial Sequence
  Synthetic
aggccctggctgctgatatgttgcatcctgacaataaatgctgttgcctccagaaaagcatcaaatgtcatcctgcccttgatggctctgttgacacctgtgacaatggctgaggtgagagaccttttgggacagcggtg

SEQ ID NO: 450912 - DNA, 140 bp, Artificial Sequence
  Synthetic
caccgctgtcccaaaaggtctctcacctcagccattgtcacaggtgtcaacagagccatcaagggcaggatgacatttgatgcttttctggaggcaacagcatttattgtcaggatgcaacatatcagcagccagggcct

SEQ ID NO: 450913 - DNA, 140 bp, Artificial Sequence
  Synthetic
atacgccatgctgggtctcctcctgcccttgatggctctgttgacacctgtgacaatggctgaggtgagacttgcaacaatgctcttctgcactgtggttatcatcggcgttctccatcacgtacttgggagtcggccat

SEQ ID NO: 450914 - DNA, 140 bp, Artificial Sequence
  Synthetic
atggccgactcccaagtacgtgatggagaacgccgatgataaccacagtgcagaagagcattgttgcaagtctcacctcagccattgtcacaggtgtcaacagagccatcaagggcaggaggagacccagcatggcgtat

SEQ ID NO: 450915 - DNA, 140 bp, Artificial Sequence
  Synthetic
aggccctggctgctgatatgcttgcaacaatgctcttctgcactgtggttatcatcggcgttctccatcagaactcaaaggacacttccatgcagaagaccatacccctggtggcccttagaccttttgggacagcggtg

SEQ ID NO: 450916 - DNA, 140 bp, Artificial Sequence
  Synthetic
caccgctgtcccaaaaggtctaagggccaccaggggtatggtcttctgcatggaagtgtcctttgagttctgatggagaacgccgatgataaccacagtgcagaagagcattgttgcaagcatatcagcagccagggcct

SEQ ID NO: 450917 - DNA, 140 bp, Artificial Sequence
  Synthetic
atacgccatgctgggtctccgaactcaaaggacacttccatgcagaagaccatacccctggtggcccttacactgacatcttacctgggactgacgcagcccttcttgggcttgtgtgcccgtacttgggagtcggccat

SEQ ID NO: 450918 - DNA, 140 bp, Artificial Sequence
  Synthetic
atggccgactcccaagtacgggcacacaagcccaagaagggctgcgtcagtcccaggtaagatgtcagtgtaagggccaccaggggtatggtcttctgcatggaagtgtcctttgagttcggagacccagcatggcgtat

SEQ ID NO: 450919 - DNA, 140 bp, Artificial Sequence
  Synthetic
aggccctggctgctgatatgttcatggcaacccgaatattcgggcgaagaagcatcccagtgaatgaagcgcttgcagctgctggtctcgtgggagtcttggcagggctagctttccagggaccttttgggacagcggtg

SEQ ID NO: 450920 - DNA, 140 bp, Artificial Sequence
  Synthetic
caccgctgtcccaaaaggtccctggaaagctagccctgccaagactcccacgagaccagcagctgcaagcgcttcattcactgggatgcttcttcgcccgaatattcgggttgccatgaacatatcagcagccagggcct

SEQ ID NO: 450921 - DNA, 140 bp, Artificial Sequence
  Synthetic
atacgccatgctgggtctccagatggaaaattttctaggtccagtcgcagttggaggaatcctgatgatgctggtcagtgtggctgggagggtagatggacttgaactcaggaagcttggcgtacttgggagtcggccat

SEQ ID NO: 450922 - DNA, 140 bp, Artificial Sequence
  Synthetic
atggccgactcccaagtacgccaagcttcctgagttcaagtccatctaccctcccagccacactgaccagcatcatcaggattcctccaactgcgactggacctagaaaattttccatctggagacccagcatggcgtat

SEQ ID NO: 450923 - DNA, 140 bp, Artificial Sequence
  Synthetic
atacgccatgctgggtctccagggaggggtcttccacacgatgtggcacgtcacgcgaggggcctttctcgttagaaacggcaaaaagctggttccatcctgggcctcagtcaaggaagacgtacttgggagtcggccat

SEQ ID NO: 450924 - DNA, 140 bp, Artificial Sequence
  Synthetic
atggccgactcccaagtacgtcttccttgactgaggcccaggatggaaccagctttttgccgtttctaacgagaaaggcccctcgcgtgacgtgccacatcgtgtggaagacccctccctggagacccagcatggcgtat

SEQ ID NO: 450925 - DNA, 140 bp, Artificial Sequence
  Synthetic
atacgccatgctgggtctccccttgttgcttatggcggctcatggaagctggagggtagatgggatggagaagaggaggttcagttgatagcagctgcccccggaaaaaacgtagtgaatcgtacttgggagtcggccat

SEQ ID NO: 450926 - DNA, 140 bp, Artificial Sequence
  Synthetic
atggccgactcccaagtacgattcactacgttttttccgggggcagctgctatcaactgaacctcctcttctccatcccatctaccctccagcttccatgagccgccataagcaacaaggggagacccagcatggcgtat

SEQ ID NO: 450927 - DNA, 140 bp, Artificial Sequence
  Synthetic
aggccctggctgctgatatggaaagaggagctacaggaaatcccgacaatgttgaagaaagggatgacaaccattcttgatttccatcctggagctgggaaaacaagacgttttcttcctgaccttttgggacagcggtg

SEQ ID NO: 450928 - DNA, 140 bp, Artificial Sequence
  Synthetic
caccgctgtcccaaaaggtcaggaagaaaacgtcttgttttcccagctccaggatggaaatcaagaatggttgtcatccctttcttcaacattgtcgggatttcctgtagctcctctttccatatcagcagccagggcct

SEQ ID NO: 450929 - DNA, 140 bp, Artificial Sequence
  Synthetic
atacgccatgctgggtctcccagatcctggctgaatgcgcacgaagacggttgcgcacacttgtgctggctcccactagagttgtcctctctgaaatgaaggaagcctttcacggcttagcgtacttgggagtcggccat

SEQ ID NO: 450930 - DNA, 140 bp, Artificial Sequence
  Synthetic
atggccgactcccaagtacgctaagccgtgaaaggcttccttcatttcagagaggacaactctagtgggagccagcacaagtgtgcgcaaccgtcttcgtgcgcattcagccaggatctgggagacccagcatggcgtat

SEQ ID NO: 450931 - DNA, 140 bp, Artificial Sequence
  Synthetic
aggccctggctgctgatatgtcccactagagttgtcctctctgaaatgaaggaagcctttcacggcttagatgtcaagtttcacacacaggctttctccgctcacggtagcggaaaagaagaccttttgggacagcggtg

SEQ ID NO: 450932 - DNA, 140 bp, Artificial Sequence
  Synthetic
caccgctgtcccaaaaggtcttcttttccgctaccgtgagcggagaaagcctgtgtgtgaaacttgacatctaagccgtgaaaggcttccttcatttcagagaggacaactctagtgggacatatcagcagccagggcct

SEQ ID NO: 450933 - DNA, 140 bp, Artificial Sequence
  Synthetic
atacgccatgctgggtctcctgatgaatttccacattcaaatggggaaatagaggatgtccaaacggacattcctagtgagccttggaacacaggtcatgactggattttggcggacaaacgtacttgggagtcggccat

SEQ ID NO: 450934 - DNA, 140 bp, Artificial Sequence
  Synthetic
atggccgactcccaagtacgtttgtccgccaaaatccagtcatgacctgtgttccaaggctcactaggaatgtccgtttggacatcctctatttccccatttgaatgtggaaattcatcaggagacccagcatggcgtat

SEQ ID NO: 450935 - DNA, 140 bp, Artificial Sequence
  Synthetic
atacgccatgctgggtctcccctttgagaaagaataccccacaattaaacagaaaaaacctgatttcatcttggccactgacatagctgagatgggagccaatctctgcgtggagagagtcgtacttgggagtcggccat

SEQ ID NO: 450936 - DNA, 140 bp, Artificial Sequence
  Synthetic
atggccgactcccaagtacgactctctccacgcagagattggctcccatctcagctatgtcagtggccaagatgaaatcaggttttttctgtttaattgtggggtattctttctcaaaggggagacccagcatggcgtat

SEQ ID NO: 450937 - DNA, 140 bp, Artificial Sequence
  Synthetic
aggccctggctgctgatatgttggccactgacatagctgagatgggagccaatctctgcgtggagagagtgttggattgtaggacggctttcaaacctgtgcttgtggatgaagggagaagaccttttgggacagcggtg

SEQ ID NO: 450938 - DNA, 140 bp, Artificial Sequence
  Synthetic
caccgctgtcccaaaaggtcttctcccttcatccacaagcacaggtttgaaagccgtcctacaatccaacactctctccacgcagagattggctcccatctcagctatgtcagtggccaacatatcagcagccagggcct

SEQ ID NO: 450939 - DNA, 140 bp, Artificial Sequence
  Synthetic
atacgccatgctgggtctccaggtggcaataaaagggccactccggatttcagcttcctccgctgcccaaaggagggggcgcattggaaggaaccctaacagagacggggactcatactacgtacttgggagtcggccat

SEQ ID NO: 450940 - DNA, 140 bp, Artificial Sequence
  Synthetic
atggccgactcccaagtacgtagtatgagtccccgtctctgttagggttccttccaatgcgccccctcctttgggcagcggaggaagctgaaatccggagtggcccttttattgccacctggagacccagcatggcgtat

SEQ ID NO: 450941 - DNA, 140 bp, Artificial Sequence
  Synthetic
atacgccatgctgggtctccctactctgagcccacaagtgaagacaatgcacatcatgtctgttggcttgaggcctcaatgctcctagacaacatggaggtgagaggtgggatggttgctcgtacttgggagtcggccat

SEQ ID NO: 450942 - DNA, 140 bp, Artificial Sequence
  Synthetic
atggccgactcccaagtacgagcaaccatcccacctctcacctccatgttgtctaggagcattgaggcctcaagccaacagacatgatgtgcattgtcttcacttgtgggctcagagtagggagacccagcatggcgtat

SEQ ID NO: 450943 - DNA, 140 bp, Artificial Sequence
  Synthetic
aggccctggctgctgatatgacgaatgaccgaaagtggtgctttgagggcccagaagaacatgagatcttgaatgacagtggtgagacagtaaagtgcagggcccctggaggagccaagagaccttttgggacagcggtg

SEQ ID NO: 450944 - DNA, 140 bp, Artificial Sequence
  Synthetic
caccgctgtcccaaaaggtctcttggctcctccaggggccctgcactttactgtctcaccactgtcattcaagatctcatgttcttctgggccctcaaagcaccactttcggtcattcgtcatatcagcagccagggcct

SEQ ID NO: 450945 - DNA, 140 bp, Artificial Sequence
  Synthetic
atacgccatgctgggtctccgcgcttgccgacttcataaagtttgctgagggcaggagaggggctgctgagatgctggtcgtgctgagtgaactcccagacttcttggccaagaaaggtgcgtacttgggagtcggccat

SEQ ID NO: 450946 - DNA, 140 bp, Artificial Sequence
  Synthetic
atggccgactcccaagtacgcacctttcttggccaagaagtctgggagttcactcagcacgaccagcatctcagcagcccctctcctgccctcagcaaactttatgaagtcggcaagcgcggagacccagcatggcgtat

SEQ ID NO: 450947 - DNA, 140 bp, Artificial Sequence
  Synthetic
atacgccatgctgggtctccgagaggcggtggatactatcagcgtgctcttgcactctgaggaaggttccagagcttaccgcaatgcattgtcaatgatgcctgaggcaatgacaacagtcgtacttgggagtcggccat

SEQ ID NO: 450948 - DNA, 140 bp, Artificial Sequence
  Synthetic
atggccgactcccaagtacgactgttgtcattgcctcaggcatcattgacaatgcattgcggtaagctctggaaccttcctcagagtgcaagagcacgctgatagtatccaccgcctctcggagacccagcatggcgtat

SEQ ID NO: 450949 - DNA, 140 bp, Artificial Sequence
  Synthetic
atacgccatgctgggtctcctcatgtctcccaagggcatcagccgaatgtctatggcaatgggcacgatggctggttgtggatacctcatgtttcttggaggcgtcaaacccacccacatcgtacttgggagtcggccat

SEQ ID NO: 450950 - DNA, 140 bp, Artificial Sequence
  Synthetic
atggccgactcccaagtacgatgtgggtgggtttgacgcctccaagaaacatgaggtatccacaaccagccatcgtgcccattgccatagacattcggctgatgcccttgggagacatgaggagacccagcatggcgtat

SEQ ID NO: 450951 - DNA, 140 bp, Artificial Sequence
  Synthetic
aggccctggctgctgatatggcttggactgtctatgttggcattgtcacaatgctctccccaatgctgcaccactggatcaaggttgagtatggcaatctgtctttgtctggaattgcacgaccttttgggacagcggtg

SEQ ID NO: 450952 - DNA, 140 bp, Artificial Sequence
  Synthetic
caccgctgtcccaaaaggtcgtgcaattccagacaaagacagattgccatactcaaccttgatccagtggtgcagcattggggagagcattgtgacaatgccaacatagacagtccaagccatatcagcagccagggcct

SEQ ID NO: 450953 - DNA, 140 bp, Artificial Sequence
  Synthetic
atacgccatgctgggtctccccactggatcaaggttgagtatggcaatctgtctttgtctggaattgcacagtcagcctcagttttgtcattcatggacaagggcatcccgttcatgaagcgtacttgggagtcggccat

SEQ ID NO: 450954 - DNA, 140 bp, Artificial Sequence
  Synthetic
atggccgactcccaagtacgcttcatgaacgggatgcccttgtccatgaatgacaaaactgaggctgactgtgcaattccagacaaagacagattgccatactcaaccttgatccagtggggagacccagcatggcgtat

SEQ ID NO: 450955 - DNA, 140 bp, Artificial Sequence
  Synthetic
atacgccatgctgggtctcccattgtatcttctgcttgcccttagcttggcctctgttgccatgtgtagaacacccttttcactggctgaaggcattgtgctggcatcagcagccctgggcgtacttgggagtcggccat

SEQ ID NO: 450956 - DNA, 140 bp, Artificial Sequence
  Synthetic
atggccgactcccaagtacgcccagggctgctgatgccagcacaatgccttcagccagtgaaaagggtgttctacacatggcaacagaggccaagctaagggcaagcagaagatacaatgggagacccagcatggcgtat

SEQ ID NO: 450957 - DNA, 140 bp, Artificial Sequence
  Synthetic
aggccctggctgctgatatgacacccttttcactggctgaaggcattgtgctggcatcagcagccctgggaccgctcatcgagggaaataccagcctcttgtggaatggacccatggctggaccttttgggacagcggtg

SEQ ID NO: 450958 - DNA, 140 bp, Artificial Sequence
  Synthetic
caccgctgtcccaaaaggtccagccatgggtccattccacaagaggctggtatttccctcgatgagcggtcccagggctgctgatgccagcacaatgccttcagccagtgaaaagggtgtcatatcagcagccagggcct

SEQ ID NO: 450959 - DNA, 140 bp, Artificial Sequence
  Synthetic
atacgccatgctgggtctccagcagtttgagctgtataaacggacagacattgtggaagtggaccgtgacacagctcgccgacacctggctgaagggaaagtggacaccggagtggccgtcgtacttgggagtcggccat

SEQ ID NO: 450960 - DNA, 140 bp, Artificial Sequence
  Synthetic
atggccgactcccaagtacgacggccactccggtgtccactttcccttcagccaggtgtcggcgagctgtgtcacggtccacttccacaatgtctgtccgtttatacagctcaaactgctggagacccagcatggcgtat

SEQ ID NO: 450961 - DNA, 140 bp, Artificial Sequence
  Synthetic
atacgccatgctgggtctccagttggaaggaagagtgactgacctgggatgtgggcgtggtggctggtgctactatgctgctgcacagagagaagtgagtggggttaagggattcaccctcgtacttgggagtcggccat

SEQ ID NO: 450962 - DNA, 140 bp, Artificial Sequence
  Synthetic
atggccgactcccaagtacgagggtgaatcccttaaccccactcacttctctctgtgcagcagcatagtagcaccagccaccacgcccacatcccaggtcagtcactcttccttccaactggagacccagcatggcgtat

SEQ ID NO: 450963 - DNA, 140 bp, Artificial Sequence
  Synthetic
atacgccatgctgggtctccacatcatcaccttcaaggacaagactgatgtccatcgccttgagccagtgaagtgtgataccctgctgtgcgacattggagagtcgtccccatcatcagtcgtacttgggagtcggccat

SEQ ID NO: 450964 - DNA, 140 bp, Artificial Sequence
  Synthetic
atggccgactcccaagtacgactgatgatggggacgactctccaatgtcgcacagcagggtatcacacttcactggctcaaggcgatggacatcagtcttgtccttgaaggtgatgatgtggagacccagcatggcgtat

SEQ ID NO: 450965 - DNA, 140 bp, Artificial Sequence
  Synthetic
aggccctggctgctgatatgtgggctgtggcgttgaaagcttctgtgtgaaggtgttggctccatacatgcctgatgtgcttgaaaagttagagttgctccaaaggaggtttggtggaacgaccttttgggacagcggtg

SEQ ID NO: 450966 - DNA, 140 bp, Artificial Sequence
  Synthetic
caccgctgtcccaaaaggtcgttccaccaaacctcctttggagcaactctaacttttcaagcacatcaggcatgtatggagccaacaccttcacacagaagctttcaacgccacagcccacatatcagcagccagggcct

SEQ ID NO: 450967 - DNA, 140 bp, Artificial Sequence
  Synthetic
aggccctggctgctgatatgggtaatcaggaatcccctctctagaaattcaacccacgagatgtattatgtgtcgggagcccgcagtaacatcacgttcactgtgaatcaaacatcccgcgaccttttgggacagcggtg

SEQ ID NO: 450968 - DNA, 140 bp, Artificial Sequence
  Synthetic
caccgctgtcccaaaaggtcgcgggatgtttgattcacagtgaacgtgatgttactgcgggctcccgacacataatacatctcgtgggttgaatttctagagaggggattcctgattacccatatcagcagccagggcct

SEQ ID NO: 450969 - DNA, 140 bp, Artificial Sequence
  Synthetic
atacgccatgctgggtctccctcttaatgaggagaatgaggcgcccgacaggcaaagtgactcttgaagccgatgttatcctcccaattggaacacgcagtgtggaaacagataaaggaccgtacttgggagtcggccat

SEQ ID NO: 450970 - DNA, 140 bp, Artificial Sequence
  Synthetic
atggccgactcccaagtacggtcctttatctgtttccacactgcgtgttccaattgggaggataacatcggcttcaagagtcactttgcctgtcgggcgcctcattctcctcattaagagggagacccagcatggcgtat

SEQ ID NO: 450971 - DNA, 140 bp, Artificial Sequence
  Synthetic
aggccctggctgctgatatgcgatgttatcctcccaattggaacacgcagtgtggaaacagataaaggaccacttgatagggcagccattgaagagagggttgaaagaataaaatctgaagaccttttgggacagcggtg

SEQ ID NO: 450972 - DNA, 140 bp, Artificial Sequence
  Synthetic
caccgctgtcccaaaaggtcttcagattttattctttcaaccctctcttcaatggctgccctatcaagtggtcctttatctgtttccacactgcgtgttccaattgggaggataacatcgcatatcagcagccagggcct

SEQ ID NO: 450973 - DNA, 140 bp, Artificial Sequence
  Synthetic
aggccctggctgctgatatgcacttgatagggcagccattgaagagagggttgaaagaataaaatctgaatacaccgccacttggttccatgataatgacaacccttacaggacttggcagaccttttgggacagcggtg

SEQ ID NO: 450974 - DNA, 140 bp, Artificial Sequence
  Synthetic
caccgctgtcccaaaaggtctgccaagtcctgtaagggttgtcattatcatggaaccaagtggcggtgtattcagattttattctttcaaccctctcttcaatggctgccctatcaagtgcatatcagcagccagggcct

SEQ ID NO: 450975 - DNA, 140 bp, Artificial Sequence
  Synthetic
aggccctggctgctgatatgtacaccgccacttggttccatgataatgacaacccttacaggacttggcattattgcggttcctacgtcacaagaacctcagggagtgcagcaagcatgagaccttttgggacagcggtg

SEQ ID NO: 450976 - DNA, 140 bp, Artificial Sequence
  Synthetic
caccgctgtcccaaaaggtctcatgcttgctgcactccctgaggttcttgtgacgtaggaaccgcaataatgccaagtcctgtaagggttgtcattatcatggaaccaagtggcggtgtacatatcagcagccagggcct

SEQ ID NO: 450977 - DNA, 140 bp, Artificial Sequence
  Synthetic
atacgccatgctgggtctccttattgcggttcctacgtcacaagaacctcagggagtgcagcaagcatgatcaacggggtgatcaagatcttgacatacccctgggacaggatagaggagcgtacttgggagtcggccat

SEQ ID NO: 450978 - DNA, 140 bp, Artificial Sequence
  Synthetic
atggccgactcccaagtacgctcctctatcctgtcccaggggtatgtcaagatcttgatcaccccgttgatcatgcttgctgcactccctgaggttcttgtgacgtaggaaccgcaataaggagacccagcatggcgtat

SEQ ID NO: 450979 - DNA, 140 bp, Artificial Sequence
  Synthetic
atacgccatgctgggtctccgtcacgagaatggcaatgacagacacaactccttttggacaacaaagagtgttcaaggaaaaagttgacaccagagcaaaggatccaccagcagggaccacgtacttgggagtcggccat

SEQ ID NO: 450980 - DNA, 140 bp, Artificial Sequence
  Synthetic
atggccgactcccaagtacgtggtccctgctggtggatcctttgctctggtgtcaactttttccttgaacactctttgttgtccaaaaggagttgtgtctgtcattgccattctcgtgacggagacccagcatggcgtat

SEQ ID NO: 450981 - DNA, 140 bp, Artificial Sequence
  Synthetic
aggccctggctgctgatatgcagtcatgcagccatcggagctttcctggaagaacaagaacagtggaagactgccaatgaagctgtccaagatccgaagttctgggaattagtggatgaggaccttttgggacagcggtg

SEQ ID NO: 450982 - DNA, 140 bp, Artificial Sequence
  Synthetic
caccgctgtcccaaaaggtcctcatccactaattcccagaacttcggatcttggacagcttcattggcagtcttccactgttcttgttcttccaggaaagctccgatggctgcatgactgcatatcagcagccagggcct

SEQ ID NO: 450983 - DNA, 140 bp, Artificial Sequence
  Synthetic
atacgccatgctgggtctccgaacgacggctgcatcagcagggcaggtgccggacttgtgtgtacaacatgatggggaagagagaaaagaagctgtcagagtttggaaaggcgaagggaacgtacttgggagtcggccat

SEQ ID NO: 450984 - DNA, 140 bp, Artificial Sequence
  Synthetic
atggccgactcccaagtacgttcccttcgcctttccaaactctgacagcttcttttctctcttccccatcatgttgtacacacaagtccggcacctgccctgctgatgcagccgtcgttcggagacccagcatggcgtat

SEQ ID NO: 450985 - DNA, 140 bp, Artificial Sequence
  Synthetic
aggccctggctgctgatatggatggggaagagagaaaagaagctgtcagagtttggaaaggcgaagggaagccgtgccatttggtacatgtggctgggagctcgatatcttgagtttgaagaccttttgggacagcggtg

SEQ ID NO: 450986 - DNA, 140 bp, Artificial Sequence
  Synthetic
caccgctgtcccaaaaggtcttcaaactcaagatatcgagctcccagccacatgtaccaaatggcacggcttcccttcgcctttccaaactctgacagcttcttttctctcttccccatccatatcagcagccagggcct

SEQ ID NO: 450987 - DNA, 140 bp, Artificial Sequence
  Synthetic
atacgccatgctgggtctccacctggctgcactagagggtggtggattctatgcggatgacacagctggatgggacacacgcataacagaggcggatctggatgatgaacaggaaatcttcgtacttgggagtcggccat

SEQ ID NO: 450988 - DNA, 140 bp, Artificial Sequence
  Synthetic
atggccgactcccaagtacgaagatttcctgttcatcatccagatccgcctctgttatgcgtgtgtcccatccagctgtgtcatccgcatagaatccaccaccctctagtgcagccaggtggagacccagcatggcgtat

SEQ ID NO: 450989 - DNA, 140 bp, Artificial Sequence
  Synthetic
aggccctggctgctgatatgtgggacacacgcataacagaggcggatctggatgatgaacaggaaatcttgaactacatgagcccacaccacaggaagcttgccctggctgtaatggaaagaccttttgggacagcggtg

SEQ ID NO: 450990 - DNA, 140 bp, Artificial Sequence
  Synthetic
caccgctgtcccaaaaggtctttccattacagccagggcaagcttcctgtggtgtgggctcatgtagttcaagatttcctgttcatcatccagatccgcctctgttatgcgtgtgtcccacatatcagcagccagggcct

SEQ ID NO: 450991 - DNA, 140 bp, Artificial Sequence
  Synthetic
atacgccatgctgggtctccggtggtgacttacgccctgaacaccatcaccaacctgaaagttcaactgataaggatggcggaggcagagatggtgatacaccaccagcatgtccaggaccgtacttgggagtcggccat

SEQ ID NO: 450992 - DNA, 140 bp, Artificial Sequence
  Synthetic
atggccgactcccaagtacggtcctggacatgctggtggtgtatcaccatctctgcctccgccatccttatcagttgaactttcaggttggtgatggtgttcagggcgtaagtcaccaccggagacccagcatggcgtat

SEQ ID NO: 450993 - DNA, 140 bp, Artificial Sequence
  Synthetic
atacgccatgctgggtctcctgactgggagaatgtgcccttctgctctcaccactttcatgaactgcaactgaaggatggcaggagaattgtagtgccttgccgggatcaagatgagctgcgtacttgggagtcggccat

SEQ ID NO: 450994 - DNA, 140 bp, Artificial Sequence
  Synthetic
atggccgactcccaagtacgcagctcatcttgatcccggcaaggcactacaattctcctgccatccttcagttgcagttcatgaaagtggtgagagcagaagggcacattctcccagtcaggagacccagcatggcgtat

SEQ ID NO: 450995 - DNA, 140 bp, Artificial Sequence
  Synthetic
atacgccatgctgggtctccgttggcagagggagagtgtctccaggaaatggttggatgatcaaggagacagcatgccttagcaaggcctacgccaacatgtggtcactgatgtactttccgtacttgggagtcggccat

SEQ ID NO: 450996 - DNA, 140 bp, Artificial Sequence
  Synthetic
atggccgactcccaagtacggaaagtacatcagtgaccacatgttggcgtaggccttgctaaggcatgctgtctccttgatcatccaaccatttcctggagacactctccctctgccaacggagacccagcatggcgtat

SEQ ID NO: 450997 - DNA, 140 bp, Artificial Sequence
  Synthetic
aggccctggctgctgatatgacatcttgggttccacagggacgcaccacgtggtctgttcatgggaagggagagtggatgaccacagaagacatgcttgaggtgtggaacagagtgtggagaccttttgggacagcggtg

SEQ ID NO: 450998 - DNA, 140 bp, Artificial Sequence
  Synthetic
caccgctgtcccaaaaggtctccacactctgttccacacctcaagcatgtcttctgtggtcatccactctcccttcccatgaacagaccacgtggtgcgtccctgtggaacccaagatgtcatatcagcagccagggcct

SEQ ID NO: 450999 - DNA, 140 bp, Artificial Sequence
  Synthetic
atacgccatgctgggtctccttgagacaccgttccaagaacaatcaagaactagactttgtacatagaacaaaactgaaaccgggataaaaactacggatggagaaccggactccacacacgtacttgggagtcggccat

SEQ ID NO: 451000 - DNA, 140 bp, Artificial Sequence
  Synthetic
atggccgactcccaagtacgtgtgtggagtccggttctccatccgtagtttttatcccggtttcagttttgttctatgtacaaagtctagttcttgattgttcttggaacggtgtctcaaggagacccagcatggcgtat

SEQ ID NO: 451001 - DNA, 140 bp, Artificial Sequence
  Synthetic
atacgccatgctgggtctcctcaaacacaggaggatgtcagcccagaaacccgcgtgggttctgccactgctaagctgtgaggcagtgcaggctgggacagccgccttccaggttgcgaacgtacttgggagtcggccat

SEQ ID NO: 451002 - DNA, 140 bp, Artificial Sequence
  Synthetic
atggccgactcccaagtacgttcgcaacctggaaggcggctgtcccagcctgcactgcctcacagcttagcagtggcagaacccacgcgggtttctgggctgacatcctcctgtgtttgaggagacccagcatggcgtat

SEQ ID NO: 451003 - DNA, 140 bp, Artificial Sequence
  Synthetic
aggccctggctgctgatatgctaagctgtgaggcagtgcaggctgggacagccgccttccaggttgcgaaaacctggtttctgagacttcccacctcagagtaaaaccaaatggagcctcgaccttttgggacagcggtg

SEQ ID NO: 451004 - DNA, 140 bp, Artificial Sequence
  Synthetic
caccgctgtcccaaaaggtcgaggctccatttggttttactctgaggtgggaagtctcagaaaccaggttttcgcaacctggaaggcggctgtcccagcctgcactgcctcacagcttagcatatcagcagccagggcct

SEQ ID NO: 451005 - DNA, 140 bp, Artificial Sequence
  Synthetic
aggccctggctgctgatatgggagaccctccagggaacaaatagtgggatgtcggcccagaaacccgcgtgggttctgccactgctaagctgtgaggcagtgcaggctgggatagccgccgaccttttgggacagcggtg

SEQ ID NO: 451006 - DNA, 140 bp, Artificial Sequence
  Synthetic
caccgctgtcccaaaaggtcggcggctatcccagcctgcactgcctcacagcttagcagtggcagaacccacgcgggtttctgggccgacatcccactatttgttccctggagggtctcccatatcagcagccagggcct

SEQ ID NO: 451007 - DNA, 140 bp, Artificial Sequence
  Synthetic
atacgccatgctgggtctccttccatgttgcgaaaaacatggtttctgagacctcccacctcagagtaaaaccaaatggagcctccgctaccacctccccacgtggtggtagaaagacaccgtacttgggagtcggccat

SEQ ID NO: 451008 - DNA, 140 bp, Artificial Sequence
  Synthetic
atggccgactcccaagtacggtgtctttctaccaccacgtggggaggtggtagcggaggctccatttggttttactctgaggtgggaggtctcagaaaccatgtttttcgcaacatggaaggagacccagcatggcgtat

SEQ ID NO: 451009 - DNA, 140 bp, Artificial Sequence
  Synthetic
aggccctggctgctgatatggcgaaaaacatggtttctgagacctcccacctcagagtaaaaccaaatggagcctccgctaccacctccccacgtggtggtagaaagacacaaaaccactgaccttttgggacagcggtg

SEQ ID NO: 451010 - DNA, 140 bp, Artificial Sequence
  Synthetic
caccgctgtcccaaaaggtcagtggttttgtgtctttctaccaccacgtggggaggtggtagcggaggctccatttggttttactctgaggtgggaggtctcagaaaccatgtttttcgccatatcagcagccagggcct

SEQ ID NO: 451011 - DNA, 140 bp, Artificial Sequence
  Synthetic
aggccctggctgctgatatgtagctgtcctgaagaaggttaagagggtggtggcgagcctgatgagaggtttgtcctcgaggaaacgccgatcccaagatgttttaactgtgcaatttctgaccttttgggacagcggtg

SEQ ID NO: 451012 - DNA, 140 bp, Artificial Sequence
  Synthetic
caccgctgtcccaaaaggtcagaaattgcacagttaaaacatcttgggatcggcgtttcctcgaggacaaacctctcatcaggctcgccaccaccctcttaaccttcttcaggacagctacatatcagcagccagggcct

SEQ ID NO: 451013 - DNA, 140 bp, Artificial Sequence
  Synthetic
atacgccatgctgggtctcctctgttggcacaggtaactgcacaaccaacattctggaggccaagtattggtgtccagattccatggaatacaactgccctaatctcagtccaagagaagcgtacttgggagtcggccat

SEQ ID NO: 451014 - DNA, 140 bp, Artificial Sequence
  Synthetic
atggccgactcccaagtacgcttctcttggactgagattagggcagttgtattccatggaatctggacaccaatacttggcctccagaatgttggttgtgcagttacctgtgccaacagaggagacccagcatggcgtat

SEQ ID NO: 451015 - DNA, 140 bp, Artificial Sequence
  Synthetic
aggccctggctgctgatatggtgtccagattccatggaatacaactgccctaatctcagtccaagagaagagcctgatgacatagactgttggtgttatggagtggaaaatgtcagagtcgaccttttgggacagcggtg

SEQ ID NO: 451016 - DNA, 140 bp, Artificial Sequence
  Synthetic
caccgctgtcccaaaaggtcgactctgacattttccactccataacaccaacagtctatgtcatcaggctcttctcttggactgagattagggcagttgtattccatggaatctggacaccatatcagcagccagggcct

SEQ ID NO: 451017 - DNA, 140 bp, Artificial Sequence
  Synthetic
atacgccatgctgggtctccagcctgatgacatagactgttggtgttatggagtggaaaatgtcagagtcgcctatggcaagtgtgattcagcgggtaggtcaagaaggtccagaagggccgtacttgggagtcggccat

SEQ ID NO: 451018 - DNA, 140 bp, Artificial Sequence
  Synthetic
atggccgactcccaagtacggcccttctggaccttcttgacctacccgctgaatcacacttgccataggcgactctgacattttccactccataacaccaacagtctatgtcatcaggctggagacccagcatggcgtat

SEQ ID NO: 451019 - DNA, 140 bp, Artificial Sequence
  Synthetic
atacgccatgctgggtctccagcgaacttactctgatagaggttggggaaatggttgtggcctgtttggaaaaggaagcattgtggcatgtgccaagtttacctgtgctaaatccatgagcgtacttgggagtcggccat

SEQ ID NO: 451020 - DNA, 140 bp, Artificial Sequence
  Synthetic
atggccgactcccaagtacgctcatggatttagcacaggtaaacttggcacatgccacaatgcttccttttccaaacaggccacaaccatttccccaacctctatcagagtaagttcgctggagacccagcatggcgtat

SEQ ID NO: 451021 - DNA, 140 bp, Artificial Sequence
  Synthetic
aggccctggctgctgatatgaaaggaagcattgtggcatgtgccaagtttacctgtgctaaatccatgagtctatttgaggttgatcagaccaaaattcagtatgtcattagggcacagcgaccttttgggacagcggtg

SEQ ID NO: 451022 - DNA, 140 bp, Artificial Sequence
  Synthetic
caccgctgtcccaaaaggtcgctgtgccctaatgacatactgaattttggtctgatcaacctcaaatagactcatggatttagcacaggtaaacttggcacatgccacaatgcttcctttcatatcagcagccagggcct

SEQ ID NO: 451023 - DNA, 140 bp, Artificial Sequence
  Synthetic
aggccctggctgctgatatgagagatgcatcatctcgtggaattcgaacctccacatgctgcaaccatcaaagtgttagcccttggaaaccaagagggatccttgaagactgccctcactgaccttttgggacagcggtg

SEQ ID NO: 451024 - DNA, 140 bp, Artificial Sequence
  Synthetic
caccgctgtcccaaaaggtcagtgagggcagtcttcaaggatccctcttggtttccaagggctaacactttgatggttgcagcatgtggaggttcgaattccacgagatgatgcatctctcatatcagcagccagggcct

SEQ ID NO: 451025 - DNA, 140 bp, Artificial Sequence
  Synthetic
aggccctggctgctgatatgcggaccaaggatgtgcaataaactttggcaagagagaactcaagtgtggggatggcatcttcgtctttagagattcagatgactggctgaacaagtattcgaccttttgggacagcggtg

SEQ ID NO: 451026 - DNA, 140 bp, Artificial Sequence
  Synthetic
caccgctgtcccaaaaggtcgaatacttgttcagccagtcatctgaatctctaaagacgaagatgccatccccacacttgagttctctcttgccaaagtttattgcacatccttggtccgcatatcagcagccagggcct

SEQ ID NO: 451027 - DNA, 140 bp, Artificial Sequence
  Synthetic
atacgccatgctgggtctccgtgtacatggatgcagtctttgaatacactatggattgtgatggatctatcctgggtgcagcagtgaatggaaagaagagcgcgcatgggtccccaacatcgtacttgggagtcggccat

SEQ ID NO: 451028 - DNA, 140 bp, Artificial Sequence
  Synthetic
atggccgactcccaagtacgatgttggggacccatgcgcgctcttctttccattcactgctgcacccaggatagatccatcacaatccatagtgtattcaaagactgcatccatgtacacggagacccagcatggcgtat

SEQ ID NO: 451029 - DNA, 140 bp, Artificial Sequence
  Synthetic
atacgccatgctgggtctcccagtgtggttgttgacggaggctgtgatgggcgtggaaaatcgactagatcgaccactgacagcgggaagatcattcctgaatggtgctgccgctcatgccgtacttgggagtcggccat

SEQ ID NO: 451030 - DNA, 140 bp, Artificial Sequence
  Synthetic
atggccgactcccaagtacggcatgagcggcagcaccattcaggaatgatcttcccgctgtcagtggtcgatctagtcgattttccacgcccatcacagcctccgtcaacaaccacactgggagacccagcatggcgtat

SEQ ID NO: 451031 - DNA, 140 bp, Artificial Sequence
  Synthetic
atacgccatgctgggtctccacaatgccaccagtgagcttccacgggagtgatggttgctggtattctatggagattagaccaaagaagacacatgatagccacctggtccgctcatgggcgtacttgggagtcggccat

SEQ ID NO: 451032 - DNA, 140 bp, Artificial Sequence
  Synthetic
atggccgactcccaagtacgcccatgagcggaccaggtggctatcatgtgtcttctttggtctaatctccatagaataccagcaaccatcactcccgtggaagctcactggtggcattgtggagacccagcatggcgtat

SEQ ID NO: 451033 - DNA, 140 bp, Artificial Sequence
  Synthetic
aggccctggctgctgatatgtgacggctggagagatccatgcagtcccctttgggttggtgagcatgatgatagccatggaagtggtattgaggaagagacagggacccaagcaaatactgaccttttgggacagcggtg

SEQ ID NO: 451034 - DNA, 140 bp, Artificial Sequence
  Synthetic
caccgctgtcccaaaaggtcagtatttgcttgggtccctgtctcttcctcaataccacttccatggctatcatcatgctcaccaacccaaaggggactgcatggatctctccagccgtcacatatcagcagccagggcct

SEQ ID NO: 451035 - DNA, 140 bp, Artificial Sequence
  Synthetic
atacgccatgctgggtctccggttggaggcatggtgcttctaggagccatgttagttggacaggtgactatcttggacttgctaaagctcacagtggcggttggattgcactttcatgagcgtacttgggagtcggccat

SEQ ID NO: 451036 - DNA, 140 bp, Artificial Sequence
  Synthetic
atggccgactcccaagtacgctcatgaaagtgcaatccaaccgccactgtgagctttagcaagtccaagatagtcacctgtccaactaacatggctcctagaagcaccatgcctccaaccggagacccagcatggcgtat

SEQ ID NO: 451037 - DNA, 140 bp, Artificial Sequence
  Synthetic
atacgccatgctgggtctccagaagtttcttgggaagaggaagctgagatcagtggaagttctgcccgttatgatgtgactctcagtgaacagggggaatttaaattactctctgaagagcgtacttgggagtcggccat

SEQ ID NO: 451038 - DNA, 140 bp, Artificial Sequence
  Synthetic
atggccgactcccaagtacgctcttcagagagtaatttaaattccccctgttcactgagagtcacatcataacgggcagaacttccactgatctcagcttcctcttcccaagaaacttctggagacccagcatggcgtat

SEQ ID NO: 451039 - DNA, 140 bp, Artificial Sequence
  Synthetic
aggccctggctgctgatatgaaggtgccatgggatcaggtcgtgatgacttcattggctttggtcggagctgctatccacccatttgcactcttactggttcttgctggctggttgttccgaccttttgggacagcggtg

SEQ ID NO: 451040 - DNA, 140 bp, Artificial Sequence
  Synthetic
caccgctgtcccaaaaggtcggaacaaccagccagcaagaaccagtaagagtgcaaatgggtggatagcagctccgaccaaagccaatgaagtcatcacgacctgatcccatggcaccttcatatcagcagccagggcct

SEQ ID NO: 451041 - DNA, 140 bp, Artificial Sequence
  Synthetic
aggccctggctgctgatatgaagaggaggttcagttgatagcagctgcccccggaaaaaacgtagtgaatgtccagacaaagccaagcctattcaaggtcaggaatggaggagaaatcgggaccttttgggacagcggtg

SEQ ID NO: 451042 - DNA, 140 bp, Artificial Sequence
  Synthetic
caccgctgtcccaaaaggtcccgatttctcctccattcctgaccttgaataggcttggctttgtctggacattcactacgttttttccgggggcagctgctatcaactgaacctcctcttcatatcagcagccagggcct

SEQ ID NO: 451043 - DNA, 140 bp, Artificial Sequence
  Synthetic
aggccctggctgctgatatgggcggttgcccttgactacccgagcggcacttctggttctcccatcgtcaacaggaatggtgaggtaatagggctgtatggcaatggaattcttgttggtgaccttttgggacagcggtg

SEQ ID NO: 451044 - DNA, 140 bp, Artificial Sequence
  Synthetic
caccgctgtcccaaaaggtcaccaacaagaattccattgccatacagccctattacctcaccattcctgttgacgatgggagaaccagaagtgccgctcgggtagtcaagggcaaccgcccatatcagcagccagggcct

SEQ ID NO: 451045 - DNA, 140 bp, Artificial Sequence
  Synthetic
atacgccatgctgggtctccacaggaatggtgaggtaatagggctgtatggcaatggaattcttgttggtgacaactcttttgtgtctgccatatcccaaactgaggtgaaagaagagggcgtacttgggagtcggccat

SEQ ID NO: 451046 - DNA, 140 bp, Artificial Sequence
  Synthetic
atggccgactcccaagtacgccctcttctttcacctcagtttgggatatggcagacacaaaagagttgtcaccaacaagaattccattgccatacagccctattacctcaccattcctgtggagacccagcatggcgtat

SEQ ID NO: 451047 - DNA, 140 bp, Artificial Sequence
  Synthetic
atacgccatgctgggtctccgtcattgacgctatgtgtcatgctaccctgacatatagaatgctggaaccaaccagagtggtcaattgggaagtgatcatcatggacgaagcacatttttcgtacttgggagtcggccat

SEQ ID NO: 451048 - DNA, 140 bp, Artificial Sequence
  Synthetic
atggccgactcccaagtacgaaaaatgtgcttcgtccatgatgatcacttcccaattgaccactctggttggttccagcattctatatgtcagggtagcatgacacatagcgtcaatgacggagacccagcatggcgtat

SEQ ID NO: 451049 - DNA, 140 bp, Artificial Sequence
  Synthetic
atacgccatgctgggtctccaggcccacggcctggtttcttccctccatcagggctgcaaatgtcatggcagcctctttgcgcaaagctggaaagagtgtggtggtgctaaacaggaaaacgtacttgggagtcggccat

SEQ ID NO: 451050 - DNA, 140 bp, Artificial Sequence
  Synthetic
atggccgactcccaagtacgttttcctgtttagcaccaccacactctttccagctttgcgcaaagaggctgccatgacatttgcagccctgatggagggaagaaaccaggccgtgggcctggagacccagcatggcgtat

SEQ ID NO: 451051 - DNA, 140 bp, Artificial Sequence
  Synthetic
atacgccatgctgggtctccgaatgacagtggcgagacagtaaagtgcagggcccctggaggagccaagaaacctctgcgtccacggtggtgcgatgaaagggtgtcgtctgaccagagtcgtacttgggagtcggccat

SEQ ID NO: 451052 - DNA, 140 bp, Artificial Sequence
  Synthetic
atggccgactcccaagtacgactctggtcagacgacaccctttcatcgcaccaccgtggacgcagaggtttcttggctcctccaggggccctgcactttactgtctcgccactgtcattcggagacccagcatggcgtat

SEQ ID NO: 451053 - DNA, 140 bp, Artificial Sequence
  Synthetic
atacgccatgctgggtctcctcatgtctcccaagggtatcagcagaatgtccatggcaatgggcacgatggctggttgtggatacctcatgtttcttggaggcgtcaaacccacccacatcgtacttgggagtcggccat

SEQ ID NO: 451054 - DNA, 140 bp, Artificial Sequence
  Synthetic
atggccgactcccaagtacgatgtgggtgggtttgacgcctccaagaaacatgaggtatccacaaccagccatcgtgcccattgccatggacattctgctgatacccttgggagacatgaggagacccagcatggcgtat

SEQ ID NO: 451055 - DNA, 140 bp, Artificial Sequence
  Synthetic
atacgccatgctgggtctccctagtgccgcaccttggagctggccagactttgacttgaaaccaggagctgcttggactgtctatgttggcattgtcacaatgctctccccaatgctgcacgtacttgggagtcggccat

SEQ ID NO: 451056 - DNA, 140 bp, Artificial Sequence
  Synthetic
atggccgactcccaagtacgtgcagcattggggagagcattgtgacaatgccaacatagacagtccaagcagctcctggtttcaagtcaaagtctggccagctccaaggtgcggcactagggagacccagcatggcgtat

SEQ ID NO: 451057 - DNA, 140 bp, Artificial Sequence
  Synthetic
atacgccatgctgggtctccgccgctcatagagggaaataccagcctcttgtggaatggacccatggctgtgtccatgactggagtcatgcgggggaactactatgcttttgtgggtgtccgtacttgggagtcggccat

SEQ ID NO: 451058 - DNA, 140 bp, Artificial Sequence
  Synthetic
atggccgactcccaagtacggacacccacaaaagcatagtagttcccccgcatgactccagtcatggacacagccatgggtccattccacaagaggctggtatttccctctatgagcggcggagacccagcatggcgtat

SEQ ID NO: 451059 - DNA, 140 bp, Artificial Sequence
  Synthetic
aggccctggctgctgatatgtgtccatgactggagtcatgcgggggaactactatgcttttgtgggtgtcatgtacaatctctggaagatgaagactggacgcagggggagagcgaatgggaccttttgggacagcggtg

SEQ ID NO: 451060 - DNA, 140 bp, Artificial Sequence
  Synthetic
caccgctgtcccaaaaggtcccattcgctctccccctgcgtccagtcttcatcttccagagattgtacatgacacccacaaaagcatagtagttcccccgcatgactccagtcatggacacatatcagcagccagggcct

SEQ ID NO: 451061 - DNA, 140 bp, Artificial Sequence
  Synthetic
atacgccatgctgggtctccatgtacaatctctggaagatgaagactggacgcagggggagagcgaatgggaagaccttgggtgaggtctggaaaagggagctgaacctgctggacaaaccgtacttgggagtcggccat

SEQ ID NO: 451062 - DNA, 140 bp, Artificial Sequence
  Synthetic
atggccgactcccaagtacggtttgtccagcaggttcagctcccttttccagacctcacccaaggtcttcccattcgctctccccctgcgtccagtcttcatcttccagagattgtacatggagacccagcatggcgtat

SEQ ID NO: 451063 - DNA, 140 bp, Artificial Sequence
  Synthetic
atacgccatgctgggtctccacatcatcacttttaaggataagactgatgtccatccccttgagccagtgaagtgtgtgatcctgctgtgcgacattggagagtcgtctccatcatcagtcgtacttgggagtcggccat

SEQ ID NO: 451064 - DNA, 140 bp, Artificial Sequence
  Synthetic
atggccgactcccaagtacgactgatgatggagacgactctccaatgtcgcacagcaggatcacacacttcactggctcaaggggatggacatcagtcttatccttaaaagtgatgatgtggagacccagcatggcgtat

SEQ ID NO: 451065 - DNA, 140 bp, Artificial Sequence
  Synthetic
atacgccatgctgggtctccccagatgtgcttgaaaagctagagttgctccaaaggaggtttggtggaacggtaatcaggaatcccctctctagaaattcaacccacgagatgtattatgcgtacttgggagtcggccat

SEQ ID NO: 451066 - DNA, 140 bp, Artificial Sequence
  Synthetic
atggccgactcccaagtacgcataatacatctcgtgggttgaatttctagagaggggattcctgattaccgttccaccaaacctcctttggagcaactctagcttttcaagcacatctggggagacccagcatggcgtat

SEQ ID NO: 451067 - DNA, 140 bp, Artificial Sequence
  Synthetic
aggccctggctgctgatatgggtaatcaggaatcccctctctagaaattcaacccacgagatgtattatgtgtcaggagcccgcagtaatatcgcgttcactgtgaatcaaacatcccgcgaccttttgggacagcggtg

SEQ ID NO: 451068 - DNA, 140 bp, Artificial Sequence
  Synthetic
caccgctgtcccaaaaggtcgcgggatgtttgattcacagtgaacgcgatattactgcgggctcctgacacataatacatctcgtgggttgaatttctagagaggggattcctgattacccatatcagcagccagggcct

SEQ ID NO: 451069 - DNA, 140 bp, Artificial Sequence
  Synthetic
atacgccatgctgggtctccggtggtgacttacgccttgaacaccatcactaacctgaaagttcaactgatcagaatggcggaggcagagatggtgatacaccaccagcatgtccaggaccgtacttgggagtcggccat

SEQ ID NO: 451070 - DNA, 140 bp, Artificial Sequence
  Synthetic
atggccgactcccaagtacggtcctggacatgctggtggtgtatcaccatctctgcctccgccattctgatcagttgaactttcaggttagtgatggtgttcaaggcgtaagtcaccaccggagacccagcatggcgtat

SEQ ID NO: 451071 - DNA, 140 bp, Artificial Sequence
  Synthetic
atacgccatgctgggtctcctaaccaacaatccacacatgcaggacaaaacgacggtgaaggagtggcgagacatcccttacctgaccaagagacaggacaagctttgtggatcactgatcgtacttgggagtcggccat

SEQ ID NO: 451072 - DNA, 140 bp, Artificial Sequence
  Synthetic
atggccgactcccaagtacgatcagtgatccacaaagcttgtcctgtctcttggtcaggtaagggatgtctcgccactccttcaccgtcgttttgtcctgcatgtgtggattgttggttaggagacccagcatggcgtat

SEQ ID NO: 451073 - DNA, 140 bp, Artificial Sequence
  Synthetic
atacgccatgctgggtctccttgagacactgttccaagaacaaccaagaactagaccttgtacataggacaaaactgaaaccgggataaaaaccacggatggagaaccggactccacacacgtacttgggagtcggccat

SEQ ID NO: 451074 - DNA, 140 bp, Artificial Sequence
  Synthetic
atggccgactcccaagtacgtgtgtggagtccggttctccatccgtggtttttatcccggtttcagttttgtcctatgtacaaggtctagttcttggttgttcttggaacagtgtctcaaggagacccagcatggcgtat

SEQ ID NO: 451075 - DNA, 140 bp, Artificial Sequence
  Synthetic
aggccctggctgctgatatgaaaactgaaaccgggataaaaaccacggatggagaaccggactccacacatcaaacagaagaggatgtcagcccagaaacccgcgtggattctgccaccggaccttttgggacagcggtg

SEQ ID NO: 451076 - DNA, 140 bp, Artificial Sequence
  Synthetic
caccgctgtcccaaaaggtccggtggcagaatccacgcgggtttctgggctgacatcctcttctgtttgatgtgtggagtccggttctccatccgtggtttttatcccggtttcagttttcatatcagcagccagggcct

SEQ ID NO: 451077 - DNA, 140 bp, Artificial Sequence
  Synthetic
atacgccatgctgggtctccagggaaagaccggagtggttctctgcttttcctccagaggttctgtgagcacagttgctcaagaataagcagacctttggatgacaaacacaaaaccactcgtacttgggagtcggccat

SEQ ID NO: 451078 - DNA, 140 bp, Artificial Sequence
  Synthetic
atggccgactcccaagtacgagtggttttgtgtttgtcatccaaaggtctgcttattcttgagcaactgtgctcacagaacctctggaggaaaagcagagaaccactccggtctttccctggagacccagcatggcgtat

SEQ ID NO: 451079 - DNA, 140 bp, Artificial Sequence
  Synthetic
atacgccatgctgggtctcctactgctcatctgaagaaactatggagaatgctggacccaagacagggcttagctgtcctgaagaaggttaagagggtggtggcgagtctgatgagaggtcgtacttgggagtcggccat

SEQ ID NO: 451080 - DNA, 140 bp, Artificial Sequence
  Synthetic
atggccgactcccaagtacgacctctcatcagactcgccaccaccctcttaaccttcttcaggacagctaagccctgtcttgggtccagcattctccatagtttcttcagatgagcagtaggagacccagcatggcgtat

SEQ ID NO: 451081 - DNA, 140 bp, Artificial Sequence
  Synthetic
atacgccatgctgggtctcctacatgtcggagccaagcaggagaattggaacactgacatcaagactctcaagtttgatgccctgtcaggctctcaggaagctgagttcactggatacggcgtacttgggagtcggccat

SEQ ID NO: 451082 - DNA, 140 bp, Artificial Sequence
  Synthetic
atggccgactcccaagtacgccgtatccagtgaactcagcttcctgagagcctgacagggcatcaaacttgagagtcttgatgtcagtgttccaattctcctgcttggctccgacatgtaggagacccagcatggcgtat

SEQ ID NO: 451083 - DNA, 140 bp, Artificial Sequence
  Synthetic
aggccctggctgctgatatgaatcagaccagggctgctcatcggctttggattgaggacgctgtggagcccccgggaacgcctcgtgctgaccctgggggccgccatggtggagattgctgaccttttgggacagcggtg

SEQ ID NO: 451084 - DNA, 140 bp, Artificial Sequence
  Synthetic
caccgctgtcccaaaaggtcagcaatctccaccatggcggcccccagggtcagcacgaggcgttcccgggggctccacagcgtcctcaatccaaagccgatgagcagccctggtctgattcatatcagcagccagggcct

SEQ ID NO: 451085 - DNA, 140 bp, Artificial Sequence
  Synthetic
aggccctggctgctgatatggtgtttcatggtgttgctaagaatccggtggttgatgggaatccaacagttgacattgaggaagccccggaaatgcctgccctctatgagaagaagttgggaccttttgggacagcggtg

SEQ ID NO: 451086 - DNA, 140 bp, Artificial Sequence
  Synthetic
caccgctgtcccaaaaggtcccaacttcttctcatagagggcaggcatttccggggcttcctcaatgtcaactgttggattcccatcaaccaccggattcttagcaacaccatgaaacaccatatcagcagccagggcct

SEQ ID NO: 451087 - DNA, 140 bp, Artificial Sequence
  Synthetic
atacgccatgctgggtctccgaagaccttgggtgaggtctggaaaagggagctgaacctgctggacaaacagcagtttgagctgtataaacggacagacattgtggaagtggaccgtgaccgtacttgggagtcggccat

SEQ ID NO: 451088 - DNA, 140 bp, Artificial Sequence
  Synthetic
atggccgactcccaagtacggtcacggtccacttccacaatgtctgtccgtttatacagctcaaactgctgtttgtccagcaggttcagctcccttttccagacctcacccaaggtcttcggagacccagcatggcgtat

SEQ ID NO: 451089 - DNA, 140 bp, Artificial Sequence
  Synthetic
aggccctggctgctgatatgccgctaccacccccccacgtggtggtagaaagatggggtctagaggttagaggagaccctccagggaataaatagtgggatgtcagcccagaaacccgcggaccttttgggacagcggtg

SEQ ID NO: 451090 - DNA, 140 bp, Artificial Sequence
  Synthetic
caccgctgtcccaaaaggtccgcgggtttctgggctgacatcccactatttattccctggagggtctcctctaacctctagaccccatctttctaccaccacgtgggggggtggtagcggcatatcagcagccagggcct

SEQ ID NO: 451091 - DNA, 140 bp, Artificial Sequence
  Synthetic
atacgccatgctgggtctccaagctgtgaagtagtgcaggctgggacagccgctttccatgttgcgaaaaacctggtttctgagacttcccacctcagagtaaaaccaaatggagcctctcgtacttgggagtcggccat

SEQ ID NO: 451092 - DNA, 140 bp, Artificial Sequence
  Synthetic
atggccgactcccaagtacgagaggctccatttggttttactctgaggtgggaagtctcagaaaccaggtttttcgcaacatggaaagcggctgtcccagcctgcactacttcacagcttggagacccagcatggcgtat

SEQ ID NO: 451093 - DNA, 140 bp, Artificial Sequence
  Synthetic
atacgccatgctgggtctcctttccatgttgcgaaaaacctggtttctgagacttcccacctcagagtaaaaccaaatggagcctccgctaccacctccccacgtggtggtagaaagacgcgtacttgggagtcggccat

SEQ ID NO: 451094 - DNA, 140 bp, Artificial Sequence
  Synthetic
atggccgactcccaagtacgcgtctttctaccaccacgtggggaggtggtagcggaggctccatttggttttactctgaggtgggaagtctcagaaaccaggtttttcgcaacatggaaaggagacccagcatggcgtat

SEQ ID NO: 451095 - DNA, 140 bp, Artificial Sequence
  Synthetic
aggccctggctgctgatatgaacaaaaaacaaaacaaattggaagtagacctggaccttcaagaggcgttcaaggatttgtttttttctttttgttcaatgttttgactggaaagaagatgaccttttgggacagcggtg

SEQ ID NO: 451096 - DNA, 140 bp, Artificial Sequence
  Synthetic
caccgctgtcccaaaaggtcatcttctttccagtcaaaacattgaacaaaaagaaaaaaacaaatccttgaacgcctcttgaaggtccaggtctacttccaatttgttttgttttttgttcatatcagcagccagggcct

SEQ ID NO: 451097 - DNA, 140 bp, Artificial Sequence
  Synthetic
atacgccatgctgggtctccacaggacaagtgtgtcactgtgatggcccctgacaagccttcactggacatatcactagaaacagttgccattgatggacctgctgaagcaaggaaggtgcgtacttgggagtcggccat

SEQ ID NO: 451098 - DNA, 140 bp, Artificial Sequence
  Synthetic
atggccgactcccaagtacgcaccttccttgcttcagcaggtccatcaatggcaactgtttctagtgatatgtccagtgaaggcttgtcaggggccatcacagtgacacacttgtcctgtggagacccagcatggcgtat

SEQ ID NO: 451099 - DNA, 140 bp, Artificial Sequence
  Synthetic
aggccctggctgctgatatgtgttacagtgcagtcttaaccaatgtgaagatcaatgacaagtgccccagcactggtgaagcccatttggaggaagaaaatgaaggagataatgcttgtagaccttttgggacagcggtg

SEQ ID NO: 451100 - DNA, 140 bp, Artificial Sequence
  Synthetic
caccgctgtcccaaaaggtctacaagcattatctccttcattttcttcctccaaatgggcttcaccagtgctggggcacttgtcattgatcttcacattggttaagactgcactgtaacacatatcagcagccagggcct

SEQ ID NO: 451101 - DNA, 140 bp, Artificial Sequence
  Synthetic
atacgccatgctgggtctccgaaggccacactggagtgccaggttcagaccgcagtggacttcagcaatagttacattgcagagatggagaaagagagctggattgtggacaaacagtggcgtacttgggagtcggccat

SEQ ID NO: 451102 - DNA, 140 bp, Artificial Sequence
  Synthetic
atggccgactcccaagtacgccactgtttgtccacaatccagctctctttctccatctctgcaatgtaactattgctgaagtccactgcggtctgaacctggcactccagtgtggccttcggagacccagcatggcgtat

SEQ ID NO: 451103 - DNA, 140 bp, Artificial Sequence
  Synthetic
aggccctggctgctgatatgagagatgcatcatctcgtggaattcgagcctccacatgctgcaaccatcaaagtgttagcccttggaaaccaagaaggatccttgaagaccgctctcactgaccttttgggacagcggtg

SEQ ID NO: 451104 - DNA, 140 bp, Artificial Sequence
  Synthetic
caccgctgtcccaaaaggtcagtgagagcggtcttcaaggatccttcttggtttccaagggctaacactttgatggttgcagcatgtggaggctcgaattccacgagatgatgcatctctcatatcagcagccagggcct

SEQ ID NO: 451105 - DNA, 140 bp, Artificial Sequence
  Synthetic
atacgccatgctgggtctccaagtgttagcccttggaaaccaagaaggatccttgaagaccgctctcactggtgcaatgcgagtcacaaaagacacaaacaacagcaagctgtacaagctcgtacttgggagtcggccat

SEQ ID NO: 451106 - DNA, 140 bp, Artificial Sequence
  Synthetic
atggccgactcccaagtacgagcttgtacagcttgctgttgtttgtgtcttttgtgactcgcattgcaccagtgagagcggtcttcaaggatccttcttggtttccaagggctaacacttggagacccagcatggcgtat

SEQ ID NO: 451107 - DNA, 140 bp, Artificial Sequence
  Synthetic
aggccctggctgctgatatgccaactgacactggacatggcactgcagtgatgcaagtgaaggtgccaaagggagcaccttgcagaatcccagtaatggtcgccgatgatctcacagcgggaccttttgggacagcggtg

SEQ ID NO: 451108 - DNA, 140 bp, Artificial Sequence
  Synthetic
caccgctgtcccaaaaggtcccgctgtgagatcatcggcgaccattactgggattctgcaaggtgctccctttggcaccttcacttgcatcactgcagtgccatgtccagtgtcagttggcatatcagcagccagggcct

SEQ ID NO: 451109 - DNA, 140 bp, Artificial Sequence
  Synthetic
aggccctggctgctgatatggggagcaccttgcagaatcccagtaatggtcgccgatgatctcacagcggcagtcaacaagggtatcttggtcacggtcaatccaatagcctccaccaatgaccttttgggacagcggtg

SEQ ID NO: 451110 - DNA, 140 bp, Artificial Sequence
  Synthetic
caccgctgtcccaaaaggtcattggtggaggctattggattgaccgtgaccaagatacccttgttgactgccgctgtgagatcatcggcgaccattactgggattctgcaaggtgctccccatatcagcagccagggcct

SEQ ID NO: 451111 - DNA, 140 bp, Artificial Sequence
  Synthetic
atacgccatgctgggtctccgatgatgaagtgttgatcgaggtgaaccctccctttggggacagctacatcatagttggaactggggattcacgcttgacttaccagtggcacaaggaagcgtacttgggagtcggccat

SEQ ID NO: 451112 - DNA, 140 bp, Artificial Sequence
  Synthetic
atggccgactcccaagtacgcttccttgtgccactggtaagtcaagcgtgaatccccagttccaactatgatgtagctgtccccaaagggagggttcacctcgatcaacacttcatcatcggagacccagcatggcgtat

SEQ ID NO: 451113 - DNA, 140 bp, Artificial Sequence
  Synthetic
atacgccatgctgggtctccgtagctcaatagggaagttgttcacccagaccatgaagggcgcagagcgcttggccgtcatgggggatgctgcctgggactttggctctgctggaggattcgtacttgggagtcggccat

SEQ ID NO: 451114 - DNA, 140 bp, Artificial Sequence
  Synthetic
atggccgactcccaagtacgaatcctccagcagagccaaagtcccaggcagcatcccccatgacggccaagcgctctgcgcccttcatggtctgggtgaacaacttccctattgagctacggagacccagcatggcgtat

SEQ ID NO: 451115 - DNA, 140 bp, Artificial Sequence
  Synthetic
atacgccatgctgggtctcccttcacatcagtcggaaaaggaatacacactgtgtttggctctgccttccaaggattgtttggtggcttgagctggataacaaaggtcattatgggggtacgtacttgggagtcggccat

SEQ ID NO: 451116 - DNA, 140 bp, Artificial Sequence
  Synthetic
atggccgactcccaagtacgtacccccataatgacctttgttatccagctcaagccaccaaacaatccttggaaggcagagccaaacacagtgtgtattccttttccgactgatgtgaagggagacccagcatggcgtat

SEQ ID NO: 451117 - DNA, 140 bp, Artificial Sequence
  Synthetic
atacgccatgctgggtctcccatgatcctagttggagtcatcatgatgttcctgtccctaggagttggggcggaccaaggatgtgcaataaactttggcaagagagaactcaagtgtgggcgtacttgggagtcggccat

SEQ ID NO: 451118 - DNA, 140 bp, Artificial Sequence
  Synthetic
atggccgactcccaagtacgcccacacttgagttctctcttgccaaagtttattgcacatccttggtccgccccaactcctagggacaggaacatcatgatgactccaactaggatcatgggagacccagcatggcgtat

SEQ ID NO: 451119 - DNA, 140 bp, Artificial Sequence
  Synthetic
atacgccatgctgggtctccatactatccagaggacccagtaaaacttgcttcaatagtgaaagcttcctttgaggaaggaaagtgtggcttgaactcagtcgactccctggaacatgaacgtacttgggagtcggccat

SEQ ID NO: 451120 - DNA, 140 bp, Artificial Sequence
  Synthetic
atggccgactcccaagtacgttcatgttccagggagtcgactgagttcaagccacactttccttcctcaaaggaagctttcactattgaagcaagttttactgggtcctctggatagtatggagacccagcatggcgtat

SEQ ID NO: 451121 - DNA, 140 bp, Artificial Sequence
  Synthetic
aggccctggctgctgatatgttgaggaaggaaagtgtggcttgaactcagtcgactccctggaacatgaaatgtggagaagcagggcagatgagatcaatgccatccttgaggagaatgagaccttttgggacagcggtg

SEQ ID NO: 451122 - DNA, 140 bp, Artificial Sequence
  Synthetic
caccgctgtcccaaaaggtctcattctcctcaaggatggcattgatctcatctgccctgcttctccacatttcatgttccagggagtcgactgagttcaagccacactttccttcctcaacatatcagcagccagggcct

SEQ ID NO: 451123 - DNA, 140 bp, Artificial Sequence
  Synthetic
aggccctggctgctgatatgggtagacatctcagtggtggttcaagactcaaaaaacatttaccagagagggacacacccattttccagaatacgtgatggcctacaatatggctggaaggaccttttgggacagcggtg

SEQ ID NO: 451124 - DNA, 140 bp, Artificial Sequence
  Synthetic
caccgctgtcccaaaaggtccttccagccatattgtaggccatcacgtattctggaaaatgggtgtgtccctctctggtaaatgttttttgagtcttgaaccaccactgagatgtctacccatatcagcagccagggcct

SEQ ID NO: 451125 - DNA, 140 bp, Artificial Sequence
  Synthetic
aggccctggctgctgatatgccctggatgcaggtgccactagaggtgaaaagggaagcttgcccaggaaccagtgtggttgttgacggaggctgtgatgggcgtggaaagtcgaccagatgaccttttgggacagcggtg

SEQ ID NO: 451126 - DNA, 140 bp, Artificial Sequence
  Synthetic
caccgctgtcccaaaaggtcatctggtcgactttccacgcccatcacagcctccgtcaacaaccacactggttcctgggcaagcttcccttttcacctctagtggcacctgcatccagggcatatcagcagccagggcct

SEQ ID NO: 451127 - DNA, 140 bp, Artificial Sequence
  Synthetic
atacgccatgctgggtctccggagatcagaccaaagaagacacatgacagccatctggtccgctcatgggtgacggctggagagatccatgcaatcccctttgggttggtgagcatgatgcgtacttgggagtcggccat

SEQ ID NO: 451128 - DNA, 140 bp, Artificial Sequence
  Synthetic
atggccgactcccaagtacgcatcatgctcaccaacccaaaggggattgcatggatctctccagccgtcacccatgagcggaccagatggctgtcatgtgtcttctttggtctgatctccggagacccagcatggcgtat

SEQ ID NO: 451129 - DNA, 140 bp, Artificial Sequence
  Synthetic
atacgccatgctgggtctccagtcggaggcatggtgcttctgggagccatgttagttggacaggtgaccatcttggacttgttgaagctcacagtggcggttggattgcactttcatgagcgtacttgggagtcggccat

SEQ ID NO: 451130 - DNA, 140 bp, Artificial Sequence
  Synthetic
atggccgactcccaagtacgctcatgaaagtgcaatccaaccgccactgtgagcttcaacaagtccaagatggtcacctgtccaactaacatggctcccagaagcaccatgcctccgactggagacccagcatggcgtat

SEQ ID NO: 451131 - DNA, 140 bp, Artificial Sequence
  Synthetic
aggccctggctgctgatatgaatcagaccaggactgctcatcggctttggattgaggacgctatggagcccccgggaacgccttgtgctgaccctgggggccgctatggtggagattgctgaccttttgggacagcggtg

SEQ ID NO: 451132 - DNA, 140 bp, Artificial Sequence
  Synthetic
caccgctgtcccaaaaggtcagcaatctccaccatagcggcccccagggtcagcacaaggcgttcccgggggctccatagcgtcctcaatccaaagccgatgagcagtcctggtctgattcatatcagcagccagggcct

SEQ ID NO: 451133 - DNA, 140 bp, Artificial Sequence
  Synthetic
atacgccatgctgggtctcccactgacatcttacctaggactgacacagccctttttgggcttgtgtgccttcatggcaacccgaatattcgggcgaaggagcatcccagtgaatgaagccgtacttgggagtcggccat

SEQ ID NO: 451134 - DNA, 140 bp, Artificial Sequence
  Synthetic
atggccgactcccaagtacggcttcattcactgggatgctccttcgcccgaatattcgggttgccatgaaggcacacaagcccaaaaagggctgtgtcagtcctaggtaagatgtcagtgggagacccagcatggcgtat

SEQ ID NO: 451135 - DNA, 140 bp, Artificial Sequence
  Synthetic
atacgccatgctgggtctccagatggaaaattttctaggtccagtcgcagttgggggaatcctgatgatgctggtcagtgtggctgggagggtggatggacttgaactcaagaaacttggcgtacttgggagtcggccat

SEQ ID NO: 451136 - DNA, 140 bp, Artificial Sequence
  Synthetic
atggccgactcccaagtacgccaagtttcttgagttcaagtccatccaccctcccagccacactgaccagcatcatcaggattcccccaactgcgactggacctagaaaattttccatctggagacccagcatggcgtat

SEQ ID NO: 451137 - DNA, 140 bp, Artificial Sequence
  Synthetic
atacgccatgctgggtctccacgtcaaaggagccagaagaagtggagatgtcctttgggacattcccacacctaaaatcattgaggagtgtgaatatctagaggatggaatctacggcatcgtacttgggagtcggccat

SEQ ID NO: 451138 - DNA, 140 bp, Artificial Sequence
  Synthetic
atggccgactcccaagtacgatgccgtagattccatcctctagatattcacactcctcaatgattttaggtgtgggaatgtcccaaaggacatctccacttcttctggctcctttgacgtggagacccagcatggcgtat

SEQ ID NO: 451139 - DNA, 140 bp, Artificial Sequence
  Synthetic
aggccctggctgctgatatgcctaaaatcattgaggagtgtgaatatctagaggatggaatctacggcatatttcagtcaacattcctaggagcctctcaacggggagtgggagtggcgcgaccttttgggacagcggtg

SEQ ID NO: 451140 - DNA, 140 bp, Artificial Sequence
  Synthetic
caccgctgtcccaaaaggtcgcgccactcccactccccgttgagaggctcctaggaatgttgactgaaatatgccgtagattccatcctctagatattcacactcctcaatgattttaggcatatcagcagccagggcct

SEQ ID NO: 451141 - DNA, 140 bp, Artificial Sequence
  Synthetic
atacgccatgctgggtctccagggaggagtcttccacacgatgtggcatgtcacgagaggggcctttcttgttagaaacggcaaaaagctggttccatcctgggcctcagtcaaggaggacgtacttgggagtcggccat

SEQ ID NO: 451142 - DNA, 140 bp, Artificial Sequence
  Synthetic
atggccgactcccaagtacgtcctccttgactgaggcccaggatggaaccagctttttgccgtttctaacaagaaaggcccctctcgtgacatgccacatcgtgtggaagactcctccctggagacccagcatggcgtat

SEQ ID NO: 451143 - DNA, 140 bp, Artificial Sequence
  Synthetic
atacgccatgctgggtctccccttgttgcttatggcggctcatggaagttggagggtagatgggatggagaagaggaggttcagttgatagcagctgcccccgggaaaaatgtagtgaatcgtacttgggagtcggccat

SEQ ID NO: 451144 - DNA, 140 bp, Artificial Sequence
  Synthetic
atggccgactcccaagtacgattcactacatttttcccgggggcagctgctatcaactgaacctcctcttctccatcccatctaccctccaacttccatgagccgccataagcaacaaggggagacccagcatggcgtat

SEQ ID NO: 451145 - DNA, 140 bp, Artificial Sequence
  Synthetic
atacgccatgctgggtctccgtccagacaaagccaagcctatttaaagttaggaatggaggagaaatcggggcggttgcccttgactacccgagcggcacttctggttctcccatcgtcacgtacttgggagtcggccat

SEQ ID NO: 451146 - DNA, 140 bp, Artificial Sequence
  Synthetic
atggccgactcccaagtacgtgacgatgggagaaccagaagtgccgctcgggtagtcaagggcaaccgccccgatttctcctccattcctaactttaaataggcttggctttgtctggacggagacccagcatggcgtat

SEQ ID NO: 451147 - DNA, 140 bp, Artificial Sequence
  Synthetic
aggccctggctgctgatatgccattcttgatttccatcctggagctgggaaaacaagacgttttcttccccagatcctggctgaatgcgcacggagacggttgcgcacacttgtattggcgaccttttgggacagcggtg

SEQ ID NO: 451148 - DNA, 140 bp, Artificial Sequence
  Synthetic
caccgctgtcccaaaaggtcgccaatacaagtgtgcgcaaccgtctccgtgcgcattcagccaggatctggggaagaaaacgtcttgttttcccagctccaggatggaaatcaagaatggcatatcagcagccagggcct

SEQ ID NO: 451149 - DNA, 140 bp, Artificial Sequence
  Synthetic
atacgccatgctgggtctcctcccactagagttgttctctctgaaatgaaggaagcctttcacggcctagatgtcaagttccatacacaggccttctccgctcacggtagcggaaaagaacgtacttgggagtcggccat

SEQ ID NO: 451150 - DNA, 140 bp, Artificial Sequence
  Synthetic
atggccgactcccaagtacgttcttttccgctaccgtgagcggagaaggcctgtgtatggaacttgacatctaggccgtgaaaggcttccttcatttcagagagaacaactctagtgggaggagacccagcatggcgtat

SEQ ID NO: 451151 - DNA, 140 bp, Artificial Sequence
  Synthetic
aggccctggctgctgatatgttcctagtgagccttggaacacaggtcatgactggatcttggcggacaaaaggcccacggcctggtttcttccatccatcagggctgcaaatgtcatggcgaccttttgggacagcggtg

SEQ ID NO: 451152 - DNA, 140 bp, Artificial Sequence
  Synthetic
caccgctgtcccaaaaggtcgccatgacatttgcagccctgatggatggaagaaaccaggccgtgggccttttgtccgccaagatccagtcatgacctgtgttccaaggctcactaggaacatatcagcagccagggcct

SEQ ID NO: 451153 - DNA, 140 bp, Artificial Sequence
  Synthetic
aggccctggctgctgatatgaggcccacggcctggtttcttccatccatcagggctgcaaatgtcatggcagcctctttgcgcaaagctggaaagagtgtggtggtgctgaacaggaaaagaccttttgggacagcggtg

SEQ ID NO: 451154 - DNA, 140 bp, Artificial Sequence
  Synthetic
caccgctgtcccaaaaggtcttttcctgttcagcaccaccacactctttccagctttgcgcaaagaggctgccatgacatttgcagccctgatggatggaagaaaccaggccgtgggcctcatatcagcagccagggcct

SEQ ID NO: 451155 - DNA, 140 bp, Artificial Sequence
  Synthetic
atacgccatgctgggtctccgtgacctgcctgtttggctctcatggcaggtggctaaggccggattgaagacaaatgaccgaaagtggtgctttgagggcccagaagaacacgagatcttcgtacttgggagtcggccat

SEQ ID NO: 451156 - DNA, 140 bp, Artificial Sequence
  Synthetic
atggccgactcccaagtacgaagatctcgtgttcttctgggccctcaaagcaccactttcggtcatttgtcttcaatccggccttagccacctgccatgagagccaaacaggcaggtcacggagacccagcatggcgtat

SEQ ID NO: 451157 - DNA, 140 bp, Artificial Sequence
  Synthetic
atacgccatgctgggtctccgcgcttgccgacttcataaaatttgctgagggcaggagaggagctgctgagatgctggtcgtgctgagtgagctcccagacttcctggccaagaaaggtgcgtacttgggagtcggccat

SEQ ID NO: 451158 - DNA, 140 bp, Artificial Sequence
  Synthetic
atggccgactcccaagtacgcacctttcttggccaggaagtctgggagctcactcagcacgaccagcatctcagcagctcctctcctgccctcagcaaattttatgaagtcggcaagcgcggagacccagcatggcgtat

SEQ ID NO: 451159 - DNA, 140 bp, Artificial Sequence
  Synthetic
atacgccatgctgggtctccgagaggcggtggacactatcagcgtgttcttgcactctgaggagggttccagggcttaccgcaatgcattatcaatgatgcctgaggcaatgacaacagtcgtacttgggagtcggccat

SEQ ID NO: 451160 - DNA, 140 bp, Artificial Sequence
  Synthetic
atggccgactcccaagtacgactgttgtcattgcctcaggcatcattgataatgcattgcggtaagccctggaaccctcctcagagtgcaagaacacgctgatagtgtccaccgcctctcggagacccagcatggcgtat

SEQ ID NO: 451161 - DNA, 140 bp, Artificial Sequence
  Synthetic
aggccctggctgctgatatgagggcttaccgcaatgcattatcaatgatgcctgaggcaatgacaacagtcatgctgtttgttctggctgggctgctgacgtctggaatggttatcttctgaccttttgggacagcggtg

SEQ ID NO: 451162 - DNA, 140 bp, Artificial Sequence
  Synthetic
caccgctgtcccaaaaggtcagaagataaccattccagacgtcagcagcccagccagaacaaacagcatgactgttgtcattgcctcaggcatcattgataatgcattgcggtaagccctcatatcagcagccagggcct

SEQ ID NO: 451163 - DNA, 140 bp, Artificial Sequence
  Synthetic
atacgccatgctgggtctccctcctacatcatgctaatattttttgtcttgatggtggttgtggttccggagccagggcagcagaggaccattcaggacaaccaggtggcttatcttatccgtacttgggagtcggccat

SEQ ID NO: 451164 - DNA, 140 bp, Artificial Sequence
  Synthetic
atggccgactcccaagtacggataagataagccacctggttgtcctgaatggtcctctgctgccctggctccggaaccacaaccaccatcaagacaaaaaatattagcatgatgtaggagggagacccagcatggcgtat

SEQ ID NO: 451165 - DNA, 140 bp, Artificial Sequence
  Synthetic
atacgccatgctgggtctcctcatcctgcctggaattaaagcgcagcagtcaaagctggcacagaggagggtgtttcatggtgttgctaagaatccggtggttgatgggaatccaacagtcgtacttgggagtcggccat

SEQ ID NO: 451166 - DNA, 140 bp, Artificial Sequence
  Synthetic
atggccgactcccaagtacgactgttggattcccatcaaccaccggattcttagcaacaccatgaaacaccctcctctgtgccagctttgactgctgcgctttaattccaggcaggatgaggagacccagcatggcgtat

SEQ ID NO: 451167 - DNA, 140 bp, Artificial Sequence
  Synthetic
atacgccatgctgggtctcccactgtatcttctgcttgcccttagcttggcctctgttgccatgtgtagaacacctttttcactggctgaaggcattgtgctggcgtcagcagccctgggcgtacttgggagtcggccat

SEQ ID NO: 451168 - DNA, 140 bp, Artificial Sequence
  Synthetic
atggccgactcccaagtacgcccagggctgctgacgccagcacaatgccttcagccagtgaaaaaggtgttctacacatggcaacagaggccaagctaagggcaagcagaagatacagtgggagacccagcatggcgtat

SEQ ID NO: 451169 - DNA, 140 bp, Artificial Sequence
  Synthetic
atacgccatgctgggtctccgccgctcatagagggaaacaccagcctcttgtggaatggacccatggctgtgtccatgacaggagtcatgcgggggaactactacgcttttgtgggtgtccgtacttgggagtcggccat

SEQ ID NO: 451170 - DNA, 140 bp, Artificial Sequence
  Synthetic
atggccgactcccaagtacggacacccacaaaagcgtagtagttcccccgcatgactcctgtcatggacacagccatgggtccattccacaagaggctggtgtttccctctatgagcggcggagacccagcatggcgtat

SEQ ID NO: 451171 - DNA, 140 bp, Artificial Sequence
  Synthetic
aggccctggctgctgatatgtgtccatgacaggagtcatgcgggggaactactacgcttttgtgggtgtcatgtacaatctctggaagatgaagactgggcgcagggggagagcgaatgggaccttttgggacagcggtg

SEQ ID NO: 451172 - DNA, 140 bp, Artificial Sequence
  Synthetic
caccgctgtcccaaaaggtcccattcgctctccccctgcgcccagtcttcatcttccagagattgtacatgacacccacaaaagcgtagtagttcccccgcatgactcctgtcatggacacatatcagcagccagggcct

SEQ ID NO: 451173 - DNA, 140 bp, Artificial Sequence
  Synthetic
aggccctggctgctgatatgagctggaaggaagagtgactgacctgggatgtgggcgtggtggctggtgctactatgctgctgcacagaaagaggtgagtggggttaagggattcaccctgaccttttgggacagcggtg

SEQ ID NO: 451174 - DNA, 140 bp, Artificial Sequence
  Synthetic
caccgctgtcccaaaaggtcagggtgaatcccttaaccccactcacctctttctgtgcagcagcatagtagcaccagccaccacgcccacatcccaggtcagtcactcttccttccagctcatatcagcagccagggcct

SEQ ID NO: 451175 - DNA, 140 bp, Artificial Sequence
  Synthetic
atacgccatgctgggtctcctggaaaggaaggtcacgaaaaacccatgaatgtgcaaagcttggggtggaacatcatcactttcaaggataagactgatatccatcgccttgagccagtgcgtacttgggagtcggccat

SEQ ID NO: 451176 - DNA, 140 bp, Artificial Sequence
  Synthetic
atggccgactcccaagtacgcactggctcaaggcgatggatatcagtcttatccttgaaagtgatgatgttccaccccaagctttgcacattcatgggtttttcgtgaccttcctttccaggagacccagcatggcgtat

SEQ ID NO: 451177 - DNA, 140 bp, Artificial Sequence
  Synthetic
aggccctggctgctgatatgggttatcaggaatcctctctccagaaattctacccacgagatgtactatgtgtcaggagcccgcagcaacatcacgttcactgtgaatcaaacatcccgcgaccttttgggacagcggtg

SEQ ID NO: 451178 - DNA, 140 bp, Artificial Sequence
  Synthetic
caccgctgtcccaaaaggtcgcgggatgtttgattcacagtgaacgtgatgttgctgcgggctcctgacacatagtacatctcgtgggtagaatttctggagagaggattcctgataacccatatcagcagccagggcct

SEQ ID NO: 451179 - DNA, 140 bp, Artificial Sequence
  Synthetic
atacgccatgctgggtctcctgtcaggagcccgcagcaacatcacgttcactgtgaatcaaacatcccgcctcctaatgagaagaatgaggcgcccgacaggcaaagtgactcttgaagccgtacttgggagtcggccat

SEQ ID NO: 451180 - DNA, 140 bp, Artificial Sequence
  Synthetic
atggccgactcccaagtacggcttcaagagtcactttgcctgtcgggcgcctcattcttctcattaggaggcgggatgtttgattcacagtgaacgtgatgttgctgcgggctcctgacaggagacccagcatggcgtat

SEQ ID NO: 451181 - DNA, 140 bp, Artificial Sequence
  Synthetic
atacgccatgctgggtctccttattgcggttcctacgtcacaagaacctcagggagcgcagcaagcatgattaacggggtgatcaaaatcttgacatacccctgggacaggatagaggaacgtacttgggagtcggccat

SEQ ID NO: 451182 - DNA, 140 bp, Artificial Sequence
  Synthetic
atggccgactcccaagtacgttcctctatcctgtcccaggggtatgtcaagattttgatcaccccgttaatcatgcttgctgcgctccctgaggttcttgtgacgtaggaaccgcaataaggagacccagcatggcgtat

SEQ ID NO: 451183 - DNA, 140 bp, Artificial Sequence
  Synthetic
aggccctggctgctgatatgggaagatcatgaaggttgtcaataggtggctattccgtcacttggccagagaaaagaaccccaggctgtgtacaaaggaggagtttatagcaaaagttcggaccttttgggacagcggtg

SEQ ID NO: 451184 - DNA, 140 bp, Artificial Sequence
  Synthetic
caccgctgtcccaaaaggtccgaacttttgctataaactcctcctttgtacacagcctggggttcttttctctggccaagtgacggaatagccacctattgacaaccttcatgatcttcccatatcagcagccagggcct

SEQ ID NO: 451185 - DNA, 140 bp, Artificial Sequence
  Synthetic
aggccctggctgctgatatgctgccaatgaagctgtccaagatccaaaattctgggaattagtggatgaagagcgacggctacatcagcagggcaggtgtcggacctgtgtgtacaacatgaccttttgggacagcggtg

SEQ ID NO: 451186 - DNA, 140 bp, Artificial Sequence
  Synthetic
caccgctgtcccaaaaggtcatgttgtacacacaggtccgacacctgccctgctgatgtagccgtcgctcttcatccactaattcccagaattttggatcttggacagcttcattggcagcatatcagcagccagggcct

SEQ ID NO: 451187 - DNA, 140 bp, Artificial Sequence
  Synthetic
atacgccatgctgggtctccgatggggaagagagaaaagaaactgtcagaatttggaaaggcgaagggaagccgtgccatctggtacatgtggctgggagcccgatatcttgagtttgaacgtacttgggagtcggccat

SEQ ID NO: 451188 - DNA, 140 bp, Artificial Sequence
  Synthetic
atggccgactcccaagtacgttcaaactcaagatatcgggctcccagccacatgtaccagatggcacggcttcccttcgcctttccaaattctgacagtttcttttctctcttccccatcggagacccagcatggcgtat

SEQ ID NO: 451189 - DNA, 140 bp, Artificial Sequence
  Synthetic
atacgccatgctgggtctccgccgtgccatctggtacatgtggctgggagcccgatatcttgagtttgaagccctgggatttctgaatgaggaccactgggcatccagggagaactcaggcgtacttgggagtcggccat

SEQ ID NO: 451190 - DNA, 140 bp, Artificial Sequence
  Synthetic
atggccgactcccaagtacgcctgagttctccctggatgcccagtggtcctcattcagaaatcccagggcttcaaactcaagatatcgggctcccagccacatgtaccagatggcacggcggagacccagcatggcgtat

SEQ ID NO: 451191 - DNA, 140 bp, Artificial Sequence
  Synthetic
atacgccatgctgggtctccacctagctgcactagagggtggtggattctatgcggatgacacagctggatgggacacacgcataacagaggcggatctagatgatgaacaggagattttcgtacttgggagtcggccat

SEQ ID NO: 451192 - DNA, 140 bp, Artificial Sequence
  Synthetic
atggccgactcccaagtacgaaaatctcctgttcatcatctagatccgcctctgttatgcgtgtgtcccatccagctgtgtcatccgcatagaatccaccaccctctagtgcagctaggtggagacccagcatggcgtat

SEQ ID NO: 451193 - DNA, 140 bp, Artificial Sequence
  Synthetic
aggccctggctgctgatatgtgacatacaaaaataaagtggtgaaagtcctgaggccagctccaggtgggaaagcttacatggatgtcataagccggcgggaccagagaggatccggacagaccttttgggacagcggtg

SEQ ID NO: 451194 - DNA, 140 bp, Artificial Sequence
  Synthetic
caccgctgtcccaaaaggtctgtccggatcctctctggtcccgccggcttatgacatccatgtaagctttcccacctggagctggcctcaggactttcaccactttatttttgtatgtcacatatcagcagccagggcct

SEQ ID NO: 451195 - DNA, 140 bp, Artificial Sequence
  Synthetic
atacgccatgctgggtctccggtggtgacctacgccttgaataccatcaccaacctgaaggttcaactgattaggatggcagaggcagagatggtgatacaccaccagcatgtccaggaccgtacttgggagtcggccat

SEQ ID NO: 451196 - DNA, 140 bp, Artificial Sequence
  Synthetic
atggccgactcccaagtacggtcctggacatgctggtggtgtatcaccatctctgcctctgccatcctaatcagttgaaccttcaggttggtgatggtattcaaggcgtaggtcaccaccggagacccagcatggcgtat

SEQ ID NO: 451197 - DNA, 140 bp, Artificial Sequence
  Synthetic
atacgccatgctgggtctccggcccattgatgacaggtttggcctggctctgtcccatcttaacgccatgtcaaaggtgcgaaaggacatatctgaatggcagccatcaaaaggatgggacgtacttgggagtcggccat

SEQ ID NO: 451198 - DNA, 140 bp, Artificial Sequence
  Synthetic
atggccgactcccaagtacgtcccatccttttgatggctgccattcagatatgtcctttcgcacctttgacatggcgttaagatgggacagagccaggccaaacctgtcatcaatgggccggagacccagcatggcgtat

SEQ ID NO: 451199 - DNA, 140 bp, Artificial Sequence
  Synthetic
atacgccatgctgggtctcctgactgggagaacgtacctttctgctctcaccactttcatgaactgcaactgaaggatggcaggagaattgtagtgccttgccgagatcaagatgagctgcgtacttgggagtcggccat

SEQ ID NO: 451200 - DNA, 140 bp, Artificial Sequence
  Synthetic
atggccgactcccaagtacgcagctcatcttgatctcggcaaggcactacaattctcctgccatccttcagttgcagttcatgaaagtggtgagagcagaaaggtacgttctcccagtcaggagacccagcatggcgtat

SEQ ID NO: 451201 - DNA, 140 bp, Artificial Sequence
  Synthetic
atacgccatgctgggtctccgttggcagaggaagagtgtctccaggaaatggctggatgatcaaggagacagcatgtcttagcaaggcctacgccaacatgtggtcactgatgtactttccgtacttgggagtcggccat

SEQ ID NO: 451202 - DNA, 140 bp, Artificial Sequence
  Synthetic
atggccgactcccaagtacggaaagtacatcagtgaccacatgttggcgtaggccttgctaagacatgctgtctccttgatcatccagccatttcctggagacactcttcctctgccaacggagacccagcatggcgtat

SEQ ID NO: 451203 - DNA, 140 bp, Artificial Sequence
  Synthetic
atacgccatgctgggtctcctgggatgaccaacagagccacttgggcatctcacatccacttggtaatacaccgcatccggacactgattgggaaagagagatacactgactatctgacacgtacttgggagtcggccat

SEQ ID NO: 451204 - DNA, 140 bp, Artificial Sequence
  Synthetic
atggccgactcccaagtacgtgtcagatagtcagtgtatctctctttcccaatcagtgtccggatgcggtgtattaccaagtggatgtgagatgcccaagtggctctgttggtcatcccaggagacccagcatggcgtat

SEQ ID NO: 451205 - DNA, 140 bp, Artificial Sequence
  Synthetic
aggccctggctgctgatatgaccgcatccggacactgattgggaaagagagatacactgactatctgacagttatggataggtactctgtggatgctgatctgcagcccggtgagctcatgaccttttgggacagcggtg

SEQ ID NO: 451206 - DNA, 140 bp, Artificial Sequence
  Synthetic
caccgctgtcccaaaaggtcatgagctcaccgggctgcagatcagcatccacagagtacctatccataactgtcagatagtcagtgtatctctctttcccaatcagtgtccggatgcggtcatatcagcagccagggcct

SEQ ID NO: 451207 - DNA, 140 bp, Artificial Sequence
  Synthetic
atacgccatgctgggtctccttgagacaccactccaagaacaaccaagaactggaccttgtacataaaaacttaaaccgggataaaaactacggatggagaaccggactccacacattaacgtacttgggagtcggccat

SEQ ID NO: 451208 - DNA, 140 bp, Artificial Sequence
  Synthetic
atggccgactcccaagtacgttaatgtgtggagtccggttctccatccgtagtttttatcccggtttaagtttttatgtacaaggtccagttcttggttgttcttggagtggtgtctcaaggagacccagcatggcgtat

SEQ ID NO: 451209 - DNA, 140 bp, Artificial Sequence
  Synthetic
aggccctggctgctgatatggctgtgaggcagtgcaggctgggacagccgccttccaggttgcgaaaaacctggtttttgagacttcccacctcaaagcaaaaccaaatggagcctccgcgaccttttgggacagcggtg

SEQ ID NO: 451210 - DNA, 140 bp, Artificial Sequence
  Synthetic
caccgctgtcccaaaaggtcgcggaggctccatttggttttgctttgaggtgggaagtctcaaaaaccaggtttttcgcaacctggaaggcggctgtcccagcctgcactgcctcacagccatatcagcagccagggcct

SEQ ID NO: 451211 - DNA, 140 bp, Artificial Sequence
  Synthetic
aggccctggctgctgatatgtaggcaataaacacatttggattaattttgatcgttcgttgagcgattagcagagaactgaccagaaaatgtctggtcgcaaagctcagggaaaaaccctgaccttttgggacagcggtg

SEQ ID NO: 451212 - DNA, 140 bp, Artificial Sequence
  Synthetic
caccgctgtcccaaaaggtcagggtttttccctgagctttgcgaccagacattttctggtcagttctctgctaatcgctcaacgaacgatcaaaattaatccaaatgtgtttattgcctacatatcagcagccagggcct

SEQ ID NO: 451213 - DNA, 140 bp, Artificial Sequence
  Synthetic
atacgccatgctgggtctcccagagaactgaccagaaaatgtctggtcgcaaagctcagggaaaaaccctgggcgtcaatatggttcgacgaggagttcgctccttgtcaagcaaaataacgtacttgggagtcggccat

SEQ ID NO: 451214 - DNA, 140 bp, Artificial Sequence
  Synthetic
atggccgactcccaagtacgttattttgcttgacaaggagcgaactcctcgtcgaaccatattgacgcccagggtttttccctgagctttgcgaccagacattttctggtcagttctctgggagacccagcatggcgtat

SEQ ID NO: 451215 - DNA, 140 bp, Artificial Sequence
  Synthetic
atacgccatgctgggtctccttgtcctcgaggaaacgccgatcccaagatgttttaactgtgcaatttctgattctgggaatgctgctgatggttggtggagtgaccttggtacgtaaaacgtacttgggagtcggccat

SEQ ID NO: 451216 - DNA, 140 bp, Artificial Sequence
  Synthetic
atggccgactcccaagtacgttttacgtaccaaggtcactccaccaaccatcagcagcattcccagaatcagaaattgcacagttaaaacatcttgggatcggcgtttcctcgaggacaaggagacccagcatggcgtat

SEQ ID NO: 451217 - DNA, 140 bp, Artificial Sequence
  Synthetic
aggccctggctgctgatatgagcctgatgacatagactgctggtgttatggagtggaaaatgtcagagtcgcttatggcaagtgtgattcagctggtaggtcaagaaggtccagaagggcgaccttttgggacagcggtg

SEQ ID NO: 451218 - DNA, 140 bp, Artificial Sequence
  Synthetic
caccgctgtcccaaaaggtcgcccttctggaccttcttgacctaccagctgaatcacacttgccataagcgactctgacattttccactccataacaccagcagtctatgtcatcaggctcatatcagcagccagggcct

SEQ ID NO: 451219 - DNA, 140 bp, Artificial Sequence
  Synthetic
aggccctggctgctgatatgtatcactagaaacagttgccattgatggacctgctgaagcaaggaaggtgtgctacagtgcagtcttaaccaatgtgaagatcaatgacaagtgccccaggaccttttgggacagcggtg

SEQ ID NO: 451220 - DNA, 140 bp, Artificial Sequence
  Synthetic
caccgctgtcccaaaaggtcctggggcacttgtcattgatcttcacattggttaagactgcactgtagcacaccttccttgcttcagcaggtccatcaatggcaactgtttctagtgatacatatcagcagccagggcct

SEQ ID NO: 451221 - DNA, 140 bp, Artificial Sequence
  Synthetic
atacgccatgctgggtctcctgctacagtgcagtcttaaccaatgtgaagatcaatgacaagtgccccagcactggtgaagcccacttggaagaagaaaatgaaggagacaatgcttgtacgtacttgggagtcggccat

SEQ ID NO: 451222 - DNA, 140 bp, Artificial Sequence
  Synthetic
atggccgactcccaagtacgtacaagcattgtctccttcattttcttcttccaagtgggcttcaccagtgctggggcacttgtcattgatcttcacattggttaagactgcactgtagcaggagacccagcatggcgtat

SEQ ID NO: 451223 - DNA, 140 bp, Artificial Sequence
  Synthetic
aggccctggctgctgatatgaaaggaagcattgtggcatgtgccaagtttacctgtgctaaatccatgagtctatttgaggttgatcagaccaaaatccagtatgtcatcagggcacagcgaccttttgggacagcggtg

SEQ ID NO: 451224 - DNA, 140 bp, Artificial Sequence
  Synthetic
caccgctgtcccaaaaggtcgctgtgccctgatgacatactggattttggtctgatcaacctcaaatagactcatggatttagcacaggtaaacttggcacatgccacaatgcttcctttcatatcagcagccagggcct

SEQ ID NO: 451225 - DNA, 140 bp, Artificial Sequence
  Synthetic
atacgccatgctgggtctcctgcatgtcggagccaagcaggagaattggaatactgacatcaaaactctcaagtttgatgccctgtcaggatctcaggaagctgagttcactggatacggcgtacttgggagtcggccat

SEQ ID NO: 451226 - DNA, 140 bp, Artificial Sequence
  Synthetic
atggccgactcccaagtacgccgtatccagtgaactcagcttcctgagatcctgacagggcatcaaacttgagagttttgatgtcagtattccaattctcctgcttggctccgacatgcaggagacccagcatggcgtat

SEQ ID NO: 451227 - DNA, 140 bp, Artificial Sequence
  Synthetic
atacgccatgctgggtctccgagggccacactggagtgccaggtacagaccgcagtggacttcagcaacagttacatcgcagagatggagaaagagagctggattgtggataaacagtggcgtacttgggagtcggccat

SEQ ID NO: 451228 - DNA, 140 bp, Artificial Sequence
  Synthetic
atggccgactcccaagtacgccactgtttatccacaatccagctctctttctccatctctgcgatgtaactgttgctgaagtccactgcggtctgtacctggcactccagtgtggccctcggagacccagcatggcgtat

SEQ ID NO: 451229 - DNA, 140 bp, Artificial Sequence
  Synthetic
atacgccatgctgggtctcccagttaacaagggcattctggtcacagtcaatccaatagcctccactaatgacgatgaagtgttgatcgaggtgaaccctccttttggggacagctacatcgtacttgggagtcggccat

SEQ ID NO: 451230 - DNA, 140 bp, Artificial Sequence
  Synthetic
atggccgactcccaagtacgatgtagctgtccccaaaaggagggttcacctcgatcaacacttcatcgtcattagtggaggctattggattgactgtgaccagaatgcccttgttaactgggagacccagcatggcgtat

SEQ ID NO: 451231 - DNA, 140 bp, Artificial Sequence
  Synthetic
atacgccatgctgggtctcccatagttggaacaggggattcacgcttgacctaccagtggcacaaagaaggcagctcaatagggaagttgttcactcagaccatgaaaggcgcggagcgccgtacttgggagtcggccat

SEQ ID NO: 451232 - DNA, 140 bp, Artificial Sequence
  Synthetic
atggccgactcccaagtacggcgctccgcgcctttcatggtctgagtgaacaacttccctattgagctgccttctttgtgccactggtaggtcaagcgtgaatcccctgttccaactatgggagacccagcatggcgtat

SEQ ID NO: 451233 - DNA, 140 bp, Artificial Sequence
  Synthetic
atacgccatgctgggtctccctggccgtcatgggggatgctgcctgggacttcggctctgctgggggttttttcacatcagtcggaaaaggtatacacactgtgtttggttctgccttcccgtacttgggagtcggccat

SEQ ID NO: 451234 - DNA, 140 bp, Artificial Sequence
  Synthetic
atggccgactcccaagtacgggaaggcagaaccaaacacagtgtgtataccttttccgactgatgtgaaaaaacccccagcagagccgaagtcccaggcagcatcccccatgacggccagggagacccagcatggcgtat

SEQ ID NO: 451235 - DNA, 140 bp, Artificial Sequence
  Synthetic
atacgccatgctgggtctccgatggcatcttcgtctttagagattcagatgactggctgaacaagtactcatattatccagaggacccagtaaaacttgcctcaatagtgaaagcttcctcgtacttgggagtcggccat

SEQ ID NO: 451236 - DNA, 140 bp, Artificial Sequence
  Synthetic
atggccgactcccaagtacgaggaagctttcactattgaggcaagttttactgggtcctctggataatatgagtacttgttcagccagtcatctgaatctctaaagacgaagatgccatcggagacccagcatggcgtat

SEQ ID NO: 451237 - DNA, 140 bp, Artificial Sequence
  Synthetic
aggccctggctgctgatatgcatcatagatgggaagtccaggaaagagtgtccgttttcaaacagagtgtggaattccttccagatagaagagtttgggacaggagtgttcaccactcgagaccttttgggacagcggtg

SEQ ID NO: 451238 - DNA, 140 bp, Artificial Sequence
  Synthetic
caccgctgtcccaaaaggtctcgagtggtgaacactcctgtcccaaactcttctatctggaaggaattccacactctgtttgaaaacggacactctttcctggacttcccatctatgatgcatatcagcagccagggcct

SEQ ID NO: 451239 - DNA, 140 bp, Artificial Sequence
  Synthetic
aggccctggctgctgatatgcctgggtgcagcagtgaatggaaagaagagcgcgcatgggtccccaacattctggatgggaagccatgaggtgaatggaacatggatgattcacaccctagaccttttgggacagcggtg

SEQ ID NO: 451240 - DNA, 140 bp, Artificial Sequence
  Synthetic
caccgctgtcccaaaaggtctagggtgtgaatcatccatgttccattcacctcatggcttcccatccagaatgttggggacccatgcgcgctcttctttccattcactgctgcacccaggcatatcagcagccagggcct

SEQ ID NO: 451241 - DNA, 140 bp, Artificial Sequence
  Synthetic
aggccctggctgctgatatgacaatgccacccgtgagcttccacgggagtgatggctgctggtatcctatggagatcagaccaaggaagacacatgacagccacctggtccgctcatggggaccttttgggacagcggtg

SEQ ID NO: 451242 - DNA, 140 bp, Artificial Sequence
  Synthetic
caccgctgtcccaaaaggtccccatgagcggaccaggtggctgtcatgtgtcttccttggtctgatctccataggataccagcagccatcactcccgtggaagctcacgggtggcattgtcatatcagcagccagggcct

SEQ ID NO: 451243 - DNA, 140 bp, Artificial Sequence
  Synthetic
aggccctggctgctgatatgtcttggacttgttgaagctcacagtggcggttggattgcactttcatgaaatgaataatggaggcgatgccatgtatatggccttgatcgctgctttctcgaccttttgggacagcggtg

SEQ ID NO: 451244 - DNA, 140 bp, Artificial Sequence
  Synthetic
caccgctgtcccaaaaggtcgagaaagcagcgatcaaggccatatacatggcatcgcctccattattcatttcatgaaagtgcaatccaaccgccactgtgagcttcaacaagtccaagacatatcagcagccagggcct

SEQ ID NO: 451245 - DNA, 140 bp, Artificial Sequence
  Synthetic
atacgccatgctgggtctccttgggtggcatgacgggaggactgtggaagtacctgaatgcagtatccctttgcatcctgacaataaatgctgttgcctccagaaaagcatcaaatgccacgtacttgggagtcggccat

SEQ ID NO: 451246 - DNA, 140 bp, Artificial Sequence
  Synthetic
atggccgactcccaagtacgtggcatttgatgcttttctggaggcaacagcatttattgtcaggatgcaaagggatactgcattcaggtacttccacagtcctcccgtcatgccacccaaggagacccagcatggcgtat

SEQ ID NO: 451247 - DNA, 140 bp, Artificial Sequence
  Synthetic
atacgccatgctgggtctccagaagtttcttgggaagaggaagctgagatcagtggaagttctgcccgctatgatgtgactctcagtgagcaaggggaatttaaactactctctgaagagcgtacttgggagtcggccat

SEQ ID NO: 451248 - DNA, 140 bp, Artificial Sequence
  Synthetic
atggccgactcccaagtacgctcttcagagagtagtttaaattccccttgctcactgagagtcacatcatagcgggcagaacttccactgatctcagcttcctcttcccaagaaacttctggagacccagcatggcgtat

SEQ ID NO: 451249 - DNA, 140 bp, Artificial Sequence
  Synthetic
atacgccatgctgggtctccagggaggggtcttccatacgatgtggcacgtcacgcgaggggcctttctcgtcagaaacggcaaaaagttggttccatcctgggcctcagtcaaggaagacgtacttgggagtcggccat

SEQ ID NO: 451250 - DNA, 140 bp, Artificial Sequence
  Synthetic
atggccgactcccaagtacgtcttccttgactgaggcccaggatggaaccaactttttgccgtttctgacgagaaaggcccctcgcgtgacgtgccacatcgtatggaagacccctccctggagacccagcatggcgtat

SEQ ID NO: 451251 - DNA, 140 bp, Artificial Sequence
  Synthetic
atacgccatgctgggtctccccttgttgcttatggcggctcatggaagttggagggcagatgggatggagaagaggaggttcagttgatagctgctgcccccggaaaaaacgtggtgaatcgtacttgggagtcggccat

SEQ ID NO: 451252 - DNA, 140 bp, Artificial Sequence
  Synthetic
atggccgactcccaagtacgattcaccacgttttttccgggggcagcagctatcaactgaacctcctcttctccatcccatctgccctccaacttccatgagccgccataagcaacaaggggagacccagcatggcgtat

SEQ ID NO: 451253 - DNA, 140 bp, Artificial Sequence
  Synthetic
aggccctggctgctgatatgaagaggaggttcagttgatagctgctgcccccggaaaaaacgtggtgaatgtccagacaaaaccaagcctattcaaagttaggaatggaggggaaatcgggaccttttgggacagcggtg

SEQ ID NO: 451254 - DNA, 140 bp, Artificial Sequence
  Synthetic
caccgctgtcccaaaaggtcccgatttcccctccattcctaactttgaataggcttggttttgtctggacattcaccacgttttttccgggggcagcagctatcaactgaacctcctcttcatatcagcagccagggcct

SEQ ID NO: 451255 - DNA, 140 bp, Artificial Sequence
  Synthetic
atacgccatgctgggtctccatgtcaagttccacacacaggccttctccgcccacggtagcggaaaagaagtcattgacgccatgtgtcatgctaccctgacatatagaatgttggaacccgtacttgggagtcggccat

SEQ ID NO: 451256 - DNA, 140 bp, Artificial Sequence
  Synthetic
atggccgactcccaagtacgggttccaacattctatatgtcagggtagcatgacacatggcgtcaatgacttcttttccgctaccgtgggcggagaaggcctgtgtgtggaacttgacatggagacccagcatggcgtat

SEQ ID NO: 451257 - DNA, 140 bp, Artificial Sequence
  Synthetic
aggccctggctgctgatatggtcattgacgccatgtgtcatgctaccctgacatatagaatgttggaaccgaccagagtggtcaattgggaagtgatcatcatggacgaagcacatttttgaccttttgggacagcggtg

SEQ ID NO: 451258 - DNA, 140 bp, Artificial Sequence
  Synthetic
caccgctgtcccaaaaggtcaaaaatgtgcttcgtccatgatgatcacttcccaattgaccactctggtcggttccaacattctatatgtcagggtagcatgacacatggcgtcaatgaccatatcagcagccagggcct

SEQ ID NO: 451259 - DNA, 140 bp, Artificial Sequence
  Synthetic
atacgccatgctgggtctcctcatcctgcctggaatcaaggcgcagcaatcaaagctggcacagaggagggtgtttcatggtgttgccaagaatccggtggttgacgggaatccaacagtcgtacttgggagtcggccat

SEQ ID NO: 451260 - DNA, 140 bp, Artificial Sequence
  Synthetic
atggccgactcccaagtacgactgttggattcccgtcaaccaccggattcttggcaacaccatgaaacaccctcctctgtgccagctttgattgctgcgccttgattccaggcaggatgaggagacccagcatggcgtat

SEQ ID NO: 451261 - DNA, 140 bp, Artificial Sequence
  Synthetic
atacgccatgctgggtctcctgacattgaggaagccccggaaatgcctgccctctatgagaaaaagttggcattgtatcttctgcttgccctcagcttggcctctgttgccatgtgcagacgtacttgggagtcggccat

SEQ ID NO: 451262 - DNA, 140 bp, Artificial Sequence
  Synthetic
atggccgactcccaagtacgtctgcacatggcaacagaggccaagctgagggcaagcagaagatacaatgccaactttttctcatagagggcaggcatttccggggcttcctcaatgtcaggagacccagcatggcgtat

SEQ ID NO: 451263 - DNA, 140 bp, Artificial Sequence
  Synthetic
aggccctggctgctgatatggccactcatagagggaaacaccagcctcttgtggaatggacccatggctgtgtccatgacaggagtcatgcgggggaactactatgcatttgtgggtgtcgaccttttgggacagcggtg

SEQ ID NO: 451264 - DNA, 140 bp, Artificial Sequence
  Synthetic
caccgctgtcccaaaaggtcgacacccacaaatgcatagtagttcccccgcatgactcctgtcatggacacagccatgggtccattccacaagaggctggtgtttccctctatgagtggccatatcagcagccagggcct

SEQ ID NO: 451265 - DNA, 140 bp, Artificial Sequence
  Synthetic
atacgccatgctgggtctccacagctcgccgacacctagctgaagggaaagtggacaccggagtggctgtctcgagagggaccgcaaaattgagatggttccatgaacgtggctatgttacgtacttgggagtcggccat

SEQ ID NO: 451266 - DNA, 140 bp, Artificial Sequence
  Synthetic
atggccgactcccaagtacgtaacatagccacgttcatggaaccatctcaattttgcggtccctctcgagacagccactccggtgtccactttcccttcagctaggtgtcggcgagctgtggagacccagcatggcgtat

SEQ ID NO: 451267 - DNA, 140 bp, Artificial Sequence
  Synthetic
aggccctggctgctgatatgctcgagagggaccgcaaaattgagatggttccatgaacgtggctatgttaagctggaaggaagagtgactgacctgggatgtgggcgtggtggctggtgcgaccttttgggacagcggtg

SEQ ID NO: 451268 - DNA, 140 bp, Artificial Sequence
  Synthetic
caccgctgtcccaaaaggtcgcaccagccaccacgcccacatcccaggtcagtcactcttccttccagcttaacatagccacgttcatggaaccatctcaattttgcggtccctctcgagcatatcagcagccagggcct

SEQ ID NO: 451269 - DNA, 140 bp, Artificial Sequence
  Synthetic
aggccctggctgctgatatgacatcatcactttcaaggataagactgatgtccatcgccttgagccagtgaagtgtgacaccctgctgtgcgacattggagagtcgtctccatcatcagtgaccttttgggacagcggtg

SEQ ID NO: 451270 - DNA, 140 bp, Artificial Sequence
  Synthetic
caccgctgtcccaaaaggtcactgatgatggagacgactctccaatgtcgcacagcagggtgtcacacttcactggctcaaggcgatggacatcagtcttatccttgaaagtgatgatgtcatatcagcagccagggcct

SEQ ID NO: 451271 - DNA, 140 bp, Artificial Sequence
  Synthetic
atacgccatgctgggtctccccagatgtgcttgaaaagttagagctgctccaaaggaggtttggtggaacggttatcaggaatcctctctctagaaattctacccacgagatgtattatgcgtacttgggagtcggccat

SEQ ID NO: 451272 - DNA, 140 bp, Artificial Sequence
  Synthetic
atggccgactcccaagtacgcataatacatctcgtgggtagaatttctagagagaggattcctgataaccgttccaccaaacctcctttggagcagctctaacttttcaagcacatctggggagacccagcatggcgtat

SEQ ID NO: 451273 - DNA, 140 bp, Artificial Sequence
  Synthetic
aggccctggctgctgatatgggttatcaggaatcctctctctagaaattctacccacgagatgtattatgtgtcaggagcccgcagcaacatcgcgttcactgtgaatcaaacatctcgcgaccttttgggacagcggtg

SEQ ID NO: 451274 - DNA, 140 bp, Artificial Sequence
  Synthetic
caccgctgtcccaaaaggtcgcgagatgtttgattcacagtgaacgcgatgttgctgcgggctcctgacacataatacatctcgtgggtagaatttctagagagaggattcctgataacccatatcagcagccagggcct

SEQ ID NO: 451275 - DNA, 140 bp, Artificial Sequence
  Synthetic
aggccctggctgctgatatgctcttaatgaggagaatgaggcgcccgacaggcaaagtgactcttgaagccgatgttatcctcccaattggaacacgcagtgtggaaacagacaaaggacgaccttttgggacagcggtg

SEQ ID NO: 451276 - DNA, 140 bp, Artificial Sequence
  Synthetic
caccgctgtcccaaaaggtcgtcctttgtctgtttccacactgcgtgttccaattgggaggataacatcggcttcaagagtcactttgcctgtcgggcgcctcattctcctcattaagagcatatcagcagccagggcct

SEQ ID NO: 451277 - DNA, 140 bp, Artificial Sequence
  Synthetic
atacgccatgctgggtctcccacttgatagggcagccattgaagagagggttgaaagaataaaatctgaatacaccgccacttggtttcatgataatgataacccttacaggacttggcacgtacttgggagtcggccat

SEQ ID NO: 451278 - DNA, 140 bp, Artificial Sequence
  Synthetic
atggccgactcccaagtacgtgccaagtcctgtaagggttatcattatcatgaaaccaagtggcggtgtattcagattttattctttcaaccctctcttcaatggctgccctatcaagtgggagacccagcatggcgtat

SEQ ID NO: 451279 - DNA, 140 bp, Artificial Sequence
  Synthetic
aggccctggctgctgatatggccctgggatttctgaatgaggaccactgggcatccagggagaactcagggggaggggttgaaggtatcggtctacaatatctaggctacgtgatcaggggaccttttgggacagcggtg

SEQ ID NO: 451280 - DNA, 140 bp, Artificial Sequence
  Synthetic
caccgctgtcccaaaaggtcccctgatcacgtagcctagatattgtagaccgataccttcaacccctccccctgagttctccctggatgcccagtggtcctcattcagaaatcccagggccatatcagcagccagggcct

SEQ ID NO: 451281 - DNA, 140 bp, Artificial Sequence
  Synthetic
atacgccatgctgggtctcctgacatacaaaaataaagtggtgaaagttctgagaccagctccaggtgggaaagcctacatggatgtcataagccggcgggaccaaagaggatccgggcacgtacttgggagtcggccat

SEQ ID NO: 451282 - DNA, 140 bp, Artificial Sequence
  Synthetic
atggccgactcccaagtacgtgcccggatcctctttggtcccgccggcttatgacatccatgtaggctttcccacctggagctggtctcagaactttcaccactttatttttgtatgtcaggagacccagcatggcgtat

SEQ ID NO: 451283 - DNA, 140 bp, Artificial Sequence
  Synthetic
atacgccatgctgggtctcctgtgacgacacggttttgaccaaacttgaagcatggctcgctgagcatggctgcgacaggctgaagaggatggcagtgagtggagatgactgtgttgtcccgtacttgggagtcggccat

SEQ ID NO: 451284 - DNA, 140 bp, Artificial Sequence
  Synthetic
atggccgactcccaagtacgggacaacacagtcatctccactcactgccatcctcttcagcctgtcgcagccatgctcagcgagccatgcttcaagtttggtcaaaaccgtgtcgtcacaggagacccagcatggcgtat

SEQ ID NO: 451285 - DNA, 140 bp, Artificial Sequence
  Synthetic
aggccctggctgctgatatgtcaaaggtgcgaaaggacatatctgaatggcagccatcaaaaggatgggatgattgggagaatgtacctttctgctctcaccatttccatgaattgcaacgaccttttgggacagcggtg

SEQ ID NO: 451286 - DNA, 140 bp, Artificial Sequence
  Synthetic
caccgctgtcccaaaaggtcgttgcaattcatggaaatggtgagagcagaaaggtacattctcccaatcatcccatccttttgatggctgccattcagatatgtcctttcgcacctttgacatatcagcagccagggcct

SEQ ID NO: 451287 - DNA, 140 bp, Artificial Sequence
  Synthetic
atacgccatgctgggtctcctgattgggagaatgtacctttctgctctcaccatttccatgaattgcaactgaaggatggcaggagagttgtagtgccttgtcgggatcaagatgagctgcgtacttgggagtcggccat

SEQ ID NO: 451288 - DNA, 140 bp, Artificial Sequence
  Synthetic
atggccgactcccaagtacgcagctcatcttgatcccgacaaggcactacaactctcctgccatccttcagttgcaattcatggaaatggtgagagcagaaaggtacattctcccaatcaggagacccagcatggcgtat

SEQ ID NO: 451289 - DNA, 140 bp, Artificial Sequence
  Synthetic
aggccctggctgctgatatgacatcttgggttccacagggacgcactacgtggtctgttcatgggaaaggagagtggatgaccacagaggacatgcttgaagtgtggaacagagtgtggagaccttttgggacagcggtg

SEQ ID NO: 451290 - DNA, 140 bp, Artificial Sequence
  Synthetic
caccgctgtcccaaaaggtctccacactctgttccacacttcaagcatgtcctctgtggtcatccactctcctttcccatgaacagaccacgtagtgcgtccctgtggaacccaagatgtcatatcagcagccagggcct

SEQ ID NO: 451291 - DNA, 140 bp, Artificial Sequence
  Synthetic
atacgccatgctgggtctccctgagacaccgttccaagaacaaccaagaactggaccttgtacatagaataaaactgaaaccgggataaaaactacggatggagaaccggactccacacacgtacttgggagtcggccat

SEQ ID NO: 451292 - DNA, 140 bp, Artificial Sequence
  Synthetic
atggccgactcccaagtacgtgtgtggagtccggttctccatccgtagtttttatcccggtttcagttttattctatgtacaaggtccagttcttggttgttcttggaacggtgtctcagggagacccagcatggcgtat

SEQ ID NO: 451293 - DNA, 140 bp, Artificial Sequence
  Synthetic
aggccctggctgctgatatgaggagaccctccagggaacaaatagtgggatgtcagcccagaaacccgcgtgggttctgccactgctaagctgtgaggcagtgcaggctgggacagccgcgaccttttgggacagcggtg

SEQ ID NO: 451294 - DNA, 140 bp, Artificial Sequence
  Synthetic
caccgctgtcccaaaaggtcgcggctgtcccagcctgcactgcctcacagcttagcagtggcagaacccacgcgggtttctgggctgacatcccactatttgttccctggagggtctcctcatatcagcagccagggcct

SEQ ID NO: 451295 - DNA, 140 bp, Artificial Sequence
  Synthetic
aggccctggctgctgatatgacagatggttacttctgaatgttacatctgaggaccttgggaaaaccttttctgttggcacaggtaactgcacaaccaacattctggaggccaaatactggaccttttgggacagcggtg

SEQ ID NO: 451296 - DNA, 140 bp, Artificial Sequence
  Synthetic
caccgctgtcccaaaaggtccagtatttggcctccagaatgttggttgtgcagttacctgtgccaacagaaaaggttttcccaaggtcctcagatgtaacattcagaagtaaccatctgtcatatcagcagccagggcct

SEQ ID NO: 451297 - DNA, 140 bp, Artificial Sequence
  Synthetic
atacgccatgctgggtctcctggctggtaaggaaccccttttttgcggcaacagccttggccattgcctacctggtggggagcaacatgacgcaacgagttgtcatagccctgctagtctcgtacttgggagtcggccat

SEQ ID NO: 451298 - DNA, 140 bp, Artificial Sequence
  Synthetic
atggccgactcccaagtacgagactagcagggctatgacaactcgttgcgtcatgttgctccccaccaggtaggcaatggccaaggctgttgccgcaaaaaaggggttccttaccagccaggagacccagcatggcgtat

SEQ ID NO: 451299 - DNA, 140 bp, Artificial Sequence
  Synthetic
atacgccatgctgggtctccgaaggccacactggagtgccaggttcagaccgcagtggacttcagcaatagttacatcgcagagagagagaaagagagctggattgtggacaaacagtggcgtacttgggagtcggccat

SEQ ID NO: 451300 - DNA, 140 bp, Artificial Sequence
  Synthetic
atggccgactcccaagtacgccactgtttgtccacaatccagctctctttctctctctctgcgatgtaactattgctgaagtccactgcggtctgaacctggcactccagtgtggccttcggagacccagcatggcgtat

SEQ ID NO: 451301 - DNA, 140 bp, Artificial Sequence
  Synthetic
atacgccatgctgggtctccgggagcaccctgcagaataccagtaatggttgccgatgatctcacagcggcagtcaacaagggcatcttggtcacagtcaatccaatagcctccactaatcgtacttgggagtcggccat

SEQ ID NO: 451302 - DNA, 140 bp, Artificial Sequence
  Synthetic
atggccgactcccaagtacgattagtggaggctattggattgactgtgaccaagatgcccttgttgactgccgctgtgagatcatcggcaaccattactggtattctgcagggtgctcccggagacccagcatggcgtat

SEQ ID NO: 451303 - DNA, 140 bp, Artificial Sequence
  Synthetic
atacgccatgctgggtctccttaggtggcatgatgggaggtctgtggaagtacctgaatgcagtatccctttgcatcctgacaataaatgctgttgcctccagaaaagcatcaaatgtcacgtacttgggagtcggccat

SEQ ID NO: 451304 - DNA, 140 bp, Artificial Sequence
  Synthetic
atggccgactcccaagtacgtgacatttgatgcttttctggaggcaacagcatttattgtcaggatgcaaagggatactgcattcaggtacttccacagacctcccatcatgccacctaaggagacccagcatggcgtat

SEQ ID NO: 451305 - DNA, 140 bp, Artificial Sequence
  Synthetic
aggccctggctgctgatatgagggaggggtcttccacacgatgtggcacgtcacgagaggggcctttctcgttagaaacggcaaaaagttggttccatcctgggcctcagtcaaggaggagaccttttgggacagcggtg

SEQ ID NO: 451306 - DNA, 140 bp, Artificial Sequence
  Synthetic
caccgctgtcccaaaaggtctcctccttgactgaggcccaggatggaaccaactttttgccgtttctaacgagaaaggcccctctcgtgacgtgccacatcgtgtggaagacccctccctcatatcagcagccagggcct

SEQ ID NO: 451307 - DNA, 140 bp, Artificial Sequence
  Synthetic
aggccctggctgctgatatgccattcttgatttccatcctggagctgggaaaacaagacgttttcttccccagatcctggccgaatgcgcacggagacggttgcgcacacttgtgctggcgaccttttgggacagcggtg

SEQ ID NO: 451308 - DNA, 140 bp, Artificial Sequence
  Synthetic
caccgctgtcccaaaaggtcgccagcacaagtgtgcgcaaccgtctccgtgcgcattcggccaggatctggggaagaaaacgtcttgttttcccagctccaggatggaaatcaagaatggcatatcagcagccagggcct

SEQ ID NO: 451309 - DNA, 140 bp, Artificial Sequence
  Synthetic
atacgccatgctgggtctcctagatccggctagcatagcagccagaggctgggcggcacatagagccagagcaaatgaaagtgcaacaatcttgatgactgccacccctccgggaactagcgtacttgggagtcggccat

SEQ ID NO: 451310 - DNA, 140 bp, Artificial Sequence
  Synthetic
atggccgactcccaagtacgctagttcccggaggggtggcagtcatcaagattgttgcactttcatttgctctggctctatgtgccgcccagcctctggctgctatgctagccggatctaggagacccagcatggcgtat

SEQ ID NO: 451311 - DNA, 140 bp, Artificial Sequence
  Synthetic
aggccctggctgctgatatgagcctctttgcgcaaagctggaaagagtgtggtggtgctgaacaggaaaacctttgagaaagaataccccacaattaaacagaaaaaacctgatttcatcgaccttttgggacagcggtg

SEQ ID NO: 451312 - DNA, 140 bp, Artificial Sequence
  Synthetic
caccgctgtcccaaaaggtcgatgaaatcaggttttttctgtttaattgtggggtattctttctcaaaggttttcctgttcagcaccaccacactctttccagctttgcgcaaagaggctcatatcagcagccagggcct

SEQ ID NO: 451313 - DNA, 140 bp, Artificial Sequence
  Synthetic
atacgccatgctgggtctccgaccgaaggggaaaggaccatgagagttcttgacactgttgagaaatggttgggctgtggcgttgaaagcttctgtgtgaaggtgttggctccatacatgcgtacttgggagtcggccat

SEQ ID NO: 451314 - DNA, 140 bp, Artificial Sequence
  Synthetic
atggccgactcccaagtacgcatgtatggagccaacaccttcacacagaagctttcaacgccacagcccaaccatttctcaacagtgtcaagaactctcatggtcctttccccttcggtcggagacccagcatggcgtat

SEQ ID NO: 451315 - DNA, 140 bp, Artificial Sequence
  Synthetic
atacgccatgctgggtctccgaactacatgagtccacaccacaggaagctagcgctggctgtaatggaaatgacatacaaaaataaagtggtgaaagtcctgaggccagctccaggtgggcgtacttgggagtcggccat

SEQ ID NO: 451316 - DNA, 140 bp, Artificial Sequence
  Synthetic
atggccgactcccaagtacgcccacctggagctggcctcaggactttcaccactttatttttgtatgtcatttccattacagccagcgctagcttcctgtggtgtggactcatgtagttcggagacccagcatggcgtat

SEQ ID NO: 451317 - DNA, 140 bp, Artificial Sequence
  Synthetic
atacgccatgctgggtctccacaagagggacatgaggctgctttcactggctgtttcttctgctgttcccacatcttgggttccacagggacgcaccacgtggtctgttcatgggaaaggcgtacttgggagtcggccat

SEQ ID NO: 451318 - DNA, 140 bp, Artificial Sequence
  Synthetic
atggccgactcccaagtacgcctttcccatgaacagaccacgtggtgcgtccctgtggaacccaagatgtgggaacagcagaagaaacagccagtgaaagcagcctcatgtccctcttgtggagacccagcatggcgtat

SEQ ID NO: 451319 - DNA, 140 bp, Artificial Sequence
  Synthetic
aggccctggctgctgatatgctggtttctgagacttcccacctcagagtaaaaccaaatggagcctccgctaccacctccccacgtggtggtagaaagatggggtctagaggttagaggagaccttttgggacagcggtg

SEQ ID NO: 451320 - DNA, 140 bp, Artificial Sequence
  Synthetic
caccgctgtcccaaaaggtctcctctaacctctagaccccatctttctaccaccacgtggggaggtggtagcggaggctccatttggttttactctgaggtgggaagtctcagaaaccagcatatcagcagccagggcct

SEQ ID NO: 451321 - DNA, 140 bp, Artificial Sequence
  Synthetic
aggccctggctgctgatatggaccctccagggaataaatagtgggatgtcagcccagaaacccgcgtgggttctgccactgctaagctgtgaggcagtgcaggctgggacagccgctttcgaccttttgggacagcggtg

SEQ ID NO: 451322 - DNA, 140 bp, Artificial Sequence
  Synthetic
caccgctgtcccaaaaggtcgaaagcggctgtcccagcctgcactgcctcacagcttagcagtggcagaacccacgcgggtttctgggctgacatcccactatttattccctggagggtccatatcagcagccagggcct

SEQ ID NO: 451323 - DNA, 140 bp, Artificial Sequence
  Synthetic
aggccctggctgctgatatgtagctgtcctgaagaaggttaagagggtggtggcgagtctgatgagaggtttgtcctcgaggaaacgccgatctcaagatgttttgactgtgcaatttctgaccttttgggacagcggtg

SEQ ID NO: 451324 - DNA, 140 bp, Artificial Sequence
  Synthetic
caccgctgtcccaaaaggtcagaaattgcacagtcaaaacatcttgagatcggcgtttcctcgaggacaaacctctcatcagactcgccaccaccctcttaaccttcttcaggacagctacatatcagcagccagggcct

SEQ ID NO: 451325 - DNA, 140 bp, Artificial Sequence
  Synthetic
atacgccatgctgggtctccagtggatgaccggaagaatgggtgagagacagctgcagaaaattgaaagatggctggtaaggaaccccttttttgcggcaacagccttggccattgcctacgtacttgggagtcggccat

SEQ ID NO: 451326 - DNA, 140 bp, Artificial Sequence
  Synthetic
atggccgactcccaagtacgtaggcaatggccaaggctgttgccgcaaaaaaggggttccttaccagccatctttcaattttctgcagctgtctctcacccattcttccggtcatccactggagacccagcatggcgtat

SEQ ID NO: 451327 - DNA, 140 bp, Artificial Sequence
  Synthetic
atacgccatgctgggtctccgggagcaccctgcagaatcccagtaatggtcgccgatgatctcacagcggcagtcaacaagggtattttggtcacagtcaatccaatagcctccactaatcgtacttgggagtcggccat

SEQ ID NO: 451328 - DNA, 140 bp, Artificial Sequence
  Synthetic
atggccgactcccaagtacgattagtggaggctattggattgactgtgaccaaaatacccttgttgactgccgctgtgagatcatcggcgaccattactgggattctgcagggtgctcccggagacccagcatggcgtat

SEQ ID NO: 451329 - DNA, 140 bp, Artificial Sequence
  Synthetic
aggccctggctgctgatatgaacatcagttgaagagagtgacatgttcatgccgaggtcaattgggggtccagttagctcccacaatcacattccgggatacaaggtccagacaaacggagaccttttgggacagcggtg

SEQ ID NO: 451330 - DNA, 140 bp, Artificial Sequence
  Synthetic
caccgctgtcccaaaaggtctccgtttgtctggaccttgtatcccggaatgtgattgtgggagctaactggacccccaattgacctcggcatgaacatgtcactctcttcaactgatgttcatatcagcagccagggcct

SEQ ID NO: 451331 - DNA, 140 bp, Artificial Sequence
  Synthetic
atacgccatgctgggtctccatgaacaatggaggggatgccatgtatatggccttgatcgctgctttctcaatcagaccaggactgctcatcggctttggattgaggacgctgtggagcccgtacttgggagtcggccat

SEQ ID NO: 451332 - DNA, 140 bp, Artificial Sequence
  Synthetic
atggccgactcccaagtacgggctccacagcgtcctcaatccaaagccgatgagcagtcctggtctgattgagaaagcagcgatcaaggccatatacatggcatcccctccattgttcatggagacccagcatggcgtat

SEQ ID NO: 451333 - DNA, 140 bp, Artificial Sequence
  Synthetic
atacgccatgctgggtctcccttgcaacaatgctcttttgcactgtggttatcatcggcatccttcatcagaactcaaaggacacttccatgcagaagaccatacccctggtggcccttacgtacttgggagtcggccat

SEQ ID NO: 451334 - DNA, 140 bp, Artificial Sequence
  Synthetic
atggccgactcccaagtacgtaagggccaccaggggtatggtcttctgcatggaagtgtcctttgagttctgatgaaggatgccgatgataaccacagtgcaaaagagcattgttgcaagggagacccagcatggcgtat

SEQ ID NO: 451335 - DNA, 140 bp, Artificial Sequence
  Synthetic
atacgccatgctgggtctccccactttatggcattgaaggaacaaagacaccagtttccccaggtgaaatgaggctaagagatgaccagaggagagtcttccgagagctggtgaggaactcgtacttgggagtcggccat

SEQ ID NO: 451336 - DNA, 140 bp, Artificial Sequence
  Synthetic
atggccgactcccaagtacgagttcctcaccagctctcggaagactctcctctggtcatctcttagcctcatttcacctggggaaactggtgtctttgttccttcaatgccataaagtggggagacccagcatggcgtat

SEQ ID NO: 451337 - DNA, 140 bp, Artificial Sequence
  Synthetic
atacgccatgctgggtctccgaatgacagtggtgagacagtaaagtgcagagcccctggaggagccaagaagcctctgcgtccaagatggtgcgatgaaagggtgtcgtctgaccagagtcgtacttgggagtcggccat

SEQ ID NO: 451338 - DNA, 140 bp, Artificial Sequence
  Synthetic
atggccgactcccaagtacgactctggtcagacgacaccctttcatcgcaccatcttggacgcagaggcttcttggctcctccaggggctctgcactttactgtctcaccactgtcattcggagacccagcatggcgtat

SEQ ID NO: 451339 - DNA, 140 bp, Artificial Sequence
  Synthetic
atacgccatgctgggtctccatgaacatctcggtcataattctattggtcagtggctggaattcaataacggtgatgcccctgctttgtggcattggatgcgccatgcttcactggactccgtacttgggagtcggccat

SEQ ID NO: 451340 - DNA, 140 bp, Artificial Sequence
  Synthetic
atggccgactcccaagtacggagtccagtgaagcatggcgcatccaatgccacaaagcaggggcatcaccgttattgaattccagccactgaccaatagaattatgaccgagatgttcatggagacccagcatggcgtat

SEQ ID NO: 451341 - DNA, 140 bp, Artificial Sequence
  Synthetic
atacgccatgctgggtctccggtggtgacctacgccttgaataccatcaccaacctgaaggtccaactgatcaggatggcggaggcagagatggtgatacaccaccagcatgtccaggaccgtacttgggagtcggccat

SEQ ID NO: 451342 - DNA, 140 bp, Artificial Sequence
  Synthetic
atggccgactcccaagtacggtcctggacatgctggtggtgtatcaccatctctgcctccgccatcctgatcagttggaccttcaggttggtgatggtattcaaggcgtaggtcaccaccggagacccagcatggcgtat

SEQ ID NO: 451343 - DNA, 140 bp, Artificial Sequence
  Synthetic
atacgccatgctgggtctcctgtgacgacacggttttgaccaaacttgaggcatggctcgctgaacatggctgcgacaggctgaagaggatggcagtgagtggagatgactgcgttgtcccgtacttgggagtcggccat

SEQ ID NO: 451344 - DNA, 140 bp, Artificial Sequence
  Synthetic
atggccgactcccaagtacgggacaacgcagtcatctccactcactgccatcctcttcagcctgtcgcagccatgttcagcgagccatgcctcaagtttggtcaaaaccgtgtcgtcacaggagacccagcatggcgtat

SEQ ID NO: 451345 - DNA, 140 bp, Artificial Sequence
  Synthetic
aggccctggctgctgatatgttctgccactgctaagctgtgaggcagtgcaggctgggacagccgccttccatgttgcgaaaaacctggtttctgagacttcccacgtcagggaaagaccgaccttttgggacagcggtg

SEQ ID NO: 451346 - DNA, 140 bp, Artificial Sequence
  Synthetic
caccgctgtcccaaaaggtcggtctttccctgacgtgggaagtctcagaaaccaggtttttcgcaacatggaaggcggctgtcccagcctgcactgcctcacagcttagcagtggcagaacatatcagcagccagggcct

SEQ ID NO: 451347 - DNA, 140 bp, Artificial Sequence
  Synthetic
atacgccatgctgggtctcctgttgcgaaaaacctggtttctgagacttcccacgtcagggaaagaccgaagtggagctctgcttcccctccagaggtggtagaaagacacaaaaccactcgtacttgggagtcggccat

SEQ ID NO: 451348 - DNA, 140 bp, Artificial Sequence
  Synthetic
atggccgactcccaagtacgagtggttttgtgtctttctaccacctctggaggggaagcagagctccacttcggtctttccctgacgtgggaagtctcagaaaccaggtttttcgcaacaggagacccagcatggcgtat

SEQ ID NO: 451349 - DNA, 140 bp, Artificial Sequence
  Synthetic
atacgccatgctgggtctccccaactgacactggacatggcactgcagtgatgcaagtaaaggtgccaaagggggcaccctgcaggatcccagtgatggtcgccgatgatctcacagcggcgtacttgggagtcggccat

SEQ ID NO: 451350 - DNA, 140 bp, Artificial Sequence
  Synthetic
atggccgactcccaagtacgccgctgtgagatcatcggcgaccatcactgggatcctgcagggtgccccctttggcacctttacttgcatcactgcagtgccatgtccagtgtcagttggggagacccagcatggcgtat

SEQ ID NO: 451351 - DNA, 140 bp, Artificial Sequence
  Synthetic
aggccctggctgctgatatgggtagacatctcagtggtggtccaagactcaaaaaacatttatcagagagggacacatccattttccagaatacgtgatggcctacaatatggctggaaggaccttttgggacagcggtg

SEQ ID NO: 451352 - DNA, 140 bp, Artificial Sequence
  Synthetic
caccgctgtcccaaaaggtccttccagccatattgtaggccatcacgtattctggaaaatggatgtgtccctctctgataaatgttttttgagtcttggaccaccactgagatgtctacccatatcagcagccagggcct

SEQ ID NO: 451353 - DNA, 140 bp, Artificial Sequence
  Synthetic
atacgccatgctgggtctccgagacactggactacaaggaatgtgaatggccgctgacgcacacgattggaacatcagttgaagagagtgacatgttcatgccgaggtcaattgggggtccgtacttgggagtcggccat

SEQ ID NO: 451354 - DNA, 140 bp, Artificial Sequence
  Synthetic
atggccgactcccaagtacggacccccaattgacctcggcatgaacatgtcactctcttcaactgatgttccaatcgtgtgcgtcagcggccattcacattccttgtagtccagtgtctcggagacccagcatggcgtat

SEQ ID NO: 451355 - DNA, 140 bp, Artificial Sequence
  Synthetic
atacgccatgctgggtctccgaaagaggagctacaggaaatcccaacaatgttgaagaaagggatgacaactattcttgatttccatcctggagctgggaaaacaagacgttttcttccccgtacttgggagtcggccat

SEQ ID NO: 451356 - DNA, 140 bp, Artificial Sequence
  Synthetic
atggccgactcccaagtacggggaagaaaacgtcttgttttcccagctccaggatggaaatcaagaatagttgtcatccctttcttcaacattgttgggatttcctgtagctcctctttcggagacccagcatggcgtat

SEQ ID NO: 451357 - DNA, 140 bp, Artificial Sequence
  Synthetic
atacgccatgctgggtctccgtgacctgcctgtttggctctcatggcaagtggctaaggccggattgaagacgaatgaccgaaagtggtgctttgagggcccagaagaacatgagatcttcgtacttgggagtcggccat

SEQ ID NO: 451358 - DNA, 140 bp, Artificial Sequence
  Synthetic
atggccgactcccaagtacgaagatctcatgttcttctgggccctcaaagcaccactttcggtcattcgtcttcaatccggccttagccacttgccatgagagccaaacaggcaggtcacggagacccagcatggcgtat

SEQ ID NO: 451359 - DNA, 140 bp, Artificial Sequence
  Synthetic
atacgccatgctgggtctccctcttacatcatgctaatattttttgtcttgatggtggttgtggttccggagccggggcagcagagaaccattcaggacaatcaggtggcttatcttatccgtacttgggagtcggccat

SEQ ID NO: 451360 - DNA, 140 bp, Artificial Sequence
  Synthetic
atggccgactcccaagtacggataagataagccacctgattgtcctgaatggttctctgctgccccggctccggaaccacaaccaccatcaagacaaaaaatattagcatgatgtaagagggagacccagcatggcgtat

SEQ ID NO: 451361 - DNA, 140 bp, Artificial Sequence
  Synthetic
atacgccatgctgggtctccattggcatcctgacgctgatttctgtggtggcagccaatgaactaggcatgctggagaagactaaggaagacctctttgggaaaaagaatttgattccatcgtacttgggagtcggccat

SEQ ID NO: 451362 - DNA, 140 bp, Artificial Sequence
  Synthetic
atggccgactcccaagtacgatggaatcaaattctttttcccaaagaggtcttccttagtcttctccagcatgcctagttcattggctgccaccacagaaatcagcgtcaggatgccaatggagacccagcatggcgtat

SEQ ID NO: 451363 - DNA, 140 bp, Artificial Sequence
  Synthetic
aggccctggctgctgatatgacacccttttcgctggctgaaggcattgtgctggcatcagcagccctggggccgctcatagagggaaacaccagcctcttgtggaatggacccatggctggaccttttgggacagcggtg

SEQ ID NO: 451364 - DNA, 140 bp, Artificial Sequence
  Synthetic
caccgctgtcccaaaaggtccagccatgggtccattccacaagaggctggtgtttccctctatgagcggccccagggctgctgatgccagcacaatgccttcagccagcgaaaagggtgtcatatcagcagccagggcct

SEQ ID NO: 451365 - DNA, 140 bp, Artificial Sequence
  Synthetic
atacgccatgctgggtctccgaaaagaaccccaggttgtgtacaaaggaggagtttatagcaaaagttcgcagtcatgcagccatcggagctttcctggaagagcaagaacagtggaagacgtacttgggagtcggccat

SEQ ID NO: 451366 - DNA, 140 bp, Artificial Sequence
  Synthetic
atggccgactcccaagtacgtcttccactgttcttgctcttccaggaaagctccgatggctgcatgactgcgaacttttgctataaactcctcctttgtacacaacctggggttcttttcggagacccagcatggcgtat

SEQ ID NO: 451367 - DNA, 140 bp, Artificial Sequence
  Synthetic
aggccctggctgctgatatgtgggacacacgcataacagaggcggatctggatgatgaacaggaaatcttgaattacatgagcccacaccacaggaagctagcgctggctgtaatggaaagaccttttgggacagcggtg

SEQ ID NO: 451368 - DNA, 140 bp, Artificial Sequence
  Synthetic
caccgctgtcccaaaaggtctttccattacagccagcgctagcttcctgtggtgtgggctcatgtaattcaagatttcctgttcatcatccagatccgcctctgttatgcgtgtgtcccacatatcagcagccagggcct

SEQ ID NO: 451369 - DNA, 140 bp, Artificial Sequence
  Synthetic
atacgccatgctgggtctccgacccattgatgacagatttggcctggctctgtcccatcttaatgccatgtcaaaggtgcgaaaggacatatctgaatggcagccatcaaaaggatgggacgtacttgggagtcggccat

SEQ ID NO: 451370 - DNA, 140 bp, Artificial Sequence
  Synthetic
atggccgactcccaagtacgtcccatccttttgatggctgccattcagatatgtcctttcgcacctttgacatggcattaagatgggacagagccaggccaaatctgtcatcaatgggtcggagacccagcatggcgtat

SEQ ID NO: 451371 - DNA, 140 bp, Artificial Sequence
  Synthetic
atacgccatgctgggtctcctgactgggagaatgtacctttctgctctcaccatttccatgaactgcaactgaaggatggcaggagaattgtagtgccttgtcgggatcaagatgagctgcgtacttgggagtcggccat

SEQ ID NO: 451372 - DNA, 140 bp, Artificial Sequence
  Synthetic
atggccgactcccaagtacgcagctcatcttgatcccgacaaggcactacaattctcctgccatccttcagttgcagttcatggaaatggtgagagcagaaaggtacattctcccagtcaggagacccagcatggcgtat

SEQ ID NO: 451373 - DNA, 140 bp, Artificial Sequence
  Synthetic
atacgccatgctgggtctccctaagctgtgaggcagtgcaggctgggacagccgccttccaggctgcgaaaaacctggtttctgagacttcccacctcagagtaaaaccaaatggagcctcgtacttgggagtcggccat

SEQ ID NO: 451374 - DNA, 140 bp, Artificial Sequence
  Synthetic
atggccgactcccaagtacgaggctccatttggttttactctgaggtgggaagtctcagaaaccaggtttttcgcagcctggaaggcggctgtcccagcctgcactgcctcacagcttagggagacccagcatggcgtat

SEQ ID NO: 451375 - DNA, 140 bp, Artificial Sequence
  Synthetic
aggccctggctgctgatatggcgaaaaacctggtttctgagactttccacctcagagtaaaaccaaatggagcctccgctaccacctccccacgtggtggtagaaagacacaaaaccactgaccttttgggacagcggtg

SEQ ID NO: 451376 - DNA, 140 bp, Artificial Sequence
  Synthetic
caccgctgtcccaaaaggtcagtggttttgtgtctttctaccaccacgtggggaggtggtagcggaggctccatttggttttactctgaggtggaaagtctcagaaaccaggtttttcgccatatcagcagccagggcct

SEQ ID NO: 451377 - DNA, 140 bp, Artificial Sequence
  Synthetic
atacgccatgctgggtctccgggcgtcaatatggttcgacaaggagtccgctccttgtcaaacaaaataaaacaaaaaacaaaacaaattggaaatagacctggaccttcaagaggcgttcgtacttgggagtcggccat

SEQ ID NO: 451378 - DNA, 140 bp, Artificial Sequence
  Synthetic
atggccgactcccaagtacgaacgcctcttgaaggtccaggtctatttccaatttgttttgttttttgttttattttgtttgacaaggagcggactccttgtcgaaccatattgacgcccggagacccagcatggcgtat

SEQ ID NO: 451379 - DNA, 140 bp, Artificial Sequence
  Synthetic
aggccctggctgctgatatgaacaaaaaacaaaacaaattggaaatagacctggaccttcaagaggcgttcaaggatttatttttttctttttgttcaatgtcttgactggaaggaagatgaccttttgggacagcggtg

SEQ ID NO: 451380 - DNA, 140 bp, Artificial Sequence
  Synthetic
caccgctgtcccaaaaggtcatcttccttccagtcaagacattgaacaaaaagaaaaaaataaatccttgaacgcctcttgaaggtccaggtctatttccaatttgttttgttttttgttcatatcagcagccagggcct

SEQ ID NO: 451381 - DNA, 140 bp, Artificial Sequence
  Synthetic
atacgccatgctgggtctcccaaggatttatttttttctttttgttcaatgtcttgactggaaggaagatcactgctcatctgaagaggctgtggaggatgctggacccaagacagggatcgtacttgggagtcggccat

SEQ ID NO: 451382 - DNA, 140 bp, Artificial Sequence
  Synthetic
atggccgactcccaagtacgatccctgtcttgggtccagcatcctccacagcctcttcagatgagcagtgatcttccttccagtcaagacattgaacaaaaagaaaaaaataaatccttgggagacccagcatggcgtat

SEQ ID NO: 451383 - DNA, 140 bp, Artificial Sequence
  Synthetic
atacgccatgctgggtctcctagctgttctgaagaaggtcaagagagtggtggcgagtctgatgagaggtttgtcctcgaggaaacgccgatcccatgaagtcttgactgttcactttctcgtacttgggagtcggccat

SEQ ID NO: 451384 - DNA, 140 bp, Artificial Sequence
  Synthetic
atggccgactcccaagtacgagaaagtgaacagtcaagacttcatgggatcggcgtttcctcgaggacaaacctctcatcagactcgccaccactctcttgaccttcttcagaacagctaggagacccagcatggcgtat

SEQ ID NO: 451385 - DNA, 140 bp, Artificial Sequence
  Synthetic
atacgccatgctgggtctccgatccttggaatgatgctgatgactggtggagtgaccctggtgcgcaagagtagatggctgctcttgaatgtaacatctgaggaccttgggaaaaccttccgtacttgggagtcggccat

SEQ ID NO: 451386 - DNA, 140 bp, Artificial Sequence
  Synthetic
atggccgactcccaagtacggaaggttttcccaaggtcctcagatgttacattcaagagcagccatctactcttgcgcaccagggtcactccaccagtcatcagcatcattccaaggatcggagacccagcatggcgtat

SEQ ID NO: 451387 - DNA, 140 bp, Artificial Sequence
  Synthetic
atacgccatgctgggtctcctctgttggcacaggcaattgcacaaccaacattctggatgccaagaattggtgtccggattccatggaatacaactgccccaacctcagtccaagagaagcgtacttgggagtcggccat

SEQ ID NO: 451388 - DNA, 140 bp, Artificial Sequence
  Synthetic
atggccgactcccaagtacgcttctcttggactgaggttggggcagttgtattccatggaatccggacaccaattcttggcatccagaatgttggttgtgcaattgcctgtgccaacagaggagacccagcatggcgtat

SEQ ID NO: 451389 - DNA, 140 bp, Artificial Sequence
  Synthetic
atacgccatgctgggtctccagcctgatgacatagattgttggtgttatggagtggaaaatgttagggttgcttatggcaagtgtgattcagcgggtaggtcaagaaggtctagaagggccgtacttgggagtcggccat

SEQ ID NO: 451390 - DNA, 140 bp, Artificial Sequence
  Synthetic
atggccgactcccaagtacggcccttctagaccttcttgacctacccgctgaatcacacttgccataagcaaccctaacattttccactccataacaccaacaatctatgtcatcaggctggagacccagcatggcgtat

SEQ ID NO: 451391 - DNA, 140 bp, Artificial Sequence
  Synthetic
atacgccatgctgggtctcccattgacttacccacacatgaaaaccatggtttgaagactcggcaagaaaagtggatgactggaagaatgggcgagagacaattgcagaaaattgaaagacgtacttgggagtcggccat

SEQ ID NO: 451392 - DNA, 140 bp, Artificial Sequence
  Synthetic
atggccgactcccaagtacgtctttcaattttctgcaattgtctctcgcccattcttccagtcatccacttttcttgccgagtcttcaaaccatggttttcatgtgtgggtaagtcaatgggagacccagcatggcgtat

SEQ ID NO: 451393 - DNA, 140 bp, Artificial Sequence
  Synthetic
atacgccatgctgggtctcctggctagtgaggaatcccttttttgcggtgacagccttagctattgcttatttagtggggagcaacatgacgcaacgagttgtgattgccttgctagtttcgtacttgggagtcggccat

SEQ ID NO: 451394 - DNA, 140 bp, Artificial Sequence
  Synthetic
atggccgactcccaagtacgaaactagcaaggcaatcacaactcgttgcgtcatgttgctccccactaaataagcaatagctaaggctgtcaccgcaaaaaagggattcctcactagccaggagacccagcatggcgtat

SEQ ID NO: 451395 - DNA, 140 bp, Artificial Sequence
  Synthetic
aggccctggctgctgatatgtttagtggggagcaacatgacgcaacgagttgtgattgccttgctagttttggctgttggcccagcctattcggctcactgcataggaataactgatagggaccttttgggacagcggtg

SEQ ID NO: 451396 - DNA, 140 bp, Artificial Sequence
  Synthetic
caccgctgtcccaaaaggtccctatcagttattcctatgcagtgagccgaataggctgggccaacagccaaaactagcaaggcaatcacaactcgttgcgtcatgttgctccccactaaacatatcagcagccagggcct

SEQ ID NO: 451397 - DNA, 140 bp, Artificial Sequence
  Synthetic
atacgccatgctgggtctccgatttcattgagggggtgcatggaggaacttgggtctcagccaccttggaacaggacaagtgtgttactgtgatggcccctgacaagccctcattggacacgtacttgggagtcggccat

SEQ ID NO: 451398 - DNA, 140 bp, Artificial Sequence
  Synthetic
atggccgactcccaagtacgtgtccaatgagggcttgtcaggggccatcacagtaacacacttgtcctgttccaaggtggctgagacccaagttcctccatgcaccccctcaatgaaatcggagacccagcatggcgtat

SEQ ID NO: 451399 - DNA, 140 bp, Artificial Sequence
  Synthetic
aggccctggctgctgatatgacaggacaagtgtgttactgtgatggcccctgacaagccctcattggacatatcattggaaacagttgccattgatggacctgctgaagcgaggaaagtggaccttttgggacagcggtg

SEQ ID NO: 451400 - DNA, 140 bp, Artificial Sequence
  Synthetic
caccgctgtcccaaaaggtccactttcctcgcttcagcaggtccatcaatggcaactgtttccaatgatatgtccaatgagggcttgtcaggggccatcacagtaacacacttgtcctgtcatatcagcagccagggcct

SEQ ID NO: 451401 - DNA, 140 bp, Artificial Sequence
  Synthetic
atacgccatgctgggtctcctgctacagtgcagtcttgacccatgtgaagatcaatgacaagtgccccagcaccggcgaagcccatttggccgaagaaaacgagggagataatgcctgtacgtacttgggagtcggccat

SEQ ID NO: 451402 - DNA, 140 bp, Artificial Sequence
  Synthetic
atggccgactcccaagtacgtacaggcattatctccctcgttttcttcggccaaatgggcttcgccggtgctggggcacttgtcattgatcttcacatgggtcaagactgcactgtagcaggagacccagcatggcgtat

SEQ ID NO: 451403 - DNA, 140 bp, Artificial Sequence
  Synthetic
atacgccatgctgggtctccaacggacttactctgacaggggctgggggaatggttgtggcctgtttgggaaaggaagcattgtggcatgtgccaagtttacctgtgccaagtccatgagcgtacttgggagtcggccat

SEQ ID NO: 451404 - DNA, 140 bp, Artificial Sequence
  Synthetic
atggccgactcccaagtacgctcatggacttggcacaggtaaacttggcacatgccacaatgcttcctttcccaaacaggccacaaccattcccccagcccctgtcagagtaagtccgttggagacccagcatggcgtat

SEQ ID NO: 451405 - DNA, 140 bp, Artificial Sequence
  Synthetic
atacgccatgctgggtctcccctgtttgaggttgaccagaccaaaatccagtatgtcatcagggcacaattgcatgttggagccaagcaggagaactggaatgctgacatcaagaccctccgtacttgggagtcggccat

SEQ ID NO: 451406 - DNA, 140 bp, Artificial Sequence
  Synthetic
atggccgactcccaagtacggagggtcttgatgtcagcattccagttctcctgcttggctccaacatgcaattgtgccctgatgacatactggattttggtctggtcaacctcaaacaggggagacccagcatggcgtat

SEQ ID NO: 451407 - DNA, 140 bp, Artificial Sequence
  Synthetic
atacgccatgctgggtctccaaatttgatgccctgtcaggttctcaggaggctgagtttactggatacgggaaggctacattggagtgccaagtacagaccgcagtggactttagcaacacgtacttgggagtcggccat

SEQ ID NO: 451408 - DNA, 140 bp, Artificial Sequence
  Synthetic
atggccgactcccaagtacgtgttgctaaagtccactgcggtctgtacttggcactccaatgtagccttcccgtatccagtaaactcagcctcctgagaacctgacagggcatcaaatttggagacccagcatggcgtat

SEQ ID NO: 451409 - DNA, 140 bp, Artificial Sequence
  Synthetic
atacgccatgctgggtctccgctacattgcagagatggagaaggagagctggattgtggatagacagtgggctcaagatttgaccctaccttggcagagtggaagtggtggtgtgtggagcgtacttgggagtcggccat

SEQ ID NO: 451410 - DNA, 140 bp, Artificial Sequence
  Synthetic
atggccgactcccaagtacgctccacacaccaccacttccactctgccaaggtagggtcaaatcttgagcccactgtctatccacaatccagctctccttctccatctctgcaatgtagcggagacccagcatggcgtat

SEQ ID NO: 451411 - DNA, 140 bp, Artificial Sequence
  Synthetic
atacgccatgctgggtctccagagatgcaccatcttgtggaatttgagcctccacatgctgcaaccatcaaggtgttggccctgggaaaccaagaaggctctttgaagacagctctcactcgtacttgggagtcggccat

SEQ ID NO: 451412 - DNA, 140 bp, Artificial Sequence
  Synthetic
atggccgactcccaagtacgagtgagagctgtcttcaaagagccttcttggtttcccagggccaacaccttgatggttgcagcatgtggaggctcaaattccacaagatggtgcatctctggagacccagcatggcgtat

SEQ ID NO: 451413 - DNA, 140 bp, Artificial Sequence
  Synthetic
aggccctggctgctgatatgaggtgttggccctgggaaaccaagaaggctctttgaagacagctctcactggtgcaatgcgggtcacaaaagacgcaaatggcagcaacctatacaagctgaccttttgggacagcggtg

SEQ ID NO: 451414 - DNA, 140 bp, Artificial Sequence
  Synthetic
caccgctgtcccaaaaggtcagcttgtataggttgctgccatttgcgtcttttgtgacccgcattgcaccagtgagagctgtcttcaaagagccttcttggtttcccagggccaacacctcatatcagcagccagggcct

SEQ ID NO: 451415 - DNA, 140 bp, Artificial Sequence
  Synthetic
atacgccatgctgggtctccccatggggggcacgtctcatgtagagtgaaattgtcagctttgacactcaagggaacatcctacaagatgtgtaccgataaaatgtcttttgttaagaatcgtacttgggagtcggccat

SEQ ID NO: 451416 - DNA, 140 bp, Artificial Sequence
  Synthetic
atggccgactcccaagtacgattcttaacaaaagacattttatcggtacacatcttgtaggatgttcccttgagtgtcaaagctgacaatttcactctacatgagacgtgccccccatggggagacccagcatggcgtat

SEQ ID NO: 451417 - DNA, 140 bp, Artificial Sequence
  Synthetic
atacgccatgctgggtctccccaactgacactggacatggcactgccgtgatgcaggtgaaggtgccaaaaggagccccctgcaggatcccagtgatggtagctgatgatctcacagcggcgtacttgggagtcggccat

SEQ ID NO: 451418 - DNA, 140 bp, Artificial Sequence
  Synthetic
atggccgactcccaagtacgccgctgtgagatcatcagctaccatcactgggatcctgcagggggctccttttggcaccttcacctgcatcacggcagtgccatgtccagtgtcagttggggagacccagcatggcgtat

SEQ ID NO: 451419 - DNA, 140 bp, Artificial Sequence
  Synthetic
atacgccatgctgggtctcccagtcaacaaaggcattttagtcacagtcaacccgatagcctccaccaacgaggatgaagtgttgattgaggtgaacccccccttcggggacagctatatcgtacttgggagtcggccat

SEQ ID NO: 451420 - DNA, 140 bp, Artificial Sequence
  Synthetic
atggccgactcccaagtacgatatagctgtccccgaagggggggttcacctcaatcaacacttcatcctcgttggtggaggctatcgggttgactgtgactaaaatgcctttgttgactgggagacccagcatggcgtat

SEQ ID NO: 451421 - DNA, 140 bp, Artificial Sequence
  Synthetic
atacgccatgctgggtctcctatagttgggacaggggactcccgcctgacctatcagtggcacaaggagggcagctcaataggaaagttgttcacccagaccatgaagggcgcggagcgccgtacttgggagtcggccat

SEQ ID NO: 451422 - DNA, 140 bp, Artificial Sequence
  Synthetic
atggccgactcccaagtacggcgctccgcgcccttcatggtctgggtgaacaactttcctattgagctgccctccttgtgccactgataggtcaggcgggagtcccctgtcccaactataggagacccagcatggcgtat

SEQ ID NO: 451423 - DNA, 140 bp, Artificial Sequence
  Synthetic
atacgccatgctgggtctccttggccgttatgggggatgctgcttgggacttcagctctgctggaggatttttcacatcagtcggaaaaggaatacacatggtgtttggttctgcctttccgtacttgggagtcggccat

SEQ ID NO: 451424 - DNA, 140 bp, Artificial Sequence
  Synthetic
atggccgactcccaagtacggaaaggcagaaccaaacaccatgtgtattccttttccgactgatgtgaaaaatcctccagcagagctgaagtcccaagcagcatcccccataacggccaaggagacccagcatggcgtat

SEQ ID NO: 451425 - DNA, 140 bp, Artificial Sequence
  Synthetic
atacgccatgctgggtctccaaggattgtttggtggcctgagttggataacaaaggtcatcataggggcagtccttatatgggttggcatcaacatgaggaacatgacaatgtctatgggcgtacttgggagtcggccat

SEQ ID NO: 451426 - DNA, 140 bp, Artificial Sequence
  Synthetic
atggccgactcccaagtacgcccatagacattgtcatgttcctcatgttgatgccaacccatataaggactgcccctatgatgacctttgttatccaactcaggccaccaaacaatccttggagacccagcatggcgtat

SEQ ID NO: 451427 - DNA, 140 bp, Artificial Sequence
  Synthetic
atacgccatgctgggtctcccatgatcctggttggagtcatcatgatgtttctgtccctgggagtgggggcggaccaaggatgtgcaatcaactttggtaagagagaacttaaatgtgggcgtacttgggagtcggccat

SEQ ID NO: 451428 - DNA, 140 bp, Artificial Sequence
  Synthetic
atggccgactcccaagtacgcccacatttaagttctctcttaccaaagttgattgcacatccttggtccgcccccactcccagggacagaaacatcatgatgactccaaccaggatcatgggagacccagcatggcgtat

SEQ ID NO: 451429 - DNA, 140 bp, Artificial Sequence
  Synthetic
atacgccatgctgggtctccgatggagttttcatcttcagggattcggatgactggctgaacaagtattcatactatccagaagatccagtgaaacttgcttcaatagtgaaggcctcctcgtacttgggagtcggccat

SEQ ID NO: 451430 - DNA, 140 bp, Artificial Sequence
  Synthetic
atggccgactcccaagtacgaggaggccttcactattgaagcaagtttcactggatcttctggatagtatgaatacttgttcagccagtcatccgaatccctgaagatgaaaactccatcggagacccagcatggcgtat

SEQ ID NO: 451431 - DNA, 140 bp, Artificial Sequence
  Synthetic
atacgccatgctgggtctcctcgaagaagggaagtgtggtttaaattcagtcgactccctggaacatgaaatgtggaggagcagggcggatgagatcaacgccatccttgaggagaatgacgtacttgggagtcggccat

SEQ ID NO: 451432 - DNA, 140 bp, Artificial Sequence
  Synthetic
atggccgactcccaagtacgtcattctcctcaaggatggcgttgatctcatccgccctgctcctccacatttcatgttccagggagtcgactgaatttaaaccacacttcccttcttcgaggagacccagcatggcgtat

SEQ ID NO: 451433 - DNA, 140 bp, Artificial Sequence
  Synthetic
atacgccatgctgggtctccggtagacatctcagtggtggtccaagacccaaaaaacatctaccagagaggaacacatcctttttccagaattcgtgatggcttgcaatatggctggaagcgtacttgggagtcggccat

SEQ ID NO: 451434 - DNA, 140 bp, Artificial Sequence
  Synthetic
atggccgactcccaagtacgcttccagccatattgcaagccatcacgaattctggaaaaaggatgtgttcctctctggtagatgttttttgggtcttggaccaccactgagatgtctaccggagacccagcatggcgtat

SEQ ID NO: 451435 - DNA, 140 bp, Artificial Sequence
  Synthetic
atacgccatgctgggtctccacctggggtaagaaccttgtgttttctccaggaagaaagaatggaagcttcatcatagacgggaagtccaggaaagagtgcccgttttcaaacagagtatcgtacttgggagtcggccat

SEQ ID NO: 451436 - DNA, 140 bp, Artificial Sequence
  Synthetic
atggccgactcccaagtacgatactctgtttgaaaacgggcactctttcctggacttcccgtctatgatgaagcttccattctttcttcctggagaaaacacaaggttcttaccccaggtggagacccagcatggcgtat

SEQ ID NO: 451437 - DNA, 140 bp, Artificial Sequence
  Synthetic
atacgccatgctgggtctccggaattctttccagatagaagagttcgggacaggagtgttcaccactcgagtgtacatggatgcagtctttgaatacaccatggactgcgatggatccatcgtacttgggagtcggccat

SEQ ID NO: 451438 - DNA, 140 bp, Artificial Sequence
  Synthetic
atggccgactcccaagtacgatggatccatcgcagtccatggtgtattcaaagactgcatccatgtacactcgagtggtgaacactcctgtcccgaactcttctatctggaaagaattccggagacccagcatggcgtat

SEQ ID NO: 451439 - DNA, 140 bp, Artificial Sequence
  Synthetic
aggccctggctgctgatatggtgtacatggatgcagtctttgaatacaccatggactgcgatggatccatcttgggggcagcagtgaatggaaaaaagagtgcacatgggtccccaacatgaccttttgggacagcggtg

SEQ ID NO: 451440 - DNA, 140 bp, Artificial Sequence
  Synthetic
caccgctgtcccaaaaggtcatgttggggacccatgtgcactcttttttccattcactgctgcccccaagatggatccatcgcagtccatggtgtattcaaagactgcatccatgtacaccatatcagcagccagggcct

SEQ ID NO: 451441 - DNA, 140 bp, Artificial Sequence
  Synthetic
atacgccatgctgggtctcctttggatgggaagccatgaggtgaatggaacgtggatgatacataccctggagacactggactacaaggaatgtgaatggccgctgacacacacgattggcgtacttgggagtcggccat

SEQ ID NO: 451442 - DNA, 140 bp, Artificial Sequence
  Synthetic
atggccgactcccaagtacgccaatcgtgtgtgtcagcggccattcacattccttgtagtccagtgtctccagggtatgtatcatccacgttccattcacctcatggcttcccatccaaaggagacccagcatggcgtat

SEQ ID NO: 451443 - DNA, 140 bp, Artificial Sequence
  Synthetic
atacgccatgctgggtctccaacatcagttgaagagagcgacatgtttatgccgaggtcaatcgggggcccagtgagctcccacaaccacattccaggatacaaggtccagacaaatgggcgtacttgggagtcggccat

SEQ ID NO: 451444 - DNA, 140 bp, Artificial Sequence
  Synthetic
atggccgactcccaagtacgcccatttgtctggaccttgtatcctggaatgtggttgtgggagctcactgggcccccgattgacctcggcataaacatgtcgctctcttcaactgatgttggagacccagcatggcgtat

SEQ ID NO: 451445 - DNA, 140 bp, Artificial Sequence
  Synthetic
aggccctggctgctgatatgcagtgagctcccacaaccacattccaggatacaaggtccagacaaatgggccttggatgcaggtgccactggaagtgaagagagaagcctgcccaggaacgaccttttgggacagcggtg

SEQ ID NO: 451446 - DNA, 140 bp, Artificial Sequence
  Synthetic
caccgctgtcccaaaaggtcgttcctgggcaggcttctctcttcacttccagtggcacctgcatccaaggcccatttgtctggaccttgtatcctggaatgtggttgtgggagctcactgcatatcagcagccagggcct

SEQ ID NO: 451447 - DNA, 140 bp, Artificial Sequence
  Synthetic
atacgccatgctgggtctcccagtgtggttgttgacggtggctgtgacgggcgtggaaaatcaaccaggtccaccaccgacagtgggaagatcattcctgaatggtgttgccgatcatgccgtacttgggagtcggccat

SEQ ID NO: 451448 - DNA, 140 bp, Artificial Sequence
  Synthetic
atggccgactcccaagtacggcatgatcggcaacaccattcaggaatgatcttcccactgtcggtggtggacctggttgattttccacgcccgtcacagccaccgtcaacaaccacactgggagacccagcatggcgtat

SEQ ID NO: 451449 - DNA, 140 bp, Artificial Sequence
  Synthetic
atacgccatgctgggtctccacaatgccgccagtgagctttcacggaagtgatggttgctggtacccaatggaaattagaccaaggaagacacatgacaaccacctggttcgctcatgggcgtacttgggagtcggccat

SEQ ID NO: 451450 - DNA, 140 bp, Artificial Sequence
  Synthetic
atggccgactcccaagtacgcccatgagcgaaccaggtggttgtcatgtgtcttccttggtctaatttccattgggtaccagcaaccatcacttccgtgaaagctcactggcggcattgtggagacccagcatggcgtat

SEQ ID NO: 451451 - DNA, 140 bp, Artificial Sequence
  Synthetic
atacgccatgctgggtctcctgacagctggagaggtccatgcagtcccttttgggttggtgagcatgatgatagcaatggaagtggtcttgaagaagagacagggacccaagcaaatactcgtacttgggagtcggccat

SEQ ID NO: 451452 - DNA, 140 bp, Artificial Sequence
  Synthetic
atggccgactcccaagtacgagtatttgcttgggtccctgtctcttcttcaagaccacttccattgctatcatcatgctcaccaacccaaaagggactgcatggacctctccagctgtcaggagacccagcatggcgtat

SEQ ID NO: 451453 - DNA, 140 bp, Artificial Sequence
  Synthetic
atacgccatgctgggtctccagttggaggcatagtgctcctaggagccatgttagttggacaggtgaccctgttggatttgctgaagctcacagtggcagttggactgcactttcatgaacgtacttgggagtcggccat

SEQ ID NO: 451454 - DNA, 140 bp, Artificial Sequence
  Synthetic
atggccgactcccaagtacgttcatgaaagtgcagtccaactgccactgtgagcttcagcaaatccaacagggtcacctgtccaactaacatggctcctaggagcactatgcctccaactggagacccagcatggcgtat

SEQ ID NO: 451455 - DNA, 140 bp, Artificial Sequence
  Synthetic
atacgccatgctgggtctccatgaacaatggaggggacgccatgtacatggccctgatcgctgctttctcgataaggccaggactgctcatcggcttcgggttgaggacactgtggagtccgtacttgggagtcggccat

SEQ ID NO: 451456 - DNA, 140 bp, Artificial Sequence
  Synthetic
atggccgactcccaagtacggactccacagtgtcctcaacccgaagccgatgagcagtcctggccttatcgagaaagcagcgatcagggccatgtacatggcgtcccctccattgttcatggagacccagcatggcgtat

SEQ ID NO: 451457 - DNA, 140 bp, Artificial Sequence
  Synthetic
atacgccatgctgggtctccctcgggaacgccttgtgctaaccctgggagcagccatggtggagatagccttgggcggcatgatgggggggctgtggaagtacctgaatgcagtgtccctcgtacttgggagtcggccat

SEQ ID NO: 451458 - DNA, 140 bp, Artificial Sequence
  Synthetic
atggccgactcccaagtacgagggacactgcattcaggtacttccacagcccccccatcatgccgcccaaggctatctccaccatggctgctcccagggttagcacaaggcgttcccgagggagacccagcatggcgtat

SEQ ID NO: 451459 - DNA, 140 bp, Artificial Sequence
  Synthetic
atacgccatgctgggtctccttgcatcttgacaataaatgctgttgcctccagaaaagcatcaaacgctatcctgcccttgatggcgctgttgacacctgtaacaatggctgaggtgagacgtacttgggagtcggccat

SEQ ID NO: 451460 - DNA, 140 bp, Artificial Sequence
  Synthetic
atggccgactcccaagtacgtctcacctcagccattgttacaggtgtcaacagcgccatcaagggcaggatagcgtttgatgcttttctggaggcaacagcatttattgtcaagatgcaaggagacccagcatggcgtat

SEQ ID NO: 451461 - DNA, 140 bp, Artificial Sequence
  Synthetic
atacgccatgctgggtctcccttgcaacgatgctcttttgcactgtggtcatcatcggagtcctccaccagaactcaaaggacacttctatgcagaagaccatacccctggtggcccttacgtacttgggagtcggccat

SEQ ID NO: 451462 - DNA, 140 bp, Artificial Sequence
  Synthetic
atggccgactcccaagtacgtaagggccaccaggggtatggtcttctgcatagaagtgtcctttgagttctggtggaggactccgatgatgaccacagtgcaaaagagcatcgttgcaagggagacccagcatggcgtat

SEQ ID NO: 451463 - DNA, 140 bp, Artificial Sequence
  Synthetic
atacgccatgctgggtctcccactgacttcttatctggggttgacacagccttttttgggcttgtgcgccttcatggcaacccgaatattcggacgaaggagcatcccagtgaatgaagccgtacttgggagtcggccat

SEQ ID NO: 451464 - DNA, 140 bp, Artificial Sequence
  Synthetic
atggccgactcccaagtacggcttcattcactgggatgctccttcgtccgaatattcgggttgccatgaaggcgcacaagcccaaaaaaggctgtgtcaaccccagataagaagtcagtgggagacccagcatggcgtat

SEQ ID NO: 451465 - DNA, 140 bp, Artificial Sequence
  Synthetic
atacgccatgctgggtctccacttgcagcggctggtctcgtgggagtgttggcgggactagctttccaagagatggaaaattttctgggcccagttgcagttggaggaattctgatgatgcgtacttgggagtcggccat

SEQ ID NO: 451466 - DNA, 140 bp, Artificial Sequence
  Synthetic
atggccgactcccaagtacgcatcatcagaattcctccaactgcaactgggcccagaaaattttccatctcttggaaagctagtcccgccaacactcccacgagaccagccgctgcaagtggagacccagcatggcgtat

SEQ ID NO: 451467 - DNA, 140 bp, Artificial Sequence
  Synthetic
atacgccatgctgggtctccctggtcagcgtggctgggagagtggatggactcgaactcaggaagctaggagaagtttcctgggaagaggaagctgagatcagtggaagttctgcccgttcgtacttgggagtcggccat

SEQ ID NO: 451468 - DNA, 140 bp, Artificial Sequence
  Synthetic
atggccgactcccaagtacgaacgggcagaacttccactgatctcagcttcctcttcccaggaaacttctcctagcttcctgagttcgagtccatccactctcccagccacgctgaccagggagacccagcatggcgtat

SEQ ID NO: 451469 - DNA, 140 bp, Artificial Sequence
  Synthetic
atacgccatgctgggtctccatgatgtggctcttagtgaacaaggggaattcaaactactctctgaagagaaggttccatgggatcagattgtcatgacctcactggccttggtcggagccgtacttgggagtcggccat

SEQ ID NO: 451470 - DNA, 140 bp, Artificial Sequence
  Synthetic
atggccgactcccaagtacggctccgaccaaggccagtgaggtcatgacaatctgatcccatggaaccttctcttcagagagtagtttgaattccccttgttcactaagagccacatcatggagacccagcatggcgtat

SEQ ID NO: 451471 - DNA, 140 bp, Artificial Sequence
  Synthetic
atacgccatgctgggtctcctgctatccatccatttgcactcatgctggttcttgctggctggctgctccatgtcaagggaaccagaagaagtggagacgtcctctgggatatccccgcacgtacttgggagtcggccat

SEQ ID NO: 451472 - DNA, 140 bp, Artificial Sequence
  Synthetic
atggccgactcccaagtacgtgcggggatatcccagaggacgtctccacttcttctggttcccttgacatggagcagccagccagcaagaaccagcatgagtgcaaatggatggatagcaggagacccagcatggcgtat

SEQ ID NO: 451473 - DNA, 140 bp, Artificial Sequence
  Synthetic
atacgccatgctgggtctcccctacaattgttgaggagtgtgaacatttagaggatgggatttatggcattttccagtcgacatttctaggagcctcccaacggggagtgggagtggcaccgtacttgggagtcggccat

SEQ ID NO: 451474 - DNA, 140 bp, Artificial Sequence
  Synthetic
atggccgactcccaagtacggtgccactcccactccccgttgggaggctcctagaaatgtcgactggaaaatgccataaatcccatcctctaaatgttcacactcctcaacaattgtaggggagacccagcatggcgtat

SEQ ID NO: 451475 - DNA, 140 bp, Artificial Sequence
  Synthetic
atacgccatgctgggtctccagggaggggtcttccacacgatgtggcatgtgacaagaggtgcctttctcgttagaaatggcaagaagctagtcccaacctgggcctcagtcaaggaggacgtacttgggagtcggccat

SEQ ID NO: 451476 - DNA, 140 bp, Artificial Sequence
  Synthetic
atggccgactcccaagtacgtcctccttgactgaggcccaggttgggactagcttcttgccatttctaacgagaaaggcacctcttgtcacatgccacatcgtgtggaagacccctccctggagacccagcatggcgtat

SEQ ID NO: 451477 - DNA, 140 bp, Artificial Sequence
  Synthetic
atacgccatgctgggtctccccttgttgcctacggtggttcatggaagctggaaggcagatgggatggagaggaggaggttcagttgattgcagccgcccccggaaagaacgtggtcaaccgtacttgggagtcggccat

SEQ ID NO: 451478 - DNA, 140 bp, Artificial Sequence
  Synthetic
atggccgactcccaagtacggttgaccacgttctttccgggggcggctgcaatcaactgaacctcctcctctccatcccatctgccttccagcttccatgaaccaccgtaggcaacaaggggagacccagcatggcgtat

SEQ ID NO: 451479 - DNA, 140 bp, Artificial Sequence
  Synthetic
atacgccatgctgggtctccgttcagacaaaaccaagcctgtttaaggttaggaatggcggagaaatcggggcggtggcccttgactacccgagcggcacctccggttctcccattgtcacgtacttgggagtcggccat

SEQ ID NO: 451480 - DNA, 140 bp, Artificial Sequence
  Synthetic
atggccgactcccaagtacgtgacaatgggagaaccggaggtgccgctcgggtagtcaagggccaccgccccgatttctccgccattcctaaccttaaacaggcttggttttgtctgaacggagacccagcatggcgtat

SEQ ID NO: 451481 - DNA, 140 bp, Artificial Sequence
  Synthetic
atacgccatgctgggtctccacaggaatggtgaagtgatagggttgtatggcaatggaattcttgttggtgacaactcctttgtatctgccatatcccaaactgaggcaaaagaagagggcgtacttgggagtcggccat

SEQ ID NO: 451482 - DNA, 140 bp, Artificial Sequence
  Synthetic
atggccgactcccaagtacgccctcttcttttgcctcagtttgggatatggcagatacaaaggagttgtcaccaacaagaattccattgccatacaaccctatcacttcaccattcctgtggagacccagcatggcgtat

SEQ ID NO: 451483 - DNA, 140 bp, Artificial Sequence
  Synthetic
atacgccatgctgggtctccgaaggaagagcttcaggaaatcccgacaatgctaaagaagggaatgacaaccattcttgacttccatcctggggctgggaaaaccagacgctttcttccccgtacttgggagtcggccat

SEQ ID NO: 451484 - DNA, 140 bp, Artificial Sequence
  Synthetic
atggccgactcccaagtacggggaagaaagcgtctggttttcccagccccaggatggaagtcaagaatggttgtcattcccttctttagcattgtcgggatttcctgaagctcttccttcggagacccagcatggcgtat

SEQ ID NO: 451485 - DNA, 140 bp, Artificial Sequence
  Synthetic
atacgccatgctgggtctcccagattctggctgaatgcgcacggagacggctgcgcacacttgttctggctcccactagagttgtcctctccgaaatgaaggaagcctttcacggcctagcgtacttgggagtcggccat

SEQ ID NO: 451486 - DNA, 140 bp, Artificial Sequence
  Synthetic
atggccgactcccaagtacgctaggccgtgaaaggcttccttcatttcggagaggacaactctagtgggagccagaacaagtgtgcgcagccgtctccgtgcgcattcagccagaatctgggagacccagcatggcgtat

SEQ ID NO: 451487 - DNA, 140 bp, Artificial Sequence
  Synthetic
atacgccatgctgggtctccatgtaaagtttcacacacaggccttctccgcgcatggcagcggaaaagaagtcattgatgccatgtgtcatgctactctgacatacaggatgctggagcccgtacttgggagtcggccat

SEQ ID NO: 451488 - DNA, 140 bp, Artificial Sequence
  Synthetic
atggccgactcccaagtacgggctccagcatcctgtatgtcagagtagcatgacacatggcatcaatgacttcttttccgctgccatgcgcggagaaggcctgtgtgtgaaactttacatggagacccagcatggcgtat

SEQ ID NO: 451489 - DNA, 140 bp, Artificial Sequence
  Synthetic
atacgccatgctgggtctccgactagagtggtgaattgggaagtgattattatggatgaggctcatttcctagatccggccagcatagcagccagaggctgggcagcacacagagctagacgtacttgggagtcggccat

SEQ ID NO: 451490 - DNA, 140 bp, Artificial Sequence
  Synthetic
atggccgactcccaagtacgtctagctctgtgtgctgcccagcctctggctgctatgctggccggatctaggaaatgagcctcatccataataatcacttcccaattcaccactctagtcggagacccagcatggcgtat

SEQ ID NO: 451491 - DNA, 140 bp, Artificial Sequence
  Synthetic
atacgccatgctgggtctccgcgaatgaaagtgcaacaatcttgatgactgccacacctccaggaactagtgatgaatttccacactcgaatggggaaatagaggatgttcagacagatacgtacttgggagtcggccat

SEQ ID NO: 451492 - DNA, 140 bp, Artificial Sequence
  Synthetic
atggccgactcccaagtacgtatctgtctgaacatcctctatttccccattcgagtgtggaaattcatcactagttcctggaggtgtggcagtcatcaagattgttgcactttcattcgcggagacccagcatggcgtat

SEQ ID NO: 451493 - DNA, 140 bp, Artificial Sequence
  Synthetic
atacgccatgctgggtctccttcctagtgagccctggaatacgggtcatgactggattttggctgacaaaaggcccacggcctggtttcttccatccatcagggctgcaaacgtcatggccgtacttgggagtcggccat

SEQ ID NO: 451494 - DNA, 140 bp, Artificial Sequence
  Synthetic
atggccgactcccaagtacggccatgacgtttgcagccctgatggatggaagaaaccaggccgtgggccttttgtcagccaaaatccagtcatgacccgtattccagggctcactaggaaggagacccagcatggcgtat

SEQ ID NO: 451495 - DNA, 140 bp, Artificial Sequence
  Synthetic
atacgccatgctgggtctccagcatctctacgcaaagctgggaagagtgtggtggtgctaaacaggaagacctttgaaaaagagtatcccacaattaaacagaagaaacctgacttcatccgtacttgggagtcggccat

SEQ ID NO: 451496 - DNA, 140 bp, Artificial Sequence
  Synthetic
atggccgactcccaagtacggatgaagtcaggtttcttctgtttaattgtgggatactctttttcaaaggtcttcctgtttagcaccaccacactcttcccagctttgcgtagagatgctggagacccagcatggcgtat

SEQ ID NO: 451497 - DNA, 140 bp, Artificial Sequence
  Synthetic
aggccctggctgctgatatgcctttgaaaaagagtatcccacaattaaacagaagaaacctgacttcatcctggccactgacatagctgaaatgggggccaacctctgtgtggagagagtgaccttttgggacagcggtg

SEQ ID NO: 451498 - DNA, 140 bp, Artificial Sequence
  Synthetic
caccgctgtcccaaaaggtcactctctccacacagaggttggcccccatttcagctatgtcagtggccaggatgaagtcaggtttcttctgtttaattgtgggatactctttttcaaaggcatatcagcagccagggcct

SEQ ID NO: 451499 - DNA, 140 bp, Artificial Sequence
  Synthetic
atacgccatgctgggtctccgctggattgcaggacggctttcaaacctgtgcttgtggatgaggggaggaaggtggcgataaagggaccacttcggatttcagcttcttccgctgcccaacgtacttgggagtcggccat

SEQ ID NO: 451500 - DNA, 140 bp, Artificial Sequence
  Synthetic
atggccgactcccaagtacgttgggcagcggaagaagctgaaatccgaagtggtccctttatcgccaccttcctcccctcatccacaagcacaggtttgaaagccgtcctgcaatccagcggagacccagcatggcgtat

SEQ ID NO: 451501 - DNA, 140 bp, Artificial Sequence
  Synthetic
atacgccatgctgggtctccagaaggggacgcattggaaggaacccaaatagggatggggattcatattattactctgagccaacaagtgaagacaatgcccatcatgtctgctggctggcgtacttgggagtcggccat

SEQ ID NO: 451502 - DNA, 140 bp, Artificial Sequence
  Synthetic
atggccgactcccaagtacgccagccagcagacatgatgggcattgtcttcacttgttggctcagagtaataatatgaatccccatccctatttgggttccttccaatgcgtccccttctggagacccagcatggcgtat

SEQ ID NO: 451503 - DNA, 140 bp, Artificial Sequence
  Synthetic
aggccctggctgctgatatgttactctgagccaacaagtgaagacaatgcccatcatgtctgctggctggaagcctcaatgctcttagacaatatggaggtgaggggtggaatggtcgctgaccttttgggacagcggtg

SEQ ID NO: 451504 - DNA, 140 bp, Artificial Sequence
  Synthetic
caccgctgtcccaaaaggtcagcgaccattccacccctcacctccatattgtctaagagcattgaggcttccagccagcagacatgatgggcattgtcttcacttgttggctcagagtaacatatcagcagccagggcct

SEQ ID NO: 451505 - DNA, 140 bp, Artificial Sequence
  Synthetic
atacgccatgctgggtctccccactctatggcatagagggaacaaaaacaccagtttccccaggcgaaatgaggctaagagatgaccaaaggagagtcttccgggagctagttaggaactcgtacttgggagtcggccat

SEQ ID NO: 451506 - DNA, 140 bp, Artificial Sequence
  Synthetic
atggccgactcccaagtacgagttcctaactagctcccggaagactctcctttggtcatctcttagcctcatttcgcctggggaaactggtgtttttgttccctctatgccatagagtggggagacccagcatggcgtat

SEQ ID NO: 451507 - DNA, 140 bp, Artificial Sequence
  Synthetic
aggccctggctgctgatatggaggctaagagatgaccaaaggagagtcttccgggagctagttaggaactgtgacctgcctgtttggctatcatggcaggtggctaaggctggactgaaggaccttttgggacagcggtg

SEQ ID NO: 451508 - DNA, 140 bp, Artificial Sequence
  Synthetic
caccgctgtcccaaaaggtccttcagtccagccttagccacctgccatgatagccaaacaggcaggtcacagttcctaactagctcccggaagactctcctttggtcatctcttagcctccatatcagcagccagggcct

SEQ ID NO: 451509 - DNA, 140 bp, Artificial Sequence
  Synthetic
atacgccatgctgggtctccggcctctacggccaaggtggtgcgatgagagggtttcatccgaccagagcgcccttgctgaattcataaagtttgccgagggcaggagaggggcggcagacgtacttgggagtcggccat

SEQ ID NO: 451510 - DNA, 140 bp, Artificial Sequence
  Synthetic
atggccgactcccaagtacgtctgccgcccctctcctgccctcggcaaactttatgaattcagcaagggcgctctggtcggatgaaaccctctcatcgcaccaccttggccgtagaggccggagacccagcatggcgtat

SEQ ID NO: 451511 - DNA, 140 bp, Artificial Sequence
  Synthetic
atacgccatgctgggtctccggtgctggttgtactgagtgaactcccagatttcctggccaaaaaaggtggagaggcgatggacactatcagcgtgttcttgaactctgaggaaggttcccgtacttgggagtcggccat

SEQ ID NO: 451512 - DNA, 140 bp, Artificial Sequence
  Synthetic
atggccgactcccaagtacgggaaccttcctcagagttcaagaacacgctgatagtgtccatcgcctctccaccttttttggccaggaaatctgggagttcactcagtacaaccagcaccggagacccagcatggcgtat

SEQ ID NO: 451513 - DNA, 140 bp, Artificial Sequence
  Synthetic
aggccctggctgctgatatggagaggcgatggacactatcagcgtgttcttgaactctgaggaaggttccagagcttaccgcaatgcattgtccatgatgcctgaggctatgacgatagtgaccttttgggacagcggtg

SEQ ID NO: 451514 - DNA, 140 bp, Artificial Sequence
  Synthetic
caccgctgtcccaaaaggtcactatcgtcatagcctcaggcatcatggacaatgcattgcggtaagctctggaaccttcctcagagttcaagaacacgctgatagtgtccatcgcctctccatatcagcagccagggcct

SEQ ID NO: 451515 - DNA, 140 bp, Artificial Sequence
  Synthetic
atacgccatgctgggtctcccatgctgtttgttctggctgggttgctgacgtctggaatggtcatctttttcatgtctcccaagggaatcagcagaatgtccatggcaatgggcacaatgcgtacttgggagtcggccat

SEQ ID NO: 451516 - DNA, 140 bp, Artificial Sequence
  Synthetic
atggccgactcccaagtacgcattgtgcccattgccatggacattctgctgattcccttgggagacatgaaaaagatgaccattccagacgtcagcaacccagccagaacaaacagcatgggagacccagcatggcgtat

SEQ ID NO: 451517 - DNA, 140 bp, Artificial Sequence
  Synthetic
atacgccatgctgggtctccgctggttgtggatacctcatgtttcttggaggtgtcaaacccacccacatctcctacatcatgctaatattttttgtcctgatggtggtggtggttccagcgtacttgggagtcggccat

SEQ ID NO: 451518 - DNA, 140 bp, Artificial Sequence
  Synthetic
atggccgactcccaagtacgctggaaccaccaccaccatcaggacaaaaaatattagcatgatgtaggagatgtgggtgggtttgacacctccaagaaacatgaggtatccacaaccagcggagacccagcatggcgtat

SEQ ID NO: 451519 - DNA, 140 bp, Artificial Sequence
  Synthetic
atacgccatgctgggtctccagccggggcagcagagaaccatccaggataaccaggtggcttatctcatcattggcattttgacgttggtttccgtggtggcggccaatgaactgggtatcgtacttgggagtcggccat

SEQ ID NO: 451520 - DNA, 140 bp, Artificial Sequence
  Synthetic
atggccgactcccaagtacgatacccagttcattggccgccaccacggaaaccaacgtcaaaatgccaatgatgagataagccacctggttatcctggatggttctctgctgccccggctggagacccagcatggcgtat

SEQ ID NO: 451521 - DNA, 140 bp, Artificial Sequence
  Synthetic
atacgccatgctgggtctccgttggaaaagaccaaggaagacctttttgggaaaaagaatctgattccatccaacaccgcaccctggaattggccagatcttgacttgaagccaggagctcgtacttgggagtcggccat

SEQ ID NO: 451522 - DNA, 140 bp, Artificial Sequence
  Synthetic
atggccgactcccaagtacgagctcctggcttcaagtcaagatctggccaattccagggtgcggtgttggatggaatcagattctttttcccaaaaaggtcttccttggtcttttccaacggagacccagcatggcgtat

SEQ ID NO: 451523 - DNA, 140 bp, Artificial Sequence
  Synthetic
atacgccatgctgggtctccgcttggactgtctatgttggcattgtaacaatgctctccccaatgctgcaccattggatcaaggttgagtatggcaatctgtccttgtctgggattgccccgtacttgggagtcggccat

SEQ ID NO: 451524 - DNA, 140 bp, Artificial Sequence
  Synthetic
atggccgactcccaagtacggggcaatcccagacaaggacagattgccatactcaaccttgatccaatggtgcagcattggggagagcattgttacaatgccaacatagacagtccaagcggagacccagcatggcgtat

SEQ ID NO: 451525 - DNA, 140 bp, Artificial Sequence
  Synthetic
atacgccatgctgggtctccagtcagcctcagttttgtctttcatggacaagggcatcccgttcatgaagatgaacatctcggtcataatcctactaatcagtggctggaattcaataaccgtacttgggagtcggccat

SEQ ID NO: 451526 - DNA, 140 bp, Artificial Sequence
  Synthetic
atggccgactcccaagtacggttattgaattccagccactgattagtaggattatgaccgagatgttcatcttcatgaacgggatgcccttgtccatgaaagacaaaactgaggctgactggagacccagcatggcgtat

SEQ ID NO: 451527 - DNA, 140 bp, Artificial Sequence
  Synthetic
aggccctggctgctgatatgatgaacatctcggtcataatcctactaatcagtggctggaattcaataacagtgatgcctctactttgtggcattggatgcgctatgcttcactggacccgaccttttgggacagcggtg

SEQ ID NO: 451528 - DNA, 140 bp, Artificial Sequence
  Synthetic
caccgctgtcccaaaaggtcgggtccagtgaagcatagcgcatccaatgccacaaagtagaggcatcactgttattgaattccagccactgattagtaggattatgaccgagatgttcatcatatcagcagccagggcct

SEQ ID NO: 451529 - DNA, 140 bp, Artificial Sequence
  Synthetic
atacgccatgctgggtctcctcatcctgcccggaatcaaggcgcagcaatcaaagttggcacagaggagagtgtttcatggtgttgctaaaaatccagtggttgatggaaatccaacagtcgtacttgggagtcggccat

SEQ ID NO: 451530 - DNA, 140 bp, Artificial Sequence
  Synthetic
atggccgactcccaagtacgactgttggatttccatcaaccactggatttttagcaacaccatgaaacactctcctctgtgccaactttgattgctgcgccttgattccgggcaggatgaggagacccagcatggcgtat

SEQ ID NO: 451531 - DNA, 140 bp, Artificial Sequence
  Synthetic
aggccctggctgctgatatggtgtttcatggtgttgctaaaaatccagtggttgatggaaatccaacagttgacattgaggaagccccggaaatgcctgctctctatgagaagaagttgggaccttttgggacagcggtg

SEQ ID NO: 451532 - DNA, 140 bp, Artificial Sequence
  Synthetic
caccgctgtcccaaaaggtcccaacttcttctcatagagagcaggcatttccggggcttcctcaatgtcaactgttggatttccatcaaccactggatttttagcaacaccatgaaacaccatatcagcagccagggcct

SEQ ID NO: 451533 - DNA, 140 bp, Artificial Sequence
  Synthetic
atacgccatgctgggtctcccattgtacctcttgcttgcccttagtttggcctctgttgccatgtgcaggacccctttctcattagccgaaggcattgtattggcgtcagcagctctgggcgtacttgggagtcggccat

SEQ ID NO: 451534 - DNA, 140 bp, Artificial Sequence
  Synthetic
atggccgactcccaagtacgcccagagctgctgacgccaatacaatgccttcggctaatgagaaaggggtcctgcacatggcaacagaggccaaactaagggcaagcaagaggtacaatgggagacccagcatggcgtat

SEQ ID NO: 451535 - DNA, 140 bp, Artificial Sequence
  Synthetic
atacgccatgctgggtctccgccactcatagaggggaataccagcctcctatggaatggacctatggctgtgtccatgacaggagttatgcgagggaattattatgcttttgtgggtgtccgtacttgggagtcggccat

SEQ ID NO: 451536 - DNA, 140 bp, Artificial Sequence
  Synthetic
atggccgactcccaagtacggacacccacaaaagcataataattccctcgcataactcctgtcatggacacagccataggtccattccataggaggctggtattcccctctatgagtggcggagacccagcatggcgtat

SEQ ID NO: 451537 - DNA, 140 bp, Artificial Sequence
  Synthetic
atacgccatgctgggtctccatgtacaatctctggaagatgaaaactgggcgcaggggaagagcgaatgggaaaaccctgggtgaggtctggaaaagggagttgaacctgctggacaagccgtacttgggagtcggccat

SEQ ID NO: 451538 - DNA, 140 bp, Artificial Sequence
  Synthetic
atggccgactcccaagtacggcttgtccagcaggttcaactcccttttccagacctcacccagggttttcccattcgctcttcccctgcgcccagttttcatcttccagagattgtacatggagacccagcatggcgtat

SEQ ID NO: 451539 - DNA, 140 bp, Artificial Sequence
  Synthetic
atacgccatgctgggtctccaacagtttgagctgtacaaaaggacagatatagtggaggtggaccgtgagacagcacgcagacacctggctgaagggaaggtggacactggggtagctgtcgtacttgggagtcggccat

SEQ ID NO: 451540 - DNA, 140 bp, Artificial Sequence
  Synthetic
atggccgactcccaagtacgacagctaccccagtgtccaccttcccttcagccaggtgtctgcgtgctgtctcacggtccacctccactatatctgtccttttgtacagctcaaactgttggagacccagcatggcgtat

SEQ ID NO: 451541 - DNA, 140 bp, Artificial Sequence
  Synthetic
atacgccatgctgggtctccttcgagagggaccgcaaaattgagatggtttcatgaacgtggctacgtcaagctagaaggcagggtgactgacttgggatgtgggcgtggtggctggtgccgtacttgggagtcggccat

SEQ ID NO: 451542 - DNA, 140 bp, Artificial Sequence
  Synthetic
atggccgactcccaagtacggcaccagccaccacgcccacatcccaagtcagtcaccctgccttctagcttgacgtagccacgttcatgaaaccatctcaattttgcggtccctctcgaaggagacccagcatggcgtat

SEQ ID NO: 451543 - DNA, 140 bp, Artificial Sequence
  Synthetic
atacgccatgctgggtctcctactatgctgctgcacagaaagaggtgagtggggtcaagggattcacccttggaaaggaaggccatgaaaaacccatgaatgtgcaaagcctgggatggacgtacttgggagtcggccat

SEQ ID NO: 451544 - DNA, 140 bp, Artificial Sequence
  Synthetic
atggccgactcccaagtacgtccatcccaggctttgcacattcatgggtttttcatggccttcctttccaagggtgaatcccttgaccccactcacctctttctgtgcagcagcatagtaggagacccagcatggcgtat

SEQ ID NO: 451545 - DNA, 140 bp, Artificial Sequence
  Synthetic
aggccctggctgctgatatgtggaaaggaaggccatgaaaaacccatgaatgtgcaaagcctgggatggaacatcatcacttttaaagacaagactgatattcaccgcctggagccagtggaccttttgggacagcggtg

SEQ ID NO: 451546 - DNA, 140 bp, Artificial Sequence
  Synthetic
caccgctgtcccaaaaggtccactggctccaggcggtgaatatcagtcttgtctttaaaagtgatgatgttccatcccaggctttgcacattcatgggtttttcatggccttcctttccacatatcagcagccagggcct

SEQ ID NO: 451547 - DNA, 140 bp, Artificial Sequence
  Synthetic
atacgccatgctgggtctccaagtgtgacaccctcttgtgcgatattggagagtcgtctccatcatcagtgaccgagggggaaaggaccatgcgagttcttgacaccgttgagaaatggccgtacttgggagtcggccat

SEQ ID NO: 451548 - DNA, 140 bp, Artificial Sequence
  Synthetic
atggccgactcccaagtacggccatttctcaacggtgtcaagaactcgcatggtcctttccccctcggtcactgatgatggagacgactctccaatatcgcacaagagggtgtcacacttggagacccagcatggcgtat

SEQ ID NO: 451549 - DNA, 140 bp, Artificial Sequence
  Synthetic
aggccctggctgctgatatggaccgagggggaaaggaccatgcgagttcttgacaccgttgagaaatggcttggctgcggtgttgagagcttttgtgtgaaggtgttggctccatacatggaccttttgggacagcggtg

SEQ ID NO: 451550 - DNA, 140 bp, Artificial Sequence
  Synthetic
caccgctgtcccaaaaggtccatgtatggagccaacaccttcacacaaaagctctcaacaccgcagccaagccatttctcaacggtgtcaagaactcgcatggtcctttccccctcggtccatatcagcagccagggcct

SEQ ID NO: 451551 - DNA, 140 bp, Artificial Sequence
  Synthetic
atacgccatgctgggtctccccagatgtgattgaaaagttggagttactccaaaggaggtttggtgggacggtcatcaggaaccccctttccagaaactctacccatgagatgtattatgcgtacttgggagtcggccat

SEQ ID NO: 451552 - DNA, 140 bp, Artificial Sequence
  Synthetic
atggccgactcccaagtacgcataatacatctcatgggtagagtttctggaaagggggttcctgatgaccgtcccaccaaacctcctttggagtaactccaacttttcaatcacatctggggagacccagcatggcgtat

SEQ ID NO: 451553 - DNA, 140 bp, Artificial Sequence
  Synthetic
aggccctggctgctgatatgggtcatcaggaaccccctttccagaaactctacccatgagatgtattatgtatctggagcccgcagcaacatcacatttactgtgaaccagacgtcccgcgaccttttgggacagcggtg

SEQ ID NO: 451554 - DNA, 140 bp, Artificial Sequence
  Synthetic
caccgctgtcccaaaaggtcgcgggacgtctggttcacagtaaatgtgatgttgctgcgggctccagatacataatacatctcatgggtagagtttctggaaagggggttcctgatgacccatatcagcagccagggcct

SEQ ID NO: 451555 - DNA, 140 bp, Artificial Sequence
  Synthetic
atacgccatgctgggtctccctcttaatgagaagaatgaggcgcccaacaggcaaagtgactctggaggctgacgtcatcctcccaattggaacacgcagtgtggaaacggacaaagggccgtacttgggagtcggccat

SEQ ID NO: 451556 - DNA, 140 bp, Artificial Sequence
  Synthetic
atggccgactcccaagtacggccctttgtccgtttccacactgcgtgttccaattgggaggatgacgtcagcctccagagtcactttgcctgttgggcgcctcattcttctcattaagagggagacccagcatggcgtat

SEQ ID NO: 451557 - DNA, 140 bp, Artificial Sequence
  Synthetic
aggccctggctgctgatatgtgacgtcatcctcccaattggaacacgcagtgtggaaacggacaaagggccactggatagggcagccattgaagagagggttgaaagaataaaatctgaagaccttttgggacagcggtg

SEQ ID NO: 451558 - DNA, 140 bp, Artificial Sequence
  Synthetic
caccgctgtcccaaaaggtcttcagattttattctttcaaccctctcttcaatggctgccctatccagtggccctttgtccgtttccacactgcgtgttccaattgggaggatgacgtcacatatcagcagccagggcct

SEQ ID NO: 451559 - DNA, 140 bp, Artificial Sequence
  Synthetic
atacgccatgctgggtctcctacacagccacctggttttatgacaatgacaacccttacaggacctggcattactgcggctcctatgtcacaagaacttcagggagtgcagcaagcatgacgtacttgggagtcggccat

SEQ ID NO: 451560 - DNA, 140 bp, Artificial Sequence
  Synthetic
atggccgactcccaagtacgtcatgcttgctgcactccctgaagttcttgtgacataggagccgcagtaatgccaggtcctgtaagggttgtcattgtcataaaaccaggtggctgtgtaggagacccagcatggcgtat

SEQ ID NO: 451561 - DNA, 140 bp, Artificial Sequence
  Synthetic
  misc_feature (91)..(91): n is a, c, g, or t
atacgccatgctgggtctcctcaatggagtgattaagatcttaacatacccctgggacaggatagaggaagttaccagaatggcaatgacngacacaactccctttggacaacaaagagtcgtacttgggagtcggccat

SEQ ID NO: 451562 - DNA, 140 bp, Artificial Sequence
  Synthetic
  misc_feature (50)..(50): n is a, c, g, or t
atggccgactcccaagtacgactctttgttgtccaaagggagttgtgtcngtcattgccattctggtaacttcctctatcctgtcccaggggtatgttaagatcttaatcactccattgaggagacccagcatggcgtat

SEQ ID NO: 451563 - DNA, 140 bp, Artificial Sequence
  Synthetic
atacgccatgctgggtctccgttcaaggaaaaagttgacaccagagcaaaggatccaccagcagggaccaggaaaattatgaaggttgtcaataggtggctgtttcgccacttggctaggcgtacttgggagtcggccat

SEQ ID NO: 451564 - DNA, 140 bp, Artificial Sequence
  Synthetic
atggccgactcccaagtacgcctagccaagtggcgaaacagccacctattgacaaccttcataattttcctggtccctgctggtggatcctttgctctggtgtcaactttttccttgaacggagacccagcatggcgtat

SEQ ID NO: 451565 - DNA, 140 bp, Artificial Sequence
  Synthetic
atacgccatgctgggtctccgaaaagagccccaggctgtgcacaaaggaggagttcatagcaaaagtccgtagccatgcagccatcggagctttcctggaagaacaagaacagtggaagacgtacttgggagtcggccat

SEQ ID NO: 451566 - DNA, 140 bp, Artificial Sequence
  Synthetic
atggccgactcccaagtacgtcttccactgttcttgttcttccaggaaagctccgatggctgcatggctacggacttttgctatgaactcctcctttgtgcacagcctggggctcttttcggagacccagcatggcgtat

SEQ ID NO: 451567 - DNA, 140 bp, Artificial Sequence
  Synthetic
aggccctggctgctgatatgtagccatgcagccatcggagctttcctggaagaacaagaacagtggaagactgccaatgaggctgtccaagatccgaaattctgggaattggtggatgaagaccttttgggacagcggtg

SEQ ID NO: 451568 - DNA, 140 bp, Artificial Sequence
  Synthetic
caccgctgtcccaaaaggtcttcatccaccaattcccagaatttcggatcttggacagcctcattggcagtcttccactgttcttgttcttccaggaaagctccgatggctgcatggctacatatcagcagccagggcct

SEQ ID NO: 451569 - DNA, 140 bp, Artificial Sequence
  Synthetic
atacgccatgctgggtctccgaacgacggctacaccaacagggtaggtgtcggacttgtgtgtacaacatgatggggaaaagggagaaaaaactgtcagagttcggaaaggcgaaaggaacgtacttgggagtcggccat

SEQ ID NO: 451570 - DNA, 140 bp, Artificial Sequence
  Synthetic
atggccgactcccaagtacgttcctttcgcctttccgaactctgacagttttttctcccttttccccatcatgttgtacacacaagtccgacacctaccctgttggtgtagccgtcgttcggagacccagcatggcgtat

SEQ ID NO: 451571 - DNA, 140 bp, Artificial Sequence
  Synthetic
atacgccatgctgggtctccgtcgagccatctggtacatgtggttgggagcccgatatcttgagtttgaagccctgggattcttaaatgaggaccactgggcgtccagggaaaactcaggcgtacttgggagtcggccat

SEQ ID NO: 451572 - DNA, 140 bp, Artificial Sequence
  Synthetic
atggccgactcccaagtacgcctgagttttccctggacgcccagtggtcctcatttaagaatcccagggcttcaaactcaagatatcgggctcccaaccacatgtaccagatggctcgacggagacccagcatggcgtat

SEQ ID NO: 451573 - DNA, 140 bp, Artificial Sequence
  Synthetic
atacgccatgctgggtctccggggggagttgaaggcatcggtctgcaacacctgggctacgtgattagaggcctggctgcactagaaggtggtggattctatgcagatgacacagctggacgtacttgggagtcggccat

SEQ ID NO: 451574 - DNA, 140 bp, Artificial Sequence
  Synthetic
atggccgactcccaagtacgtccagctgtgtcatctgcatagaatccaccaccttctagtgcagccaggcctctaatcacgtagcccaggtgttgcagaccgatgccttcaactccccccggagacccagcatggcgtat

SEQ ID NO: 451575 - DNA, 140 bp, Artificial Sequence
  Synthetic
atacgccatgctgggtctcctgggatacacgcatcacagaggcggatctggatgatgaacaggagatcttgaactacatgagtccacaccataggaagctcgcactggcagtgatggaaacgtacttgggagtcggccat

SEQ ID NO: 451576 - DNA, 140 bp, Artificial Sequence
  Synthetic
atggccgactcccaagtacgtttccatcactgccagtgcgagcttcctatggtgtggactcatgtagttcaagatctcctgttcatcatccagatccgcctctgtgatgcgtgtatcccaggagacccagcatggcgtat

SEQ ID NO: 451577 - DNA, 140 bp, Artificial Sequence
  Synthetic
atacgccatgctgggtctcctgacatataaaaacaaggtggtgaaagtcttgagaccagctccaggtgggaaagcatacatggatgtcataagccggcgggaccagaggggatctgggcacgtacttgggagtcggccat

SEQ ID NO: 451578 - DNA, 140 bp, Artificial Sequence
  Synthetic
atggccgactcccaagtacgtgcccagatcccctctggtcccgccggcttatgacatccatgtatgctttcccacctggagctggtctcaagactttcaccaccttgtttttatatgtcaggagacccagcatggcgtat

SEQ ID NO: 451579 - DNA, 140 bp, Artificial Sequence
  Synthetic
atacgccatgctgggtctccggtagtgacttatgctttgaataccatcaccaatctgaaggttcaactggtcaggatggcggaagcagagatggtggtgcaccaccagcatgtccaggatcgtacttgggagtcggccat

SEQ ID NO: 451580 - DNA, 140 bp, Artificial Sequence
  Synthetic
atggccgactcccaagtacgatcctggacatgctggtggtgcaccaccatctctgcttccgccatcctgaccagttgaaccttcagattggtgatggtattcaaagcataagtcactaccggagacccagcatggcgtat

SEQ ID NO: 451581 - DNA, 140 bp, Artificial Sequence
  Synthetic
atacgccatgctgggtctcctgtgacgatgcggttttgacaaaacttgaggcatggctcgctgagcatggctgcgataggttgaagaggatggcagtgagtggagatgactgtgtcgttccgtacttgggagtcggccat

SEQ ID NO: 451582 - DNA, 140 bp, Artificial Sequence
  Synthetic
atggccgactcccaagtacggaacgacacagtcatctccactcactgccatcctcttcaacctatcgcagccatgctcagcgagccatgcctcaagttttgtcaaaaccgcatcgtcacaggagacccagcatggcgtat

SEQ ID NO: 451583 - DNA, 140 bp, Artificial Sequence
  Synthetic
atacgccatgctgggtctccgccccattgatgacaggtttggcctggctctgtctcatcttaacgccatgtccaaggtgcgcaaggacatatctgaatggcagccatcaaaaggatggaacgtacttgggagtcggccat

SEQ ID NO: 451584 - DNA, 140 bp, Artificial Sequence
  Synthetic
atggccgactcccaagtacgttccatccttttgatggctgccattcagatatgtccttgcgcaccttggacatggcgttaagatgagacagagccaggccaaacctgtcatcaatggggcggagacccagcatggcgtat

SEQ ID NO: 451585 - DNA, 140 bp, Artificial Sequence
  Synthetic
aggccctggctgctgatatgtccaaggtgcgcaaggacatatctgaatggcagccatcaaaaggatggaatgactgggagaatgtgccgttctgctcccaccacttccacgaactgcagcgaccttttgggacagcggtg

SEQ ID NO: 451586 - DNA, 140 bp, Artificial Sequence
  Synthetic
caccgctgtcccaaaaggtcgctgcagttcgtggaagtggtgggagcagaacggcacattctcccagtcattccatccttttgatggctgccattcagatatgtccttgcgcaccttggacatatcagcagccagggcct

SEQ ID NO: 451587 - DNA, 140 bp, Artificial Sequence
  Synthetic
atacgccatgctgggtctcctgaaggatggcaggagaatcgtggtgccttgtcgggatcaagatgagctaattgggaggggaagagtttctccaggaaatggctggatgatcaaggagaccgtacttgggagtcggccat

SEQ ID NO: 451588 - DNA, 140 bp, Artificial Sequence
  Synthetic
atggccgactcccaagtacggtctccttgatcatccagccatttcctggagaaactcttcccctcccaattagctcatcttgatcccgacaaggcaccacgattctcctgccatccttcaggagacccagcatggcgtat

SEQ ID NO: 451589 - DNA, 140 bp, Artificial Sequence
  Synthetic
atacgccatgctgggtctccagcgtgcctaagtaaggcttatgccaacatgtggtcattgatgtactttcacaagagggatatgaggctgctgtcactggctgtttcttctgctgttccccgtacttgggagtcggccat

SEQ ID NO: 451590 - DNA, 140 bp, Artificial Sequence
  Synthetic
atggccgactcccaagtacggggaacagcagaagaaacagccagtgacagcagcctcatatccctcttgtgaaagtacatcaatgaccacatgttggcataagccttacttaggcacgctggagacccagcatggcgtat

SEQ ID NO: 451591 - DNA, 140 bp, Artificial Sequence
  Synthetic
atacgccatgctgggtctcctagtcaacaacccacacatgcaggacaaaacaacggtgaaagagtggcgagacatcccctacctaaccaagaggcaggacaagctttgtggatcactgatcgtacttgggagtcggccat

SEQ ID NO: 451592 - DNA, 140 bp, Artificial Sequence
  Synthetic
atggccgactcccaagtacgatcagtgatccacaaagcttgtcctgcctcttggttaggtaggggatgtctcgccactctttcaccgttgttttgtcctgcatgtgtgggttgttgactaggagacccagcatggcgtat

SEQ ID NO: 451593 - DNA, 140 bp, Artificial Sequence
  Synthetic
atacgccatgctgggtctcctggaatgaccaacagagccacttgggcatctcatatccacttggtgatacaccgcatccggacattgattgggaaggaaaaatatactgattatctgacacgtacttgggagtcggccat

SEQ ID NO: 451594 - DNA, 140 bp, Artificial Sequence
  Synthetic
atggccgactcccaagtacgtgtcagataatcagtatatttttccttcccaatcaatgtccggatgcggtgtatcaccaagtggatatgagatgcccaagtggctctgttggtcattccaggagacccagcatggcgtat

SEQ ID NO: 451595 - DNA, 140 bp, Artificial Sequence
  Synthetic
atacgccatgctgggtctccgtcatggacagatactctgtggatgctgacctgcagcccggcgagctcatttgagacgccattttacagggacaaccaagaacctaacactgtatatagacgtacttgggagtcggccat

SEQ ID NO: 451596 - DNA, 140 bp, Artificial Sequence
  Synthetic
atggccgactcccaagtacgtctatatacagtgttaggttcttggttgtccctgtaaaatggcgtctcaaatgagctcgccgggctgcaggtcagcatccacagagtatctgtccatgacggagacccagcatggcgtat

SEQ ID NO: 451597 - DNA, 140 bp, Artificial Sequence
  Synthetic
atacgccatgctgggtctccatgggaatgaaaccgggataaaaactacggatggagaaccggactccacacattaaatagaagatgatgtcagcccagaaccccatgtgggttctgccaccgtacttgggagtcggccat

SEQ ID NO: 451598 - DNA, 140 bp, Artificial Sequence
  Synthetic
atggccgactcccaagtacggtggcagaacccacatggggttctgggctgacatcatcttctatttaatgtgtggagtccggttctccatccgtagtttttatcccggtttcattcccatggagacccagcatggcgtat

SEQ ID NO: 451599 - DNA, 140 bp, Artificial Sequence
  Synthetic
aggccctggctgctgatatgcattaaatagaagatgatgtcagcccagaaccccatgtgggttctgccactgctaagctgtgaggcagtgcaggctgggacagccgccttccaggttgcggaccttttgggacagcggtg

SEQ ID NO: 451600 - DNA, 140 bp, Artificial Sequence
  Synthetic
caccgctgtcccaaaaggtccgcaacctggaaggcggctgtcccagcctgcactgcctcacagcttagcagtggcagaacccacatggggttctgggctgacatcatcttctatttaatgcatatcagcagccagggcct

SEQ ID NO: 451601 - DNA, 140 bp, Artificial Sequence
  Synthetic
atacgccatgctgggtctccataaacctggtttctgagacttcccacctcagagtaaaaccaaacggagcctccgctaccaccttcccacgtggtggtagaaagacggggtctagaggttcgtacttgggagtcggccat

SEQ ID NO: 451602 - DNA, 140 bp, Artificial Sequence
  Synthetic
atggccgactcccaagtacgaacctctagaccccgtctttctaccaccacgtgggaaggtggtagcggaggctccgtttggttttactctgaggtgggaagtctcagaaaccaggtttatggagacccagcatggcgtat

SEQ ID NO: 451603 - DNA, 140 bp, Artificial Sequence
  Synthetic
aggccctggctgctgatatgtagctgtcctgaagaaggttaaaagggtggtggcgagtctgatgagaggtttgtcctcgaggaaacgccgatcccaagacgttctgactgtgcaatttctgaccttttgggacagcggtg

SEQ ID NO: 451604 - DNA, 140 bp, Artificial Sequence
  Synthetic
caccgctgtcccaaaaggtcagaaattgcacagtcagaacgtcttgggatcggcgtttcctcgaggacaaacctctcatcagactcgccaccacccttttaaccttcttcaggacagctacatatcagcagccagggcct

SEQ ID NO: 451605 - DNA, 140 bp, Artificial Sequence
  Synthetic
atacgccatgctgggtctccgcttatggcaagtgtgattcagcgggtaggtcaagaaggtccagaagggccattgacttacccacacatgaaaatcatggcttaaagacccggcaagaaacgtacttgggagtcggccat

SEQ ID NO: 451606 - DNA, 140 bp, Artificial Sequence
  Synthetic
atggccgactcccaagtacgtttcttgccgggtctttaagccatgattttcatgtgtgggtaagtcaatggcccttctggaccttcttgacctacccgctgaatcacacttgccataagcggagacccagcatggcgtat

SEQ ID NO: 451607 - DNA, 140 bp, Artificial Sequence
  Synthetic
atacgccatgctgggtctcccattgacttacccacacatgaaaatcatggcttaaagacccggcaagaaaagtggatgaccggaagaatgggcgagagacagctgcagaaaattgaaagacgtacttgggagtcggccat

SEQ ID NO: 451608 - DNA, 140 bp, Artificial Sequence
  Synthetic
atggccgactcccaagtacgtctttcaattttctgcagctgtctctcgcccattcttccggtcatccacttttcttgccgggtctttaagccatgattttcatgtgtgggtaagtcaatgggagacccagcatggcgtat

SEQ ID NO: 451609 - DNA, 140 bp, Artificial Sequence
  Synthetic
aggccctggctgctgatatgagagatgcatcatctcgtggaatttgagcctccacatgctgcaaccatcaaagtgttagcccttggaaaccaagaaggatccttgaagactgctctcactgaccttttgggacagcggtg

SEQ ID NO: 451610 - DNA, 140 bp, Artificial Sequence
  Synthetic
caccgctgtcccaaaaggtcagtgagagcagtcttcaaggatccttcttggtttccaagggctaacactttgatggttgcagcatgtggaggctcaaattccacgagatgatgcatctctcatatcagcagccagggcct

SEQ ID NO: 451611 - DNA, 140 bp, Artificial Sequence
  Synthetic
atacgccatgctgggtctccaagtgttagcccttggaaaccaagaaggatccttgaagactgctctcactggtgcaatgcgagttacaaaagacacaaataacagcaagctatacaagttcgtacttgggagtcggccat

SEQ ID NO: 451612 - DNA, 140 bp, Artificial Sequence
  Synthetic
atggccgactcccaagtacgaacttgtatagcttgctgttatttgtgtcttttgtaactcgcattgcaccagtgagagcagtcttcaaggatccttcttggtttccaagggctaacacttggagacccagcatggcgtat

SEQ ID NO: 451613 - DNA, 140 bp, Artificial Sequence
  Synthetic
aggccctggctgctgatatggggagcaccctgcaggatcccagtgatggtcgccgatgatctcacagcggcagtcaacaagggcattttggtcacagtcaatccaatagcctccactaacgaccttttgggacagcggtg

SEQ ID NO: 451614 - DNA, 140 bp, Artificial Sequence
  Synthetic
caccgctgtcccaaaaggtcgttagtggaggctattggattgactgtgaccaaaatgcccttgttgactgccgctgtgagatcatcggcgaccatcactgggatcctgcagggtgctccccatatcagcagccagggcct

SEQ ID NO: 451615 - DNA, 140 bp, Artificial Sequence
  Synthetic
atacgccatgctgggtctccgcagctcaatagggaagttgttcacccagaccatgaagggcgcagagcgtctggctgtcatgggggatgctgcctgggactttggctctgctgggggattcgtacttgggagtcggccat

SEQ ID NO: 451616 - DNA, 140 bp, Artificial Sequence
  Synthetic
atggccgactcccaagtacgaatcccccagcagagccaaagtcccaggcagcatcccccatgacagccagacgctctgcgcccttcatggtctgggtgaacaacttccctattgagctgcggagacccagcatggcgtat

SEQ ID NO: 451617 - DNA, 140 bp, Artificial Sequence
  Synthetic
atacgccatgctgggtctccatgtggagaagcagggcagatgagatcaatgccatccttgaggagaatgaggtagacatctcagtggtggtccaagactcaaaaaacatttaccagagagcgtacttgggagtcggccat

SEQ ID NO: 451618 - DNA, 140 bp, Artificial Sequence
  Synthetic
atggccgactcccaagtacgctctctggtaaatgttttttgagtcttggaccaccactgagatgtctacctcattctcctcaaggatggcattgatctcatctgccctgcttctccacatggagacccagcatggcgtat

SEQ ID NO: 451619 - DNA, 140 bp, Artificial Sequence
  Synthetic
atacgccatgctgggtctccagtcggaggcatggtgcttctaggagccatgttagttggacaggtgactatcttggacttgctgaagctcacagtggcggttggattgcactttcatgagcgtacttgggagtcggccat

SEQ ID NO: 451620 - DNA, 140 bp, Artificial Sequence
  Synthetic
atggccgactcccaagtacgctcatgaaagtgcaatccaaccgccactgtgagcttcagcaagtccaagatagtcacctgtccaactaacatggctcctagaagcaccatgcctccgactggagacccagcatggcgtat

SEQ ID NO: 451621 - DNA, 140 bp, Artificial Sequence
  Synthetic
atacgccatgctgggtctccatgaataatggaggggatgccatgtatatggccttgatcactgcattctcaatcagaccagggctgctcatcggctttggattgaggacgctgtggagcccgtacttgggagtcggccat

SEQ ID NO: 451622 - DNA, 140 bp, Artificial Sequence
  Synthetic
atggccgactcccaagtacgggctccacagcgtcctcaatccaaagccgatgagcagccctggtctgattgagaatgcagtgatcaaggccatatacatggcatcccctccattattcatggagacccagcatggcgtat

SEQ ID NO: 451623 - DNA, 140 bp, Artificial Sequence
  Synthetic
aggccctggctgctgatatgaatcagaccagggctgctcatcggctttggattgaggacgctgtggagccctcgggaacgccttgtgctgaccctgggggctgctatggtggagattgctgaccttttgggacagcggtg

SEQ ID NO: 451624 - DNA, 140 bp, Artificial Sequence
  Synthetic
caccgctgtcccaaaaggtcagcaatctccaccatagcagcccccagggtcagcacaaggcgttcccgagggctccacagcgtcctcaatccaaagccgatgagcagccctggtctgattcatatcagcagccagggcct

SEQ ID NO: 451625 - DNA, 140 bp, Artificial Sequence
  Synthetic
atacgccatgctgggtctccaaggtgccatgggatcaggttgtgatgacttcattggctttggtcggagctgctatccacccatttgcactcttattggttcttgctggctggttgttcccgtacttgggagtcggccat

SEQ ID NO: 451626 - DNA, 140 bp, Artificial Sequence
  Synthetic
atggccgactcccaagtacgggaacaaccagccagcaagaaccaataagagtgcaaatgggtggatagcagctccgaccaaagccaatgaagtcatcacaacctgatcccatggcaccttggagacccagcatggcgtat

SEQ ID NO: 451627 - DNA, 140 bp, Artificial Sequence
  Synthetic
atacgccatgctgggtctccgacaactcttttgtgtctgccatatcccaaactgaggtgaaagaagaggggaaagaggagctacaggaaatcccgacaatgttgaagaaagggatgacaacgtacttgggagtcggccat

SEQ ID NO: 451628 - DNA, 140 bp, Artificial Sequence
  Synthetic
atggccgactcccaagtacgttgtcatccctttcttcaacattgtcgggatttcctgtagctcctctttcccctcttctttcacctcagtttgggatatggcagacacaaaagagttgtcggagacccagcatggcgtat

SEQ ID NO: 451629 - DNA, 140 bp, Artificial Sequence
  Synthetic
atacgccatgctgggtctccgtcattgacgccatgtgtcatgctaccctgacatataggatgctggaaccaaccagagtggtcaactgggaagtgatcatcatggacgaagcacacttttcgtacttgggagtcggccat

SEQ ID NO: 451630 - DNA, 140 bp, Artificial Sequence
  Synthetic
atggccgactcccaagtacgaaaagtgtgcttcgtccatgatgatcacttcccagttgaccactctggttggttccagcatcctatatgtcagggtagcatgacacatggcgtcaatgacggagacccagcatggcgtat

SEQ ID NO: 451631 - DNA, 140 bp, Artificial Sequence
  Synthetic
atacgccatgctgggtctccttggccactgacatagctgagatgggagccaatctctgcgtggagagagtgttggattgtagaacgtcctttaaacctgtgcttgtggatgaagggaggacgtacttgggagtcggccat

SEQ ID NO: 451632 - DNA, 140 bp, Artificial Sequence
  Synthetic
atggccgactcccaagtacgtcctcccttcatccacaagcacaggtttaaaggacgttctacaatccaacactctctccacgcagagattggctcccatctcagctatgtcagtggccaaggagacccagcatggcgtat

SEQ ID NO: 451633 - DNA, 140 bp, Artificial Sequence
  Synthetic
atacgccatgctgggtctccctactctgagcccacaagtgaagacaatgcacatcatgtctgttggctggaggcctcaatgctcctagacaacatggaggtgaggggtgggatggttgctcgtacttgggagtcggccat

SEQ ID NO: 451634 - DNA, 140 bp, Artificial Sequence
  Synthetic
atggccgactcccaagtacgagcaaccatcccacccctcacctccatgttgtctaggagcattgaggcctccagccaacagacatgatgtgcattgtcttcacttgtgggctcagagtagggagacccagcatggcgtat

SEQ ID NO: 451635 - DNA, 140 bp, Artificial Sequence
  Synthetic
atacgccatgctgggtctccgaatgacagtggtgagacagtaaagtgtagagcccctggaggagctaagaagcctctgcgtccaaggtggtgcgatgaaagggtgtcgtctgaccagagtcgtacttgggagtcggccat

SEQ ID NO: 451636 - DNA, 140 bp, Artificial Sequence
  Synthetic
atggccgactcccaagtacgactctggtcagacgacaccctttcatcgcaccaccttggacgcagaggcttcttagctcctccaggggctctacactttactgtctcaccactgtcattcggagacccagcatggcgtat

SEQ ID NO: 451637 - DNA, 140 bp, Artificial Sequence
  Synthetic
aggccctggctgctgatatgagagcttaccgcaatgcattatcaatgatgcctgaggcaatgacaacagtcatgctgtttgttctggctgggctgctgacgtctggaatggttatcttttgaccttttgggacagcggtg

SEQ ID NO: 451638 - DNA, 140 bp, Artificial Sequence
  Synthetic
caccgctgtcccaaaaggtcaaaagataaccattccagacgtcagcagcccagccagaacaaacagcatgactgttgtcattgcctcaggcatcattgataatgcattgcggtaagctctcatatcagcagccagggcct

SEQ ID NO: 451639 - DNA, 140 bp, Artificial Sequence
  Synthetic
atacgccatgctgggtctccctcctatatcatgctaatattttttgtcttgatggtggttgtggttccggagccggggcagcagagaaccattcaggacaatcaggtggcttatctcatccgtacttgggagtcggccat

SEQ ID NO: 451640 - DNA, 140 bp, Artificial Sequence
  Synthetic
atggccgactcccaagtacggatgagataagccacctgattgtcctgaatggttctctgctgccccggctccggaaccacaaccaccatcaagacaaaaaatattagcatgatataggagggagacccagcatggcgtat

SEQ ID NO: 451641 - DNA, 140 bp, Artificial Sequence
  Synthetic
aggccctggctgctgatatggctggaaaagactaaggaagacctctttgggaaaaagaatttgattccatcaagcgccgcaccttggagctggccagactttgacctgaaaccaggagctgaccttttgggacagcggtg

SEQ ID NO: 451642 - DNA, 140 bp, Artificial Sequence
  Synthetic
caccgctgtcccaaaaggtcagctcctggtttcaggtcaaagtctggccagctccaaggtgcggcgcttgatggaatcaaattctttttcccaaagaggtcttccttagtcttttccagccatatcagcagccagggcct

SEQ ID NO: 451643 - DNA, 140 bp, Artificial Sequence
  Synthetic
aggccctggctgctgatatgtactatgctgctgcacagagagaagtgagtggggttaagggattcacccttggaaaggaaggccacgaaaagcccatgaatgtgcaaagcctggggtggagaccttttgggacagcggtg

SEQ ID NO: 451644 - DNA, 140 bp, Artificial Sequence
  Synthetic
caccgctgtcccaaaaggtctccaccccaggctttgcacattcatgggcttttcgtggccttcctttccaagggtgaatcccttaaccccactcacttctctctgtgcagcagcatagtacatatcagcagccagggcct

SEQ ID NO: 451645 - DNA, 140 bp, Artificial Sequence
  Synthetic
atacgccatgctgggtctccacatcatcactttcaaggataagattgatgtccatcgccttgagccagtaaagtgtgacaccctgctgtgcgacattggagagtcgtcttcatcatcagtcgtacttgggagtcggccat

SEQ ID NO: 451646 - DNA, 140 bp, Artificial Sequence
  Synthetic
atggccgactcccaagtacgactgatgatgaagacgactctccaatgtcgcacagcagggtgtcacactttactggctcaaggcgatggacatcaatcttatccttgaaagtgatgatgtggagacccagcatggcgtat

SEQ ID NO: 451647 - DNA, 140 bp, Artificial Sequence
  Synthetic
aggccctggctgctgatatgggttatcaggaaccctctctctagaaattctacccacgagatgtattatgtgtcaggagcccgcagcaacatcgcgttcactgtaaatcaaacatcccgcgaccttttgggacagcggtg

SEQ ID NO: 451648 - DNA, 140 bp, Artificial Sequence
  Synthetic
caccgctgtcccaaaaggtcgcgggatgtttgatttacagtgaacgcgatgttgctgcgggctcctgacacataatacatctcgtgggtagaatttctagagagagggttcctgataacccatatcagcagccagggcct

SEQ ID NO: 451649 - DNA, 140 bp, Artificial Sequence
  Synthetic
aggccctggctgctgatatgtacaccgccacttggttccatgataatgacaacccttacaggacttggcattattgcggttcctatgttacaagaacctcagggagcgcggcaagcatgagaccttttgggacagcggtg

SEQ ID NO: 451650 - DNA, 140 bp, Artificial Sequence
  Synthetic
caccgctgtcccaaaaggtctcatgcttgccgcgctccctgaggttcttgtaacataggaaccgcaataatgccaagtcctgtaagggttgtcattatcatggaaccaagtggcggtgtacatatcagcagccagggcct

SEQ ID NO: 451651 - DNA, 140 bp, Artificial Sequence
  Synthetic
aggccctggctgctgatatgtcaacggggtgatcaaaatcttgacatacccctgggacaggatagaggaagtcacgagaatggcaatgacagacacaactccttttggacaacaaagagtgaccttttgggacagcggtg

SEQ ID NO: 451652 - DNA, 140 bp, Artificial Sequence
  Synthetic
caccgctgtcccaaaaggtcactctttgttgtccaaaaggagttgtgtctgtcattgccattctcgtgacttcctctatcctgtcccaggggtatgtcaagattttgatcaccccgttgacatatcagcagccagggcct

SEQ ID NO: 451653 - DNA, 140 bp, Artificial Sequence
  Synthetic
aggccctggctgctgatatggttcaaggaaaaagttgacaccagagcaaaggatccaccagcagggaccaggaaaatcatgaaggttgtcaataggtggctattccgtcacttggccagagaccttttgggacagcggtg

SEQ ID NO: 451654 - DNA, 140 bp, Artificial Sequence
  Synthetic
caccgctgtcccaaaaggtctctggccaagtgacggaatagccacctattgacaaccttcatgattttcctggtccctgctggtggatcctttgctctggtgtcaactttttccttgaaccatatcagcagccagggcct

SEQ ID NO: 451655 - DNA, 140 bp, Artificial Sequence
  Synthetic
atacgccatgctgggtctcccagtcatgcagccatcggagctttcctggaagagcaagaacagtggaagactgccaatgaagctgtccaagatccgaaattctgggaattagtggatgaacgtacttgggagtcggccat

SEQ ID NO: 451656 - DNA, 140 bp, Artificial Sequence
  Synthetic
atggccgactcccaagtacgttcatccactaattcccagaatttcggatcttggacagcttcattggcagtcttccactgttcttgctcttccaggaaagctccgatggctgcatgactgggagacccagcatggcgtat

SEQ ID NO: 451657 - DNA, 140 bp, Artificial Sequence
  Synthetic
atacgccatgctgggtctccgaactacatgagtccacaccacaggaagctagcgctggctgtgatggaaatgacatacaaaaataaagtggtgaaagtcctaaggccatctccaggtgggcgtacttgggagtcggccat

SEQ ID NO: 451658 - DNA, 140 bp, Artificial Sequence
  Synthetic
atggccgactcccaagtacgcccacctggagatggccttaggactttcaccactttatttttgtatgtcatttccatcacagccagcgctagcttcctgtggtgtggactcatgtagttcggagacccagcatggcgtat

SEQ ID NO: 451659 - DNA, 140 bp, Artificial Sequence
  Synthetic
aggccctggctgctgatatgtgacatacaaaaataaagtggtgaaagtcctaaggccatctccaggtgggaaagcttacatggatgtcataagccggcgggaccagataggatccgggcagaccttttgggacagcggtg

SEQ ID NO: 451660 - DNA, 140 bp, Artificial Sequence
  Synthetic
caccgctgtcccaaaaggtctgcccggatcctatctggtcccgccggcttatgacatccatgtaagctttcccacctggagatggccttaggactttcaccactttatttttgtatgtcacatatcagcagccagggcct

SEQ ID NO: 451661 - DNA, 140 bp, Artificial Sequence
  Synthetic
atacgccatgctgggtctcctgtgatgatgcggttctgaccaaacttgaagcatggctcgctgagcatggctgcgataggctgaagaggatggcagtgagtggagatgactgtgttgtcccgtacttgggagtcggccat

SEQ ID NO: 451662 - DNA, 140 bp, Artificial Sequence
  Synthetic
atggccgactcccaagtacgggacaacacagtcatctccactcactgccatcctcttcagcctatcgcagccatgctcagcgagccatgcttcaagtttggtcagaaccgcatcatcacaggagacccagcatggcgtat

SEQ ID NO: 451663 - DNA, 140 bp, Artificial Sequence
  Synthetic
atacgccatgctgggtctcctgactgggagaatgtacctttctgctctcaccactttcatgaactgcaattgaaggatggcaggagaattgtggtgccttgccgggatcaagatgagctgcgtacttgggagtcggccat

SEQ ID NO: 451664 - DNA, 140 bp, Artificial Sequence
  Synthetic
atggccgactcccaagtacgcagctcatcttgatcccggcaaggcaccacaattctcctgccatccttcaattgcagttcatgaaagtggtgagagcagaaaggtacattctcccagtcaggagacccagcatggcgtat

SEQ ID NO: 451665 - DNA, 140 bp, Artificial Sequence
  Synthetic
atacgccatgctgggtctccgttggcagaggaagagtgtctccaggaaatggctggatgatcaaggaaacagcatgccttagcaaggcctacgccaacatgtgggcactgatgtactttccgtacttgggagtcggccat

SEQ ID NO: 451666 - DNA, 140 bp, Artificial Sequence
  Synthetic
atggccgactcccaagtacggaaagtacatcagtgcccacatgttggcgtaggccttgctaaggcatgctgtttccttgatcatccagccatttcctggagacactcttcctctgccaacggagacccagcatggcgtat

SEQ ID NO: 451667 - DNA, 140 bp, Artificial Sequence
  Synthetic
aggccctggctgctgatatgaaaactgaaaccgggataaaaactacggatggagaaccggactccacacattaaacagaagaggatgtcagcccagaaacccgcgtgggttctgccactggaccttttgggacagcggtg

SEQ ID NO: 451668 - DNA, 140 bp, Artificial Sequence
  Synthetic
caccgctgtcccaaaaggtccagtggcagaacccacgcgggtttctgggctgacatcctcttctgtttaatgtgtggagtccggttctccatccgtagtttttatcccggtttcagttttcatatcagcagccagggcct

SEQ ID NO: 451669 - DNA, 140 bp, Artificial Sequence
  Synthetic
atacgccatgctgggtctccctaagctgtgaggcagtgcaggctgggacagccgttttccaggatgcgaaaaacctggtttctgagacttcccacctcagagtaaaaccaaatggagcctcgtacttgggagtcggccat

SEQ ID NO: 451670 - DNA, 140 bp, Artificial Sequence
  Synthetic
atggccgactcccaagtacgaggctccatttggttttactctgaggtgggaagtctcagaaaccaggtttttcgcatcctggaaaacggctgtcccagcctgcactgcctcacagcttagggagacccagcatggcgtat

SEQ ID NO: 451671 - DNA, 140 bp, Artificial Sequence
  Synthetic
atacgccatgctgggtctccgattctgggaatgctgctgatggttggtggagtgaccctggtgcgcagaaacagatggttacttctgaatgttacatctgaggaccttgggaaaacctttcgtacttgggagtcggccat

SEQ ID NO: 451672 - DNA, 140 bp, Artificial Sequence
  Synthetic
atggccgactcccaagtacgaaaggttttcccaaggtcctcagatgtaacattcagaagtaaccatctgtttctgcgcaccagggtcactccaccaaccatcagcagcattcccagaatcggagacccagcatggcgtat

SEQ ID NO: 451673 - DNA, 140 bp, Artificial Sequence
  Synthetic
atacgccatgctgggtctccgtgtccagattccatggaatacaactgccccaatctcagtccaagagaagagcctgatgacatagattgttggtgctatggagtggaaaatgtcagagtccgtacttgggagtcggccat

SEQ ID NO: 451674 - DNA, 140 bp, Artificial Sequence
  Synthetic
atggccgactcccaagtacggactctgacattttccactccatagcaccaacaatctatgtcatcaggctcttctcttggactgagattggggcagttgtattccatggaatctggacacggagacccagcatggcgtat

SEQ ID NO: 451675 - DNA, 140 bp, Artificial Sequence
  Synthetic
atacgccatgctgggtctccaaggtgccatgggaccaggttgtgatgacttcattggccttggtcggagctgctatccacccatttgccctcttattggttcttgctggctggttgcttccgtacttgggagtcggccat

SEQ ID NO: 451676 - DNA, 140 bp, Artificial Sequence
  Synthetic
atggccgactcccaagtacggaagcaaccagccagcaagaaccaataagagggcaaatgggtggatagcagctccgaccaaggccaatgaagtcatcacaacctggtcccatggcaccttggagacccagcatggcgtat

SEQ ID NO: 451677 - DNA, 140 bp, Artificial Sequence
  Synthetic
atacgccatgctgggtctccacagaagaggatgtcagcccggaaacccgcgcgggttctgccactgctaagctgtgaggcagtgcaggctgggacagccgccttccaggttgcgaaaaaccgtacttgggagtcggccat

SEQ ID NO: 451678 - DNA, 140 bp, Artificial Sequence
  Synthetic
atggccgactcccaagtacggtttttcgcaacctggaaggcggctgtcccagcctgcactgcctcacagcttagcagtggcagaacccgcgcgggtttccgggctgacatcctcttctgtggagacccagcatggcgtat

SEQ ID NO: 451679 - DNA, 140 bp, Artificial Sequence
  Synthetic
atacgccatgctgggtctccagggaaagaccggagtggttctctgcttttcctccagaggttctgtgagcacagttgctcaagaataagcagacctttggtagaaagacacaaaaccactcgtacttgggagtcggccat

SEQ ID NO: 451680 - DNA, 140 bp, Artificial Sequence
  Synthetic
atggccgactcccaagtacgagtggttttgtgtctttctaccaaaggtctgcttattcttgagcaactgtgctcacagaacctctggaggaaaagcagagaaccactccggtctttccctggagacccagcatggcgtat

SEQ ID NO: 451681 - DNA, 140 bp, Artificial Sequence
  Synthetic
atacgccatgctgggtctcctgggcgtcaatatggtaagacgaggagtacgctccttgtcaaacaaaataaaacaaaaaacaaaacagattggaaacagacctggcccttcaagaggtgtcgtacttgggagtcggccat

SEQ ID NO: 451682 - DNA, 140 bp, Artificial Sequence
  Synthetic
atggccgactcccaagtacgacacctcttgaagggccaggtctgtttccaatctgttttgttttttgttttattttgtttgacaaggagcgtactcctcgtcttaccatattgacgcccaggagacccagcatggcgtat

SEQ ID NO: 451683 - DNA, 140 bp, Artificial Sequence
  Synthetic
atacgccatgctgggtctcctaactacccacctgaaaaggctctggagaatgcttgacccccgacagggacttgctgttctaaggaaagttaagagggtggtagccagcttgatgagaggcgtacttgggagtcggccat

SEQ ID NO: 451684 - DNA, 140 bp, Artificial Sequence
  Synthetic
atggccgactcccaagtacgcctctcatcaagctggctaccaccctcttaactttccttagaacagcaagtccctgtcgggggtcaagcattctccagagccttttcaggtgggtagttaggagacccagcatggcgtat

SEQ ID NO: 451685 - DNA, 140 bp, Artificial Sequence
  Synthetic
atacgccatgctgggtctccgttgtcatctaggaagcgtcgctctaatgagatgaccatgatgccacttctaatcttgagcatggtgatcttggctggaggggtgacactcgtccggaaacgtacttgggagtcggccat

SEQ ID NO: 451686 - DNA, 140 bp, Artificial Sequence
  Synthetic
atggccgactcccaagtacgtttccggacgagtgtcacccctccagccaagatcaccatgctcaagattagaagtggcatcatggtcatctcattagagcgacgcttcctagatgacaacggagacccagcatggcgtat

SEQ ID NO: 451687 - DNA, 140 bp, Artificial Sequence
  Synthetic
atacgccatgctgggtctccaaccgatggctactcttgaatgtcacagctgaggacttgggaaagacgttctcagtgggaaccgggaactgcaccaccaacatccttgaggcaaagtattcgtacttgggagtcggccat

SEQ ID NO: 451688 - DNA, 140 bp, Artificial Sequence
  Synthetic
atggccgactcccaagtacgaatactttgcctcaaggatgttggtggtgcagttcccggttcccactgagaacgtctttcccaagtcctcagctgtgacattcaagagtagccatcggttggagacccagcatggcgtat

SEQ ID NO: 451689 - DNA, 140 bp, Artificial Sequence
  Synthetic
atacgccatgctgggtctccggtgtcccgactcaatggaatacaattgtcccaatcttagccccagagaggagcctgatgacattgactgttggtgttatggagtggaaaatgtccgagtcgtacttgggagtcggccat

SEQ ID NO: 451690 - DNA, 140 bp, Artificial Sequence
  Synthetic
atggccgactcccaagtacgactcggacattttccactccataacaccaacagtcaatgtcatcaggctcctctctggggctaagattgggacaattgtattccattgagtcgggacaccggagacccagcatggcgtat

SEQ ID NO: 451691 - DNA, 140 bp, Artificial Sequence
  Synthetic
atacgccatgctgggtctccagcctatggaaggtgtgatgcagtgggaaggtcaaagagatctaggagagcaattgatctgcccacacatgaaaaccacggactgaaaactcggcaggaacgtacttgggagtcggccat

SEQ ID NO: 451692 - DNA, 140 bp, Artificial Sequence
  Synthetic
atggccgactcccaagtacgttcctgccgagttttcagtccgtggttttcatgtgtgggcagatcaattgctctcctagatctctttgaccttcccactgcatcacaccttccataggctggagacccagcatggcgtat

SEQ ID NO: 451693 - DNA, 140 bp, Artificial Sequence
  Synthetic
atacgccatgctgggtctccaaatggatgacaggcagaatgggtgagcggcaactccaaaagattgagcggtggctggtgaggaatccgttcttcgccataacagccttggccattgcttcgtacttgggagtcggccat

SEQ ID NO: 451694 - DNA, 140 bp, Artificial Sequence
  Synthetic
atggccgactcccaagtacgaagcaatggccaaggctgttatggcgaagaacggattcctcaccagccaccgctcaatcttttggagttgccgctcacccattctgcctgtcatccatttggagacccagcatggcgtat

SEQ ID NO: 451695 - DNA, 140 bp, Artificial Sequence
  Synthetic
atacgccatgctgggtctccatttggtgggcaataatatgacacaacgtgtcgtcatagctctgctggttctggcagttggcccagcctattctgcacattgcattgggataactgacagcgtacttgggagtcggccat

SEQ ID NO: 451696 - DNA, 140 bp, Artificial Sequence
  Synthetic
atggccgactcccaagtacgctgtcagttatcccaatgcaatgtgcagaataggctgggccaactgccagaaccagcagagctatgacgacacgttgtgtcatattattgcccaccaaatggagacccagcatggcgtat

SEQ ID NO: 451697 - DNA, 140 bp, Artificial Sequence
  Synthetic
atacgccatgctgggtctccagacttcattgagggtgtccatgggggcacctgggtgtcagcaaccctggagcaggataagtgcgtgactgtcatggcgcctgataaaccatcactggaccgtacttgggagtcggccat

SEQ ID NO: 451698 - DNA, 140 bp, Artificial Sequence
  Synthetic
atggccgactcccaagtacggtccagtgatggtttatcaggcgccatgacagtcacgcacttatcctgctccagggttgctgacacccaggtgcccccatggacaccctcaatgaagtctggagacccagcatggcgtat

SEQ ID NO: 451699 - DNA, 140 bp, Artificial Sequence
  Synthetic
atacgccatgctgggtctccatctcactccaaacagtggcaatagatgggccagctgaagcgagaaaggtttgctacagcgcggttctcacccatgtaaaaatcaatgataaatgcccgacgtacttgggagtcggccat

SEQ ID NO: 451700 - DNA, 140 bp, Artificial Sequence
  Synthetic
atggccgactcccaagtacgtcgggcatttatcattgatttttacatgggtgagaaccgcgctgtagcaaacctttctcgcttcagctggcccatctattgccactgtttggagtgagatggagacccagcatggcgtat

SEQ ID NO: 451701 - DNA, 140 bp, Artificial Sequence
  Synthetic
atacgccatgctgggtctccgcactggtgaggctcaccttgcagaggaaaatgatggtgacaacgcgtgcaaacgaacatactcagatagaggctggggcaatggttgtgggctctttggcgtacttgggagtcggccat

SEQ ID NO: 451702 - DNA, 140 bp, Artificial Sequence
  Synthetic
atggccgactcccaagtacgccaaagagcccacaaccattgccccagcctctatctgagtatgttcgtttgcacgcgttgtcaccatcattttcctctgcaaggtgagcctcaccagtgcggagacccagcatggcgtat

SEQ ID NO: 451703 - DNA, 140 bp, Artificial Sequence
  Synthetic
atacgccatgctgggtctccaaaggggagcattgtggcatgtgctaagttcacgtgtgccaaatccatgagcctttttgaagtggaccagaccaaaatccagtatgtcatcagagcccagcgtacttgggagtcggccat

SEQ ID NO: 451704 - DNA, 140 bp, Artificial Sequence
  Synthetic
atggccgactcccaagtacgctgggctctgatgacatactggattttggtctggtccacttcaaaaaggctcatggatttggcacacgtgaacttagcacatgccacaatgctcccctttggagacccagcatggcgtat

SEQ ID NO: 451705 - DNA, 140 bp, Artificial Sequence
  Synthetic
atacgccatgctgggtctcccttcatgtaggtgccaagcaggaaaactggaacacagacataaagacattgaaatttgatgccttatctggctctcaagaggccgaatttactggctatgcgtacttgggagtcggccat

SEQ ID NO: 451706 - DNA, 140 bp, Artificial Sequence
  Synthetic
atggccgactcccaagtacgcatagccagtaaattcggcctcttgagagccagataaggcatcaaatttcaatgtctttatgtctgtgttccagttttcctgcttggcacctacatgaagggagacccagcatggcgtat

SEQ ID NO: 451707 - DNA, 140 bp, Artificial Sequence
  Synthetic
aggccctggctgctgatatggaaatttgatgccttatctggctctcaagaggccgaatttactggctatgggaaagcaacactagagtgtcaggtccagactgcggtggactttggaaacgaccttttgggacagcggtg

SEQ ID NO: 451708 - DNA, 140 bp, Artificial Sequence
  Synthetic
caccgctgtcccaaaaggtcgtttccaaagtccaccgcagtctggacctgacactctagtgttgctttcccatagccagtaaattcggcctcttgagagccagataaggcatcaaatttccatatcagcagccagggcct

SEQ ID NO: 451709 - DNA, 140 bp, Artificial Sequence
  Synthetic
atacgccatgctgggtctccagagtgttggccctgggaaaccaagaggggtctttgaaaacagcccttacaggagccatgcgggtcactaaagatgaaaatgacaacaacttgtacaagccgtacttgggagtcggccat

SEQ ID NO: 451710 - DNA, 140 bp, Artificial Sequence
  Synthetic
atggccgactcccaagtacggcttgtacaagttgttgtcattttcatctttagtgacccgcatggctcctgtaagggctgttttcaaagacccctcttggtttcccagggccaacactctggagacccagcatggcgtat

SEQ ID NO: 451711 - DNA, 140 bp, Artificial Sequence
  Synthetic
atacgccatgctgggtctcctgcatggtggtcatgtttcttgtagggtgaaactctcagctttaactctcaagggaacatcctacaaaatgtgcacagataaaatgtcatttgtgaaaaacgtacttgggagtcggccat

SEQ ID NO: 451712 - DNA, 140 bp, Artificial Sequence
  Synthetic
atggccgactcccaagtacgtttttcacaaatgacattttatctgtgcacattttgtaggatgttcccttgagagttaaagctgagagtttcaccctacaagaaacatgaccaccatgcaggagacccagcatggcgtat

SEQ ID NO: 451713 - DNA, 140 bp, Artificial Sequence
  Synthetic
atacgccatgctgggtctcctccaacggacacaggtcatggcactgttgtcatgcaggtgaaggtccccaaaggagctccatgcaagatccccgtgattgtggccgatgatctaacagctcgtacttgggagtcggccat

SEQ ID NO: 451714 - DNA, 140 bp, Artificial Sequence
  Synthetic
atggccgactcccaagtacgagctgttagatcatcggccacaatcacggggatcttgcatggagctcctttggggaccttcacctgcatgacaacagtgccatgacctgtgtccgttggaggagacccagcatggcgtat

SEQ ID NO: 451715 - DNA, 140 bp, Artificial Sequence
  Synthetic
atacgccatgctgggtctccgcagtgaacaagggtatattggtcactgtcaaccccatagcatccacaaatgacgatgaagttctaattgaagtcaatcccccttttggagacagctacacgtacttgggagtcggccat

SEQ ID NO: 451716 - DNA, 140 bp, Artificial Sequence
  Synthetic
atggccgactcccaagtacgtgtagctgtctccaaaagggggattgacttcaattagaacttcatcgtcatttgtggatgctatggggttgacagtgaccaatatacccttgttcactgcggagacccagcatggcgtat

SEQ ID NO: 451717 - DNA, 140 bp, Artificial Sequence
  Synthetic
atacgccatgctgggtctccttattgttgggactggagactcaagactgacttatcagtggcataaagaaggaagctcaatagggaaattgttcacacagacaatgaagggagctgaacgcgtacttgggagtcggccat

SEQ ID NO: 451718 - DNA, 140 bp, Artificial Sequence
  Synthetic
atggccgactcccaagtacgcgttcagctcccttcattgtctgtgtgaacaatttccctattgagcttccttctttatgccactgataagtcagtcttgagtctccagtcccaacaataaggagacccagcatggcgtat

SEQ ID NO: 451719 - DNA, 140 bp, Artificial Sequence
  Synthetic
atacgccatgctgggtctcctcttgcagtgatgggtgacgccgcctgggactttagctctgcaggtggcttcttcacgtcagtgggaaaaggaattcatactgtgtttggctcagctttccgtacttgggagtcggccat

SEQ ID NO: 451720 - DNA, 140 bp, Artificial Sequence
  Synthetic
atggccgactcccaagtacggaaagctgagccaaacacagtatgaattccttttcccactgacgtgaagaagccacctgcagagctaaagtcccaggcggcgtcacccatcactgcaagaggagacccagcatggcgtat

SEQ ID NO: 451721 - DNA, 140 bp, Artificial Sequence
  Synthetic
atacgccatgctgggtctcccaggggttgtttggtggcctgagctggattacaaaggtcatcatgggagctgttcttatctgggttggaattaacacacgtaacatgactatgtccatgtcgtacttgggagtcggccat

SEQ ID NO: 451722 - DNA, 140 bp, Artificial Sequence
  Synthetic
atggccgactcccaagtacgacatggacatagtcatgttacgtgtgttaattccaacccagataagaacagctcccatgatgacctttgtaatccagctcaggccaccaaacaacccctgggagacccagcatggcgtat

SEQ ID NO: 451723 - DNA, 140 bp, Artificial Sequence
  Synthetic
atacgccatgctgggtctccctatgattctggtaggagtgatcatgatgtttctttccctgggtgttggggcagaccaaggatgtgctgtcaactttgggaagcgagagcttaaatgtggcgtacttgggagtcggccat

SEQ ID NO: 451724 - DNA, 140 bp, Artificial Sequence
  Synthetic
atggccgactcccaagtacgccacatttaagctctcgcttcccaaagttgacagcacatccttggtctgccccaacacccagggaaagaaacatcatgatcactcctaccagaatcatagggagacccagcatggcgtat

SEQ ID NO: 451725 - DNA, 140 bp, Artificial Sequence
  Synthetic
atacgccatgctgggtctccagatggcatctttgtgttcagagactcagatgattggctcaccaagtactcatattatccagaagaccctgttaaattggcttctatcattaaggcctcccgtacttgggagtcggccat

SEQ ID NO: 451726 - DNA, 140 bp, Artificial Sequence
  Synthetic
atggccgactcccaagtacgggaggccttaatgatagaagccaatttaacagggtcttctggataatatgagtacttggtgagccaatcatctgagtctctgaacacaaagatgccatctggagacccagcatggcgtat

SEQ ID NO: 451727 - DNA, 140 bp, Artificial Sequence
  Synthetic
atacgccatgctgggtctccaagtggacatctcggttgttgttcaagacccaaagaacatctaccaaagagggacacatcctttttctcggattcgtgatgggttgcagtatggatggaacgtacttgggagtcggccat

SEQ ID NO: 451728 - DNA, 140 bp, Artificial Sequence
  Synthetic
atggccgactcccaagtacgttccatccatactgcaacccatcacgaatccgagaaaaaggatgtgtccctctttggtagatgttctttgggtcttgaacaacaaccgagatgtccacttggagacccagcatggcgtat

SEQ ID NO: 451729 - DNA, 140 bp, Artificial Sequence
  Synthetic
atacgccatgctgggtctccaacctggggtaaaaatcttatcttctcacccggaagaagaaatggcagtttcatcattgatgggaagtcaaggaaggaatgccctttttcaaacagagtgcgtacttgggagtcggccat

SEQ ID NO: 451730 - DNA, 140 bp, Artificial Sequence
  Synthetic
atggccgactcccaagtacgcactctgtttgaaaaagggcattccttccttgacttcccatcaatgatgaaactgccatttcttcttccgggtgagaagataagatttttaccccaggttggagacccagcatggcgtat

SEQ ID NO: 451731 - DNA, 140 bp, Artificial Sequence
  Synthetic
atacgccatgctgggtctcctggaactcttttcaaattgaggagtttggcatgggggtttttacgacacgggtttttatggatgctgtctttgactactcagtggactgtgatggggccacgtacttgggagtcggccat

SEQ ID NO: 451732 - DNA, 140 bp, Artificial Sequence
  Synthetic
atggccgactcccaagtacgtggccccatcacagtccactgagtagtcaaagacagcatccataaaaacccgtgtcgtaaaaacccccatgccaaactcctcaatttgaaaagagttccaggagacccagcatggcgtat

SEQ ID NO: 451733 - DNA, 140 bp, Artificial Sequence
  Synthetic
aggccctggctgctgatatgggtttttatggatgctgtctttgactactcagtggactgtgatggggccatactaggggcagctgtgaatgggaagaagagcgcacacggatcgcccaccgaccttttgggacagcggtg

SEQ ID NO: 451734 - DNA, 140 bp, Artificial Sequence
  Synthetic
caccgctgtcccaaaaggtcggtgggcgatccgtgtgcgctcttcttcccattcacagctgcccctagtatggccccatcacagtccactgagtagtcaaagacagcatccataaaaacccatatcagcagccagggcct

SEQ ID NO: 451735 - DNA, 140 bp, Artificial Sequence
  Synthetic
atacgccatgctgggtctccccagtgagctcccataaccacattccaggttacaaggtccaaacgaacggaccatggatgcaagtccctctggaagtcagaagggagccatgtccggggacgtacttgggagtcggccat

SEQ ID NO: 451736 - DNA, 140 bp, Artificial Sequence
  Synthetic
atggccgactcccaagtacgtccccggacatggctcccttctgacttccagagggacttgcatccatggtccgttcgtttggaccttgtaacctggaatgtggttatgggagctcactggggagacccagcatggcgtat

SEQ ID NO: 451737 - DNA, 140 bp, Artificial Sequence
  Synthetic
atacgccatgctgggtctcccaagtgtggtgctagacaccggctgtgatggacgtggcaaatcaaccagatcaactactgacagtgggaaaataattccagaatggtgctgtagatcttgcgtacttgggagtcggccat

SEQ ID NO: 451738 - DNA, 140 bp, Artificial Sequence
  Synthetic
atggccgactcccaagtacgcaagatctacagcaccattctggaattattttcccactgtcagtagttgatctggttgatttgccacgtccatcacagccggtgtctagcaccacacttgggagacccagcatggcgtat

SEQ ID NO: 451739 - DNA, 140 bp, Artificial Sequence
  Synthetic
atacgccatgctgggtctcccaccatgcccccagtcagctttcacggcagtgatggctgctggtaccccatggaaattagacccatgaagacccacgagagccatctggtgagatcatggcgtacttgggagtcggccat

SEQ ID NO: 451740 - DNA, 140 bp, Artificial Sequence
  Synthetic
atggccgactcccaagtacgccatgatctcaccagatggctctcgtgggtcttcatgggtctaatttccatggggtaccagcagccatcactgccgtgaaagctgactgggggcatggtgggagacccagcatggcgtat

SEQ ID NO: 451741 - DNA, 140 bp, Artificial Sequence
  Synthetic
atacgccatgctgggtctccgttgctgcaggagaagtgcatgcggtgcctttcggtttggtgagcatgatgattgccatggaggttgtcttacgcaaaagacaaggaccaaagcaaatgccgtacttgggagtcggccat

SEQ ID NO: 451742 - DNA, 140 bp, Artificial Sequence
  Synthetic
atggccgactcccaagtacggcatttgctttggtccttgtcttttgcgtaagacaacctccatggcaatcatcatgctcaccaaaccgaaaggcaccgcatgcacttctcctgcagcaacggagacccagcatggcgtat

SEQ ID NO: 451743 - DNA, 140 bp, Artificial Sequence
  Synthetic
atacgccatgctgggtctcctggtgggaggaatcattttacttggagcaatgctagtaggacaagtcacgacattggatctagtgaaacttattgtggcagtgggcttgcattttcacgacgtacttgggagtcggccat

SEQ ID NO: 451744 - DNA, 140 bp, Artificial Sequence
  Synthetic
atggccgactcccaagtacgtcgtgaaaatgcaagcccactgccacaataagtttcactagatccaatgtcgtgacttgtcctactagcattgctccaagtaaaatgattcctcccaccaggagacccagcatggcgtat

SEQ ID NO: 451745 - DNA, 140 bp, Artificial Sequence
  Synthetic
atacgccatgctgggtctccgatcaacaatggaggagacgctatgtacatggctttgattgcgagcttttctattcgcccgggcctgctcataggttttggactgcgcacactctggagtcgtacttgggagtcggccat

SEQ ID NO: 451746 - DNA, 140 bp, Artificial Sequence
  Synthetic
atggccgactcccaagtacgactccagagtgtgcgcagtccaaaacctatgagcaggcccgggcgaatagaaaagctcgcaatcaaagccatgtacatagcgtctcctccattgttgatcggagacccagcatggcgtat

SEQ ID NO: 451747 - DNA, 140 bp, Artificial Sequence
  Synthetic
atacgccatgctgggtctcccctcgcgaacgtctcgtgatggcattcggagcagccatggttgaagtggcattgggcgggatgatgggtggactgtggcagtatttgaacgccgtctcaccgtacttgggagtcggccat

SEQ ID NO: 451748 - DNA, 140 bp, Artificial Sequence
  Synthetic
atggccgactcccaagtacggtgagacggcgttcaaatactgccacagtccacccatcatcccgcccaatgccacttcaaccatggctgctccgaatgccatcacgagacgttcgcgaggggagacccagcatggcgtat

SEQ ID NO: 451749 - DNA, 140 bp, Artificial Sequence
  Synthetic
atacgccatgctgggtctcctatgcgtcctcaccatcaatgcaatttcttcaagaaaggcctcaaatgcggtcctccctcttatggcgctcttgactcctgtgacaatgcatgaagtaagcgtacttgggagtcggccat

SEQ ID NO: 451750 - DNA, 140 bp, Artificial Sequence
  Synthetic
atggccgactcccaagtacgcttacttcatgcattgtcacaggagtcaagagcgccataagagggaggaccgcatttgaggcctttcttgaagaaattgcattgatggtgaggacgcataggagacccagcatggcgtat

SEQ ID NO: 451751 - DNA, 140 bp, Artificial Sequence
  Synthetic
atacgccatgctgggtctccgatggcaacaatgttgttctgcacagtggtcatagtgggtgtgctctaccagaattcaaaagacacgtccatgcaaaaagccattcccattgtggctctgcgtacttgggagtcggccat

SEQ ID NO: 451752 - DNA, 140 bp, Artificial Sequence
  Synthetic
atggccgactcccaagtacgcagagccacaatgggaatggctttttgcatggacgtgtcttttgaattctggtagagcacacccactatgaccactgtgcagaacaacattgttgccatcggagacccagcatggcgtat

SEQ ID NO: 451753 - DNA, 140 bp, Artificial Sequence
  Synthetic
atacgccatgctgggtctccacactgacttcatatatgggtctaacccaaccttttcttggactgtgtgcctacatgtccacacaagtgtttggtagaagaagcatccccgtaaatgaagcgtacttgggagtcggccat

SEQ ID NO: 451754 - DNA, 140 bp, Artificial Sequence
  Synthetic
atggccgactcccaagtacgcttcatttacggggatgcttcttctaccaaacacttgtgtggacatgtaggcacacagtccaagaaaaggttgggttagacccatatatgaagtcagtgtggagacccagcatggcgtat

SEQ ID NO: 451755 - DNA, 140 bp, Artificial Sequence
  Synthetic
atacgccatgctgggtctccctcttgcagcagctggcctggtaggagtgttggcaggcttggccttccaagacatggaaaattttttagggccgattgctgtgggcgggatactcatgatcgtacttgggagtcggccat

SEQ ID NO: 451756 - DNA, 140 bp, Artificial Sequence
  Synthetic
atggccgactcccaagtacgatcatgagtatcccgcccacagcaatcggccctaaaaaattttccatgtcttggaaggccaagcctgccaacactcctaccaggccagctgctgcaagagggagacccagcatggcgtat

SEQ ID NO: 451757 - DNA, 140 bp, Artificial Sequence
  Synthetic
aggccctggctgctgatatggacatggaaaattttttagggccgattgctgtgggcgggatactcatgatgctagtcagtgtggcagggaaagttgatggactggaactcaaaaagctcggaccttttgggacagcggtg

SEQ ID NO: 451758 - DNA, 140 bp, Artificial Sequence
  Synthetic
caccgctgtcccaaaaggtccgagctttttgagttccagtccatcaactttccctgccacactgactagcatcatgagtatcccgcccacagcaatcggccctaaaaaattttccatgtccatatcagcagccagggcct

SEQ ID NO: 451759 - DNA, 140 bp, Artificial Sequence
  Synthetic
atacgccatgctgggtctcctaaagtgccctgggaccagattgtcatgacctccttggctcttgttggggcagcaatacatccatttgccctattgctggttctaggaggttgggttttacgtacttgggagtcggccat

SEQ ID NO: 451760 - DNA, 140 bp, Artificial Sequence
  Synthetic
atggccgactcccaagtacgtaaaacccaacctcctagaaccagcaatagggcaaatggatgtattgctgccccaacaagagccaaggaggtcatgacaatctggtcccagggcactttaggagacccagcatggcgtat

SEQ ID NO: 451761 - DNA, 140 bp, Artificial Sequence
  Synthetic
atacgccatgctgggtctcccatatcaaaggagctagaaggagcggggatgtcctttgggacattcccacaccaaaagtcatagaggaatgtgagcacctggaagatggaatttacggcacgtacttgggagtcggccat

SEQ ID NO: 451762 - DNA, 140 bp, Artificial Sequence
  Synthetic
atggccgactcccaagtacgtgccgtaaattccatcttccaggtgctcacattcctctatgacttttggtgtgggaatgtcccaaaggacatccccgctccttctagctcctttgatatgggagacccagcatggcgtat

SEQ ID NO: 451763 - DNA, 140 bp, Artificial Sequence
  Synthetic
atacgccatgctgggtctcctattccaatcaacctttcttggagcatcccagagaggagttggagtggcccaagggggtgtcttccacacgatgtggcacgtcaccagaggagcgtttctcgtacttgggagtcggccat

SEQ ID NO: 451764 - DNA, 140 bp, Artificial Sequence
  Synthetic
atggccgactcccaagtacgagaaacgctcctctggtgacgtgccacatcgtgtggaagacacccccttgggccactccaactcctctctgggatgctccaagaaaggttgattggaataggagacccagcatggcgtat

SEQ ID NO: 451765 - DNA, 140 bp, Artificial Sequence
  Synthetic
atacgccatgctgggtctcccttgaggaacgggaagaaattagtgccatcctgggcctctgtgaaggaggatttggtggcctatggtggatcttggaagctggatggaaagtgggatggtcgtacttgggagtcggccat

SEQ ID NO: 451766 - DNA, 140 bp, Artificial Sequence
  Synthetic
atggccgactcccaagtacgaccatcccactttccatccagcttccaagatccaccataggccaccaaatcctccttcacagaggcccaggatggcactaatttcttcccgttcctcaagggagacccagcatggcgtat

SEQ ID NO: 451767 - DNA, 140 bp, Artificial Sequence
  Synthetic
atacgccatgctgggtctccgaggaagaggtacaactcatagctgctgtgccaggaaaagccgttgtaaatgtgcagaccaagccaagtttgttcaaagttagaaatggaggtgagattgcgtacttgggagtcggccat

SEQ ID NO: 451768 - DNA, 140 bp, Artificial Sequence
  Synthetic
atggccgactcccaagtacgcaatctcacctccatttctaactttgaacaaacttggcttggtctgcacatttacaacggcttttcctggcacagcagctatgagttgtacctcttcctcggagacccagcatggcgtat

SEQ ID NO: 451769 - DNA, 140 bp, Artificial Sequence
  Synthetic
atacgccatgctgggtctccgggcagtagccctggactatcctagcgggacctctggttcacccattgtgaatcgcagtggtgaagtggtggggctctatggcaacgggatcttggttggcgtacttgggagtcggccat

SEQ ID NO: 451770 - DNA, 140 bp, Artificial Sequence
  Synthetic
atggccgactcccaagtacgccaaccaagatcccgttgccatagagccccaccacttcaccactgcgattcacaatgggtgaaccagaggtcccgctaggatagtccagggctactgcccggagacccagcatggcgtat

SEQ ID NO: 451771 - DNA, 140 bp, Artificial Sequence
  Synthetic
atacgccatgctgggtctccaccatccttgatttccaccccggcgcgggaaagacccgcaggttcctgccccaaatactggcagaatgcgccaggaggcgcctacgaacactagtgctggcgtacttgggagtcggccat

SEQ ID NO: 451772 - DNA, 140 bp, Artificial Sequence
  Synthetic
atggccgactcccaagtacgccagcactagtgttcgtaggcgcctcctggcgcattctgccagtatttggggcaggaacctgcgggtctttcccgcgccggggtggaaatcaaggatggtggagacccagcatggcgtat

SEQ ID NO: 451773 - DNA, 140 bp, Artificial Sequence
  Synthetic
atacgccatgctgggtctcccgcctacccgggttgtcctgtcagaaatgaaggaagcttttcatggacttgatgtgaagtttcacacgcaggctttttcggcccatgggagtgggaaagacgtacttgggagtcggccat

SEQ ID NO: 451774 - DNA, 140 bp, Artificial Sequence
  Synthetic
atggccgactcccaagtacgtctttcccactcccatgggccgaaaaagcctgcgtgtgaaacttcacatcaagtccatgaaaagcttccttcatttctgacaggacaacccgggtaggcgggagacccagcatggcgtat

SEQ ID NO: 451775 - DNA, 140 bp, Artificial Sequence
  Synthetic
atacgccatgctgggtctccagtcattgatgcaatgtgccatgcgaccctcacgtacaggatgctggagccaacaagagctgtcaactgggaggtgattatcatggatgaggctcacttccgtacttgggagtcggccat

SEQ ID NO: 451776 - DNA, 140 bp, Artificial Sequence
  Synthetic
atggccgactcccaagtacggaagtgagcctcatccatgataatcacctcccagttgacagctcttgttggctccagcatcctgtacgtgagggtcgcatggcacattgcatcaatgactggagacccagcatggcgtat

SEQ ID NO: 451777 - DNA, 140 bp, Artificial Sequence
  Synthetic
atacgccatgctgggtctccttggatcctgccagcattgcagcaagaggctgggcagcccatagggcaagagcaaacgagagtgccacgatactcatgacagccactccaccaggcacaacgtacttgggagtcggccat

SEQ ID NO: 451778 - DNA, 140 bp, Artificial Sequence
  Synthetic
atggccgactcccaagtacgttgtgcctggtggagtggctgtcatgagtatcgtggcactctcgtttgctcttgccctatgggctgcccagcctcttgctgcaatgctggcaggatccaaggagacccagcatggcgtat

SEQ ID NO: 451779 - DNA, 140 bp, Artificial Sequence
  Synthetic
aggccctggctgctgatatgagcaaacgagagtgccacgatactcatgacagccactccaccaggcacaagtgatgaatttccccattccaatggtgaaattgaagatgtccagactgatgaccttttgggacagcggtg

SEQ ID NO: 451780 - DNA, 140 bp, Artificial Sequence
  Synthetic
caccgctgtcccaaaaggtcatcagtctggacatcttcaatttcaccattggaatggggaaattcatcacttgtgcctggtggagtggctgtcatgagtatcgtggcactctcgtttgctcatatcagcagccagggcct

SEQ ID NO: 451781 - DNA, 140 bp, Artificial Sequence
  Synthetic
atacgccatgctgggtctccctgcctctttgcggaaggccgggaagagtgtggtggtgttgaacaggaagacctttgaaaaggaataccccaccattaaacaaaagagaccggatttcatcgtacttgggagtcggccat

SEQ ID NO: 451782 - DNA, 140 bp, Artificial Sequence
  Synthetic
atggccgactcccaagtacgatgaaatccggtctcttttgtttaatggtggggtattccttttcaaaggtcttcctgttcaacaccaccacactcttcccggccttccgcaaagaggcagggagacccagcatggcgtat

SEQ ID NO: 451783 - DNA, 140 bp, Artificial Sequence
  Synthetic
atacgccatgctgggtctcccctagccacagacattgccgagatgggagcaaacttgtgcgttgaaagagtgctggactgtaggactgcatacaaacctgtcctggtggatgaagggaggcgtacttgggagtcggccat

SEQ ID NO: 451784 - DNA, 140 bp, Artificial Sequence
  Synthetic
atggccgactcccaagtacgcctcccttcatccaccaggacaggtttgtatgcagtcctacagtccagcactctttcaacgcacaagtttgctcccatctcggcaatgtctgtggctaggggagacccagcatggcgtat

SEQ ID NO: 451785 - DNA, 140 bp, Artificial Sequence
  Synthetic
atacgccatgctgggtctccaaagtggccatcaaagggccattacggatttctgcatcatcggctgctcagagaagagggcgcattggacgaaacccaaacagagatggagattcctactcgtacttgggagtcggccat

SEQ ID NO: 451786 - DNA, 140 bp, Artificial Sequence
  Synthetic
atggccgactcccaagtacgagtaggaatctccatctctgtttgggtttcgtccaatgcgccctcttctctgagcagccgatgatgcagaaatccgtaatggccctttgatggccactttggagacccagcatggcgtat

SEQ ID NO: 451787 - DNA, 140 bp, Artificial Sequence
  Synthetic
atacgccatgctgggtctccactattcagaacccactagtgaggataatgcccatcatgtgtgttggctggaagcttccatgcttcttgacaacatggaagttagagggggaatggttgccgtacttgggagtcggccat

SEQ ID NO: 451788 - DNA, 140 bp, Artificial Sequence
  Synthetic
atggccgactcccaagtacggcaaccattccccctctaacttccatgttgtcaagaagcatggaagcttccagccaacacacatgatgggcattatcctcactagtgggttctgaatagtggagacccagcatggcgtat

SEQ ID NO: 451789 - DNA, 140 bp, Artificial Sequence
  Synthetic
atacgccatgctgggtctcccccgctctatggaattgaagggacaaagactcctgtttcccctggggaaatgaggctgagagatgatcaaaggagagttttcagggagttggtgcgtggacgtacttgggagtcggccat

SEQ ID NO: 451790 - DNA, 140 bp, Artificial Sequence
  Synthetic
atggccgactcccaagtacgtccacgcaccaactccctgaaaactctcctttgatcatctctcagcctcatttccccaggggaaacaggagtctttgtcccttcaattccatagagcgggggagacccagcatggcgtat

SEQ ID NO: 451791 - DNA, 140 bp, Artificial Sequence
  Synthetic
atacgccatgctgggtctcctgtgacctgccggtctggctatcctggcaggtagcaaaggccggtttaaaaaccaatgaccgcaagtggtgctttgaaggacccgaggaacacgagataccgtacttgggagtcggccat

SEQ ID NO: 451792 - DNA, 140 bp, Artificial Sequence
  Synthetic
atggccgactcccaagtacggtatctcgtgttcctcgggtccttcaaagcaccacttgcggtcattggtttttaaaccggcctttgctacctgccaggatagccagaccggcaggtcacaggagacccagcatggcgtat

SEQ ID NO: 451793 - DNA, 140 bp, Artificial Sequence
  Synthetic
atacgccatgctgggtctcctcaatgacaacggtgaaactgtgaagtgtaggtcacctggtggagcgaaaaaggcactgagacctagatggtgtgatgaaagagtgtcctcagatcagagcgtacttgggagtcggccat

SEQ ID NO: 451794 - DNA, 140 bp, Artificial Sequence
  Synthetic
atggccgactcccaagtacgctctgatctgaggacactctttcatcacaccatctaggtctcagtgcctttttcgctccaccaggtgacctacacttcacagtttcaccgttgtcattgaggagacccagcatggcgtat

SEQ ID NO: 451795 - DNA, 140 bp, Artificial Sequence
  Synthetic
atacgccatgctgggtctcccgctttggctgacttcattaagtttgccgaaggtagaagaggagctgctgagatgcttgtggttctcacggaactgcctgacttcttgatgcaaaaagggcgtacttgggagtcggccat

SEQ ID NO: 451796 - DNA, 140 bp, Artificial Sequence
  Synthetic
atggccgactcccaagtacgccctttttgcatcaagaagtcaggcagttccgtgagaaccacaagcatctcagcagctcctcttctaccttcggcaaacttaatgaagtcagccaaagcgggagacccagcatggcgtat

SEQ ID NO: 451797 - DNA, 140 bp, Artificial Sequence
  Synthetic
atacgccatgctgggtctccggggaggctatggacaccattagtgtgtttctccattctgaggagggatcaagagcttatagaaatgctctatcaatgatgcctgaagccatgaccatcgcgtacttgggagtcggccat

SEQ ID NO: 451798 - DNA, 140 bp, Artificial Sequence
  Synthetic
atggccgactcccaagtacgcgatggtcatggcttcaggcatcattgatagagcatttctataagctcttgatccctcctcagaatggagaaacacactaatggtgtccatagcctccccggagacccagcatggcgtat

SEQ ID NO: 451799 - DNA, 140 bp, Artificial Sequence
  Synthetic
aggccctggctgctgatatgaagagcttatagaaatgctctatcaatgatgcctgaagccatgaccatcgtgatgcttttcatactggctggtctcttgacctcaggaatggtgatcttcgaccttttgggacagcggtg

SEQ ID NO: 451800 - DNA, 140 bp, Artificial Sequence
  Synthetic
caccgctgtcccaaaaggtcgaagatcaccattcctgaggtcaagagaccagccagtatgaaaagcatcacgatggtcatggcttcaggcatcattgatagagcatttctataagctcttcatatcagcagccagggcct

SEQ ID NO: 451801 - DNA, 140 bp, Artificial Sequence
  Synthetic
atacgccatgctgggtctcccattggaatactcacattgctgtccattgtggcggctaatgagttaggaatgctggaaaagaccaaggaagacttttttggaagaagaaatgctgccacacgtacttgggagtcggccat

SEQ ID NO: 451802 - DNA, 140 bp, Artificial Sequence
  Synthetic
atggccgactcccaagtacgtgtggcagcatttcttcttccaaaaaagtcttccttggtcttttccagcattcctaactcattagccgccacaatggacagcaatgtgagtattccaatgggagacccagcatggcgtat

SEQ ID NO: 451803 - DNA, 140 bp, Artificial Sequence
  Synthetic
atacgccatgctgggtctcccctggggggacgattccatggagttggcccgatttggatctgaaacctggggctgcctggaccgtttatgtgggaattgtgacaatgctgtcaccaatgccgtacttgggagtcggccat

SEQ ID NO: 451804 - DNA, 140 bp, Artificial Sequence
  Synthetic
atggccgactcccaagtacggcattggtgacagcattgtcacaattcccacataaacggtccaggcagccccaggtttcagatccaaatcgggccaactccatggaatcgtccccccaggggagacccagcatggcgtat

SEQ ID NO: 451805 - DNA, 140 bp, Artificial Sequence
  Synthetic
atacgccatgctgggtctccttcatcactggattaaagtggagtatggcaacctctcgttgtcagggatagcccagtcggcctcggtcctttcatttatggataaaggaatccctttcatcgtacttgggagtcggccat

SEQ ID NO: 451806 - DNA, 140 bp, Artificial Sequence
  Synthetic
atggccgactcccaagtacgatgaaagggattcctttatccataaatgaaaggaccgaggccgactgggctatccctgacaacgagaggttgccatactccactttaatccagtgatgaaggagacccagcatggcgtat

SEQ ID NO: 451807 - DNA, 140 bp, Artificial Sequence
  Synthetic
atacgccatgctgggtctccgaagatgaacatatctgtggtcatactcctagtcagtggctggaactcaataacagtgatccccctgttatgtggtgtgggtggagccatgctgcattggcgtacttgggagtcggccat

SEQ ID NO: 451808 - DNA, 140 bp, Artificial Sequence
  Synthetic
atggccgactcccaagtacgccaatgcagcatggctccacccacaccacataacagggggatcactgttattgagttccagccactgactaggagtatgaccacagatatgttcatcttcggagacccagcatggcgtat

SEQ ID NO: 451809 - DNA, 140 bp, Artificial Sequence
  Synthetic
atacgccatgctgggtctccacactgattcttcctggaatcaaagcccagcagtcaaaactagcacaaaaaagagtttttcatggagtggcaaaaaatccagtcgttgatggcaatccaacgtacttgggagtcggccat

SEQ ID NO: 451810 - DNA, 140 bp, Artificial Sequence
  Synthetic
atggccgactcccaagtacgttggattgccatcaacgactggattttttgccactccatgaaaaactcttttttgtgctagttttgactgctgggctttgattccaggaagaatcagtgtggagacccagcatggcgtat

SEQ ID NO: 451811 - DNA, 140 bp, Artificial Sequence
  Synthetic
atacgccatgctgggtctccctgctgacattgaagaagcacctgaaatgcctgccctgtacgagaagaaattggcactgtatcttctcctcgccttgagcctgatgtcggtagccatgtgcgtacttgggagtcggccat

SEQ ID NO: 451812 - DNA, 140 bp, Artificial Sequence
  Synthetic
atggccgactcccaagtacgcacatggctaccgacatcaggctcaaggcgaggagaagatacagtgccaatttcttctcgtacagggcaggcatttcaggtgcttcttcaatgtcagcagggagacccagcatggcgtat

SEQ ID NO: 451813 - DNA, 140 bp, Artificial Sequence
  Synthetic
atacgccatgctgggtctcccagaactcctttttccctagccgaaggcatagtgctgtcatctgctgcccttgggcccctaatagagggaaacacaagtctgctatggaatggtcctatgcgtacttgggagtcggccat

SEQ ID NO: 451814 - DNA, 140 bp, Artificial Sequence
  Synthetic
atggccgactcccaagtacgcataggaccattccatagcagacttgtgtttccctctattaggggcccaagggcagcagatgacagcactatgccttcggctagggaaaaaggagttctgggagacccagcatggcgtat

SEQ ID NO: 451815 - DNA, 140 bp, Artificial Sequence
  Synthetic
atacgccatgctgggtctccgccgtttccatgactggggttatgcgcggcaattactacgcttttgtgggtgtgatgtacaacctctggaagatgaaaacagggcgtagagggagagcaacgtacttgggagtcggccat

SEQ ID NO: 451816 - DNA, 140 bp, Artificial Sequence
  Synthetic
atggccgactcccaagtacgttgctctccctctacgccctgttttcatcttccagaggttgtacatcacacccacaaaagcgtagtaattgccgcgcataaccccagtcatggaaacggcggagacccagcatggcgtat

SEQ ID NO: 451817 - DNA, 140 bp, Artificial Sequence
  Synthetic
atacgccatgctgggtctccgtggcaagacactaggtgaggtctggaagagggagctcaacctgctagacaaacagcaatttgagctgtacaagagaacagatatcaccgaggtggatcgcgtacttgggagtcggccat

SEQ ID NO: 451818 - DNA, 140 bp, Artificial Sequence
  Synthetic
atggccgactcccaagtacgcgatccacctcggtgatatctgttctcttgtacagctcaaattgctgtttgtctagcaggttgagctccctcttccagacctcacctagtgtcttgccacggagacccagcatggcgtat

SEQ ID NO: 451819 - DNA, 140 bp, Artificial Sequence
  Synthetic
atacgccatgctgggtctcccgacatggctaggcgacatctagcagaggggaaggtggacactggagtggccgtgtcgagagggacagcgaagctaaggtggttccacgagcgtggctatcgtacttgggagtcggccat

SEQ ID NO: 451820 - DNA, 140 bp, Artificial Sequence
  Synthetic
atggccgactcccaagtacgatagccacgctcgtggaaccaccttagcttcgctgtccctctcgacacggccactccagtgtccaccttcccctctgctagatgtcgcctagccatgtcgggagacccagcatggcgtat

SEQ ID NO: 451821 - DNA, 140 bp, Artificial Sequence
  Synthetic
atacgccatgctgggtctccgtaaaacttgaaggaagggtcatggatttgggatgtggacgtggaggttggtgctactatgcagcagctcagaaagaggtcagtggtgtgaaaggttacacgtacttgggagtcggccat

SEQ ID NO: 451822 - DNA, 140 bp, Artificial Sequence
  Synthetic
atggccgactcccaagtacgtgtaacctttcacaccactgacctctttctgagctgctgcatagtagcaccaacctccacgtccacatcccaaatccatgacccttccttcaagttttacggagacccagcatggcgtat

SEQ ID NO: 451823 - DNA, 140 bp, Artificial Sequence
  Synthetic
atacgccatgctgggtctccccctgggcagggatggccatgagaagcccatgaacgtgcaaagcttaggatggaacattgtgaccttcaaggacaagactgacatccacaggctagagcccgtacttgggagtcggccat

SEQ ID NO: 451824 - DNA, 140 bp, Artificial Sequence
  Synthetic
atggccgactcccaagtacgggctctagcctgtggatgtcagtcttgtccttgaaggtcacaatgttccatcctaagctttgcacgttcatgggcttctcatggccatccctgcccagggggagacccagcatggcgtat

SEQ ID NO: 451825 - DNA, 140 bp, Artificial Sequence
  Synthetic
atacgccatgctgggtctccggccaagtgtgaaaccctcctttgtgacattggagaatcctcaccttcctcggttaccgagggtgagaggaccttgagagttcttgaaacaattgaaaagcgtacttgggagtcggccat

SEQ ID NO: 451826 - DNA, 140 bp, Artificial Sequence
  Synthetic
atggccgactcccaagtacgcttttcaattgtttcaagaactctcaaggtcctctcaccctcggtaaccgaggaaggtgaggattctccaatgtcacaaaggagggtttcacacttggccggagacccagcatggcgtat

SEQ ID NO: 451827 - DNA, 140 bp, Artificial Sequence
  Synthetic
atacgccatgctgggtctcctggctggcctgtggagtggacaacttttgtgtcaaggttctagcaccatacatgcctgatgtgatagagaaactggaacttctccaaagaagatttggtgcgtacttgggagtcggccat

SEQ ID NO: 451828 - DNA, 140 bp, Artificial Sequence
  Synthetic
atggccgactcccaagtacgcaccaaatcttctttggagaagttccagtttctctatcacatcaggcatgtatggtgctagaaccttgacacaaaagttgtccactccacaggccagccaggagacccagcatggcgtat

SEQ ID NO: 451829 - DNA, 140 bp, Artificial Sequence
  Synthetic
atacgccatgctgggtctccgaactgttatcaggaatcccctttccagaaactcaacccatgagatgtattatgtgtcaggagcaagaagtaatatcactttcacagtcaaccaaacgtccgtacttgggagtcggccat

SEQ ID NO: 451830 - DNA, 140 bp, Artificial Sequence
  Synthetic
atggccgactcccaagtacggacgtttggttgactgtgaaagtgatattacttcttgctcctgacacataatacatctcatgggttgagtttctggaaaggggattcctgataacagttcggagacccagcatggcgtat

SEQ ID NO: 451831 - DNA, 140 bp, Artificial Sequence
  Synthetic
atacgccatgctgggtctccacgtctgctgatgaggaggatgagacgcccaacaggcaaggtcacccttgagcccgatgtcattcttcccataggcacacgcagcgtagaaactgacaagcgtacttgggagtcggccat

SEQ ID NO: 451832 - DNA, 140 bp, Artificial Sequence
  Synthetic
atggccgactcccaagtacgcttgtcagtttctacgctgcgtgtgcctatgggaagaatgacatcgggctcaagggtgaccttgcctgttgggcgtctcatcctcctcatcagcagacgtggagacccagcatggcgtat

SEQ ID NO: 451833 - DNA, 140 bp, Artificial Sequence
  Synthetic
atacgccatgctgggtctccggaccattggacagggatgccattgaagagagggttgagagaatcaagaccgagtatgccactacatggttctatgacaatgacaacccataccggacctcgtacttgggagtcggccat

SEQ ID NO: 451834 - DNA, 140 bp, Artificial Sequence
  Synthetic
atggccgactcccaagtacgaggtccggtatgggttgtcattgtcatagaaccatgtagtggcatactcggtcttgattctctcaaccctctcttcaatggcatccctgtccaatggtccggagacccagcatggcgtat

SEQ ID NO: 451835 - DNA, 140 bp, Artificial Sequence
  Synthetic
atacgccatgctgggtctccggcattactgtggctcatatatcactaaaacatcaggcagtgcagccagcatgataaatggagtcatcaaaatcttgacttttccatgggataggatagacgtacttgggagtcggccat

SEQ ID NO: 451836 - DNA, 140 bp, Artificial Sequence
  Synthetic
atggccgactcccaagtacgtctatcctatcccatggaaaagtcaagattttgatgactccatttatcatgctggctgcactgcctgatgttttagtgatatatgagccacagtaatgccggagacccagcatggcgtat

SEQ ID NO: 451837 - DNA, 140 bp, Artificial Sequence
  Synthetic
atacgccatgctgggtctccagaggtcaccaggatggcaatgactgacactacgccttttggccaacaaagagttttcaaggaaaaggtggacacgagagccaaagatcctcctgctggacgtacttgggagtcggccat

SEQ ID NO: 451838 - DNA, 140 bp, Artificial Sequence
  Synthetic
atggccgactcccaagtacgtccagcaggaggatctttggctctcgtgtccaccttttccttgaaaactctttgttggccaaaaggcgtagtgtcagtcattgccatcctggtgacctctggagacccagcatggcgtat

SEQ ID NO: 451839 - DNA, 140 bp, Artificial Sequence
  Synthetic
atacgccatgctgggtctccactaggaaaatcatgaaggtggtaaaccgttggctgttccgtcatctggcccgggagaagaaccctaggctgtgcacaaaggaggaattcatagccaaggcgtacttgggagtcggccat

SEQ ID NO: 451840 - DNA, 140 bp, Artificial Sequence
  Synthetic
atggccgactcccaagtacgccttggctatgaattcctcctttgtgcacagcctagggttcttctcccgggccagatgacggaacagccaacggtttaccaccttcatgattttcctagtggagacccagcatggcgtat

SEQ ID NO: 451841 - DNA, 140 bp, Artificial Sequence
  Synthetic
atacgccatgctgggtctcctgcgcagtcatgctgcggtaggagcctttctagaagagcaggagcaatggaagacagccaatgaagcagttcaagaccctaagttttgggagatggttgacgtacttgggagtcggccat

SEQ ID NO: 451842 - DNA, 140 bp, Artificial Sequence
  Synthetic
atggccgactcccaagtacgtcaaccatctcccaaaacttagggtcttgaactgcttcattggctgtcttccattgctcctgctcttctagaaaggctcctaccgcagcatgactgcgcaggagacccagcatggcgtat

SEQ ID NO: 451843 - DNA, 140 bp, Artificial Sequence
  Synthetic
atacgccatgctgggtctcctgctgagcgcaaactacatcaacaggggcgttgccagtcttgtgtctataacatgatgggaaagagagagaaaaaactgtctgagtttgggaaagcaaaacgtacttgggagtcggccat

SEQ ID NO: 451844 - DNA, 140 bp, Artificial Sequence
  Synthetic
atggccgactcccaagtacgttttgctttcccaaactcagacagttttttctctctctttcccatcatgttatagacacaagactggcaacgcccctgttgatgtagtttgcgctcagcaggagacccagcatggcgtat

SEQ ID NO: 451845 - DNA, 140 bp, Artificial Sequence
  Synthetic
atacgccatgctgggtctccggaagtcgtgcgatctggtacatgtggctgggggcgcgtttccttgagttcgaggctcttgggttcttgaatgaagatcactgggcctccagagagaactcgtacttgggagtcggccat

SEQ ID NO: 451846 - DNA, 140 bp, Artificial Sequence
  Synthetic
atggccgactcccaagtacgagttctctctggaggcccagtgatcttcattcaagaacccaagagcctcgaactcaaggaaacgcgcccccagccacatgtaccagatcgcacgacttccggagacccagcatggcgtat

SEQ ID NO: 451847 - DNA, 140 bp, Artificial Sequence
  Synthetic
atacgccatgctgggtctcccaggaggaggtgttgaaggcataggactccaatatctgggctatgtaatcaaggacctatccaccaaagaagggggaggattctatgcagatgacacggccgtacttgggagtcggccat

SEQ ID NO: 451848 - DNA, 140 bp, Artificial Sequence
  Synthetic
atggccgactcccaagtacggccgtgtcatctgcatagaatcctcccccttctttggtggataggtccttgattacatagcccagatattggagtcctatgccttcaacacctcctcctgggagacccagcatggcgtat

SEQ ID NO: 451849 - DNA, 140 bp, Artificial Sequence
  Synthetic
atacgccatgctgggtctccaaacagcctgcctcagcaaggcttatgcaaacatgtggtcactgatgtattttcacaagagggacatgaggctgctttcatttgctgtctcatcggccgtcgtacttgggagtcggccat

SEQ ID NO: 451850 - DNA, 140 bp, Artificial Sequence
  Synthetic
atggccgactcccaagtacgacggccgatgagacagcaaatgaaagcagcctcatgtccctcttgtgaaaatacatcagtgaccacatgtttgcataagccttgctgaggcaggctgtttggagacccagcatggcgtat

SEQ ID NO: 451851 - DNA, 140 bp, Artificial Sequence
  Synthetic
atacgccatgctgggtctcccccaacggcatgggtacccagtggaagaacaacatggtctgttcatggaaaaggagaatggatgaccaccgaagacatgttggacgtctggaacagagttcgtacttgggagtcggccat

SEQ ID NO: 451852 - DNA, 140 bp, Artificial Sequence
  Synthetic
atggccgactcccaagtacgaactctgttccagacgtccaacatgtcttcggtggtcatccattctccttttccatgaacagaccatgttgttcttccactgggtacccatgccgttgggggagacccagcatggcgtat

SEQ ID NO: 451853 - DNA, 140 bp, Artificial Sequence
  Synthetic
atacgccatgctgggtctcctgggttttaaacaacccacacatgaaggacaagactaccgtgaaggagtggagagatgttccttacctcacaaaaaggcaagacaagctctgtgggtccccgtacttgggagtcggccat

SEQ ID NO: 451854 - DNA, 140 bp, Artificial Sequence
  Synthetic
atggccgactcccaagtacggggacccacagagcttgtcttgcctttttgtgaggtaaggaacatctctccactccttcacggtagtcttgtccttcatgtgtgggttgtttaaaacccaggagacccagcatggcgtat

SEQ ID NO: 451855 - DNA, 140 bp, Artificial Sequence
  Synthetic
atacgccatgctgggtctcctaataggaatgacaaacagggccacatgggcctcacacatccacctggtgatccaccgaattcggactttaatcggccaagaaaaatacacagattatctcgtacttgggagtcggccat

SEQ ID NO: 451856 - DNA, 140 bp, Artificial Sequence
  Synthetic
atggccgactcccaagtacgagataatctgtgtatttttcttggccgattaaagtccgaattcggtggatcaccaggtggatgtgtgaggcccatgtggccctgtttgtcattcctattaggagacccagcatggcgtat

SEQ ID NO: 451857 - DNA, 140 bp, Artificial Sequence
  Synthetic
atacgccatgctgggtctcccactgtgatggacaggtactcggttgatgctgacctccaaccaggagagctcatctgagaccagccatcgtaaatcaaccgggataaaaactacgggtggcgtacttgggagtcggccat

SEQ ID NO: 451858 - DNA, 140 bp, Artificial Sequence
  Synthetic
atggccgactcccaagtacgccacccgtagtttttatcccggttgatttacgatggctggtctcagatgagctctcctggttggaggtcagcatcaaccgagtacctgtccatcacagtgggagacccagcatggcgtat

SEQ ID NO: 451859 - DNA, 140 bp, Artificial Sequence
  Synthetic
atacgccatgctgggtctccagaaccggactccccacttccaaagcatcaacaagaaaccggtataaaaactacggatggagaaccggactccacacttaagaggccattgacgtcagcccgtacttgggagtcggccat

SEQ ID NO: 451860 - DNA, 140 bp, Artificial Sequence
  Synthetic
atggccgactcccaagtacgggctgacgtcaatggcctcttaagtgtggagtccggttctccatccgtagtttttataccggtttcttgttgatgctttggaagtggggagtccggttctggagacccagcatggcgtat

SEQ ID NO: 451861 - DNA, 140 bp, Artificial Sequence
  Synthetic
aggccctggctgctgatatgctacggatggagaaccggactccacacttaagaggccattgacgtcagcccaggaccctagaattaggagtcttgccaccgctaagctgtgaggcggtgcgaccttttgggacagcggtg

SEQ ID NO: 451862 - DNA, 140 bp, Artificial Sequence
  Synthetic
caccgctgtcccaaaaggtcgcaccgcctcacagcttagcggtggcaagactcctaattctagggtcctgggctgacgtcaatggcctcttaagtgtggagtccggttctccatccgtagcatatcagcagccagggcct

SEQ ID NO: 451863 - DNA, 140 bp, Artificial Sequence
  Synthetic
aggccctggctgctgatatgagggaaagaccggagtggttctctgcttttcctccaggggtctgcgagcacagtttgctctagaagaagcagacctttggacgaaaaacacaaaaccactgaccttttgggacagcggtg

SEQ ID NO: 451864 - DNA, 140 bp, Artificial Sequence
  Synthetic
caccgctgtcccaaaaggtcagtggttttgtgtttttcgtccaaaggtctgcttcttctagagcaaactgtgctcgcagacccctggaggaaaagcagagaaccactccggtctttccctcatatcagcagccagggcct

SEQ ID NO: 451865 - DNA, 140 bp, Artificial Sequence
  Synthetic
atacgccatgctgggtctcccaaggatttatctttttctttttgttcaacattttgactggaaaaaagatcacggcccacctaaagaggttgtggaaaatgctggacccaagacaaggctcgtacttgggagtcggccat

SEQ ID NO: 451866 - DNA, 140 bp, Artificial Sequence
  Synthetic
atggccgactcccaagtacgagccttgtcttgggtccagcattttccacaacctctttaggtgggccgtgatcttttttccagtcaaaatgttgaacaaaaagaaaaagataaatccttgggagacccagcatggcgtat

SEQ ID NO: 451867 - DNA, 140 bp, Artificial Sequence
  Synthetic
aggccctggctgctgatatggcaagacaagtgtgtcactgttatggcccctgacaagccttcattggacatctcactagagacagtagccattgatggacctgctgaggcgaggaaagtggaccttttgggacagcggtg

SEQ ID NO: 451868 - DNA, 140 bp, Artificial Sequence
  Synthetic
caccgctgtcccaaaaggtccactttcctcgcctcagcaggtccatcaatggctactgtctctagtgagatgtccaatgaaggcttgtcaggggccataacagtgacacacttgtcttgccatatcagcagccagggcct

SEQ ID NO: 451869 - DNA, 140 bp, Artificial Sequence
  Synthetic
atacgccatgctgggtctcctttgtttgaggttgatcagaccaaaattcagtatgtcatcagagcacaattgcatgtaggggccaagcaggaaaattggaataccgacattaagactctccgtacttgggagtcggccat

SEQ ID NO: 451870 - DNA, 140 bp, Artificial Sequence
  Synthetic
atggccgactcccaagtacggagagtcttaatgtcggtattccaattttcctgcttggcccctacatgcaattgtgctctgatgacatactgaattttggtctgatcaacctcaaacaaaggagacccagcatggcgtat

SEQ ID NO: 451871 - DNA, 140 bp, Artificial Sequence
  Synthetic
atacgccatgctgggtctccaagtttgatgccctgtcaggctcccaggaagccgagttcactgggtatggaaaagctacactggaatgccaggtgcaaactgcggtggactttggtaacacgtacttgggagtcggccat

SEQ ID NO: 451872 - DNA, 140 bp, Artificial Sequence
  Synthetic
atggccgactcccaagtacgtgttaccaaagtccaccgcagtttgcacctggcattccagtgtagcttttccatacccagtgaactcggcttcctgggagcctgacagggcatcaaacttggagacccagcatggcgtat

SEQ ID NO: 451873 - DNA, 140 bp, Artificial Sequence
  Synthetic
atacgccatgctgggtctccagagatgcatcatcttgtcgaatttgaacctccgcatgccgccactatcagagtactggccctgggaaaccaggaaggctccttgaaaacagctcttacccgtacttgggagtcggccat

SEQ ID NO: 451874 - DNA, 140 bp, Artificial Sequence
  Synthetic
atggccgactcccaagtacgggtaagagctgttttcaaggagccttcctggtttcccagggccagtactctgatagtggcggcatgcggaggttcaaattcgacaagatgatgcatctctggagacccagcatggcgtat

SEQ ID NO: 451875 - DNA, 140 bp, Artificial Sequence
  Synthetic
atacgccatgctgggtctccccaactgacactggccatggcactgttgtgatgcaggtgaaagtgccaaaaggagccccctgcaagattccagtgatagtagctgatgatcttacagcggcgtacttgggagtcggccat

SEQ ID NO: 451876 - DNA, 140 bp, Artificial Sequence
  Synthetic
atggccgactcccaagtacgccgctgtaagatcatcagctactatcactggaatcttgcagggggctccttttggcactttcacctgcatcacaacagtgccatggccagtgtcagttggggagacccagcatggcgtat

SEQ ID NO: 451877 - DNA, 140 bp, Artificial Sequence
  Synthetic
atacgccatgctgggtctccggttggaggagtggtgctcttgggagcaatgctggtcgggcaagtaactctccttgatttgctgaaactcacagtggctgtgggattgcatttccatgagcgtacttgggagtcggccat

SEQ ID NO: 451878 - DNA, 140 bp, Artificial Sequence
  Synthetic
atggccgactcccaagtacgctcatggaaatgcaatcccacagccactgtgagtttcagcaaatcaaggagagttacttgcccgaccagcattgctcccaagagcaccactcctccaaccggagacccagcatggcgtat

SEQ ID NO: 451879 - DNA, 140 bp, Artificial Sequence
  Synthetic
atacgccatgctgggtctccgaactccaaggacacctccatgcagaagactatacctctggtggccctcacactcacatcttacctgggcttgacacaaccttttttgggcctgtgtgcacgtacttgggagtcggccat

SEQ ID NO: 451880 - DNA, 140 bp, Artificial Sequence
  Synthetic
atggccgactcccaagtacgtgcacacaggcccaaaaaaggttgtgtcaagcccaggtaagatgtgagtgtgagggccaccagaggtatagtcttctgcatggaggtgtccttggagttcggagacccagcatggcgtat

SEQ ID NO: 451881 - DNA, 140 bp, Artificial Sequence
  Synthetic
atacgccatgctgggtctcctgaagtttcatgggaagaggaggcggagatcagcggaagttccgcccgctatgatgtggcactcagtgaacaaggggagttcaagctgctttctgaagagcgtacttgggagtcggccat

SEQ ID NO: 451882 - DNA, 140 bp, Artificial Sequence
  Synthetic
atggccgactcccaagtacgctcttcagaaagcagcttgaactccccttgttcactgagtgccacatcatagcgggcggaacttccgctgatctccgcctcctcttcccatgaaacttcaggagacccagcatggcgtat

SEQ ID NO: 451883 - DNA, 140 bp, Artificial Sequence
  Synthetic
atacgccatgctgggtctccaaagtgccatgggaccaggttgtgatgacctcgctggccttggttggggctgccattcatccatttgctcttctgctggtccttgctgggtggctgtttccgtacttgggagtcggccat

SEQ ID NO: 451884 - DNA, 140 bp, Artificial Sequence
  Synthetic
atggccgactcccaagtacggaaacagccacccagcaaggaccagcagaagagcaaatggatgaatggcagccccaaccaaggccagcgaggtcatcacaacctggtcccatggcactttggagacccagcatggcgtat

SEQ ID NO: 451885 - DNA, 140 bp, Artificial Sequence
  Synthetic
atacgccatgctgggtctccctatccttgattttcatcctggagctgggaagacaagacgttttctcccacagatcttggccgagtgcgcacggagacgcttgcgcactcttgtgttggccgtacttgggagtcggccat

SEQ ID NO: 451886 - DNA, 140 bp, Artificial Sequence
  Synthetic
atggccgactcccaagtacggccaacacaagagtgcgcaagcgtctccgtgcgcactcggccaagatctgtgggagaaaacgtcttgtcttcccagctccaggatgaaaatcaaggatagggagacccagcatggcgtat

SEQ ID NO: 451887 - DNA, 140 bp, Artificial Sequence
  Synthetic
aggccctggctgctgatatgaggtggcaataaaagggccacttcgcatctccgcatcctctgctgctcaaaggagggggcgcattgggagaaatcccaacagagatggagactcatactagaccttttgggacagcggtg

SEQ ID NO: 451888 - DNA, 140 bp, Artificial Sequence
  Synthetic
caccgctgtcccaaaaggtctagtatgagtctccatctctgttgggatttctcccaatgcgccccctcctttgagcagcagaggatgcggagatgcgaagtggcccttttattgccacctcatatcagcagccagggcct

SEQ ID NO: 451889 - DNA, 140 bp, Artificial Sequence
  Synthetic
aggccctggctgctgatatgatcgtatccgaacgctgattggacaggagaaatatactgactacctaacagtcatggacagatattctgtggatgctgacctgcaaccgggtgagcttatgaccttttgggacagcggtg

SEQ ID NO: 451890 - DNA, 140 bp, Artificial Sequence
  Synthetic
caccgctgtcccaaaaggtcataagctcacccggttgcaggtcagcatccacagaatatctgtccatgactgttaggtagtcagtatatttctcctgtccaatcagcgttcggatacgatcatatcagcagccagggcct

SEQ ID NO: 451891 - DNA, 140 bp, Artificial Sequence
  Synthetic
atacgccatgctgggtctccgtcatggacagatattctgtggatgctgacctgcaaccgggtgagcttatctgaaacaccatctaataggaataaccgggatacaaaccacgggtggagacgtacttgggagtcggccat

SEQ ID NO: 451892 - DNA, 140 bp, Artificial Sequence
  Synthetic
atggccgactcccaagtacgtctccacccgtggtttgtatcccggttattcctattagatggtgtttcagataagctcacccggttgcaggtcagcatccacagaatatctgtccatgacggagacccagcatggcgtat

SEQ ID NO: 451893 - DNA, 140 bp, Artificial Sequence
  Synthetic
aggccctggctgctgatatgaccggactccccacaacttgaaaccgggatataaaccacggctggagaaccggactccgcacttaaaatgaaacagaaaccgggataaaaactacggatggaccttttgggacagcggtg

SEQ ID NO: 451894 - DNA, 140 bp, Artificial Sequence
  Synthetic
caccgctgtcccaaaaggtccatccgtagtttttatcccggtttctgtttcattttaagtgcggagtccggttctccagccgtggtttatatcccggtttcaagttgtggggagtccggtcatatcagcagccagggcct

SEQ ID NO: 451895 - DNA, 140 bp, Artificial Sequence
  Synthetic
atacgccatgctgggtctccgggcgtcaatatggttcgacggggagtccgctccttgtcaaacaaaataaaacaaaaaacaaaacaaattggaaacagacctggaccttcaagaggtgttcgtacttgggagtcggccat

SEQ ID NO: 451896 - DNA, 140 bp, Artificial Sequence
  Synthetic
atggccgactcccaagtacgaacacctcttgaaggtccaggtctgtttccaatttgttttgttttttgttttattttgtttgacaaggagcggactccccgtcgaaccatattgacgcccggagacccagcatggcgtat

SEQ ID NO: 451897 - DNA, 140 bp, Artificial Sequence
  Synthetic
atacgccatgctgggtctcccaaggatttatctctttcttctcgttcaacattctgactggaaagaagatcacggctcacctaaagaggttgtggaaaatgctagacccaaggcaaggcccgtacttgggagtcggccat

SEQ ID NO: 451898 - DNA, 140 bp, Artificial Sequence
  Synthetic
atggccgactcccaagtacgggccttgccttgggtctagcattttccacaacctctttaggtgagccgtgatcttctttccagtcagaatgttgaacgagaagaaagagataaatccttgggagacccagcatggcgtat

SEQ ID NO: 451899 - DNA, 140 bp, Artificial Sequence
  Synthetic
atacgccatgctgggtctcctggctgttctgaggaaagttaaaagagtggtggctggcttgatgagagggttgtcttcaaggaaacgccgctcccatgatgtcttgactgtgcaatttctcgtacttgggagtcggccat

SEQ ID NO: 451900 - DNA, 140 bp, Artificial Sequence
  Synthetic
atggccgactcccaagtacgagaaattgcacagtcaagacatcatgggagcggcgtttccttgaagacaaccctctcatcaagccagccaccactcttttaactttcctcagaacagccaggagacccagcatggcgtat

SEQ ID NO: 451901 - DNA, 140 bp, Artificial Sequence
  Synthetic
atacgccatgctgggtctccgattctgggaatgctgctgatggcgggtggagttaccttggtgcggaaaaacagatggctactcttaaatgtgacatctgaggaccttgggaagacctttcgtacttgggagtcggccat

SEQ ID NO: 451902 - DNA, 140 bp, Artificial Sequence
  Synthetic
atggccgactcccaagtacgaaaggtcttcccaaggtcctcagatgtcacatttaagagtagccatctgtttttccgcaccaaggtaactccacccgccatcagcagcattcccagaatcggagacccagcatggcgtat

SEQ ID NO: 451903 - DNA, 140 bp, Artificial Sequence
  Synthetic
atacgccatgctgggtctcctctgtgggcacaggcaactgtacaacaaacattctagaagccaagtactggtgccccgattcaatggaatacaactgtcccaatcttagcccaagagaggcgtacttgggagtcggccat

SEQ ID NO: 451904 - DNA, 140 bp, Artificial Sequence
  Synthetic
atggccgactcccaagtacgcctctcttgggctaagattgggacagttgtattccattgaatcggggcaccagtacttggcttctagaatgtttgttgtacagttgcctgtgcccacagaggagacccagcatggcgtat

SEQ ID NO: 451905 - DNA, 140 bp, Artificial Sequence
  Synthetic
atacgccatgctgggtctccagcctgatgacatcgattgctggtgttacggagtggaaaatgttagagttgcatatggtaagtgtgactcagcaggcaggtcgaggaggtcaagaagagccgtacttgggagtcggccat

SEQ ID NO: 451906 - DNA, 140 bp, Artificial Sequence
  Synthetic
atggccgactcccaagtacggctcttcttgacctcctcgacctgcctgctgagtcacacttaccatatgcaactctaacattttccactccgtaacaccagcaatcgatgtcatcaggctggagacccagcatggcgtat

SEQ ID NO: 451907 - DNA, 140 bp, Artificial Sequence
  Synthetic
aggccctggctgctgatatggcatatggtaagtgtgactcagcaggcaggtcgaggaggtcaagaagagccattgatttgcccacgcatgaaaaccatggcctgaaaactcggcaagaaagaccttttgggacagcggtg

SEQ ID NO: 451908 - DNA, 140 bp, Artificial Sequence
  Synthetic
caccgctgtcccaaaaggtctttcttgccgagttttcaggccatggttttcatgcgtgggcaaatcaatggctcttcttgacctcctcgacctgcctgctgagtcacacttaccatatgccatatcagcagccagggcct

SEQ ID NO: 451909 - DNA, 140 bp, Artificial Sequence
  Synthetic
atacgccatgctgggtctccccttgtgggcagcaacatgacacaacgagtcgtgattgccctgctggttttggctgttggcccggcttactcagctcactgcattggaatcactgacaggcgtacttgggagtcggccat

SEQ ID NO: 451910 - DNA, 140 bp, Artificial Sequence
  Synthetic
atggccgactcccaagtacgcctgtcagtgattccaatgcagtgagctgagtaagccgggccaacagccaaaaccagcagggcaatcacgactcgttgtgtcatgttgctgcccacaaggggagacccagcatggcgtat

SEQ ID NO: 451911 - DNA, 140 bp, Artificial Sequence
  Synthetic
atacgccatgctgggtctcctctcactggagacagtggccattgatggacctgctgaggcaagaaaagtgtgttacaatgcagtccttacccatgtgaagatcaatgacaagtgccctagcgtacttgggagtcggccat

SEQ ID NO: 451912 - DNA, 140 bp, Artificial Sequence
  Synthetic
atggccgactcccaagtacgctagggcacttgtcattgatcttcacatgggtaaggactgcattgtaacacacttttcttgcctcagcaggtccatcaatggccactgtctccagtgagaggagacccagcatggcgtat

SEQ ID NO: 451913 - DNA, 140 bp, Artificial Sequence
  Synthetic
atacgccatgctgggtctcccactggtgaggcccatttagctgaagagaatgagggggataatgcgtgtaagcgcacctattcggacagaggctggggaaacggctgtggcctgtttgggcgtacttgggagtcggccat

SEQ ID NO: 451914 - DNA, 140 bp, Artificial Sequence
  Synthetic
atggccgactcccaagtacgcccaaacaggccacagccgtttccccagcctctgtccgaataggtgcgcttacacgcattatccccctcattctcttcagctaaatgggcctcaccagtgggagacccagcatggcgtat

SEQ ID NO: 451915 - DNA, 140 bp, Artificial Sequence
  Synthetic
atacgccatgctgggtctccaagggaagcattgtggcatgcgccaagttcacttgtgccaagtccatgagcttgtttgaggttgaccagacaaagatccagtacgtcatcagagcacaatcgtacttgggagtcggccat

SEQ ID NO: 451916 - DNA, 140 bp, Artificial Sequence
  Synthetic
atggccgactcccaagtacgattgtgctctgatgacgtactggatctttgtctggtcaacctcaaacaagctcatggacttggcacaagtgaacttggcgcatgccacaatgcttcccttggagacccagcatggcgtat

SEQ ID NO: 451917 - DNA, 140 bp, Artificial Sequence
  Synthetic
atacgccatgctgggtctcctacatgttggggcaaagcaggaaaattggaataccgatatcaaaactctcaagtttgatgcgttgtcaggctctcaggaagccgagtttactgggtatggcgtacttgggagtcggccat

SEQ ID NO: 451918 - DNA, 140 bp, Artificial Sequence
  Synthetic
atggccgactcccaagtacgccatacccagtaaactcggcttcctgagagcctgacaacgcatcaaacttgagagttttgatatcggtattccaattttcctgctttgccccaacatgtaggagacccagcatggcgtat

SEQ ID NO: 451919 - DNA, 140 bp, Artificial Sequence
  Synthetic
atacgccatgctgggtctccaaaagctactctggaatgccgggtgcagactgcagtagactttggcaacagttacattgctgagatggagaaagagagttggatagtggacaggcaatggcgtacttgggagtcggccat

SEQ ID NO: 451920 - DNA, 140 bp, Artificial Sequence
  Synthetic
atggccgactcccaagtacgccattgcctgtccactatccaactctctttctccatctcagcaatgtaactgttgccaaagtctactgcagtctgcacccggcattccagagtagcttttggagacccagcatggcgtat

SEQ ID NO: 451921 - DNA, 140 bp, Artificial Sequence
  Synthetic
atacgccatgctgggtctccgcccaggatctaaccttaccatggcagagcggtagcggcggggtgtggagagaaatgcaccatcttgttgaatttgaaccccctcacgccgcaaccatcacgtacttgggagtcggccat

SEQ ID NO: 451922 - DNA, 140 bp, Artificial Sequence
  Synthetic
atggccgactcccaagtacgtgatggttgcggcgtgagggggttcaaattcaacaagatggtgcatttctctccacaccccgccgctaccgctctgccatggtaaggttagatcctgggcggagacccagcatggcgtat

SEQ ID NO: 451923 - DNA, 140 bp, Artificial Sequence
  Synthetic
atacgccatgctgggtctccgagtgttagccctaggaaaccaggaaggctctttgaaaacagcccttacaggtgcaatgagggtcacaaaggacaccaatgataacaatctgtacaaactcgtacttgggagtcggccat

SEQ ID NO: 451924 - DNA, 140 bp, Artificial Sequence
  Synthetic
atggccgactcccaagtacgagtttgtacagattgttatcattggtgtcctttgtgaccctcattgcacctgtaagggctgttttcaaagagccttcctggtttcctagggctaacactcggagacccagcatggcgtat

SEQ ID NO: 451925 - DNA, 140 bp, Artificial Sequence
  Synthetic
atacgccatgctgggtctccacatggtggacatgtttcctgtagagtgaaactgtcagctttaacactcaaggggacatcctacaaaatgtgcacagataaaatgtcctttgtcaagaaccgtacttgggagtcggccat

SEQ ID NO: 451926 - DNA, 140 bp, Artificial Sequence
  Synthetic
atggccgactcccaagtacggttcttgacaaaggacattttatctgtgcacattttgtaggatgtccccttgagtgttaaagctgacagtttcactctacaggaaacatgtccaccatgtggagacccagcatggcgtat

SEQ ID NO: 451927 - DNA, 140 bp, Artificial Sequence
  Synthetic
atacgccatgctgggtctccccgactgacactgaccatggcactgttgtgatgcaggtgaaagtgccaaaaggagctccctgcaagatcccagtgatagtggctgatgatcttacagcagcgtacttgggagtcggccat

SEQ ID NO: 451928 - DNA, 140 bp, Artificial Sequence
  Synthetic
atggccgactcccaagtacgctgctgtaagatcatcagccactatcactgggatcttgcagggagctccttttggcactttcacctgcatcacaacagtgccatggtcagtgtcagtcggggagacccagcatggcgtat

SEQ ID NO: 451929 - DNA, 140 bp, Artificial Sequence
  Synthetic
atacgccatgctgggtctcccaatcaataaaggcattttggttacagttaaccccatcgcctcaaccaatgatgatgaagtgctgattgaggtgaatccaccctttggagatagttacatcgtacttgggagtcggccat

SEQ ID NO: 451930 - DNA, 140 bp, Artificial Sequence
  Synthetic
atggccgactcccaagtacgatgtaactatctccaaagggtggattcacctcaatcagcacttcatcatcattggttgaggcgatggggttaactgtaaccaaaatgcctttattgattgggagacccagcatggcgtat

SEQ ID NO: 451931 - DNA, 140 bp, Artificial Sequence
  Synthetic
atacgccatgctgggtctcccatagttggaacgggagattcacgtcttacttatcagtggcacaaagaggggagttcaataggaaagctgtttacccagaccatgaaaggcgcagaacgccgtacttgggagtcggccat

SEQ ID NO: 451932 - DNA, 140 bp, Artificial Sequence
  Synthetic
atggccgactcccaagtacggcgttctgcgcctttcatggtctgggtaaacagctttcctattgaactcccctctttgtgccactgataagtaagacgtgaatctcccgttccaactatgggagacccagcatggcgtat

SEQ ID NO: 451933 - DNA, 140 bp, Artificial Sequence
  Synthetic
atacgccatgctgggtctccctggctgttatgggagacgctgcctgggattttagctctgctggggggctcttcacttcgattgggaaaggaagtcacacggtgtttggctctgcctttccgtacttgggagtcggccat

SEQ ID NO: 451934 - DNA, 140 bp, Artificial Sequence
  Synthetic
atggccgactcccaagtacggaaaggcagagccaaacaccgtgtgacttcctttcccaatcgaagtgaagagccccccagcagagctaaaatcccaggcagcgtctcccataacagccagggagacccagcatggcgtat

SEQ ID NO: 451935 - DNA, 140 bp, Artificial Sequence
  Synthetic
atacgccatgctgggtctccagggattgtttggtggcttgagctggataacgaaggtcattatgggcgcggtcctcatatgggttggcatcaacacaagaaacatgacaatgtccatgagcgtacttgggagtcggccat

SEQ ID NO: 451936 - DNA, 140 bp, Artificial Sequence
  Synthetic
atggccgactcccaagtacgctcatggacattgtcatgtttcttgtgttgatgccaacccatatgaggaccgcgcccataatgaccttcgttatccagctcaagccaccaaacaatccctggagacccagcatggcgtat

SEQ ID NO: 451937 - DNA, 140 bp, Artificial Sequence
  Synthetic
atacgccatgctgggtctcctatgatcttggtgggagtgatcatgatgttcttgtctctgggagttggggcggatcaaggatgtgcaatcaactttggtaagagagagctcaagtgtgggcgtacttgggagtcggccat

SEQ ID NO: 451938 - DNA, 140 bp, Artificial Sequence
  Synthetic
atggccgactcccaagtacgcccacacttgagctctctcttaccaaagttgattgcacatccttgatccgccccaactcccagagacaagaacatcatgatcactcccaccaagatcataggagacccagcatggcgtat

SEQ ID NO: 451939 - DNA, 140 bp, Artificial Sequence
  Synthetic
atacgccatgctgggtctccgatggcatcttcatctttagagattctgatgactggctgaacaagtactcatactacccagaggatcctgtgaagcttgcatcaatagtgaaagcctcctcgtacttgggagtcggccat

SEQ ID NO: 451940 - DNA, 140 bp, Artificial Sequence
  Synthetic
atggccgactcccaagtacgaggaggctttcactattgatgcaagcttcacaggatcctctgggtagtatgagtacttgttcagccagtcatcagaatctctaaagatgaagatgccatcggagacccagcatggcgtat

SEQ ID NO: 451941 - DNA, 140 bp, Artificial Sequence
  Synthetic
atacgccatgctgggtctccttgaggaaggaaagtgtggcctaaactcagttgactcccttgaccatgagatgtggagaagtagggcagatgagatcaatgccattctcgaggaaaatgacgtacttgggagtcggccat

SEQ ID NO: 451942 - DNA, 140 bp, Artificial Sequence
  Synthetic
atggccgactcccaagtacgtcattttcctcgagaatggcattgatctcatctgccctacttctccacatctcatggtcaagggagtcaactgagtttaggccacactttccttcctcaaggagacccagcatggcgtat

SEQ ID NO: 451943 - DNA, 140 bp, Artificial Sequence
  Synthetic
atacgccatgctgggtctccggttgacatttctgttgtcgtgcaggacccaaaaaatgtgtaccagagaggaacgcatccattttccagaatccgagatggtctgcagtatggctggaagcgtacttgggagtcggccat

SEQ ID NO: 451944 - DNA, 140 bp, Artificial Sequence
  Synthetic
atggccgactcccaagtacgcttccagccatactgcagaccatctcggattctggaaaatggatgcgttcctctctggtacacattttttgggtcctgcacgacaacagaaatgtcaaccggagacccagcatggcgtat

SEQ ID NO: 451945 - DNA, 140 bp, Artificial Sequence
  Synthetic
atacgccatgctgggtctccacttggggtaagaaccttgtgttctccccagggaggaagaacggaagcttcattatagatggaaagtccagaaaagaatgcccgttttcaaaccgggtttcgtacttgggagtcggccat

SEQ ID NO: 451946 - DNA, 140 bp, Artificial Sequence
  Synthetic
atggccgactcccaagtacgaaacccggtttgaaaacgggcattcttttctggactttccatctataatgaagcttccgttcttcctccctggggagaacacaaggttcttaccccaagtggagacccagcatggcgtat

SEQ ID NO: 451947 - DNA, 140 bp, Artificial Sequence
  Synthetic
atacgccatgctgggtctccggaattccttccagatagaagagtttgggacaggagtgttcaccacacgcgtgtacatggacgcagtctttgaatacaccatagactgtgatggatccatcgtacttgggagtcggccat

SEQ ID NO: 451948 - DNA, 140 bp, Artificial Sequence
  Synthetic
atggccgactcccaagtacgatggatccatcacagtctatggtgtattcaaagactgcgtccatgtacacgcgtgtggtgaacactcctgtcccaaactcttctatctggaaggaattccggagacccagcatggcgtat

SEQ ID NO: 451949 - DNA, 140 bp, Artificial Sequence
  Synthetic
atacgccatgctgggtctcctctgggtgcagcagtgaatggaaaaaagagtgcccatgggtctccaacattttggatgggaagccatgaggtgaatgggacatggatgatccacaccttacgtacttgggagtcggccat

SEQ ID NO: 451950 - DNA, 140 bp, Artificial Sequence
  Synthetic
atggccgactcccaagtacgtaaggtgtggatcatccatgtcccattcacctcatggcttcccatccaaaatgttggagacccatgggcactcttttttccattcactgctgcacccagaggagacccagcatggcgtat

SEQ ID NO: 451951 - DNA, 140 bp, Artificial Sequence
  Synthetic
atacgccatgctgggtctccgagacattagattataaggagtgtgagtggccactgacgcacacaataggaacatcagttgaagaaagtgacatgttcatgccaagatcaattggaggcccgtacttgggagtcggccat

SEQ ID NO: 451952 - DNA, 140 bp, Artificial Sequence
  Synthetic
atggccgactcccaagtacgggcctccaattgatcttggcatgaacatgtcactttcttcaactgatgttcctattgtgtgcgtcagtggccactcacactccttataatctaatgtctcggagacccagcatggcgtat

SEQ ID NO: 451953 - DNA, 140 bp, Artificial Sequence
  Synthetic
aggccctggctgctgatatgaacatcagttgaagaaagtgacatgttcatgccaagatcaattggaggcccggttagctcccacaatcatattcctggatacaaggtccagacgaatggagaccttttgggacagcggtg

SEQ ID NO: 451954 - DNA, 140 bp, Artificial Sequence
  Synthetic
caccgctgtcccaaaaggtctccattcgtctggaccttgtatccaggaatatgattgtgggagctaaccgggcctccaattgatcttggcatgaacatgtcactttcttcaactgatgttcatatcagcagccagggcct

SEQ ID NO: 451955 - DNA, 140 bp, Artificial Sequence
  Synthetic
atacgccatgctgggtctccacaatgccgcctgtgagctttcatgggaatgatggatgttggtaccccatggaaattcggccaaggaaaacacatgaaagccatctggtacgatcatgggcgtacttgggagtcggccat

SEQ ID NO: 451956 - DNA, 140 bp, Artificial Sequence
  Synthetic
atggccgactcccaagtacgcccatgatcgtaccagatggctttcatgtgttttccttggccgaatttccatggggtaccaacatccatcattcccatgaaagctcacaggcggcattgtggagacccagcatggcgtat

SEQ ID NO: 451957 - DNA, 140 bp, Artificial Sequence
  Synthetic
atacgccatgctgggtctcctaacggctggagaaatacatgcagtcccttttgggctggtgagcatgatgatagcaatggaggtggtcctaaggaaaagacagggaccaaagcaaatgctcgtacttgggagtcggccat

SEQ ID NO: 451958 - DNA, 140 bp, Artificial Sequence
  Synthetic
atggccgactcccaagtacgagcatttgctttggtccctgtcttttccttaggaccacctccattgctatcatcatgctcaccagcccaaaagggactgcatgtatttctccagccgttaggagacccagcatggcgtat

SEQ ID NO: 451959 - DNA, 140 bp, Artificial Sequence
  Synthetic
atacgccatgctgggtctccagttggaggaatggtgctcctgggggcaatgctggttggacaggtaactctccttgatttgctgaaactcacaatggccgtgggactgcattttcatgagcgtacttgggagtcggccat

SEQ ID NO: 451960 - DNA, 140 bp, Artificial Sequence
  Synthetic
atggccgactcccaagtacgctcatgaaaatgcagtcccacggccattgtgagtttcagcaaatcaaggagagttacctgtccaaccagcattgcccccaggagcaccattcctccaactggagacccagcatggcgtat

SEQ ID NO: 451961 - DNA, 140 bp, Artificial Sequence
  Synthetic
atacgccatgctgggtctccatgaacaatggaggagacgccatgtacatggcgttgattgctgccttttcaatcaggccagggctgctcattggctttgggctcaggaccctgtggagcccgtacttgggagtcggccat

SEQ ID NO: 451962 - DNA, 140 bp, Artificial Sequence
  Synthetic
atggccgactcccaagtacgggctccacagggtcctgagcccaaagccaatgagcagccctggcctgattgaaaaggcagcaatcaacgccatgtacatggcgtctcctccattgttcatggagacccagcatggcgtat

SEQ ID NO: 451963 - DNA, 140 bp, Artificial Sequence
  Synthetic
atacgccatgctgggtctcccccgggaacgccttgtgctgaccctgggtgcagccatggtggagattgccctgggtggcatgatgggcggcctgtggaaatatctgaacgcagtctctctcgtacttgggagtcggccat

SEQ ID NO: 451964 - DNA, 140 bp, Artificial Sequence
  Synthetic
atggccgactcccaagtacgagagagactgcgttcagatatttccacaggccgcccatcatgccacccagggcaatctccaccatggctgcacccagggtcagcacaaggcgttcccgggggagacccagcatggcgtat

SEQ ID NO: 451965 - DNA, 140 bp, Artificial Sequence
  Synthetic
atacgccatgctgggtctccctgcatcctgacaataaatgctgtagcctctaggaaagcatcaaacaccatcttgcccctcatggctctgttaacacctgtgaccatggcggaggtgaggcgtacttgggagtcggccat

SEQ ID NO: 451966 - DNA, 140 bp, Artificial Sequence
  Synthetic
atggccgactcccaagtacgcctcacctccgccatggtcacaggtgttaacagagccatgaggggcaagatggtgtttgatgctttcctagaggctacagcatttattgtcaggatgcagggagacccagcatggcgtat

SEQ ID NO: 451967 - DNA, 140 bp, Artificial Sequence
  Synthetic
atacgccatgctgggtctcccttgccacgatgctcttatgcgccgtggttatcataggggtccttcaccagaactccaaggacacctccatgcaaaagaccatacccttggtggctctcacgtacttgggagtcggccat

SEQ ID NO: 451968 - DNA, 140 bp, Artificial Sequence
  Synthetic
atggccgactcccaagtacgtgagagccaccaagggtatggtcttttgcatggaggtgtccttggagttctggtgaaggacccctatgataaccacggcgcataagagcatcgtggcaagggagacccagcatggcgtat

SEQ ID NO: 451969 - DNA, 140 bp, Artificial Sequence
  Synthetic
atacgccatgctgggtctcccacttacatcttacctgggcttgacacaaccttttctgggcctgtgtgcatttctggcaacccgcatatttgggcgaaggagcattccagtgaatgaggccgtacttgggagtcggccat

SEQ ID NO: 451970 - DNA, 140 bp, Artificial Sequence
  Synthetic
atggccgactcccaagtacggcctcattcactggaatgctccttcgcccaaatatgcgggttgccagaaatgcacacaggcccagaaaaggttgtgtcaagcccaggtaagatgtaagtgggagacccagcatggcgtat

SEQ ID NO: 451971 - DNA, 140 bp, Artificial Sequence
  Synthetic
atacgccatgctgggtctccctggttagcgtggctgggagagtagatgggcttgagctgaagaagctcggtgaggtttcatgggaagaggaggcagagatcagcgggagctccgctcgctcgtacttgggagtcggccat

SEQ ID NO: 451972 - DNA, 140 bp, Artificial Sequence
  Synthetic
atggccgactcccaagtacgagcgagcggagctcccgctgatctctgcctcctcttcccatgaaacctcaccgagcttcttcagctcaagcccatctactctcccagccacgctaaccagggagacccagcatggcgtat

SEQ ID NO: 451973 - DNA, 140 bp, Artificial Sequence
  Synthetic
atacgccatgctgggtctccatgatgtggcactcagtgaacagggggaattcaagctgctttctgaagagaaagtgccatgggaccaggttgtgatgacctcgctggccttggttggagccgtacttgggagtcggccat

SEQ ID NO: 451974 - DNA, 140 bp, Artificial Sequence
  Synthetic
atggccgactcccaagtacggctccaaccaaggccagcgaggtcatcacaacctggtcccatggcactttctcttcagaaagcagcttgaattccccctgttcactgagtgccacatcatggagacccagcatggcgtat

SEQ ID NO: 451975 - DNA, 140 bp, Artificial Sequence
  Synthetic
atacgccatgctgggtctcctgccattcatccatctgctcttctgctggtccttgctggctggctgttccatgtcaagggagctaggagaagtggggatgtcctgtgggacattcccactcgtacttgggagtcggccat

SEQ ID NO: 451976 - DNA, 140 bp, Artificial Sequence
  Synthetic
atggccgactcccaagtacgagtgggaatgtcccacaggacatccccacttctcctagctcccttgacatggaacagccagccagcaaggaccagcagaagagcagatggatgaatggcaggagacccagcatggcgtat

SEQ ID NO: 451977 - DNA, 140 bp, Artificial Sequence
  Synthetic
atacgccatgctgggtctcccctaagatcattgaagaatgtgaacatctggaggatgggatttatggcatattccagtcaaccttcttgggagcctcccagcgaggagtgggagtagcaccgtacttgggagtcggccat

SEQ ID NO: 451978 - DNA, 140 bp, Artificial Sequence
  Synthetic
atggccgactcccaagtacggtgctactcccactcctcgctgggaggctcccaagaaggttgactggaatatgccataaatcccatcctccagatgttcacattcttcaatgatcttaggggagacccagcatggcgtat

SEQ ID NO: 451979 - DNA, 140 bp, Artificial Sequence
  Synthetic
atacgccatgctgggtctccaaggaggggtgttccacacaatgtggcatgtcacaagaggagctttccttgtcaggaatggcaagaagctgattccatcttgggcttcagtaaaagaggacgtacttgggagtcggccat

SEQ ID NO: 451980 - DNA, 140 bp, Artificial Sequence
  Synthetic
atggccgactcccaagtacgtcctcttttactgaagcccaagatggaatcagcttcttgccattcctgacaaggaaagctcctcttgtgacatgccacattgtgtggaacacccctccttggagacccagcatggcgtat

SEQ ID NO: 451981 - DNA, 140 bp, Artificial Sequence
  Synthetic
atacgccatgctgggtctccccttgtcgcctatggtggctcatggaaattggaaggtagatgggatggggaagaagaggtccagttgattgctgctgtaccagggaagaatgtggtcaatcgtacttgggagtcggccat

SEQ ID NO: 451982 - DNA, 140 bp, Artificial Sequence
  Synthetic
atggccgactcccaagtacgattgaccacattcttccctggtacagcagcaatcaactggacctcttcttccccatcccatctaccttccaatttccatgagccaccataggcgacaaggggagacccagcatggcgtat

SEQ ID NO: 451983 - DNA, 140 bp, Artificial Sequence
  Synthetic
atacgccatgctgggtctccgtccagacgaaacctagcttgttcaaagtgaggaatgggggagaaatcggggcggttgctcttgattacccaagtggcacttcgggatctcctattgtcacgtacttgggagtcggccat

SEQ ID NO: 451984 - DNA, 140 bp, Artificial Sequence
  Synthetic
atggccgactcccaagtacgtgacaataggagatcccgaagtgccacttgggtaatcaagagcaaccgccccgatttctcccccattcctcactttgaacaagctaggtttcgtctggacggagacccagcatggcgtat

SEQ ID NO: 451985 - DNA, 140 bp, Artificial Sequence
  Synthetic
atacgccatgctgggtctccacaggaatggagaggtgattggtctgtatggcaatggcattcttgtcggtgacaattcattcgtgtccgccatttcccagactgaggtgaaggaggaaggcgtacttgggagtcggccat

SEQ ID NO: 451986 - DNA, 140 bp, Artificial Sequence
  Synthetic
atggccgactcccaagtacgccttcctccttcacctcagtctgggaaatggcggacacgaatgaattgtcaccgacaagaatgccattgccatacagaccaatcacctctccattcctgtggagacccagcatggcgtat

SEQ ID NO: 451987 - DNA, 140 bp, Artificial Sequence
  Synthetic
atacgccatgctgggtctccaaaggaggagcttcaggagatcccgacaatgttgaagaaaggaatgacaactatcctcgactaccatcctggagctgggaagacgcgacggtttctcccacgtacttgggagtcggccat

SEQ ID NO: 451988 - DNA, 140 bp, Artificial Sequence
  Synthetic
atggccgactcccaagtacgtgggagaaaccgtcgcgtcttcccagctccaggatggtagtcgaggatagttgtcattcctttcttcaacattgtcgggatctcctgaagctcctcctttggagacccagcatggcgtat

SEQ ID NO: 451989 - DNA, 140 bp, Artificial Sequence
  Synthetic
atacgccatgctgggtctcccagatcttggctgaatgcgcacggagacgcctacgcacgcttgtgctggctcctaccagggttgttctttctgaaatgaaggaggctttccatggcttggcgtacttgggagtcggccat

SEQ ID NO: 451990 - DNA, 140 bp, Artificial Sequence
  Synthetic
atggccgactcccaagtacgccaagccatggaaagcctccttcatttcagaaagaacaaccctggtaggagccagcacaagcgtgcgtaggcgtctccgtgcgcattcagccaagatctgggagacccagcatggcgtat

SEQ ID NO: 451991 - DNA, 140 bp, Artificial Sequence
  Synthetic
atacgccatgctgggtctccacgtgaaatttcacacacaggctttctccgcccacggcagtggaagagaagtcattgatgccatgtgccatgccactctaacatatagaatgttggaacccgtacttgggagtcggccat

SEQ ID NO: 451992 - DNA, 140 bp, Artificial Sequence
  Synthetic
atggccgactcccaagtacgggttccaacattctatatgttagagtggcatggcacatggcatcaatgacttctcttccactgccgtgggcggagaaagcctgtgtgtgaaatttcacgtggagacccagcatggcgtat

SEQ ID NO: 451993 - DNA, 140 bp, Artificial Sequence
  Synthetic
atacgccatgctgggtctccaaccaggattgtcaactgggaagtgatcattatggatgaagcccatttcctggacccagccagcatagcagctagaggctgggcagcacacagagccaggcgtacttgggagtcggccat

SEQ ID NO: 451994 - DNA, 140 bp, Artificial Sequence
  Synthetic
atggccgactcccaagtacgcctggctctgtgtgctgcccagcctctagctgctatgctggctgggtccaggaaatgggcttcatccataatgatcacttcccagttgacaatcctggttggagacccagcatggcgtat

SEQ ID NO: 451995 - DNA, 140 bp, Artificial Sequence
  Synthetic
atacgccatgctgggtctccgcaaatgaaagtgcaacaattctgatgacggccacaccgccagggaccagtgatgaattcccacattcaaatggtgaaatagaagatgtccaaacggacacgtacttgggagtcggccat

SEQ ID NO: 451996 - DNA, 140 bp, Artificial Sequence
  Synthetic
atggccgactcccaagtacgtgtccgtttggacatcttctatttcaccatttgaatgtgggaattcatcactggtccctggcggtgtggccgtcatcagaattgttgcactttcatttgcggagacccagcatggcgtat

SEQ ID NO: 451997 - DNA, 140 bp, Artificial Sequence
  Synthetic
atacgccatgctgggtctcctacccagtgaaccctggaacacagggcatgattggatcctggcagacaaaaggcccacggcatggttcctcccttccatcagggctgcaaatgtcatggccgtacttgggagtcggccat

SEQ ID NO: 451998 - DNA, 140 bp, Artificial Sequence
  Synthetic
atggccgactcccaagtacggccatgacatttgcagccctgatggaagggaggaaccatgccgtgggccttttgtctgccaggatccaatcatgccctgtgttccagggttcactgggtaggagacccagcatggcgtat

SEQ ID NO: 451999 - DNA, 140 bp, Artificial Sequence
  Synthetic
atacgccatgctgggtctccttggccactgacatagctgagatgggagccaacctttgcgtggacagagtgctggactgcaggacggcttttaagcctgtacttgtggatgaaggaaggacgtacttgggagtcggccat

SEQ ID NO: 452000 - DNA, 140 bp, Artificial Sequence
  Synthetic
atggccgactcccaagtacgtccttccttcatccacaagtacaggcttaaaagccgtcctgcagtccagcactctgtccacgcaaaggttggctcccatctcagctatgtcagtggccaaggagacccagcatggcgtat

SEQ ID NO: 452001 - DNA, 140 bp, Artificial Sequence
  Synthetic
atacgccatgctgggtctccaggtggcaataaaggggccactccgcatctctgcatcttctgctgcccaaagaagaggacgcattgggagaaatcccaatagagatggagattcatactacgtacttgggagtcggccat

SEQ ID NO: 452002 - DNA, 140 bp, Artificial Sequence
  Synthetic
atggccgactcccaagtacgtagtatgaatctccatctctattgggatttctcccaatgcgtcctcttctttgggcagcagaagatgcagagatgcggagtggcccctttattgccacctggagacccagcatggcgtat

SEQ ID NO: 452003 - DNA, 140 bp, Artificial Sequence
  Synthetic
aggccctggctgctgatatgagaagaggacgcattgggagaaatcccaatagagatggagattcatactactattctgagcccacaagtgaggataatgcccaccacgtctgctggctgggaccttttgggacagcggtg

SEQ ID NO: 452004 - DNA, 140 bp, Artificial Sequence
  Synthetic
caccgctgtcccaaaaggtcccagccagcagacgtggtgggcattatcctcacttgtgggctcagaatagtagtatgaatctccatctctattgggatttctcccaatgcgtcctcttctcatatcagcagccagggcct

SEQ ID NO: 452005 - DNA, 140 bp, Artificial Sequence
  Synthetic
atacgccatgctgggtctccgtgatctgcctgtctggctgtcctggcaagtggccaaggctggtttgaagacgaatgaccggaaatggtgtttcgatggccctaaggaacatgaaattttcgtacttgggagtcggccat

SEQ ID NO: 452006 - DNA, 140 bp, Artificial Sequence
  Synthetic
atggccgactcccaagtacgaaaatttcatgttccttagggccatcgaaacaccatttccggtcattcgtcttcaaaccagccttggccacttgccaggacagccagacaggcagatcacggagacccagcatggcgtat

SEQ ID NO: 452007 - DNA, 140 bp, Artificial Sequence
  Synthetic
atacgccatgctgggtctccgaacgatagtggtgaaacagtgaagtgcagggctcctggaggagcgaagaggcctctgcgcccaaggtggtgtgatgaaagggtgtcatctgatcagagtcgtacttgggagtcggccat

SEQ ID NO: 452008 - DNA, 140 bp, Artificial Sequence
  Synthetic
atggccgactcccaagtacgactctgatcagatgacaccctttcatcacaccaccttgggcgcagaggcctcttcgctcctccaggagccctgcacttcactgtttcaccactatcgttcggagacccagcatggcgtat

SEQ ID NO: 452009 - DNA, 140 bp, Artificial Sequence
  Synthetic
atacgccatgctgggtctccgcgcttgctgacttcataaagttcgctgaaggtagaaggggagctgcagaaatcctggtagtgctgagtgagctccctgacttcttggcgaagaaaggtgcgtacttgggagtcggccat

SEQ ID NO: 452010 - DNA, 140 bp, Artificial Sequence
  Synthetic
atggccgactcccaagtacgcacctttcttcgccaagaagtcagggagctcactcagcactaccaggatttctgcagctccccttctaccttcagcgaactttatgaagtcagcaagcgcggagacccagcatggcgtat

SEQ ID NO: 452011 - DNA, 140 bp, Artificial Sequence
  Synthetic
atacgccatgctgggtctccgagaggccatggataccatcagtgtgttcctgcattccgaggaaggctccagggcataccgcaatgctctgtcaatgatgcctgaagcaatgacaatagtcgtacttgggagtcggccat

SEQ ID NO: 452012 - DNA, 140 bp, Artificial Sequence
  Synthetic
atggccgactcccaagtacgactattgtcattgcttcaggcatcattgacagagcattgcggtatgccctggagccttcctcggaatgcaggaacacactgatggtatccatggcctctcggagacccagcatggcgtat

SEQ ID NO: 452013 - DNA, 140 bp, Artificial Sequence
  Synthetic
atacgccatgctgggtctcccatgctgttcatactggctggattgttgacatcgggaatggtcatcttcttcatgtctcccaaaggtatcagtagaatgtccatggcgatgggcacaatgcgtacttgggagtcggccat

SEQ ID NO: 452014 - DNA, 140 bp, Artificial Sequence
  Synthetic
atggccgactcccaagtacgcattgtgcccatcgccatggacattctactgatacctttgggagacatgaagaagatgaccattcccgatgtcaacaatccagccagtatgaacagcatgggagacccagcatggcgtat

SEQ ID NO: 452015 - DNA, 140 bp, Artificial Sequence
  Synthetic
atacgccatgctgggtctccgccggctgtggatatctcatgtttcttggaggcgccaaacccactcatatttcctacatcatgctcatattctttgtcctgatggtagttgtgattcccgcgtacttgggagtcggccat

SEQ ID NO: 452016 - DNA, 140 bp, Artificial Sequence
  Synthetic
atggccgactcccaagtacgcgggaatcacaactaccatcaggacaaagaatatgagcatgatgtaggaaatatgagtgggtttggcgcctccaagaaacatgagatatccacagccggcggagacccagcatggcgtat

SEQ ID NO: 452017 - DNA, 140 bp, Artificial Sequence
  Synthetic
atacgccatgctgggtctccagccagggcaacaaaggtccattcaggacaatcaggtggcatatcttatcattggcatcttgacactggtctcggtagtggcagctaatgaattgggcatcgtacttgggagtcggccat

SEQ ID NO: 452018 - DNA, 140 bp, Artificial Sequence
  Synthetic
atggccgactcccaagtacgatgcccaattcattagctgccactaccgagaccagtgtcaagatgccaatgataagatatgccacctgattgtcctgaatggacctttgttgccctggctggagacccagcatggcgtat

SEQ ID NO: 452019 - DNA, 140 bp, Artificial Sequence
  Synthetic
atacgccatgctgggtctccgctggagagaactaaagaagacctctttgggaagaagaacttgattccatctagcgcctcaccctggagttggccggatcttgacttaaagccaggagcgcgtacttgggagtcggccat

SEQ ID NO: 452020 - DNA, 140 bp, Artificial Sequence
  Synthetic
atggccgactcccaagtacgcgctcctggctttaagtcaagatccggccaactccagggtgaggcgctagatggaatcaagttcttcttcccaaagaggtcttctttagttctctccagcggagacccagcatggcgtat

SEQ ID NO: 452021 - DNA, 140 bp, Artificial Sequence
  Synthetic
atacgccatgctgggtctccgcttggactgtgtatgttggcattgtcacaatcctctctccaatgttgcaccactggatcaaggtcgagtatggcaacctgtctctgtctggaatagccccgtacttgggagtcggccat

SEQ ID NO: 452022 - DNA, 140 bp, Artificial Sequence
  Synthetic
atggccgactcccaagtacggggctattccagacagagacaggttgccatactcgaccttgatccagtggtgcaacattggagagaggattgtgacaatgccaacatacacagtccaagcggagacccagcatggcgtat

SEQ ID NO: 452023 - DNA, 140 bp, Artificial Sequence
  Synthetic
atacgccatgctgggtctccagtgatgcccctgctttgtggcatagggtgtgccatgctccactggactctcatcttacctgggatcaaggcgcagcagtcaaagcttccacaaagaaggcgtacttgggagtcggccat

SEQ ID NO: 452024 - DNA, 140 bp, Artificial Sequence
  Synthetic
atggccgactcccaagtacgccttctttgtggaagctttgactgctgcgccttgatcccaggtaagatgagagtccagtggagcatggcacaccctatgccacaaagcaggggcatcactggagacccagcatggcgtat

SEQ ID NO: 452025 - DNA, 140 bp, Artificial Sequence
  Synthetic
atacgccatgctgggtctccgtgtttcatggcgtagccaagaacccggtggttgatggaaacccaacagttgacattgaagaagcccctgaaatgcctgctctgtatgaaaagaaactggcgtacttgggagtcggccat

SEQ ID NO: 452026 - DNA, 140 bp, Artificial Sequence
  Synthetic
atggccgactcccaagtacgccagtttcttttcatacagagcaggcatttcaggggcttcttcaatgtcaactgttgggtttccatcaaccaccgggttcttggctacgccatgaaacacggagacccagcatggcgtat

SEQ ID NO: 452027 - DNA, 140 bp, Artificial Sequence
  Synthetic
atacgccatgctgggtctccccctatatcttcttcttgctctcagcttggcctctgttgccatgtgcagaactcccttctcactggctgaaggcattgtcctagcatcagcagccttgggcgtacttgggagtcggccat

SEQ ID NO: 452028 - DNA, 140 bp, Artificial Sequence
  Synthetic
atggccgactcccaagtacgcccaaggctgctgatgctaggacaatgccttcagccagtgagaagggagttctgcacatggcaacagaggccaagctgagagcaagaagaagatatagggggagacccagcatggcgtat

SEQ ID NO: 452029 - DNA, 140 bp, Artificial Sequence
  Synthetic
atacgccatgctgggtctccgcctctcatagagggaaacactagccttctctggaacggacccatggctgtttccatgacaggagttatgcgtggaaactactatgcctttgtgggagtccgtacttgggagtcggccat

SEQ ID NO: 452030 - DNA, 140 bp, Artificial Sequence
  Synthetic
atggccgactcccaagtacggactcccacaaaggcatagtagtttccacgcataactcctgtcatggaaacagccatgggtccgttccagagaaggctagtgtttccctctatgagaggcggagacccagcatggcgtat

SEQ ID NO: 452031 - DNA, 140 bp, Artificial Sequence
  Synthetic
atacgccatgctgggtctccatgtacaatctgtggaagatggagactggacgcagggggagggcgaatggaaaaactctgggtgaagtctggaaaagggagctgaacctgctggacaggccgtacttgggagtcggccat

SEQ ID NO: 452032 - DNA, 140 bp, Artificial Sequence
  Synthetic
atggccgactcccaagtacggcctgtccagcaggttcagctcccttttccagacttcacccagagtttttccattcgccctccccctgcgtccagtctccatcttccacagattgtacatggagacccagcatggcgtat

SEQ ID NO: 452033 - DNA, 140 bp, Artificial Sequence
  Synthetic
atacgccatgctgggtctccagcagtttgagctgtacaaaaggactgacattgtggaggtggaccgtgacacggcacgcagacatctggctgaaggaaaggtggacaccggggtggctgtcgtacttgggagtcggccat

SEQ ID NO: 452034 - DNA, 140 bp, Artificial Sequence
  Synthetic
atggccgactcccaagtacgacagccaccccggtgtccacctttccttcagccagatgtctgcgtgccgtgtcacggtccacctccacaatgtcagtccttttgtacagctcaaactgctggagacccagcatggcgtat

SEQ ID NO: 452035 - DNA, 140 bp, Artificial Sequence
  Synthetic
atacgccatgctgggtctccctcgagggggaccgcaaagttaaggtggtttcatgaacgtggctatgtcaagctggaaggcagggtgactgacctagggtgcggacgcgggggctggtgccgtacttgggagtcggccat

SEQ ID NO: 452036 - DNA, 140 bp, Artificial Sequence
  Synthetic
atggccgactcccaagtacggcaccagcccccgcgtccgcaccctaggtcagtcaccctgccttccagcttgacatagccacgttcatgaaaccaccttaactttgcggtccccctcgagggagacccagcatggcgtat

SEQ ID NO: 452037 - DNA, 140 bp, Artificial Sequence
  Synthetic
atacgccatgctgggtctccatatcatcaccttcaaggataaaactgacatccaccacctggaaccagtgaaatgtgacacccttctgtgtgacattggagagtcatcatcgtcatcagtcgtacttgggagtcggccat

SEQ ID NO: 452038 - DNA, 140 bp, Artificial Sequence
  Synthetic
atggccgactcccaagtacgactgatgacgatgatgactctccaatgtcacacagaagggtgtcacatttcactggttccaggtggtggatgtcagttttatccttgaaggtgatgatatggagacccagcatggcgtat

SEQ ID NO: 452039 - DNA, 140 bp, Artificial Sequence
  Synthetic
atacgccatgctgggtctccgacagaaggggaaagaaccatgagagttcttgataccgttgagaaatggctggcttgcggcgttgacaatttctgtgtgaaggtgttggctccatacatgcgtacttgggagtcggccat

SEQ ID NO: 452040 - DNA, 140 bp, Artificial Sequence
  Synthetic
atggccgactcccaagtacgcatgtatggagccaacaccttcacacagaaattgtcaacgccgcaagccagccatttctcaacggtatcaagaactctcatggttctttccccttctgtcggagacccagcatggcgtat

SEQ ID NO: 452041 - DNA, 140 bp, Artificial Sequence
  Synthetic
atacgccatgctgggtctccccagatgttctcgagaagctggaactgctccaaaggaggtttggtggaacagtgatcaggaaccctctttccagaaattccactcatgagatgtactacgcgtacttgggagtcggccat

SEQ ID NO: 452042 - DNA, 140 bp, Artificial Sequence
  Synthetic
atggccgactcccaagtacgcgtagtacatctcatgagtggaatttctggaaagagggttcctgatcactgttccaccaaacctcctttggagcagttccagcttctcgagaacatctggggagacccagcatggcgtat

SEQ ID NO: 452043 - DNA, 140 bp, Artificial Sequence
  Synthetic
atacgccatgctgggtctcctgtctggagcccgcagtaatgtcacatttactgtgaaccaaacatctcgtctcctaatgaggagaatgagacgtccaactggcaaagtgaccctggaagccgtacttgggagtcggccat

SEQ ID NO: 452044 - DNA, 140 bp, Artificial Sequence
  Synthetic
atggccgactcccaagtacggcttccagggtcactttgccagttggacgtctcattctcctcattaggagacgagatgtttggttcacagtaaatgtgacattactgcgggctccagacaggagacccagcatggcgtat

SEQ ID NO: 452045 - DNA, 140 bp, Artificial Sequence
  Synthetic
atacgccatgctgggtctcctgatgtcattctcccaattgggacacgcagtgtcgagacagacaaaggacccctgaatagagaggccatagaagagagagttgagagaataaaatctgagcgtacttgggagtcggccat

SEQ ID NO: 452046 - DNA, 140 bp, Artificial Sequence
  Synthetic
atggccgactcccaagtacgctcagattttattctctcaactctctcttctatggcctctctattcaggggtcctttgtctgtctcgacactgcgtgtcccaattgggagaatgacatcaggagacccagcatggcgtat

SEQ ID NO: 452047 - DNA, 140 bp, Artificial Sequence
  Synthetic
atacgccatgctgggtctcctacatgactacctggttttatgacaatgacaacccttacaggacttggcattactgtggctcctatgttactaaaacctcagggagcgcggcaagcatggcgtacttgggagtcggccat

SEQ ID NO: 452048 - DNA, 140 bp, Artificial Sequence
  Synthetic
atggccgactcccaagtacgccatgcttgccgcgctccctgaggttttagtaacataggagccacagtaatgccaagtcctgtaagggttgtcattgtcataaaaccaggtagtcatgtaggagacccagcatggcgtat

SEQ ID NO: 452049 - DNA, 140 bp, Artificial Sequence
  Synthetic
atacgccatgctgggtctcctcaatggtgtcatcaagattttgacgtatccatgggacagaatagaggaggttacaagaatggcaatgactgacacaaccccctttggacagcagagggtcgtacttgggagtcggccat

SEQ ID NO: 452050 - DNA, 140 bp, Artificial Sequence
  Synthetic
atggccgactcccaagtacgaccctctgctgtccaaagggggttgtgtcagtcattgccattcttgtaacctcctctattctgtcccatggatacgtcaaaatcttgatgacaccattgaggagacccagcatggcgtat

SEQ ID NO: 452051 - DNA, 140 bp, Artificial Sequence
  Synthetic
atacgccatgctgggtctccgttcaaagaaaaagttgacaccagagcaaaggatccacccgcgggaaccagaaaaatcatgaaagttgtcaacagatggctcttccgtcacttggccaggcgtacttgggagtcggccat

SEQ ID NO: 452052 - DNA, 140 bp, Artificial Sequence
  Synthetic
atggccgactcccaagtacgcctggccaagtgacggaagagccatctgttgacaactttcatgatttttctggttcccgcgggtggatcctttgctctggtgtcaactttttctttgaacggagacccagcatggcgtat

SEQ ID NO: 452053 - DNA, 140 bp, Artificial Sequence
  Synthetic
atacgccatgctgggtctccgagaagaatcctagactgtgcacaaaagaagaattcattgcaaaggtccgcagccacgcagccattggagcctacctggaagaacaagaacagtggaagacgtacttgggagtcggccat

SEQ ID NO: 452054 - DNA, 140 bp, Artificial Sequence
  Synthetic
atggccgactcccaagtacgtcttccactgttcttgttcttccaggtaggctccaatggctgcgtggctgcggacctttgcaatgaattcttcttttgtgcacagtctaggattcttctcggagacccagcatggcgtat

SEQ ID NO: 452055 - DNA, 140 bp, Artificial Sequence
  Synthetic
atacgccatgctgggtctccctgccaacgaggctgtccaggacccgaagttttgggaattggtggatgaagaaaggaggctgcaccaacaaggcaggtgccggacttgcgtgtacaacatcgtacttgggagtcggccat

SEQ ID NO: 452056 - DNA, 140 bp, Artificial Sequence
  Synthetic
atggccgactcccaagtacgatgttgtacacgcaagtccggcacctgccttgttggtgcagcctcctttcttcatccaccaattcccaaaacttcgggtcctggacagcctcgttggcagggagacccagcatggcgtat

SEQ ID NO: 452057 - DNA, 140 bp, Artificial Sequence
  Synthetic
atacgccatgctgggtctccgccctaggattcctgaatgaagaccattgggcatccagagagaattcggggggaggagtagaaggcattggtttacagtacctaggatatgtgatcagagcgtacttgggagtcggccat

SEQ ID NO: 452058 - DNA, 140 bp, Artificial Sequence
  Synthetic
atggccgactcccaagtacgctctgatcacatatcctaggtactgtaaaccaatgccttctactcctccccccgaattctctctggatgcccaatggtcttcattcaggaatcctagggcggagacccagcatggcgtat

SEQ ID NO: 452059 - DNA, 140 bp, Artificial Sequence
  Synthetic
atacgccatgctgggtctccacttggctgcaatggatggtgggggattctacgcggatgataccgctgggtgggacacacgcatcacagaggcagaccttgatgatgaacaggagatcctcgtacttgggagtcggccat

SEQ ID NO: 452060 - DNA, 140 bp, Artificial Sequence
  Synthetic
atggccgactcccaagtacgaggatctcctgttcatcatcaaggtctgcctctgtgatgcgtgtgtcccacccagcggtatcatccgcgtagaatcccccaccatccattgcagccaagtggagacccagcatggcgtat

SEQ ID NO: 452061 - DNA, 140 bp, Artificial Sequence
  Synthetic
atacgccatgctgggtctccgaattacatgagctcacatcacaaaaaactggcacaagcagtgatggaaatgacatacaagaataaggtggtgaaagtgctgagaccaacaccaggcgggcgtacttgggagtcggccat

SEQ ID NO: 452062 - DNA, 140 bp, Artificial Sequence
  Synthetic
atggccgactcccaagtacgcccgcctggtgttggtctcagcactttcaccaccttattcttgtatgtcatttccatcactgcttgtgccagttttttgtgatgtgagctcatgtaattcggagacccagcatggcgtat

SEQ ID NO: 452063 - DNA, 140 bp, Artificial Sequence
  Synthetic
atacgccatgctgggtctccaaagcctacatggatgtcataagccggagagaccaaagagggtccgggcaggtggtgacctatgccctgaacaccatcaccaacctgaaagtccaattgacgtacttgggagtcggccat

SEQ ID NO: 452064 - DNA, 140 bp, Artificial Sequence
  Synthetic
atggccgactcccaagtacgtcaattggactttcaggttggtgatggtgttcagggcataggtcaccacctgcccggaccctctttggtctctccggcttatgacatccatgtaggctttggagacccagcatggcgtat

SEQ ID NO: 452065 - DNA, 140 bp, Artificial Sequence
  Synthetic
atacgccatgctgggtctcctcaggatggcagaagcagagatggtgatacatcatcatcatgttcaagattgtgatgactcgaccttggttagactggaggcatggctcattgagcatggcgtacttgggagtcggccat

SEQ ID NO: 452066 - DNA, 140 bp, Artificial Sequence
  Synthetic
atggccgactcccaagtacgccatgctcaatgagccatgcctccagtctaaccaaggtcgagtcatcacaatcttgaacatgatgatgatgtatcaccatctctgcttctgccatcctgaggagacccagcatggcgtat

SEQ ID NO: 452067 - DNA, 140 bp, Artificial Sequence
  Synthetic
atacgccatgctgggtctccatgtgacagactgaataggatggcggtgaatggagacgactgcgtggtccggcctattgatgacaggttcggcatggccttgtcccacctcaacgccatgcgtacttgggagtcggccat

SEQ ID NO: 452068 - DNA, 140 bp, Artificial Sequence
  Synthetic
atggccgactcccaagtacgcatggcgttgaggtgggacaaggccatgccgaacctgtcatcaataggccggaccacgcagtcgtctccattcaccgccatcctattcagtctgtcacatggagacccagcatggcgtat

SEQ ID NO: 452069 - DNA, 140 bp, Artificial Sequence
  Synthetic
atacgccatgctgggtctcctccaaggttagaaaggacatatctgaatggcagccatcaaaagggtggaatgactgggagaatgtgcccttttgttcccaccacttccacgaactgcagccgtacttgggagtcggccat

SEQ ID NO: 452070 - DNA, 140 bp, Artificial Sequence
  Synthetic
atggccgactcccaagtacggctgcagttcgtggaagtggtgggaacaaaagggcacattctcccagtcattccacccttttgatggctgccattcagatatgtcctttctaaccttggaggagacccagcatggcgtat

SEQ ID NO: 452071 - DNA, 140 bp, Artificial Sequence
  Synthetic
atacgccatgctgggtctcctgaaggacggcaggaggattgtggtgccctgccgggaacaagatgagctcattgggagaggaagggtgtctccaggaaatggctggatgatcaaggaaaccgtacttgggagtcggccat

SEQ ID NO: 452072 - DNA, 140 bp, Artificial Sequence
  Synthetic
atggccgactcccaagtacggtttccttgatcatccagccatttcctggagacacccttcctctcccaatgagctcatcttgttcccggcagggcaccacaatcctcctgccgtccttcaggagacccagcatggcgtat

SEQ ID NO: 452073 - DNA, 140 bp, Artificial Sequence
  Synthetic
atacgccatgctgggtctccggcatgccttagcaaagcctatgccaacatgtggtcactgatgtactttcacaagagggacatgagattgttgtcattggctgtttcctcggccgttccccgtacttgggagtcggccat

SEQ ID NO: 452074 - DNA, 140 bp, Artificial Sequence
  Synthetic
atggccgactcccaagtacggggaacggccgaggaaacagccaatgacaacaatctcatgtccctcttgtgaaagtacatcagtgaccacatgttggcataggctttgctaaggcatgccggagacccagcatggcgtat

SEQ ID NO: 452075 - DNA, 140 bp, Artificial Sequence
  Synthetic
atacgccatgctgggtctccacctcatgggtcccacaaggacgcacgacatggtcgattcatgggaaaggggagtggatgaccacggaagacatgcttgaggtgtggaacagggtgtggacgtacttgggagtcggccat

SEQ ID NO: 452076 - DNA, 140 bp, Artificial Sequence
  Synthetic
atggccgactcccaagtacgtccacaccctgttccacacctcaagcatgtcttccgtggtcatccactcccctttcccatgaatcgaccatgtcgtgcgtccttgtgggacccatgaggtggagacccagcatggcgtat

SEQ ID NO: 452077 - DNA, 140 bp, Artificial Sequence
  Synthetic
aggccctggctgctgatatgggagtggatgaccacggaagacatgcttgaggtgtggaacagggtgtggataaccaataacccgcacatgcaggacaaaacagtggtgaaagaatggagggaccttttgggacagcggtg

SEQ ID NO: 452078 - DNA, 140 bp, Artificial Sequence
  Synthetic
caccgctgtcccaaaaggtccctccattctttcaccactgttttgtcctgcatgtgcgggttattggttatccacaccctgttccacacctcaagcatgtcttccgtggtcatccactcccatatcagcagccagggcct

SEQ ID NO: 452079 - DNA, 140 bp, Artificial Sequence
  Synthetic
atacgccatgctgggtctccatcgcatccgaacactgattggacaggagaaatatactgactatctgacagtcatggacagatactctgtggatgctgacctgcaaccaggtgagcttatcgtacttgggagtcggccat

SEQ ID NO: 452080 - DNA, 140 bp, Artificial Sequence
  Synthetic
atggccgactcccaagtacgataagctcacctggttgcaggtcagcatccacagagtatctgtccatgactgtcagatagtcagtatatttctcctgtccaatcagtgttcggatgcgatggagacccagcatggcgtat

SEQ ID NO: 452081 - DNA, 140 bp, Artificial Sequence
  Synthetic
aggccctggctgctgatatggtcatggacagatactctgtggatgctgacctgcaaccaggtgagcttatttgaaacatcatttagtaggaacaaccgggatacaaaccacgggtggagagaccttttgggacagcggtg

SEQ ID NO: 452082 - DNA, 140 bp, Artificial Sequence
  Synthetic
caccgctgtcccaaaaggtctctccacccgtggtttgtatcccggttgttcctactaaatgatgtttcaaataagctcacctggttgcaggtcagcatccacagagtatctgtccatgaccatatcagcagccagggcct

SEQ ID NO: 452083 - DNA, 140 bp, Artificial Sequence
  Synthetic
aggccctggctgctgatatgcggactccgcactcaaaatgaaacagaaaccgggataaaaactacggatggagaaccggactccacacattgaatagaagatgttgtcagcccagagcccgaccttttgggacagcggtg

SEQ ID NO: 452084 - DNA, 140 bp, Artificial Sequence
  Synthetic
caccgctgtcccaaaaggtcgggctctgggctgacaacatcttctattcaatgtgtggagtccggttctccatccgtagtttttatcccggtttctgtttcattttgagtgcggagtccgcatatcagcagccagggcct

SEQ ID NO: 452085 - DNA, 140 bp, Artificial Sequence
  Synthetic
atacgccatgctgggtctcccacatgggctctgccactgctaagctgtgaggcagtgcaggctgggacagccgacctccaggttgcgaaaaatctggtttctgggacctcccaccccagacgtacttgggagtcggccat

SEQ ID NO: 452086 - DNA, 140 bp, Artificial Sequence
  Synthetic
atggccgactcccaagtacgtctggggtgggaggtcccagaaaccagatttttcgcaacctggaggtcggctgtcccagcctgcactgcctcacagcttagcagtggcagagcccatgtgggagacccagcatggcgtat

SEQ ID NO: 452087 - DNA, 140 bp, Artificial Sequence
  Synthetic
atacgccatgctgggtctccgtaaaaaagaaaggagcctccgctaccacctccccacgtggtggtagaaaggtggggtctagaggttagaggagaccctccagggaacaattagtgggaccgtacttgggagtcggccat

SEQ ID NO: 452088 - DNA, 140 bp, Artificial Sequence
  Synthetic
atggccgactcccaagtacggtcccactaattgttccctggagggtctcctctaacctctagaccccacctttctaccaccacgtggggaggtggtagcggaggctcctttcttttttacggagacccagcatggcgtat

SEQ ID NO: 452089 - DNA, 140 bp, Artificial Sequence
  Synthetic
atacgccatgctgggtctcccaaggatttatttttttctttttgttcaatgttctgactggaaggaagattactgctcatttgaagaagctgtggagaatgctggacccaagacagggatcgtacttgggagtcggccat

SEQ ID NO: 452090 - DNA, 140 bp, Artificial Sequence
  Synthetic
atggccgactcccaagtacgatccctgtcttgggtccagcattctccacagcttcttcaaatgagcagtaatcttccttccagtcagaacattgaacaaaaagaaaaaaataaatccttgggagacccagcatggcgtat

SEQ ID NO: 452091 - DNA, 140 bp, Artificial Sequence
  Synthetic
atacgccatgctgggtctccgatcttgggaatgctgctgatgactggtggagtgaccctggtgcgtaagagcagatggttgcttttgaatgtcacatctgaggaccttgggaaaaccttccgtacttgggagtcggccat

SEQ ID NO: 452092 - DNA, 140 bp, Artificial Sequence
  Synthetic
atggccgactcccaagtacggaaggttttcccaaggtcctcagatgtgacattcaaaagcaaccatctgctcttacgcaccagggtcactccaccagtcatcagcagcattcccaagatcggagacccagcatggcgtat

SEQ ID NO: 452093 - DNA, 140 bp, Artificial Sequence
  Synthetic
atacgccatgctgggtctcctctgttggcacaggcaattgcacaaccaacattctggaggccaagaattggtgtccggattccatggaatacaactgccccaaccttagtccaagagaggcgtacttgggagtcggccat

SEQ ID NO: 452094 - DNA, 140 bp, Artificial Sequence
  Synthetic
atggccgactcccaagtacgcctctcttggactaaggttggggcagttgtattccatggaatccggacaccaattcttggcctccagaatgttggttgtgcaattgcctgtgccaacagaggagacccagcatggcgtat

SEQ ID NO: 452095 - DNA, 140 bp, Artificial Sequence
  Synthetic
atacgccatgctgggtctcctggctagtgaggaaccccttctttgcggtgacagccttggctattgcttatttggtggggagcaacatgacgcaacgagttgtgattgctttgctagtttcgtacttgggagtcggccat

SEQ ID NO: 452096 - DNA, 140 bp, Artificial Sequence
  Synthetic
atggccgactcccaagtacgaaactagcaaagcaatcacaactcgttgcgtcatgttgctccccaccaaataagcaatagccaaggctgtcaccgcaaagaaggggttcctcactagccaggagacccagcatggcgtat

SEQ ID NO: 452097 - DNA, 140 bp, Artificial Sequence
  Synthetic
aggccctggctgctgatatgtttggtggggagcaacatgacgcaacgagttgtgattgctttgctagttttggctgttggcccagcttactcggctcactgcataggaataactgacagggaccttttgggacagcggtg

SEQ ID NO: 452098 - DNA, 140 bp, Artificial Sequence
  Synthetic
caccgctgtcccaaaaggtccctgtcagttattcctatgcagtgagccgagtaagctgggccaacagccaaaactagcaaagcaatcacaactcgttgcgtcatgttgctccccaccaaacatatcagcagccagggcct

SEQ ID NO: 452099 - DNA, 140 bp, Artificial Sequence
  Synthetic
atacgccatgctgggtctcctgttacagtgcagtcttgacccatgtgaagatcaatgataagtgccccagcaccggtgaagcccatttggccgaagaaaacgagggagatcacgcctgtacgtacttgggagtcggccat

SEQ ID NO: 452100 - DNA, 140 bp, Artificial Sequence
  Synthetic
atggccgactcccaagtacgtacaggcgtgatctccctcgttttcttcggccaaatgggcttcaccggtgctggggcacttatcattgatcttcacatgggtcaagactgcactgtaacaggagacccagcatggcgtat

SEQ ID NO: 452101 - DNA, 140 bp, Artificial Sequence
  Synthetic
atacgccatgctgggtctccaacgaacttactctgacagaggctgggggaacggctgtggcctgtttggaaaaggaagtattgtggcatgtgccaaattcacctgtgccaagtctatgagcgtacttgggagtcggccat

SEQ ID NO: 452102 - DNA, 140 bp, Artificial Sequence
  Synthetic
atggccgactcccaagtacgctcatagacttggcacaggtgaatttggcacatgccacaatacttccttttccaaacaggccacagccgttcccccagcctctgtcagagtaagttcgttggagacccagcatggcgtat

SEQ ID NO: 452103 - DNA, 140 bp, Artificial Sequence
  Synthetic
atacgccatgctgggtctcccctgtttgaggttgaccagaccaaaatccagtatgtcattagggcacagctgcatgttggagccaagcaggagaactggaatgctgatattaagactctccgtacttgggagtcggccat

SEQ ID NO: 452104 - DNA, 140 bp, Artificial Sequence
  Synthetic
atggccgactcccaagtacggagagtcttaatatcagcattccagttctcctgcttggctccaacatgcagctgtgccctaatgacatactggattttggtctggtcaacctcaaacaggggagacccagcatggcgtat

SEQ ID NO: 452105 - DNA, 140 bp, Artificial Sequence
  Synthetic
atacgccatgctgggtctccaaatttgatgccctgtcaggttctcaggaggctgagttcactggatatgggaaggccacactggagtgtcaagtacagacagcagtggactttagcaacacgtacttgggagtcggccat

SEQ ID NO: 452106 - DNA, 140 bp, Artificial Sequence
  Synthetic
atggccgactcccaagtacgtgttgctaaagtccactgctgtctgtacttgacactccagtgtggccttcccatatccagtgaactcagcctcctgagaacctgacagggcatcaaatttggagacccagcatggcgtat

SEQ ID NO: 452107 - DNA, 140 bp, Artificial Sequence
  Synthetic
atacgccatgctgggtctccgctacattgcagagatggagaaagagagctggattgtggatagacagtgggctcaggatttgaccctaccttggcagagtggaagtggcggtgtgtggagcgtacttgggagtcggccat

SEQ ID NO: 452108 - DNA, 140 bp, Artificial Sequence
  Synthetic
atggccgactcccaagtacgctccacacaccgccacttccactctgccaaggtagggtcaaatcctgagcccactgtctatccacaatccagctctctttctccatctctgcaatgtagcggagacccagcatggcgtat

SEQ ID NO: 452109 - DNA, 140 bp, Artificial Sequence
  Synthetic
atacgccatgctgggtctccagagatgcaccatcttgtggaattcgagcctccacatgctgcaactatcaaagtgttggccctgggaaaccaagaaggctctctgaagacagctctcactcgtacttgggagtcggccat

SEQ ID NO: 452110 - DNA, 140 bp, Artificial Sequence
  Synthetic
atggccgactcccaagtacgagtgagagctgtcttcagagagccttcttggtttcccagggccaacactttgatagttgcagcatgtggaggctcgaattccacaagatggtgcatctctggagacccagcatggcgtat

SEQ ID NO: 452111 - DNA, 140 bp, Artificial Sequence
  Synthetic
aggccctggctgctgatatgaagtgttggccctgggaaaccaagaaggctctctgaagacagctctcactggcgcaatgcgggtcacaaaggacacaaatggcagcaacctgtacaagctgaccttttgggacagcggtg

SEQ ID NO: 452112 - DNA, 140 bp, Artificial Sequence
  Synthetic
caccgctgtcccaaaaggtcagcttgtacaggttgctgccatttgtgtcctttgtgacccgcattgcgccagtgagagctgtcttcagagagccttcttggtttcccagggccaacacttcatatcagcagccagggcct

SEQ ID NO: 452113 - DNA, 140 bp, Artificial Sequence
  Synthetic
atacgccatgctgggtctccccaacagacactggacatggcactgccgtgatgcaggtgaaagtgccaaagggagccccctgtaggatcccagtgatggtagctgatgacctcacggcgtcgtacttgggagtcggccat

SEQ ID NO: 452114 - DNA, 140 bp, Artificial Sequence
  Synthetic
atggccgactcccaagtacgacgccgtgaggtcatcagctaccatcactgggatcctacagggggctccctttggcactttcacctgcatcacggcagtgccatgtccagtgtctgttggggagacccagcatggcgtat

SEQ ID NO: 452115 - DNA, 140 bp, Artificial Sequence
  Synthetic
atacgccatgctgggtctcccagtcaacaaaggcattttagtcacagtcaatccaatagcctccactaatgaggatgaggtgttgattgaggtgaacccccccttcggggacagctatatcgtacttgggagtcggccat

SEQ ID NO: 452116 - DNA, 140 bp, Artificial Sequence
  Synthetic
atggccgactcccaagtacgatatagctgtccccgaagggggggttcacctcaatcaacacctcatcctcattagtggaggctattggattgactgtgactaaaatgcctttgttgactgggagacccagcatggcgtat

SEQ ID NO: 452117 - DNA, 140 bp, Artificial Sequence
  Synthetic
atacgccatgctgggtctcccatagttgggacgggggactctcgtctgacctaccagtggcacaaggagggcagctcaatagggaagttgttcactcagaccatgaagggcgcggagcgccgtacttgggagtcggccat

SEQ ID NO: 452118 - DNA, 140 bp, Artificial Sequence
  Synthetic
atggccgactcccaagtacggcgctccgcgcccttcatggtctgagtgaacaacttccctattgagctgccctccttgtgccactggtaggtcagacgagagtcccccgtcccaactatgggagacccagcatggcgtat

SEQ ID NO: 452119 - DNA, 140 bp, Artificial Sequence
  Synthetic
atacgccatgctgggtctccctggccgttatgggggatgctgcatgggacttcagctctgctggaggatttttcacatcagttggaaaaggaatacacatggtgtttggttctgcctttccgtacttgggagtcggccat

SEQ ID NO: 452120 - DNA, 140 bp, Artificial Sequence
  Synthetic
atggccgactcccaagtacggaaaggcagaaccaaacaccatgtgtattccttttccaactgatgtgaaaaatcctccagcagagctgaagtcccatgcagcatcccccataacggccagggagacccagcatggcgtat

SEQ ID NO: 452121 - DNA, 140 bp, Artificial Sequence
  Synthetic
atacgccatgctgggtctccagggattgtttggtggcttgagttggataacaaaggtcatcatgggggcagtcctcatatgggttggcatcaacatgaggaacatgacaatgtctatgagcgtacttgggagtcggccat

SEQ ID NO: 452122 - DNA, 140 bp, Artificial Sequence
  Synthetic
atggccgactcccaagtacgctcatagacattgtcatgttcctcatgttgatgccaacccatatgaggactgcccccatgatgacctttgttatccaactcaagccaccaaacaatccctggagacccagcatggcgtat

SEQ ID NO: 452123 - DNA, 140 bp, Artificial Sequence
  Synthetic
atacgccatgctgggtctcctatgatcctggttggagtcatcatgatgtttctgtccctaggagtgggggcggaccaaggatgtgcaatcaactttggcaggagagaactcaaatgtgggcgtacttgggagtcggccat

SEQ ID NO: 452124 - DNA, 140 bp, Artificial Sequence
  Synthetic
atggccgactcccaagtacgcccacatttgagttctctcctgccaaagttgattgcacatccttggtccgcccccactcctagggacagaaacatcatgatgactccaaccaggatcataggagacccagcatggcgtat

SEQ ID NO: 452125 - DNA, 140 bp, Artificial Sequence
  Synthetic
  misc_feature (23)..(23): n is a, c, g, or t
atacgccatgctgggtctccganggagtcttcatcttcagggattcggatgattggttgaacaagtattcatactatccagaagacccagtgaaacttgcttcaatagtgaaggcctcctcgtacttgggagtcggccat

SEQ ID NO: 452126 - DNA, 140 bp, Artificial Sequence
  Synthetic
  misc_feature (118)..(118): n is a, c, g, or t
atggccgactcccaagtacgaggaggccttcactattgaagcaagtttcactgggtcttctggatagtatgaatacttgttcaaccaatcatccgaatccctgaagatgaagactccntcggagacccagcatggcgtat

SEQ ID NO: 452127 - DNA, 140 bp, Artificial Sequence
  Synthetic
atacgccatgctgggtctcctcgaggaagggaagtgtggtttaaactcagtcgattccctggaacatgaaatgtggaggagcagggcggatgagatcaatgccatccttgaggagaatgacgtacttgggagtcggccat

SEQ ID NO: 452128 - DNA, 140 bp, Artificial Sequence
  Synthetic
atggccgactcccaagtacgtcattctcctcaaggatggcattgatctcatccgccctgctcctccacatttcatgttccagggaatcgactgagtttaaaccacacttcccttcctcgaggagacccagcatggcgtat

SEQ ID NO: 452129 - DNA, 140 bp, Artificial Sequence
  Synthetic
atacgccatgctgggtctccggtagacatctcagtggtggtccaagaccccaaaaacatctatcagagagggacacatcctttttctagaattcgtgatggcttgcaatatggctggaagcgtacttgggagtcggccat

SEQ ID NO: 452130 - DNA, 140 bp, Artificial Sequence
  Synthetic
atggccgactcccaagtacgcttccagccatattgcaagccatcacgaattctagaaaaaggatgtgtccctctctgatagatgtttttggggtcttggaccaccactgagatgtctaccggagacccagcatggcgtat

SEQ ID NO: 452131 - DNA, 140 bp, Artificial Sequence
  Synthetic
atacgccatgctgggtctccggaattccttccagatagaagagtttgggacgggagtgttcaccactcgagtgtacatggatgcagtctttgaatacaccatggattgcgatggatctatcgtacttgggagtcggccat

SEQ ID NO: 452132 - DNA, 140 bp, Artificial Sequence
  Synthetic
atggccgactcccaagtacgatagatccatcgcaatccatggtgtattcaaagactgcatccatgtacactcgagtggtgaacactcccgtcccaaactcttctatctggaaggaattccggagacccagcatggcgtat

SEQ ID NO: 452133 - DNA, 140 bp, Artificial Sequence
  Synthetic
aggccctggctgctgatatggtgtacatggatgcagtctttgaatacaccatggattgcgatggatctatcttgggggcagcagtgaatggaaagaagagcgcacatgggtccccaacatgaccttttgggacagcggtg

SEQ ID NO: 452134 - DNA, 140 bp, Artificial Sequence
  Synthetic
caccgctgtcccaaaaggtcatgttggggacccatgtgcgctcttctttccattcactgctgcccccaagatagatccatcgcaatccatggtgtattcaaagactgcatccatgtacaccatatcagcagccagggcct

SEQ ID NO: 452135 - DNA, 140 bp, Artificial Sequence
  Synthetic
atacgccatgctgggtctcccagtgtggttgttgacggtggctgtgacggacgtgggaaatcaaccaggtccaccaccgacagtgggaagatcattcctgagtggtgttgccgatcatgccgtacttgggagtcggccat

SEQ ID NO: 452136 - DNA, 140 bp, Artificial Sequence
  Synthetic
atggccgactcccaagtacggcatgatcggcaacaccactcaggaatgatcttcccactgtcggtggtggacctggttgatttcccacgtccgtcacagccaccgtcaacaaccacactgggagacccagcatggcgtat

SEQ ID NO: 452137 - DNA, 140 bp, Artificial Sequence
  Synthetic
atacgccatgctgggtctccacgatgccgccagtgagctttcacgggagtgatggttgctggtatcccatggaaatcagaccaaggaagacacatgacaaccacctggttcgctcatgggcgtacttgggagtcggccat

SEQ ID NO: 452138 - DNA, 140 bp, Artificial Sequence
  Synthetic
atggccgactcccaagtacgcccatgagcgaaccaggtggttgtcatgtgtcttccttggtctgatttccatgggataccagcaaccatcactcccgtgaaagctcactggcggcatcgtggagacccagcatggcgtat

SEQ ID NO: 452139 - DNA, 140 bp, Artificial Sequence
  Synthetic
atacgccatgctgggtctcctgacagctggggaggtccatgcagtcccttttgggctggtgagcatgatgatagcaatggaagtgttcttgaagaggagacagggacccaagcaaatattcgtacttgggagtcggccat

SEQ ID NO: 452140 - DNA, 140 bp, Artificial Sequence
  Synthetic
atggccgactcccaagtacgaatatttgcttgggtccctgtctcctcttcaagaacacttccattgctatcatcatgctcaccagcccaaaagggactgcatggacctccccagctgtcaggagacccagcatggcgtat

SEQ ID NO: 452141 - DNA, 140 bp, Artificial Sequence
  Synthetic
atacgccatgctgggtctccagttggaggcatagtgctcctaggagccatgttagttggacaggtgaccctgttggacctgctgaagcttgtagtggcggttggactgcactttcatgagcgtacttgggagtcggccat

SEQ ID NO: 452142 - DNA, 140 bp, Artificial Sequence
  Synthetic
atggccgactcccaagtacgctcatgaaagtgcagtccaaccgccactacaagcttcagcaggtccaacagggtcacctgtccaactaacatggctcctaggagcactatgcctccaactggagacccagcatggcgtat

SEQ ID NO: 452143 - DNA, 140 bp, Artificial Sequence
  Synthetic
atacgccatgctgggtctccatgaacaatggaggggatgccatgtacatggccttgatcgctgctttctcgatcaggccgggactgctcatcggcttcgggttgaggacactgtggagcccgtacttgggagtcggccat

SEQ ID NO: 452144 - DNA, 140 bp, Artificial Sequence
  Synthetic
atggccgactcccaagtacgggctccacagtgtcctcaacccgaagccgatgagcagtcccggcctgatcgagaaagcagcgatcaaggccatgtacatggcatcccctccattgttcatggagacccagcatggcgtat

SEQ ID NO: 452145 - DNA, 140 bp, Artificial Sequence
  Synthetic
atacgccatgctgggtctccctcgggaacgccttgtactagcctttggagctgccatggtggagatagccctgggcggcatgatgggagggctgtggaagtacttgaatgcagtgtccctcgtacttgggagtcggccat

SEQ ID NO: 452146 - DNA, 140 bp, Artificial Sequence
  Synthetic
atggccgactcccaagtacgagggacactgcattcaagtacttccacagccctcccatcatgccgcccagggctatctccaccatggcagctccaaaggctagtacaaggcgttcccgagggagacccagcatggcgtat

SEQ ID NO: 452147 - DNA, 140 bp, Artificial Sequence
  Synthetic
atacgccatgctgggtctccttgcatcttgacaataaatgctgttgcctccagaaaagcgtcaagcgccatcctgcccttgatggcgttgttgacacctgtgacaatggctgaggtgagacgtacttgggagtcggccat

SEQ ID NO: 452148 - DNA, 140 bp, Artificial Sequence
  Synthetic
atggccgactcccaagtacgtctcacctcagccattgtcacaggtgtcaacaacgccatcaagggcaggatggcgcttgacgcttttctggaggcaacagcatttattgtcaagatgcaaggagacccagcatggcgtat

SEQ ID NO: 452149 - DNA, 140 bp, Artificial Sequence
  Synthetic
atacgccatgctgggtctcccttgcaacgatgctcttttgcaccgtggtcatcataggggtcctccaccagaactcaaaggacacttccatgcaaaagaccatgcccctggtggccctcacgtacttgggagtcggccat

SEQ ID NO: 452150 - DNA, 140 bp, Artificial Sequence
  Synthetic
atggccgactcccaagtacgtgagggccaccaggggcatggtcttttgcatggaagtgtcctttgagttctggtggaggacccctatgatgaccacggtgcaaaagagcatcgttgcaagggagacccagcatggcgtat

SEQ ID NO: 452151 - DNA, 140 bp, Artificial Sequence
  Synthetic
atacgccatgctgggtctcccactgacttcttacctgggattgacacagccttttttgggcttgtgtgccttcatggcgacccgaatattcggacgaaggagcatcccagtgaatgaggccgtacttgggagtcggccat

SEQ ID NO: 452152 - DNA, 140 bp, Artificial Sequence
  Synthetic
atggccgactcccaagtacggcctcattcactgggatgctccttcgtccgaatattcgggtcgccatgaaggcacacaagcccaaaaaaggctgtgtcaatcccaggtaagaagtcagtgggagacccagcatggcgtat

SEQ ID NO: 452153 - DNA, 140 bp, Artificial Sequence
  Synthetic
atacgccatgctgggtctccacttgcagcggctggtctcgtgggagtgttggcgggactggctttccaggagatggagaactttctgggcccagttgcagttggaggaattctgatgatgcgtacttgggagtcggccat

SEQ ID NO: 452154 - DNA, 140 bp, Artificial Sequence
  Synthetic
atggccgactcccaagtacgcatcatcagaattcctccaactgcaactgggcccagaaagttctccatctcctggaaagccagtcccgccaacactcccacgagaccagccgctgcaagtggagacccagcatggcgtat

SEQ ID NO: 452155 - DNA, 140 bp, Artificial Sequence
  Synthetic
atacgccatgctgggtctccctgatcagcgtggctgggagagtagatgggctcgaactcaggaagctaggagaagtttcttgggaagaggaagctgagatcagtggaagttctgcccgttcgtacttgggagtcggccat

SEQ ID NO: 452156 - DNA, 140 bp, Artificial Sequence
  Synthetic
atggccgactcccaagtacgaacgggcagaacttccactgatctcagcttcctcttcccaagaaacttctcctagcttcctgagttcgagcccatctactctcccagccacgctgatcagggagacccagcatggcgtat

SEQ ID NO: 452157 - DNA, 140 bp, Artificial Sequence
  Synthetic
atacgccatgctgggtctccatgatgtggccctcagtgaacagggggaattcaaactactctctgaagagaagatcccatgggatcagattgtcatgacctcactggctttggtcggagccgtacttgggagtcggccat

SEQ ID NO: 452158 - DNA, 140 bp, Artificial Sequence
  Synthetic
atggccgactcccaagtacggctccgaccaaagccagtgaggtcatgacaatctgatcccatgggatcttctcttcagagagtagtttgaattccccctgttcactgagggccacatcatggagacccagcatggcgtat

SEQ ID NO: 452159 - DNA, 140 bp, Artificial Sequence
  Synthetic
atacgccatgctgggtctcctgctatccatccatttgcactcatgctagttcttgctggttggttgctccatgtcaagggagctaggagaagtggagacgtcctctgggatatccccgcacgtacttgggagtcggccat

SEQ ID NO: 452160 - DNA, 140 bp, Artificial Sequence
  Synthetic
atggccgactcccaagtacgtgcggggatatcccagaggacgtctccacttctcctagctcccttgacatggagcaaccaaccagcaagaactagcatgagtgcaaatggatggatagcaggagacccagcatggcgtat

SEQ ID NO: 452161 - DNA, 140 bp, Artificial Sequence
  Synthetic
atacgccatgctgggtctcccccacaattgttgaggagtgtgaacacttagaggatgggatttatggcattttccagtcgacttttctaggggcctctcagcggggagtgggagtggcaccgtacttgggagtcggccat

SEQ ID NO: 452162 - DNA, 140 bp, Artificial Sequence
  Synthetic
atggccgactcccaagtacggtgccactcccactccccgctgagaggcccctagaaaagtcgactggaaaatgccataaatcccatcctctaagtgttcacactcctcaacaattgtgggggagacccagcatggcgtat

SEQ ID NO: 452163 - DNA, 140 bp, Artificial Sequence
  Synthetic
atacgccatgctgggtctccagggaggggtcttccacacaatgtggcatgtgacaagaggtgcctttctcgttagaaatggcaagaagctagtcccaacctgggcttcagtcaaggaagacgtacttgggagtcggccat

SEQ ID NO: 452164 - DNA, 140 bp, Artificial Sequence
  Synthetic
atggccgactcccaagtacgtcttccttgactgaagcccaggttgggactagcttcttgccatttctaacgagaaaggcacctcttgtcacatgccacattgtgtggaagacccctccctggagacccagcatggcgtat

SEQ ID NO: 452165 - DNA, 140 bp, Artificial Sequence
  Synthetic
atacgccatgctgggtctccccttgtcgcctacggtggttcatggaagctggagggcaggtgggatggagaagaggaggttcagttgatcgctgccgcccccggaaagaacgtggtcaatcgtacttgggagtcggccat

SEQ ID NO: 452166 - DNA, 140 bp, Artificial Sequence
  Synthetic
atggccgactcccaagtacgattgaccacgttctttccgggggcggcagcgatcaactgaacctcctcttctccatcccacctgccctccagcttccatgaaccaccgtaggcgacaaggggagacccagcatggcgtat

SEQ ID NO: 452167 - DNA, 140 bp, Artificial Sequence
  Synthetic
atacgccatgctgggtctccgttcagacaaagccaagcctattcaaggttaggaatggcggagaaatcggggcggtggctcttgactacccgagcggtacctctggctctcccattgtcacgtacttgggagtcggccat

SEQ ID NO: 452168 - DNA, 140 bp, Artificial Sequence
  Synthetic
atggccgactcccaagtacgtgacaatgggagagccagaggtaccgctcgggtagtcaagagccaccgccccgatttctccgccattcctaaccttgaataggcttggctttgtctgaacggagacccagcatggcgtat

SEQ ID NO: 452169 - DNA, 140 bp, Artificial Sequence
  Synthetic
atacgccatgctgggtctccgagggaagagcttcaggaaatcccgacaatgctaaagaagggaatgacaacaattcttgacttccatcctggggccggaaaaactaggcgctatctgccccgtacttgggagtcggccat

SEQ ID NO: 452170 - DNA, 140 bp, Artificial Sequence
  Synthetic
atggccgactcccaagtacggggcagatagcgcctagtttttccggccccaggatggaagtcaagaattgttgtcattcccttctttagcattgtcgggatttcctgaagctcttccctcggagacccagcatggcgtat

SEQ ID NO: 452171 - DNA, 140 bp, Artificial Sequence
  Synthetic
atacgccatgctgggtctcccagattctggctgaatgtgcacggagacggctgcgcacgcttgttctggctcccactagggttgttctttccgagatgaaggaggcctttcatggcctagcgtacttgggagtcggccat

SEQ ID NO: 452172 - DNA, 140 bp, Artificial Sequence
  Synthetic
atggccgactcccaagtacgctaggccatgaaaggcctccttcatctcggaaagaacaaccctagtgggagccagaacaagcgtgcgcagccgtctccgtgcacattcagccagaatctgggagacccagcatggcgtat

SEQ ID NO: 452173 - DNA, 140 bp, Artificial Sequence
  Synthetic
atacgccatgctgggtctccatgtaaaatttcacacacaggccttctccgcgcatggcagcggaaaggaagtcattgatgccatgtgtcacgccaccctgacatacaggatgctggagcccgtacttgggagtcggccat

SEQ ID NO: 452174 - DNA, 140 bp, Artificial Sequence
  Synthetic
atggccgactcccaagtacgggctccagcatcctgtatgtcagggtggcgtgacacatggcatcaatgacttcctttccgctgccatgcgcggagaaggcctgtgtgtgaaattttacatggagacccagcatggcgtat

SEQ ID NO: 452175 - DNA, 140 bp, Artificial Sequence
  Synthetic
atacgccatgctgggtctccaactagagtggtgaattgggaggtgattatcatggatgaggctcattttttagatccggccagtatagcagccagaggctgggcagcgcacagagctagacgtacttgggagtcggccat

SEQ ID NO: 452176 - DNA, 140 bp, Artificial Sequence
  Synthetic
atggccgactcccaagtacgtctagctctgtgcgctgcccagcctctggctgctatactggccggatctaaaaaatgagcctcatccatgataatcacctcccaattcaccactctagttggagacccagcatggcgtat

SEQ ID NO: 452177 - DNA, 140 bp, Artificial Sequence
  Synthetic
atacgccatgctgggtctccgcaaatgaaagtgcaacaatcttgatgactgccacacccccaggaactggtgatgaatttccacattcgaatggggaaatagaggatgttcagacagatacgtacttgggagtcggccat

SEQ ID NO: 452178 - DNA, 140 bp, Artificial Sequence
  Synthetic
atggccgactcccaagtacgtatctgtctgaacatcctctatttccccattcgaatgtggaaattcatcaccagttcctgggggtgtggcagtcatcaagattgttgcactttcatttgcggagacccagcatggcgtat

SEQ ID NO: 452179 - DNA, 140 bp, Artificial Sequence
  Synthetic
atacgccatgctgggtctccttcctagtgagccctggaacacgggtcatgactggatcttggctgacaaaaggcccacggcctggtttcttccatccatcagggctgcgaatgtcatggccgtacttgggagtcggccat

SEQ ID NO: 452180 - DNA, 140 bp, Artificial Sequence
  Synthetic
atggccgactcccaagtacggccatgacattcgcagccctgatggatggaagaaaccaggccgtgggccttttgtcagccaagatccagtcatgacccgtgttccagggctcactaggaaggagacccagcatggcgtat

SEQ ID NO: 452181 - DNA, 140 bp, Artificial Sequence
  Synthetic
atacgccatgctgggtctccagcctctctacgcaaagctgggaagagtgtggtggtgttaaacaggaagacctttgaaaaagagtaccccacaattaaacagaagaaacctgacttcatccgtacttgggagtcggccat

SEQ ID NO: 452182 - DNA, 140 bp, Artificial Sequence
  Synthetic
atggccgactcccaagtacggatgaagtcaggtttcttctgtttaattgtggggtactctttttcaaaggtcttcctgtttaacaccaccacactcttcccagctttgcgtagagaggctggagacccagcatggcgtat

SEQ ID NO: 452183 - DNA, 140 bp, Artificial Sequence
  Synthetic
aggccctggctgctgatatgcctttgaaaaagagtaccccacaattaaacagaagaaacctgacttcatcttggccactgacatagctgaaatgggagccaatctctgtgtggagagagtgaccttttgggacagcggtg

SEQ ID NO: 452184 - DNA, 140 bp, Artificial Sequence
  Synthetic
caccgctgtcccaaaaggtcactctctccacacagagattggctcccatttcagctatgtcagtggccaagatgaagtcaggtttcttctgtttaattgtggggtactctttttcaaaggcatatcagcagccagggcct

SEQ ID NO: 452185 - DNA, 140 bp, Artificial Sequence
  Synthetic
atacgccatgctgggtctccccactctatggcatagaggggacaaagacaccagtctccacaggcgaaatgaggttaagagatgaccaaagaagagtcttccgagagctagtgaggaactcgtacttgggagtcggccat

SEQ ID NO: 452186 - DNA, 140 bp, Artificial Sequence
  Synthetic
atggccgactcccaagtacgagttcctcactagctctcggaagactcttctttggtcatctcttaacctcatttcgcctgtggagactggtgtctttgtcccctctatgccatagagtggggagacccagcatggcgtat

SEQ ID NO: 452187 - DNA, 140 bp, Artificial Sequence
  Synthetic
atacgccatgctgggtctccgtgacctgcctgtttggctctcatggcaggtggccaaggctggactgaagacgaatgaccgaaagtggtgctttgaaggtccagaggaacacgagatcttcgtacttgggagtcggccat

SEQ ID NO: 452188 - DNA, 140 bp, Artificial Sequence
  Synthetic
atggccgactcccaagtacgaagatctcgtgttcctctggaccttcaaagcaccactttcggtcattcgtcttcagtccagccttggccacctgccatgagagccaaacaggcaggtcacggagacccagcatggcgtat

SEQ ID NO: 452189 - DNA, 140 bp, Artificial Sequence
  Synthetic
atacgccatgctgggtctccgaatgacagtggtgagacagtgaagtgcagggcccctggaggagcgaagaggcctttgcggccaagatggtgcgatgagagggtttcatccgaccagagccgtacttgggagtcggccat

SEQ ID NO: 452190 - DNA, 140 bp, Artificial Sequence
  Synthetic
atggccgactcccaagtacggctctggtcggatgaaaccctctcatcgcaccatcttggccgcaaaggcctcttcgctcctccaggggccctgcacttcactgtctcaccactgtcattcggagacccagcatggcgtat

SEQ ID NO: 452191 - DNA, 140 bp, Artificial Sequence
  Synthetic
atacgccatgctgggtctccgctcttgccgaattcataaagtttgccgagggcaggagaggggcggcagaggtgctagttgtactgagtgagctcccagatttcctggccaagaagggtgcgtacttgggagtcggccat

SEQ ID NO: 452192 - DNA, 140 bp, Artificial Sequence
  Synthetic
atggccgactcccaagtacgcacccttcttggccaggaaatctgggagctcactcagtacaactagcacctctgccgcccctctcctgccctcggcaaactttatgaattcggcaagagcggagacccagcatggcgtat

SEQ ID NO: 452193 - DNA, 140 bp, Artificial Sequence
  Synthetic
atacgccatgctgggtctccgagaggcgatggacactatcagtgtgtttttgaactctgaggaaggttccagggcttaccgcaatgcattgtcaatgatgcctgaggcaatgacgatagtcgtacttgggagtcggccat

SEQ ID NO: 452194 - DNA, 140 bp, Artificial Sequence
  Synthetic
atggccgactcccaagtacgactatcgtcattgcctcaggcatcattgacaatgcattgcggtaagccctggaaccttcctcagagttcaaaaacacactgatagtgtccatcgcctctcggagacccagcatggcgtat

SEQ ID NO: 452195 - DNA, 140 bp, Artificial Sequence
  Synthetic
atacgccatgctgggtctccgctggtagcggatacctcatgtttcttgggggtgtcaaacccacccacatctcctacattatgctgatattctttgtcctaatggtggtggtggttccagcgtacttgggagtcggccat

SEQ ID NO: 452196 - DNA, 140 bp, Artificial Sequence
  Synthetic
atggccgactcccaagtacgctggaaccaccaccaccattaggacaaagaatatcagcataatgtaggagatgtgggtgggtttgacacccccaagaaacatgaggtatccgctaccagcggagacccagcatggcgtat

SEQ ID NO: 452197 - DNA, 140 bp, Artificial Sequence
  Synthetic
atacgccatgctgggtctccagccggggcagcagagaaccattcaggacaaccaggtggcttatcttatcattggcattttgacgttggtttccgtggtggcagccaatgaactgggtatcgtacttgggagtcggccat

SEQ ID NO: 452198 - DNA, 140 bp, Artificial Sequence
  Synthetic
atggccgactcccaagtacgatacccagttcattggctgccaccacggaaaccaacgtcaaaatgccaatgataagataagccacctggttgtcctgaatggttctctgctgccccggctggagacccagcatggcgtat

SEQ ID NO: 452199 - DNA, 140 bp, Artificial Sequence
  Synthetic
atacgccatgctgggtctccgttggaaaagaccaaggaagacctttttggaaaaaagaatttgattccatccagcaccgcaccctggaattggccagatcttgacttaaagccaggagctcgtacttgggagtcggccat

SEQ ID NO: 452200 - DNA, 140 bp, Artificial Sequence
  Synthetic
atggccgactcccaagtacgagctcctggctttaagtcaagatctggccaattccagggtgcggtgctggatggaatcaaattcttttttccaaaaaggtcttccttggtcttttccaacggagacccagcatggcgtat

SEQ ID NO: 452201 - DNA, 140 bp, Artificial Sequence
  Synthetic
atacgccatgctgggtctccgcttggactgtctatgttggcattgtgacgatgctctctccaatgctgcaccattggatcaaggttgagtatggcaacttgtccctgtctggaattgccccgtacttgggagtcggccat

SEQ ID NO: 452202 - DNA, 140 bp, Artificial Sequence
  Synthetic
atggccgactcccaagtacggggcaattccagacagggacaagttgccatactcaaccttgatccaatggtgcagcattggagagagcatcgtcacaatgccaacatagacagtccaagcggagacccagcatggcgtat

SEQ ID NO: 452203 - DNA, 140 bp, Artificial Sequence
  Synthetic
atacgccatgctgggtctccagtcggcctcagttttgtcattcatggacaagggtatcccgttcatgaagatgaacatctcggtcataatcctactaattagtggctggaattcaataaccgtacttgggagtcggccat

SEQ ID NO: 452204 - DNA, 140 bp, Artificial Sequence
  Synthetic
atggccgactcccaagtacggttattgaattccagccactaattagtaggattatgaccgagatgttcatcttcatgaacgggatacccttgtccatgaatgacaaaactgaggccgactggagacccagcatggcgtat

SEQ ID NO: 452205 - DNA, 140 bp, Artificial Sequence
  Synthetic
aggccctggctgctgatatgatgaacatctcggtcataatcctactaattagtggctggaattcaataacagtgatgcctttgctttgtggcattggatgcgccatgcttcattggacccgaccttttgggacagcggtg

SEQ ID NO: 452206 - DNA, 140 bp, Artificial Sequence
  Synthetic
caccgctgtcccaaaaggtcgggtccaatgaagcatggcgcatccaatgccacaaagcaaaggcatcactgttattgaattccagccactaattagtaggattatgaccgagatgttcatcatatcagcagccagggcct

SEQ ID NO: 452207 - DNA, 140 bp, Artificial Sequence
  Synthetic
  misc_feature (79)..(79): n is a, c, g, or t
atacgccatgctgggtctcccattgtacctcttgcttgcccttagtttggcctctgttgctatgtgcaggacccctttntcattagccgaaggcattgtactggcatcggcagctctgggcgtacttgggagtcggccat

SEQ ID NO: 452208 - DNA, 140 bp, Artificial Sequence
  Synthetic
  misc_feature (62)..(62): n is a, c, g, or t
atggccgactcccaagtacgcccagagctgccgatgccagtacaatgccttcggctaatganaaaggggtcctgcacatagcaacagaggccaaactaagggcaagcaagaggtacaatgggagacccagcatggcgtat

SEQ ID NO: 452209 - DNA, 140 bp, Artificial Sequence
  Synthetic
atacgccatgctgggtctccaccactcatagaggggaataccagcctcctgtggaatggacccatggctgtgtccatgacgggagtcatgcgggggaactattatgcctttgtgggtgtccgtacttgggagtcggccat

SEQ ID NO: 452210 - DNA, 140 bp, Artificial Sequence
  Synthetic
atggccgactcccaagtacggacacccacaaaggcataatagttcccccgcatgactcccgtcatggacacagccatgggtccattccacaggaggctggtattcccctctatgagtggtggagacccagcatggcgtat

SEQ ID NO: 452211 - DNA, 140 bp, Artificial Sequence
  Synthetic
atacgccatgctgggtctccatgtacaatctctggaagatgaatactgggcgcagggggagagcaaatgggaaaaccctgggtgaggtctggaaaagggagctgaacctgctggacaagccgtacttgggagtcggccat

SEQ ID NO: 452212 - DNA, 140 bp, Artificial Sequence
  Synthetic
atggccgactcccaagtacggcttgtccagcaggttcagctcccttttccagacctcacccagggttttcccatttgctctccccctgcgcccagtattcatcttccagagattgtacatggagacccagcatggcgtat

SEQ ID NO: 452213 - DNA, 140 bp, Artificial Sequence
  Synthetic
atacgccatgctgggtctccaacagtttgagctgtacaaaaggacagacatcgtggaggtggaccgtgaaacagcacgcagacacttggctgaagggaaggtggacactggggtggctgtcgtacttgggagtcggccat

SEQ ID NO: 452214 - DNA, 140 bp, Artificial Sequence
  Synthetic
atggccgactcccaagtacgacagccaccccagtgtccaccttcccttcagccaagtgtctgcgtgctgtttcacggtccacctccacgatgtctgtccttttgtacagctcaaactgttggagacccagcatggcgtat

SEQ ID NO: 452215 - DNA, 140 bp, Artificial Sequence
  Synthetic
atacgccatgctgggtctccctcgagagggactgctaaactaagatggtttcatgaacgtggctatgtcaggctggaaggcagggtgactgacctaggatgcgggcgtggtggctggtgccgtacttgggagtcggccat

SEQ ID NO: 452216 - DNA, 140 bp, Artificial Sequence
  Synthetic
atggccgactcccaagtacggcaccagccaccacgcccgcatcctaggtcagtcaccctgccttccagcctgacatagccacgttcatgaaaccatcttagtttagcagtccctctcgagggagacccagcatggcgtat

SEQ ID NO: 452217 - DNA, 140 bp, Artificial Sequence
  Synthetic
atacgccatgctgggtctccccagatgtgctagaaaagttagagttactccaaaggaggtttggtgggacggtcatcagaaaccccctttccagaaattctacccatgagatgtattatgcgtacttgggagtcggccat

SEQ ID NO: 452218 - DNA, 140 bp, Artificial Sequence
  Synthetic
atggccgactcccaagtacgcataatacatctcatgggtagaatttctggaaagggggtttctgatgaccgtcccaccaaacctcctttggagtaactctaacttttctagcacatctggggagacccagcatggcgtat

SEQ ID NO: 452219 - DNA, 140 bp, Artificial Sequence
  Synthetic
aggccctggctgctgatatgggtcatcagaaaccccctttccagaaattctacccatgagatgtattatgtatctggagcccgcagtaacatcacattcactgtgaaccagacgtcccgcgaccttttgggacagcggtg

SEQ ID NO: 452220 - DNA, 140 bp, Artificial Sequence
  Synthetic
caccgctgtcccaaaaggtcgcgggacgtctggttcacagtgaatgtgatgttactgcgggctccagatacataatacatctcatgggtagaatttctggaaagggggtttctgatgacccatatcagcagccagggcct

SEQ ID NO: 452221 - DNA, 140 bp, Artificial Sequence
  Synthetic
atacgccatgctgggtctcctacgcagccacctggttccatgacaatgacaatccctacaggacctggcattattgcggctcctatgtcacaagaacctcagggagcgcagcaagtatgacgtacttgggagtcggccat

SEQ ID NO: 452222 - DNA, 140 bp, Artificial Sequence
  Synthetic
atggccgactcccaagtacgtcatacttgctgcgctccctgaggttcttgtgacataggagccgcaataatgccaggtcctgtagggattgtcattgtcatggaaccaggtggctgcgtaggagacccagcatggcgtat

SEQ ID NO: 452223 - DNA, 140 bp, Artificial Sequence
  Synthetic
atacgccatgctgggtctcctcaatggagtgatcaagattctgacatatccctgggataggatagaggaggtcactagaatggcaatgacagacacaactccttttggacaacaaagagtcgtacttgggagtcggccat

SEQ ID NO: 452224 - DNA, 140 bp, Artificial Sequence
  Synthetic
atggccgactcccaagtacgactctttgttgtccaaaaggagttgtgtctgtcattgccattctagtgacctcctctatcctatcccagggatatgtcagaatcttgatcactccattgaggagacccagcatggcgtat

SEQ ID NO: 452225 - DNA, 140 bp, Artificial Sequence
  Synthetic
atacgccatgctgggtctccgtttaaggaaaaagttgataccagagcaaaggatccaccagtagggaccaggaaaattatgaaggttgttaataggtggctattccgtcacctggctaggcgtacttgggagtcggccat

SEQ ID NO: 452226 - DNA, 140 bp, Artificial Sequence
  Synthetic
atggccgactcccaagtacgcctagccaggtgacggaatagccacctattaacaaccttcataattttcctggtccctactggtggatcctttgctctggtatcaactttttccttaaacggagacccagcatggcgtat

SEQ ID NO: 452227 - DNA, 140 bp, Artificial Sequence
  Synthetic
atacgccatgctgggtctccgaacggcggttacatcagcagggtaggtgtcggacctgtgtgtacaacatgatggggaaaagagagaaaaaactgtcagagttcgggaaggcgaaaggaacgtacttgggagtcggccat

SEQ ID NO: 452228 - DNA, 140 bp, Artificial Sequence
  Synthetic
atggccgactcccaagtacgttcctttcgccttcccgaactctgacagttttttctctcttttccccatcatgttgtacacacaggtccgacacctaccctgctgatgtaaccgccgttcggagacccagcatggcgtat

SEQ ID NO: 452229 - DNA, 140 bp, Artificial Sequence
  Synthetic
atacgccatgctgggtctccgtcgcgccatctggtacatgtggttgggagcccgatatcttgagtttgaagccctgggattcttaaatgaggaccactgggcatccagggagaattcaggcgtacttgggagtcggccat

SEQ ID NO: 452230 - DNA, 140 bp, Artificial Sequence
  Synthetic
atggccgactcccaagtacgcctgaattctccctggatgcccagtggtcctcatttaagaatcccagggcttcaaactcaagatatcgggctcccaaccacatgtaccagatggcgcgacggagacccagcatggcgtat

SEQ ID NO: 452231 - DNA, 140 bp, Artificial Sequence
  Synthetic
atacgccatgctgggtctccgggaggagttgaaggtatcggtctgcaacacctaggctacgtgatcagagacctggctgcactagaaggtggtggattctatgcagatgacacagctggacgtacttgggagtcggccat

SEQ ID NO: 452232 - DNA, 140 bp, Artificial Sequence
  Synthetic
atggccgactcccaagtacgtccagctgtgtcatctgcatagaatccaccaccttctagtgcagccaggtctctgatcacgtagcctaggtgttgcagaccgataccttcaactcctcccggagacccagcatggcgtat

SEQ ID NO: 452233 - DNA, 140 bp, Artificial Sequence
  Synthetic
atacgccatgctgggtctcctgggacacacgcatcacagaggcggatctggatgatgaacaggagatcctgaactacatgagtccacaccataggaagctggcattggcagtaatggaaacgtacttgggagtcggccat

SEQ ID NO: 452234 - DNA, 140 bp, Artificial Sequence
  Synthetic
atggccgactcccaagtacgtttccattactgccaatgccagcttcctatggtgtggactcatgtagttcaggatctcctgttcatcatccagatccgcctctgtgatgcgtgtgtcccaggagacccagcatggcgtat

SEQ ID NO: 452235 - DNA, 140 bp, Artificial Sequence
  Synthetic
atacgccatgctgggtctcctgacatacaaaaacaaggtggtgaaggtcctaagaccagcaccaggtgggaaagcatacatggatatcataagccggcgggaccagaggggatctgggcacgtacttgggagtcggccat

SEQ ID NO: 452236 - DNA, 140 bp, Artificial Sequence
  Synthetic
atggccgactcccaagtacgtgcccagatcccctctggtcccgccggcttatgatatccatgtatgctttcccacctggtgctggtcttaggaccttcaccaccttgtttttgtatgtcaggagacccagcatggcgtat

SEQ ID NO: 452237 - DNA, 140 bp, Artificial Sequence
  Synthetic
atacgccatgctgggtctccggtagtgacttatgctttgaacaccatcaccaacctgaaggttcaattgatcaggatggcagaagcagagatggtggtgcaccaccagcatgtccaggaccgtacttgggagtcggccat

SEQ ID NO: 452238 - DNA, 140 bp, Artificial Sequence
  Synthetic
atggccgactcccaagtacggtcctggacatgctggtggtgcaccaccatctctgcttctgccatcctgatcaattgaaccttcaggttggtgatggtgttcaaagcataagtcactaccggagacccagcatggcgtat

SEQ ID NO: 452239 - DNA, 140 bp, Artificial Sequence
  Synthetic
atacgccatgctgggtctcctgtgacgatgcggttctgacaaaactcgaggcatggctcgctgagcatggttgtgataggttgaagaggatggcagtgagtggagatgactgtgtcgtcccgtacttgggagtcggccat

SEQ ID NO: 452240 - DNA, 140 bp, Artificial Sequence
  Synthetic
atggccgactcccaagtacgggacgacacagtcatctccactcactgccatcctcttcaacctatcacaaccatgctcagcgagccatgcctcgagttttgtcagaaccgcatcgtcacaggagacccagcatggcgtat

SEQ ID NO: 452241 - DNA, 140 bp, Artificial Sequence
  Synthetic
atacgccatgctgggtctccggcatgcctaagcaaagcttacgccaacatgtggtcattgatgtactttcacaagagggatatgaggctgctgtcactggctgtttcttctgctgttccccgtacttgggagtcggccat

SEQ ID NO: 452242 - DNA, 140 bp, Artificial Sequence
  Synthetic
atggccgactcccaagtacggggaacagcagaagaaacagccagtgacagcagcctcatatccctcttgtgaaagtacatcaatgaccacatgttggcgtaagctttgcttaggcatgccggagacccagcatggcgtat

SEQ ID NO: 452243 - DNA, 140 bp, Artificial Sequence
  Synthetic
atacgccatgctgggtctccacatcgtgggttccacaggggcgtaccacgtggtctgttcatgggaaaggagagtggatgactacagaagacatgcttgaggtgtggaacagagtgtggacgtacttgggagtcggccat

SEQ ID NO: 452244 - DNA, 140 bp, Artificial Sequence
  Synthetic
atggccgactcccaagtacgtccacactctgttccacacctcaagcatgtcttctgtagtcatccactctcctttcccatgaacagaccacgtggtacgcccctgtggaacccacgatgtggagacccagcatggcgtat

SEQ ID NO: 452245 - DNA, 140 bp, Artificial Sequence
  Synthetic
atacgccatgctgggtctcctagtcaacaacccacacatgcaggacaaaacgacggtgaaggagtggcgagacatcccttacctgaccaagaggcaggacaagctttgtggatcactgatcgtacttgggagtcggccat

SEQ ID NO: 452246 - DNA, 140 bp, Artificial Sequence
  Synthetic
atggccgactcccaagtacgatcagtgatccacaaagcttgtcctgcctcttggtcaggtaagggatgtctcgccactccttcaccgtcgttttgtcctgcatgtgtgggttgttgactaggagacccagcatggcgtat

SEQ ID NO: 452247 - DNA, 140 bp, Artificial Sequence
  Synthetic
atacgccatgctgggtctcctggaatgaccaacagagccacttgggcatctcacatccacttggtcatacaccgcatccggacactgattgggaaagagaaatacactgactatctaacacgtacttgggagtcggccat

SEQ ID NO: 452248 - DNA, 140 bp, Artificial Sequence
  Synthetic
atggccgactcccaagtacgtgttagatagtcagtgtatttctctttcccaatcagtgtccggatgcggtgtatgaccaagtggatgtgagatgcccaagtggctctgttggtcattccaggagacccagcatggcgtat

SEQ ID NO: 452249 - DNA, 140 bp, Artificial Sequence
  Synthetic
atacgccatgctgggtctccgtcatggacagatattctgtggatgctgacctgcagcccggcgagctcatttgagacgccattttgcagggataaccatgaatatgacactgtatatagacgtacttgggagtcggccat

SEQ ID NO: 452250 - DNA, 140 bp, Artificial Sequence
  Synthetic
atggccgactcccaagtacgtctatatacagtgtcatattcatggttatccctgcaaaatggcgtctcaaatgagctcgccgggctgcaggtcagcatccacagaatatctgtccatgacggagacccagcatggcgtat

SEQ ID NO: 452251 - DNA, 140 bp, Artificial Sequence
  Synthetic
atacgccatgctgggtctccatgggactgaaaccgggataaaaactacggatggagaaccggactccacacattaaacagaagaggatgtcagcccagaaccccatgtgggttctgccaccgtacttgggagtcggccat

SEQ ID NO: 452252 - DNA, 140 bp, Artificial Sequence
  Synthetic
atggccgactcccaagtacggtggcagaacccacatggggttctgggctgacatcctcttctgtttaatgtgtggagtccggttctccatccgtagtttttatcccggtttcagtcccatggagacccagcatggcgtat

SEQ ID NO: 452253 - DNA, 140 bp, Artificial Sequence
  Synthetic
aggccctggctgctgatatgcattaaacagaagaggatgtcagcccagaaccccatgtgggttctgccactgctaagctgtgaggcagtgcaggctgggacagccgctttccgggttgcggaccttttgggacagcggtg

SEQ ID NO: 452254 - DNA, 140 bp, Artificial Sequence
  Synthetic
caccgctgtcccaaaaggtccgcaacccggaaagcggctgtcccagcctgcactgcctcacagcttagcagtggcagaacccacatggggttctgggctgacatcctcttctgtttaatgcatatcagcagccagggcct

SEQ ID NO: 452255 - DNA, 140 bp, Artificial Sequence
  Synthetic
aggccctggctgctgatatgtggtttctgagacttcccacctcagagtaaaaccaaacggagcctccgctaccaccctcccacgtggtggtagaaagacggggtctagaggttagaggaggaccttttgggacagcggtg

SEQ ID NO: 452256 - DNA, 140 bp, Artificial Sequence
  Synthetic
caccgctgtcccaaaaggtcctcctctaacctctagaccccgtctttctaccaccacgtgggagggtggtagcggaggctccgtttggttttactctgaggtgggaagtctcagaaaccacatatcagcagccagggcct

SEQ ID NO: 452257 - DNA, 140 bp, Artificial Sequence
  Synthetic
aggccctggctgctgatatggtgtgctaattgaggtgcattggtctgcaaatcgagttgctaggcaataaacacatttggattaattttaatcgttcgttgagcgattagcagagaactggaccttttgggacagcggtg

SEQ ID NO: 452258 - DNA, 140 bp, Artificial Sequence
  Synthetic
caccgctgtcccaaaaggtccagttctctgctaatcgctcaacgaacgattaaaattaatccaaatgtgtttattgcctagcaactcgatttgcagaccaatgcacctcaattagcacaccatatcagcagccagggcct

SEQ ID NO: 452259 - DNA, 140 bp, Artificial Sequence
  Synthetic
aggccctggctgctgatatgcaggcaactgcacaacaaacattttggaagccaagtactggtgcccagactcaatggaatacaactgtcccaatctcagtccaagagaggagccagatgagaccttttgggacagcggtg

SEQ ID NO: 452260 - DNA, 140 bp, Artificial Sequence
  Synthetic
caccgctgtcccaaaaggtctcatctggctcctctcttggactgagattgggacagttgtattccattgagtctgggcaccagtacttggcttccaaaatgtttgttgtgcagttgcctgcatatcagcagccagggcct

SEQ ID NO: 452261 - DNA, 140 bp, Artificial Sequence
  Synthetic
aggccctggctgctgatatgcctgggaaaccaggaaggctccttgaaaacagctcttaccggcgcaatgagggttacaaaggacacaaatgacaacaacctttacaaactacatggtggagaccttttgggacagcggtg

SEQ ID NO: 452262 - DNA, 140 bp, Artificial Sequence
  Synthetic
caccgctgtcccaaaaggtctccaccatgtagtttgtaaaggttgttgtcatttgtgtcctttgtaaccctcattgcgccggtaagagctgttttcaaggagccttcctggtttcccaggcatatcagcagccagggcct

SEQ ID NO: 452263 - DNA, 140 bp, Artificial Sequence
  Synthetic
aggccctggctgctgatatgattttccagaattcgggatggtctgcagtatggttggaagacttggggtaagaaccttgtgttctccccagggaggaagaatggaagcttcatcatagatgaccttttgggacagcggtg

SEQ ID NO: 452264 - DNA, 140 bp, Artificial Sequence
  Synthetic
caccgctgtcccaaaaggtcatctatgatgaagcttccattcttcctccctggggagaacacaaggttcttaccccaagtcttccaaccatactgcagaccatcccgaattctggaaaatcatatcagcagccagggcct

SEQ ID NO: 452265 - DNA, 140 bp, Artificial Sequence
  Synthetic
aggccctggctgctgatatgcttccttggtccgattgcagttggaggaatcctgatgatgctggttagcgtggctgggagggtggatgggctagagctcaagaagcttggtgaagtttcagaccttttgggacagcggtg

SEQ ID NO: 452266 - DNA, 140 bp, Artificial Sequence
  Synthetic
caccgctgtcccaaaaggtctgaaacttcaccaagcttcttgagctctagcccatccaccctcccagccacgctaaccagcatcatcaggattcctccaactgcaatcggaccaaggaagcatatcagcagccagggcct

SEQ ID NO: 452267 - DNA, 140 bp, Artificial Sequence
  Synthetic
aggccctggctgctgatatgccatttgctcttctgctggtccttgctgggtggctgtttcatgtcaggggagctaggagaagtggggatgtcttgtgggatattcccactcctaagatcagaccttttgggacagcggtg

SEQ ID NO: 452268 - DNA, 140 bp, Artificial Sequence
  Synthetic
caccgctgtcccaaaaggtctgatcttaggagtgggaatatcccacaagacatccccacttctcctagctcccctgacatgaaacagccacccagcaaggaccagcagaagagcaaatggcatatcagcagccagggcct

SEQ ID NO: 452269 - DNA, 140 bp, Artificial Sequence
  Synthetic
atacgccatgctgggtctccgcaagaagttgattccatcttgggcttcagtaaaggaagaccttgtcgcctatggtggctcatggaagttggaaggcagatgggatggagaggaagaggtcgtacttgggagtcggccat

SEQ ID NO: 452270 - DNA, 140 bp, Artificial Sequence
  Synthetic
atggccgactcccaagtacgacctcttcctctccatcccatctgccttccaacttccatgagccaccataggcgacaaggtcttcctttactgaagcccaagatggaatcaacttcttgcggagacccagcatggcgtat

SEQ ID NO: 452271 - DNA, 140 bp, Artificial Sequence
  Synthetic
aggccctggctgctgatatgagaggtgattgggctgtacggcaatggcatccttgtcggtgacaactccttcgtgtccgccatatcccagactgaggtgaaggaagaaggaaaggaggaggaccttttgggacagcggtg

SEQ ID NO: 452272 - DNA, 140 bp, Artificial Sequence
  Synthetic
caccgctgtcccaaaaggtcctcctcctttccttcttccttcacctcagtctgggatatggcggacacgaaggagttgtcaccgacaaggatgccattgccgtacagcccaatcacctctcatatcagcagccagggcct

SEQ ID NO: 452273 - DNA, 140 bp, Artificial Sequence
  Synthetic
aggccctggctgctgatatgctccaagagatcccgacaatgctaaagaaaggaatgacaactatccttgattttcatcctggagctgggaagacaagacgttttctcccacagatcttgggaccttttgggacagcggtg

SEQ ID NO: 452274 - DNA, 140 bp, Artificial Sequence
  Synthetic
caccgctgtcccaaaaggtcccaagatctgtgggagaaaacgtcttgtcttcccagctccaggatgaaaatcaaggatagttgtcattcctttctttagcattgtcgggatctcttggagcatatcagcagccagggcct

SEQ ID NO: 452275 - DNA, 140 bp, Artificial Sequence
  Synthetic
aggccctggctgctgatatgccatgtgccatgccaccctaacttacaggatgttggaaccaactagggttgttaactgggaagtgatcatcatggatgaagcccattttttggatccagcgaccttttgggacagcggtg

SEQ ID NO: 452276 - DNA, 140 bp, Artificial Sequence
  Synthetic
caccgctgtcccaaaaggtcgctggatccaaaaaatgggcttcatccatgatgatcacttcccagttaacaaccctagttggttccaacatcctgtaagttagggtggcatggcacatggcatatcagcagccagggcct

SEQ ID NO: 452277 - DNA, 140 bp, Artificial Sequence
  Synthetic
atacgccatgctgggtctccgttaactgggaagtgatcatcatggatgaagcccattttttggatccagctagcatagccgccagaggttgggcagcgcacagagctagggcaaatgaaacgtacttgggagtcggccat

SEQ ID NO: 452278 - DNA, 140 bp, Artificial Sequence
  Synthetic
atggccgactcccaagtacgtttcatttgccctagctctgtgcgctgcccaacctctggcggctatgctagctggatccaaaaaatgggcttcatccatgatgatcacttcccagttaacggagacccagcatggcgtat

SEQ ID NO: 452279 - DNA, 140 bp, Artificial Sequence
  Synthetic
atacgccatgctgggtctccacatagctgaaatgggagccaacctttgcgtggagcgagtgctggattgcaggacggcttttaagcctgtgcttgtggatgaagggaggaaggtggcaatcgtacttgggagtcggccat

SEQ ID NO: 452280 - DNA, 140 bp, Artificial Sequence
  Synthetic
atggccgactcccaagtacgattgccaccttcctcccttcatccacaagcacaggcttaaaagccgtcctgcaatccagcactcgctccacgcaaaggttggctcccatttcagctatgtggagacccagcatggcgtat

SEQ ID NO: 452281 - DNA, 140 bp, Artificial Sequence
  Synthetic
aggccctggctgctgatatgcctacaagtgaagataatgcccaccacgtctgctggttggaggcctcaatgctcttggacaacatggaggtgaggggtggaatggtcgccccactctatggaccttttgggacagcggtg

SEQ ID NO: 452282 - DNA, 140 bp, Artificial Sequence
  Synthetic
caccgctgtcccaaaaggtccatagagtggggcgaccattccacccctcacctccatgttgtccaagagcattgaggcctccaaccagcagacgtggtgggcattatcttcacttgtaggcatatcagcagccagggcct

SEQ ID NO: 452283 - DNA, 140 bp, Artificial Sequence
  Synthetic
aggccctggctgctgatatgacaaaggtccatccaagacaaccaagtggcatacctcattattggcatcctgacgctggtttcagtggtggcagccaacgagctaggcatgctggagaaagaccttttgggacagcggtg

SEQ ID NO: 452284 - DNA, 140 bp, Artificial Sequence
  Synthetic
caccgctgtcccaaaaggtctttctccagcatgcctagctcgttggctgccaccactgaaaccagcgtcaggatgccaataatgaggtatgccacttggttgtcttggatggacctttgtcatatcagcagccagggcct

SEQ ID NO: 452285 - DNA, 140 bp, Artificial Sequence
  Synthetic
aggccctggctgctgatatgagtcctttctttcatggacaaggggataccattcatgaagatgaatatctcggtcataatactgctggtcagtggctggaattcaataacagtgatgcctgaccttttgggacagcggtg

SEQ ID NO: 452286 - DNA, 140 bp, Artificial Sequence
  Synthetic
caccgctgtcccaaaaggtcaggcatcactgttattgaattccagccactgaccagcagtattatgaccgagatattcatcttcatgaatggtatccccttgtccatgaaagaaaggactcatatcagcagccagggcct

SEQ ID NO: 452287 - DNA, 140 bp, Artificial Sequence
  Synthetic
aggccctggctgctgatatgggccatgagaaacccatgaatgtgcaaagtctgggatggaacatcattaccttcaaggacaaaactgatatccaccgcctagaaccagtgaaatgtgacagaccttttgggacagcggtg

SEQ ID NO: 452288 - DNA, 140 bp, Artificial Sequence
  Synthetic
caccgctgtcccaaaaggtctgtcacatttcactggttctaggcggtggatatcagttttgtccttgaaggtaatgatgttccatcccagactttgcacattcatgggtttctcatggcccatatcagcagccagggcct

SEQ ID NO: 452289 - DNA, 140 bp, Artificial Sequence
  Synthetic
atacgccatgctgggtctcccttcaaggacaaaactgatatccaccgcctagaaccagtgaaatgtgacacccttttgtgtgacattggagagtcatcatcgtcatcggtcacagaggggcgtacttgggagtcggccat

SEQ ID NO: 452290 - DNA, 140 bp, Artificial Sequence
  Synthetic
atggccgactcccaagtacgcccctctgtgaccgatgacgatgatgactctccaatgtcacacaaaagggtgtcacatttcactggttctaggcggtggatatcagttttgtccttgaagggagacccagcatggcgtat

SEQ ID NO: 452291 - DNA, 140 bp, Artificial Sequence
  Synthetic
atacgccatgctgggtctccggagaatgaggcgtccaactggaaaagtgaccctggaggctgacgtcatcctcccaattgggacacgcagtgttgagacagacaagggacccctggacaacgtacttgggagtcggccat

SEQ ID NO: 452292 - DNA, 140 bp, Artificial Sequence
  Synthetic
atggccgactcccaagtacgttgtccaggggtcccttgtctgtctcaacactgcgtgtcccaattgggaggatgacgtcagcctccagggtcacttttccagttggacgcctcattctccggagacccagcatggcgtat

SEQ ID NO: 452293 - DNA, 140 bp, Artificial Sequence
  Synthetic
atacgccatgctgggtctccagaggccatagaagaaagggttgagaggataaaatctgagtacatgacctcttggttttatgacaatgacaacccctacaggacctggcactactgtggccgtacttgggagtcggccat

SEQ ID NO: 452294 - DNA, 140 bp, Artificial Sequence
  Synthetic
atggccgactcccaagtacggccacagtagtgccaggtcctgtaggggttgtcattgtcataaaaccaagaggtcatgtactcagattttatcctctcaaccctttcttctatggcctctggagacccagcatggcgtat

SEQ ID NO: 452295 - DNA, 140 bp, Artificial Sequence
  Synthetic
atacgccatgctgggtctcctgcaccaacaaggcaggtgtcggacttgtgtgtacaacatgatggggaaaagagagaagaagctgtcagagtttgggaaagcaaagggaagccgtgccatcgtacttgggagtcggccat

SEQ ID NO: 452296 - DNA, 140 bp, Artificial Sequence
  Synthetic
atggccgactcccaagtacgatggcacggcttccctttgctttcccaaactctgacagcttcttctctcttttccccatcatgttgtacacacaagtccgacacctgccttgttggtgcaggagacccagcatggcgtat

SEQ ID NO: 452297 - DNA, 140 bp, Artificial Sequence
  Synthetic
aggccctggctgctgatatggtgggaccatattgacgccagggaaagaccggagtggttctctgcttttcctccaggggtctgtgagcacagtttgctcaagaataagcagacctttggagaccttttgggacagcggtg

SEQ ID NO: 452298 - DNA, 140 bp, Artificial Sequence
  Synthetic
caccgctgtcccaaaaggtctccaaaggtctgcttattcttgagcaaactgtgctcacagacccctggaggaaaagcagagaaccactccggtctttccctggcgtcaatatggtcccaccatatcagcagccagggcct

SEQ ID NO: 452299 - DNA, 140 bp, Artificial Sequence
  Synthetic
aggccctggctgctgatatggtgctaattgaggtgcattggtctgcaaatcgagttgctaggcaataaacacatttggattaattttaatcgttcgttgagcgattagcagagaactgacgaccttttgggacagcggtg

SEQ ID NO: 452300 - DNA, 140 bp, Artificial Sequence
  Synthetic
caccgctgtcccaaaaggtcgtcagttctctgctaatcgctcaacgaacgattaaaattaatccaaatgtgtttattgcctagcaactcgatttgcagaccaatgcacctcaattagcaccatatcagcagccagggcct

SEQ ID NO: 452301 - DNA, 140 bp, Artificial Sequence
  Synthetic
aggccctggctgctgatatgatatttagagactctgatgactggctgaacaagtactcatactatccagaagatcctgtgaagcttgcatcaatagtgaaagcctcttttgaagaagggagaccttttgggacagcggtg

SEQ ID NO: 452302 - DNA, 140 bp, Artificial Sequence
  Synthetic
caccgctgtcccaaaaggtctcccttcttcaaaagaggctttcactattgatgcaagcttcacaggatcttctggatagtatgagtacttgttcagccagtcatcagagtctctaaatatcatatcagcagccagggcct

SEQ ID NO: 452303 - DNA, 140 bp, Artificial Sequence
  Synthetic
aggccctggctgctgatatgggagcctccgctaccaccctcccacgtggtggtagaaagacggggtctagaggttagaggagaccctccagggaacaaatagtgggaccatattgacgccgaccttttgggacagcggtg

SEQ ID NO: 452304 - DNA, 140 bp, Artificial Sequence
  Synthetic
caccgctgtcccaaaaggtcggcgtcaatatggtcccactatttgttccctggagggtctcctctaacctctagaccccgtctttctaccaccacgtgggagggtggtagcggaggctcccatatcagcagccagggcct

SEQ ID NO: 452305 - DNA, 140 bp, Artificial Sequence
  Synthetic
aggccctggctgctgatatgacagatggttgctcctaaatgtgacatctgaggaccttgggaaaacattctccgtgggtgcaggcaactgcactacaaacattttggaagccaagtactggaccttttgggacagcggtg

SEQ ID NO: 452306 - DNA, 140 bp, Artificial Sequence
  Synthetic
caccgctgtcccaaaaggtccagtacttggcttccaaaatgtttgtagtgcagttgcctgcacccacggagaatgttttcccaaggtcctcagatgtcacatttaggagcaaccatctgtcatatcagcagccagggcct

SEQ ID NO: 452307 - DNA, 140 bp, Artificial Sequence
  Synthetic
aggccctggctgctgatatgtggcttgtgaggaaccccttttttgcagtgacggccttgaccattgcctaccttgtgggaagcaacatgacgcaacgagtcgtgattgccctactggtctgaccttttgggacagcggtg

SEQ ID NO: 452308 - DNA, 140 bp, Artificial Sequence
  Synthetic
caccgctgtcccaaaaggtcagaccagtagggcaatcacgactcgttgcgtcatgttgcttcccacaaggtaggcaatggtcaaggccgtcactgcaaaaaaggggttcctcacaagccacatatcagcagccagggcct

SEQ ID NO: 452309 - DNA, 140 bp, Artificial Sequence
  Synthetic
atacgccatgctgggtctccgatttcattgagggggtgcatggaggaacctgggtttcagccaccctggagcaagacaagtgtgtcactgttatggcccctgacaagccttcattggacacgtacttgggagtcggccat

SEQ ID NO: 452310 - DNA, 140 bp, Artificial Sequence
  Synthetic
atggccgactcccaagtacgtgtccaatgaaggcttgtcaggggccataacagtgacacacttgtcttgctccagggtggctgaaacccaggttcctccatgcaccccctcaatgaaatcggagacccagcatggcgtat

SEQ ID NO: 452311 - DNA, 140 bp, Artificial Sequence
  Synthetic
aggccctggctgctgatatgcggatcaaggatgcgccatcaactttggcaagagagagctcaagtgcggagatggtatcttcatatttagagactctgatgattggctaaacaagtactcgaccttttgggacagcggtg

SEQ ID NO: 452312 - DNA, 140 bp, Artificial Sequence
  Synthetic
caccgctgtcccaaaaggtcgagtacttgtttagccaatcatcagagtctctaaatatgaagataccatctccgcacttgagctctctcttgccaaagttgatggcgcatccttgatccgcatatcagcagccagggcct

SEQ ID NO: 452313 - DNA, 140 bp, Artificial Sequence
  Synthetic
aggccctggctgctgatatgctgcatcttgacaataaatgctgttgcttctaggaaagcatcaaacaccatcctgcccctcatggctctgttgacacctgtcactatggctgaggtgagagaccttttgggacagcggtg

SEQ ID NO: 452314 - DNA, 140 bp, Artificial Sequence
  Synthetic
caccgctgtcccaaaaggtctctcacctcagccatagtgacaggtgtcaacagagccatgaggggcaggatggtgtttgatgctttcctagaagcaacagcatttattgtcaagatgcagcatatcagcagccagggcct

SEQ ID NO: 452315 - DNA, 140 bp, Artificial Sequence
  Synthetic
aggccctggctgctgatatggagactgagggatgaccagaggaaagtcttcagagaactagtgaggaattgtgaccagccggtatggctttcgtggcaagtggccaaggctggtttgaaggaccttttgggacagcggtg

SEQ ID NO: 452316 - DNA, 140 bp, Artificial Sequence
  Synthetic
caccgctgtcccaaaaggtccttcaaaccagccttggccacttgccacgaaagccataccggctggtcacaattcctcactagttctctgaagactttcctctggtcatccctcagtctccatatcagcagccagggcct

SEQ ID NO: 452317 - DNA, 140 bp, Artificial Sequence
  Synthetic
aggccctggctgctgatatggctggagaaaaccaaagaggacctctttggaaagaaggacttaattccatctagtgcttcaccctggagttggccggatcttgacttgaagccaggagctgaccttttgggacagcggtg

SEQ ID NO: 452318 - DNA, 140 bp, Artificial Sequence
  Synthetic
caccgctgtcccaaaaggtcagctcctggcttcaagtcaagatccggccaactccagggtgaagcactagatggaattaagtccttctttccaaagaggtcctctttggttttctccagccatatcagcagccagggcct

SEQ ID NO: 452319 - DNA, 140 bp, Artificial Sequence
  Synthetic
aggccctggctgctgatatgcggactccgcacttaaaatgaaacagaaaccgggatataaactacggatggagaaccggactccacacattgaaacagaagaagttgtcagcccagaactgaccttttgggacagcggtg

SEQ ID NO: 452320 - DNA, 140 bp, Artificial Sequence
  Synthetic
caccgctgtcccaaaaggtcagttctgggctgacaacttcttctgtttcaatgtgtggagtccggttctccatccgtagtttatatcccggtttctgtttcattttaagtgcggagtccgcatatcagcagccagggcct

SEQ ID NO: 452321 - DNA, 140 bp, Artificial Sequence
  Synthetic
aggccctggctgctgatatgggtgcaatgagggttacaaaggacacgaatgacaacaacctttacaaactacatggtggacatgtctcttgcagagtgaaattgtcagctttgacactcagaccttttgggacagcggtg

SEQ ID NO: 452322 - DNA, 140 bp, Artificial Sequence
  Synthetic
caccgctgtcccaaaaggtctgagtgtcaaagctgacaatttcactctgcaagagacatgtccaccatgtagtttgtaaaggttgttgtcattcgtgtcctttgtaaccctcattgcacccatatcagcagccagggcct

SEQ ID NO: 452323 - DNA, 140 bp, Artificial Sequence
  Synthetic
  misc_feature (77)..(77): n is a, c, g, or t
  misc_feature (84)..(84): n is a, c, g, or t
  misc_feature (90)..(90): n is a, c, g, or t
aggccctggctgctgatatggagactgagggatgaccagaggaaagtcttcagagaactagtgaggaattgtgaccngcccgtntggctntcgtggcaagtggccaaggctggtttgaaggaccttttgggacagcggtg

SEQ ID NO: 452324 - DNA, 140 bp, Artificial Sequence
  Synthetic
  misc_feature (51)..(51): n is a, c, g, or t
  misc_feature (57)..(57): n is a, c, g, or t
  misc_feature (64)..(64): n is a, c, g, or t
caccgctgtcccaaaaggtccttcaaaccagccttggccacttgccacganagccanacgggcnggtcacaattcctcactagttctctgaagactttcctctggtcatccctcagtctccatatcagcagccagggcct

SEQ ID NO: 452325 - DNA, 140 bp, Artificial Sequence
  Synthetic
aggccctggctgctgatatgtgtgatgaatcagttctgaccaggctggaggcatggctcactgagcacggatgtaacagactgaggaggatggcggtgagtggagacgactgtgtggtccgaccttttgggacagcggtg

SEQ ID NO: 452326 - DNA, 140 bp, Artificial Sequence
  Synthetic
caccgctgtcccaaaaggtcggaccacacagtcgtctccactcaccgccatcctcctcagtctgttacatccgtgctcagtgagccatgcctccagcctggtcagaactgattcatcacacatatcagcagccagggcct

SEQ ID NO: 452327 - DNA, 140 bp, Artificial Sequence
  Synthetic
atacgccatgctgggtctccagcttgcctcagcaaagcctatgccaacatgtggtcactgatgtattttcacaaaagggacatgaggctgctgtcattggctgtttcctcagctgttccccgtacttgggagtcggccat

SEQ ID NO: 452328 - DNA, 140 bp, Artificial Sequence
  Synthetic
atggccgactcccaagtacggggaacagctgaggaaacagccaatgacagcagcctcatgtcccttttgtgaaaatacatcagtgaccacatgttggcataggctttgctgaggcaagctggagacccagcatggcgtat

SEQ ID NO: 452329 - DNA, 140 bp, Artificial Sequence
  Synthetic
atacgccatgctgggtctcctatcgttgggacaggagattcacgtctcacttaccagtggcacaaagagggaagctcaataggaaagttgttcactcagaccatgaaaggcgtggaacgccgtacttgggagtcggccat

SEQ ID NO: 452330 - DNA, 140 bp, Artificial Sequence
  Synthetic
atggccgactcccaagtacggcgttccacgcctttcatggtctgagtgaacaactttcctattgagcttccctctttgtgccactggtaagtgagacgtgaatctcctgtcccaacgataggagacccagcatggcgtat
